United States Patent 9,487,797 (GENOMIC PLANT SEQUENCES AND USES THEREOF) - sequence listing, part 27

SEQ ID NO: 58649 - DNA, 6326 bp, Oryza sativa
  unsure (1)..(6326): unsure at all n locations
gtgagagcatcttgttgattgtggattttatcttagggagtttattattaactttggatgatcagagcttggatctccatattcttattttttatccgtttgtattggattgtacaatgaaatgatggtgatgattcttttttttttttgcatcgatcaactcagctggcatccattgcatctgcagcttctagcttgccatttacaccattgcaagatcttactgtcccacttcatctgttcatcacatcattaggcaaacagtgaagtatttaaagatggccatggaacagatctaccacatgaagtagtagtatttaacagatgcctcatcgtgtcggtgtcctggactgctagtcccagacagaagagattcgatggtccaggcattgataacgtgatcttgaacagtactcttcatattaccttggctgcctggcacaaacaggaagctgctgtccatagggttagctgtgttgccaagcaccatcgggcaaaccatgttggcttccacagaaatctgtcatgttggatggaaaaaaccgtgtcctgatgtccatcaactgtccatgcatgatcacttccatagcaatgcaggcatggctggtacgtgccggcacttcatttttaagacattcacaaattattaatcattgaagccactcaaccttagacctgcaactcgcctccatccaaaaaagagttcactcttgtacacaaatctggacaagtgaatgtacacttcgtaggacagaggtagtatcagatagtgttatgcaagaaacgaatatctggaacaattagattgttgaaataatgcacttcatatctgaataaatgaaccggacggtacaaatgtacaatgacgccaggctccagcagtatatgcaacttctgtttaccagaaggaaaagtaagaaaacatatgctccgcgagttctatacttgttcatggtgtcatagcaacgttccagttgtacacctttacatcgaaggtggcagaattctcgagtgcttgtctgagttctttggcagagttaagattctttccaagcatcaacgcaaagccgcccccaccagctccaacaagcttgtagccgcagcagtaagggtcagcaaatgcaaacaattcgtccacaagcttgttgctgcaaaaaggatctagctcctgatgcagcctccaggcctccgacattatgccaccaagctcgtctatttcaccattcatcagggcttcccttccaattttcgccaactcagcaagcctcttgatgctagatatcaacaggctatcacggcggagatatcgagtgacaactttctgcaggacccggtgggcaagccttacctgtgcagagtatacattcatttggggagaaaattatactcttttgaagcaaaatcaatgtggaaaatggatgggcgtgcacacttggaaggaatcttgtttggacgtacaaatcttagaatcatggtggaacttgaacaggctactgtttgtaaattgaaacttctagccctaatttcagtttatctactatgttatatatgcttacagcagaaaattcatacttacttgaccagtgaacacaaccaggagacgttgttgtaattcttgaatcaactgcggagatgccagcaatggaacaacatgcaaacgcaatggctgtcctggaaaactctgagtgcacttgattccaggatataggccaccaatttgatcttgccatccaccgcctgtgcccattacttgctctactaccagcacagctctagcaacagttgcatcactttcatcaccttctataagttggaatagccccttaactaccgcagctgctaatatgctagaagttcccagaccacttccacgaggaacatttgcccatgtcctaatgttcaaccctaattttgacaatctttcatggtttaggacaccagtcacaataagagcagacttgactaaacggaatgaatcattttctttgaatggtgaagtaatagaagacaggtcatcaatacaaacatttctgccagcatcatcttcaatgagaactccaaggtggtccattgttgtctctatcatagcaccaactggaaggttcccttccaaccgtattgccatattcaaaacacaacctggacgctccaaactccatggaggtgtatcactccaacccccgacaaagtcgacacggaccggtaattccacaatagccttcttaggatgcaggttaccattacttgaacacttggaatcgcttgatggctctacaaaatcatacatatgtgttaactagattgatataaacatcaatattgataatggtaaaatgaaccacatttagctcgttgcctggaagacataactgcattttgagaaaagcgacagaaaaaatagcattaagtttgttggtagtgtacagactgtacctttagatccatattttatagctgatgcagtttcacttgctatggaagcccacactttatcttcaacaatagctgcagtggaaagatctccagaagctgtaagcagatccattttgacctggtatcttctgctctgcggaagaacaccagaatactgatccccatgactgggacaaagcgaaagtaactcattacagacttctacgcatgaattttccttttgtagcatttcctcacatagttgaaacaggttgcgcccaagcaagccataggtcatgcaagctttagcaatgttggttgctagatctgcttgatgcttgcttgaattcacacagagctgatggtagtcaatcgaacgatgcagctcttctaagctgatcctccgtgattctttccacagggaagcgactttgccatccaggtcacatgtcgatcccataagccacatacctactttcagcgtttcaggtagagacatgactggaaaaagctttgcattccataagcagttgtcttcattggttgagctccacagatctgtatcctggattttaagatgttccaagacatttctccatggtttgccacagaatgtcccatctttcttcatagatacttttggattatcatgaaggccacagtaaacnnnnnnnnnnnnnnnnnnnnnnnnnaaagggacttcccagaggcaatgtcgatcaggtaatgtgaagtatgagctagtactgattatctgagacctgttcccatgtaactcatgtatattcaccccaacaacaatacattgtgagccaatcctaattctacctgaaagtgatgaatcatagaccaatgaatcctctccaactgagaccccagcagaaattttactggacaaaatgacagctgttgccgcaatatcacaagcagtagtctctggtatcgaagacatgtgccttcgccctacaagtcctgaatatgagcccgccaagtgatcaagaacttcagcggatgtgccaaaatgtaaaaatgagaaatcatctgaaaagaaaatggtcacaacttagctttgcaaaaggcataatatcacacaaaactaatcagaaatataacatgtgaactgtttgtcaaatacaggagaatttaatgcacagccataccagaaagagaatcagcataatttacttgcaactgctacataatgaattctaaagagaacatacatgaacaaaagctgaacatcctgtgctttcccaaagcagcaattagttccatgccaaatggacgggtccttaaccattcatgcctggaaggcacccatgcagcaacaagatcttcgtataagctcatctgcaatagatcgggtaatatgaacccacgaaatgaaatatattatatcaaatctacagttagataaatgataaacgtaactaatggaagcaatggagcaaaagaaaatgagtttaggacgtcactttgaatttctggtctaacaaaaaaaattccataaagatgagattaatgaggtttggaatattcagagctttatcatgacaaagaaaaaaggttaggaaaatctggtctcaatataaaataaaacataaagcagcctaacaatgccaatgcctctctttaggatggaaaagcagactactgttgcttctagcatatcaaagcaaagagcgaaacagagacagacagcatctaactttcgtaaaattcaggatgatagaatattgtattgtacagctagaagagcatccagcactgcaagaattatagcaaatttatttataactcccaaactgaagtaatgagtgattatgtcttttaagggaagttgctcattagtagaccgatatctccaactactacaaatgcaacacatgcattttcagaataatcacatagccttgattcgatgaagcaagtctgcagtaaatgagagagcctgttgtgaaaaattggacagtgtgttaggaaatatttgctcacctcttttctgccagttatgagctccttgatcatgacatggctagatgaatatgcaagtctaacaagctcctgccatgctttacccctggctgatattatccctgtgtcaagcagtgctctcccgtcatctcgaatagcctggccctccacaagctcgtgcactgtaggcttctggaggagattatcaaccaaacacagggaatagttctccccatcagttccgtcctttgccgctacaactacaccatgattagcagccacatctagagttgttggcacggtgacgatgcaagcagcatcatcaggaagaactaggtttgaagcatcgaagcatgggagaacatccccggtcattatgaagatcccacctgatcatactgtaccaattaaaattgaacatattgctcaaaatcagtggctctgtctataagctacaaccttggtttttgaaagcttgccttgcgctggatgagatcgcgagaatgtggtcgaaaagcagcggaacaggtccatcaggattgtctccggccaagtaaggcagaggcaggaaggccttccccatggggttcgcccatggaaccctcttgctatcacccccagcgtgaagcagcagtacgtgtttgttcgccatgaatcgtaccaccgagctgagtgggatgtcatctgctgaagaatcacttgcttcgggcagcaattcggcgatctcttccttggaagcctgcagattcagatgatgttaaacaggggaggggatcgattctgtagtagtagtacatagggcagaagtggctggacctgggcgatgagatggcggacgagggaggcgacggcgtggagagtggcggcgccggagccgatgcgcgcggcgtcggggtcggggacggcgagggcggcggtggaggccgggaagcggccgaggcggcgggcgcgcgcaagctggcggtcgtagagcgcggcctgctcggggctggccgcggtgaggacgacggcgtcccacggcggcacccgcgacggatcccgcgccgatagccgcagccggcaccacgccttccgcagcaccgccgccgcctcgtccgccgtgtgcgccctccgccgccgccgccggtgacgctcggccggctccatcgatcgagcgacttttgctcctcgactcttatctagatcggagaatttggccgttgaaagaaagaaagaaatatctcgtctagacaccgacgcgactccactccactgatccactctactgccttgcttagccctcgacgacttggccagtcttctcttcccgctgctaccgatggcgatagcgttcttcagactcgtgcgttgcgttcagacttcagttcatgtactccctccatgtactccaatttgatctttcgtcttatttgataaattttttaaaaaaattaaaaacataagtcacgcataaagtattattcatgttttatcattttataacaataaaaatactaattacaacaaatttcaaataagacagacgactaaagttcagcgcggaaactcatgtttgcatttaaaatggaacggagagagtaactgctatgaacgactgtaatccaagtaaaatctcaagtaaaaaccacagataaatgaacaggaaacactgatggcaactcatctaaactttcaagatctgaaacgatatgatatttatgaaaactttgtatatgtaaatttatttgttttttcagttttgtgatagttgattcaatcacctgtaccctcgaataattatcacaaatccgttcatcagtcagcacaaaataatttacacccatcaaacatatatgcagcagcacgtccatagatttccggaaacaggggggcaacagacagaactaaacacaatgcatatgtattgttacaaaactctcagcattttaagtttgttcatt

SEQ ID NO: 58650 - DNA, 1108 bp, Oryza sativa
cctactccactcacttaatttattccaattgtttcactaattgcaaaatttaactattttcttctatgatatatcgtgaagtgtcacaagcaacctagaggcactgtcctttgcgggtattacgcgtgcgaattcctcagtgttaatgggaggtacagagttaacacaaaggatgtaagtctctagactatggactagacagcttcacatatttatgatactaacatattgtttatcttccatgcatgcagttgccaagaatagaacttcgaacaagctttgacgatacaggcatcacaaatgttcagcgcgatctatgccacttcatccaccgtgagtgctgtcatatgcgaggagaattcttcgacccaaagggtgccctaactacaagtgacgaattcaagcaacttcgggagtggaacaatgctatgccataatgtaactagatggtgtatttgaagtgacaatgtaaaaaaatattgtaatatatatattttgataacacttttcacttatgcaatatatgtagttttctcagtactaaatgcttgataattactaataatcttcctgcatcaatttctattaaataactaaaaagtaatatttgggcaaattattattgtatcaaatttcaaaattttctacctatcttcgcaggcggatgtttttattttttgcaggcagccacttcctatttccgcaggtggacctgactagctttttatccacctgcgaaaattgtcttcacaggcggacggctgccccgcctgcgaagatcggtgatcttcatagtcgtttgcttacaggcaaatggctgccccgcctgcgaagaccggtttccatcaccgatgataatgctttttctagtagtgaagataagtattgttatcacggagtggttaggtggacttgcttgtcgtgataaacacacggggtatcatatcttgcatgatatatatatcctagcgagtggtcatcactgtacacaatgagaaaatactgcagcaacatttgaagaacctaacatatatagtctagaatatttcagtaggaaatggaggcactaggtagtaattcacatcagaatcaaatatatttcggcttg

SEQ ID NO: 58651 - DNA, 20889 bp, Oryza sativa
ctaacctagcagaaacagcccttagcttagaatagactttgcctgcaggagaacctaagataagactacagagtgaatcccgagcaaccttgatgttaacaaaggatccaagtatatggatcttcgtatcagcgataactatgcgagtcctcgtagaattctcgatggcatatttggtcttgcctccttttcctgacaagcggccaatagcacgtgacagatgctctcctcggagtgtcttcacgtccttgatctcaaaggaatccacatacaggtcatcgagacggagcagcgcaacagcatcggcgatgtcaaaaccaagcataaaagcatgtacgaagtctgcacacttctgaaggttgctcacgtcaggtgtgtcttgtcttgttttcagctccacccttcttgcctgagataatggaaacatattatatggtctgtttgatggtaggcagcttaagcattcaaaaatacaactgtaggattatggcattttttcacaagcactgataatacttcttgccaaatggtttaaggtcagtgagcaaacagttactactcactagacaaggacaaactaatggagtgacttacaaatgacggctgagtgtttgcagacacaaagctatgatgaatttgtgattagtagtgtctcaggtaaaagttgcaagttgtgagctttcaccacatcaaatatctatgtttttcgtactgaattgaaaaggttagacagctcaactgtcgtgctgatcatgggcaagaaattagcacagaggattttaaaaacagtgtcttcttacggtataattcaatggacattatactccatttactcatagcaccatattgaattctactcccatttggagtagaattctagcacaacgcatgtactaattatgtacagcttgcaacaatgttacaaggataacagaatcacttatcctaagggcctgtttggcacagctccagctccagctccacccctcctggagctggagctcagccaaacagtttcagctctaccaaaactggaagtggagctgggtggagctctctcacaaaatgaaagagttgtgggctgcagctccacaactccactccagactcaactcctggagttaaatttaggagttggagctgtaccaaacaggccctaagtaaaatgccaaaatatagttttgacactgcagcatcatgccgaaaagcaacacggacatgtctcaccattcaggatttgcaaccacatactactcaaaagactgagatatatccataaggcgattagctacacaaaggatttagatatatccatgaggcaatttgcgactatcaacggaatcagaagtgtacatccaggagagaaattggaggctaccttaaggttcatgcggatgtcgatcttcatgtgctcgtagacgggggtgtagatatccatccacgccttcttgagcggcgcgaagcggtgctgcggcaccggcaccttcctgaactgtggcctcccgccgctcatctcgctcggcatcagcgcctcgaaccgcggcttctccacgccgccagccgcgtccaccgccatcgcgccggaggacgaggaggattctccctgcccggcagcgctcgccggcctgccagcctccatcctgctgcccgttggctgtggcggtggcggcaatggaagccggcggcggagggtgtcggctctcgtcttctcctaggctagggtttgggaatcggggaagagaggaggctggagaaggccaacctggtttataaaccgaaactattgggccgaaaaaatgatagcatgggccgtccgaattctgtactactccgtaatgggctacttcaagtaaactccagttgtctaatgggccgccttaaacatggagatttttttagaactgggagatttttctgttgcatatatctccctgatcaagattaacaagtttatttatgagtgccatatagagctaaaaagattaataagctataagtaatacagttctgaaagcacgaaatactgcatagtatagagttgtagttcagtcatcaaggtttaagatcgaatcattttcttactgttggtgctttaatgcaaagacaatgaattcatggaattttcacacccacaacaattgttcagtgacaaatccgagtcaagatcctcgatgtctgtgttgacgtttactccgtccgtcttaaaataaaccaacctaagataagttgagatattacttagtacaataaatctgaacaaaacggagagagtaggttccagtcaggtgaaacaaatcttgccagctgctgccccatgctttactcatggacttgagtgcggcgtccatgctgccttcctgtctcgttgtcccctatccgattatctccaactcaaagctgttacaagtaagaatacagaacatgtgtatagcagtagcaagcagggtgtcatgtccgatcatctgtgtcactgtgtgagcaggcgttgctgaatattgtgaaacagtttttatcatcaggcataaattttgattgctggtaaggactatgtgttttgtttctaaatgataaggaataggtgccacgccttggtgatgaaagaatgcattcaaacatactgggatcacgcttcaacgcaccttataaacaattgcagatggatgatggatcaactgcccacaaaactagctgcgagagcagatttaagaatttatctgcataagaattgtattatgatattagatgatttgatggcactgcatagttagctgaagagtgtaagatataattcgatttgtaaactaacttattgtacaaagttgaatgattgttcatctgttccaaggaattgattattgctagaacatacaaagagctagaattgaagtgccattgtttcagttcagtttccaagccgttgacaaataccaaaataaaaattagaaaagaagtatgagctgtttacctttgccaatagcattcagctaggagtgagtactcaaagaagcactcgactaggagtatgtgattgcccttgcccggccaacctttgtgttgatggtaattcattcacactaggagtatgtgattgcccttgcccggccaacctttgtgttgatggtaattcattcactcatcatagtcaagctctgttatgtttccctggcattccccttggtccatcattattttgaaccaccccaagaaaaatggaaaaagggcattattttttatcaacctctgaaactgattcctgattcagaaacaaggtaaccagtgaataccatcaatcagcttggataattaatgcatacattggttaatatgaaatacaagcttgctgtaacagtggaagacacttaccagcagcttgccatcaaccatgcccacttccatctttaacaaattagcagcttcatccatcccatgtacattgtatgcctggatcatggtggtgtaagttactttatcgggcttacatttcttttccttcataagctgcagcatttcctccataattttgatatccccagacttggcatatgcatcgatcacacaattaaaaaatggagtatctaaaaccacatcagtattctctgtttgtcgaatgatcccaggaaccttgtcgagaaacccagctttgctgtacccattgaccagtgagcagtaagtgatggggttgggtttaacaccctgaattttcatcaatcggaaatagtactccatcttctcgatgtttcccgcccgtccaaaactttctattattatgttgaaggtaacaacagttggtgagaagaagtgtttcttcatatatttcagcaccgacatcattttgtcatgcatcttagcattaccatatgatttgatcatgatattaaatgtttgcgtatctggctcaacacccatcaactgaaactcactgtaccacctctccatttcatgtatcctgttaccatgattcccataagcccaaatgatagaattcatcgtgtatatgtccggcacactgtccccatcttcaagcatactagtcagtgcattctccatctcctccaacatgccggctttcccgtacccatcaattatcgcattatggataacagcattgcattgtagccccaagtaggacatctcatcaagaatcgcaggtatccgatcaaagcggcgcaatttgctacagcaattgatgagaacagagaatgtgtactcatctggcttgcaatccgcgacacctttcatctgttcgacggtggccaacgcctggtccagcagcccactgtagccgtacgcgccgacgagggccgtgtagacatccaccgtcggcttgagacgctccgagagcatcaccttgaagagggcagtggccgcgccgggctgctggcacttgccgagcatcatcagcaacctggcgtaggtctgcgacctcggcttgtaccattgctgcttacgcaacagctcgaagatctaaaccccaatcaagcgagcacagcacaatgagcatcagaatcaagctgattcctcaaggggattgggggttacctcgagagcgggctcccagcggcatgaggcgacggcggagtcgagggcctcgagcacggcgcggggccagaggcgggtggaatgctgccgcgacgccgccgccgccttgcgggagacgccggagacggcggcctcggtgcggaggatgcgggagagcgcctccggctgctcggcctcgggggcagacgacggcggcttgtgcctccggccgccgcgggccatcacgacgtgggtcgcacggctgctggcgcggggaggtggtgacgaggtggccggtgggcaccccgccggcgccggcgacggcgagtgcatggcgccggcagccggagtgaggccgagacggcgataaggtcccgagcgatcagatgacaagtccgagtgaggctgcacgaatcttaaccatccaacagttgggccgtcaagggagagggagctccgtgtggcccacactattgggccggaacgggaatgcgagcttcgtgcgacccattatagttgggccggaacggcccatactacagtcggcttgctgaaattgctgggtccaaattaagccactgttttgcctatttttgcaggagatatgagaagagagttgaggaagaagatgagacgagagaaagtcattgagatgttgggttccacgtgctgatgtggtggacctgtcacgttagcaaaaaaccgtttttaaaaccatagaagcagttgatttgcctcggttttcaaacatagggaagatgttaaacctggtttgtggttcaggtggttttgcggtcgaggaagatgattcaataaatggaggcaaaataaacttactctattcacaaacaaactgctccctgctaaagtacagagggagcagagcagatcaggacgagcagacatatatgtcgccttgagatcgactagctctagcatcttcttcttctcaatcttctccttatctttcggagcagcagctaagctaagctttggcagtatcgtcgttgatccacgtagctaattaccaaccgttaactgatccagacaacaaaaaggacggctgcatgcatccacgtccttggttcagtcaccagtgagatccaattataagttatcattcagagagtccagacaatcgactacctttctctgttaagcttgctgttaccaattccatgcgatgaacaatcgaaaagtacagtgtcttttttttcgcgaacgcgaaaagtacagtgtcgagtgttgcattcataaattattatactttcttcaggtacagatactaacacgtaaggccagactattcctcaccgatcgatatctcctagtcacaactcaaaaggtacaaatgtcatcatccctcgtatgtacagcacaatctaggtgttcaatctttgaaagtgagattaccaaagtgacaggagtatacattcgtattcgaaccccaaaaaatgaatgatatatagctagatcgacacttcgacagagactgtgcatccatggatggccctcactcaggccaccggcagctagctacctcgtcgatcgactacttattaagctataatttctctcagtttgagcttcacgctgctagattccaaatccaatggcatatagagaagcatctcactgcaagcatggaggcaaccactgagtagttgcagctagcagcagggaggaagaagaatatacaactagcccatgcacgttctctctcggttcatcgatcgctagcaactctctctgattgatttgctggatatatatgttactagtatcctgtggacagtatcagcatgtacatgtgcaagaactttggccacacatagtctgattaaaagaatccatgagcactgcagcttgcattgacacctgaaaaaggttagagctgattgataagcatgcacacatagttccttagctactgtttagcagcttggctgggctggctcattctcctgatgaatgatgatggtgtttttttttcctctctttagaaagatgcatggctagttgggactaaagagttgtgtgctaacacctgtcctacaacaaagatccatcgtacgtgtgatatatctaactaaaagtagccctgctttcgtttgatcgaaattaatcatgcatccaacttgctctataattcagtacaactagctggtagaaagtccctgaactgaacaccatcagtgcaattgcacacaaggacatctctacgcctagggtagctagctgctaattaacttaatttgacagcactcgagtgataacaaccattaatgccagcttgaagacagtgtaacacatgaacccttttttgcgtggttggtttggttggcgcaagtggagatcgtactgaagatcatgcataatctctccacaggtcaatgctgctgcagcatgcatgaactgatgaagaaacatgtccctgattaatccctgcgacttgagctgaaaacccggggcaaattgcagctgatgctctgacagagttggtacagtgaaccgtgtagcgacctaaacagttggggagtacagtgaacttagtgaactgaagctgcttgattggtcaccacaagctttgcatgacacacaagtaaaaaaaagtaattaaattaaacaagtggtagaattttgttaagctgcagggccagcaacacgacgacacgtcgatcaccggattaaccctcgaccttgcaacacctcacatgcatgcacgcgaggtccgtactaggcgctacggcgatttaaagaaagaaattgacgcgcaatacaagttaattaattaaatacaggtcatttagcctcttaattatccacgtcgatcgatccatcacgcagaaatatcaagcaagcaagcaaatgagataaatgattccatcttaaattaactacagctagagctaagctagctcctaattttgtttgttgagctcatgtgatcagcctccctgctcacatgtgcgcatgatcacgtcctagcttagcattggcattagctactaattaaacagcatctgtttttctttaggaggaaccgaaaggtacacttgttgagcaggaaccagagcaaatgacaatggtgtacttgtgttcccaccaagcacggctttgtttttttttaactttgattaaaaatccctttgcttagttttatttccaccgaggaaggtgccatgttccatcacattaggcttttgtttaacaagtccttgtaccttgattagagcgcaaagacactagtactagtgactaattaagaattagtttttcccctagccttgtatgattgccagctgatccttcttggggaattttgtagacaaagtaccataaaaccgcctcattagaaacgtgcctgtcggtgttaatcaggaccgcttgtttttacctcatcagcttagctatctggatataaaagtcatcacagtaaataattaattgtttgtttgctgttgtaacgaagtggacggcaataaaacgccataataaagaatacgttcatcgattactactgcattaatttaatcattaaaacatgatggcacatggaagtatatgtggagttgtagcatgcaatgtagcagtagtacggattaattggatggttggtggtagtgctaactgctaagctactgatgatgatcgctcagtgcattcctgcaactgcttgacaattattttttagggggttaattagttgcagctagaattaaacaagtgttttattaccgttaactgttgaacagtattcagtagaaaaatcaactgaggaatgctctataaacaatttgcaaatcgcataacaatccaaagacggaaatgcttccgcaggattcaagaagtgatcaaaccaggaagtttcggaaaaccaaagtcttggttagttaattagtttcattgattatgatctagagagaggacttctgaataagggcatatacaatggtatttattagcggtctctttttatcgtcatgcaagtatatttggtgatgtggaagagagaggaagaagaaaagaaaaagatggttactacacatgacaacggcatagaatcgactattagcatttattagaaaaatttttgttgcattgagtctaacaaaggaaaaatgactagtaagaaagtattttggtacactaatgattagagactgtattatcttaactattgtaacgtgataatctctaattaacgtagagaccataccagtctctacctttgtaattgccttaaaaaggttgtcggaaactgaaattaacaatagtactaacctgcagcaagatggttttagacttttagttgctggatagattaaaacaacaaccaacggacggtcaacgaacagaatagccacaacgtcaaatcgagtccggaattctagagatctctaattgacgatatggccatctcgtcgctggtagctgctactagtacagtaatatgttccaagtgcgtcacgaaagtgattgcaatttctgtccggttacgaacgagtcgggcgcgcggtttcacacccccaacaactcgtggatcttttttggagctcaatcgcgtgtgctgcggctttaatttgactggcttttgatcgatctatcgcgtcgttcgtcttggcgtgtatacaacaaattcatgcaagaacagaaaattcactgtgttggtggtgttgttggagttgcatgccaacgtgaacagcagatgaaaacaatgtataaagaggtgatcaagatgctaaagcgaaagatgtcacgtacgctagctttgctagctaggcgaatctgtagatcctatatctctaaatgtaggatcaacagtgatggtatatttgacccttaactcgtctgcttgttccagctagctagctactccagtttaaatttaaatttatccagcatgttcgtccgaaaaggaaattaaatgagaaagatattgagaaggagaagagctagacgacgacgaaggatcataccagatctgtgtgtatgtgggtaaggtaggtgcaaagtgccactctctcaaagtgcgtagctagcgatttttttttttttttgaacaatagctagcgattattagtgtacgtgtgcgcatgcatcacgcgcaattggcactagaacgtagaagcacttcgctcgatgtacgtacgcacgtacatatatacgtgtatatatatttgctacgacttgactgatcagctggatgcaactttgtgaacagatatactccaacggctcagatcgtacgtataactggcttaattattagtcgtcggtcgtccaagcaaagtcttgttgtcaacgaaaacgaaagaatttgaccaggagatcgatcggtcgaagaagaacaaaatcaaagagacaaacgttgtcacgtaacggagatgtgacaaccgaagcttgtgctgcacggtgaggcagggtgcagtcactgcagtggatcaccttgttgggtcttgggaggatttggcctcggattgaatcgagtacacgtagcccccgcgcgcgactggatcatcgtcatctgggtggattggatacgggataaacccaaccaacaaacgaccgatcggtggctggcctaacgcagctgcccacctcgccttcgccccgcgcggacgcagcagccgccacggtggctccacgtacgcgtccatcttcacgcgcgaccgagtgcgagtgcgagcgagcgagcgagcggctgaccaaaccacccgcgcgcgctgactccaccacgagctaagctgagtccgcgccgaccaaacgcgtcgtcgcttgctgcctctcgtttccgagcacggatagctcgctgtatgtgcgtgttggaacgggaattccgacgtgttactattgtggcgactacttctccttaatttttcgccatacgtccgtatctaatcgattattattagtcctaagttgataggatacgtacgtgcccaattaaggccgggtacgtacgtttcaggcttaactcacgattaacgtacgtgcagttaaattagttcgatggatcaagctcaactgcgactttgcttctgtggtacaaaatacagtaccgcagggcaagaaaggcacctaaactaacctttcgtgatataaacttttggttttactctactgcttttggccttttgttttcattagcgacagtatataatttttttttcacaggtcgaccaacggaaaggagctaattgcagccatgagcaaagcaacaataacaggtaaggaaaaaaaaagtactgccactctgccccatctcaatctcacctgttaccgcttgaggaacaaggtagctgaggtcaggacgcctacgtgtatatattttttttaacaatctgtttacttgtttgattactgctctacttaaaccatgttaattaattatcaagaggatcctcaaacagtcatgcctactttgctcatttaccatctactggtcagaaattcagtactgccaaccagtgctaattaataattggtggtgacatactaaacccttaatgattaaacaaaagcaactgattagtactccttaccaactgacatgagtaagagcaggcccgttgatcaggaaggaaatgtagagaacagcaccgagagatgcgctcgtgtctaccaaagattccggagcagcgtagcaaacaatttataactaggtagtgacagcaaaacatctccaagtaatcagcaagtttattttgcttcttgaacctgcaacgaccatttaatatcattacagtggcatgaagattaattaggaggatgttgtatatatgtagtatatgtttcaatgttttgtataatcacggtatcttgctagcaactcagcatggatttctgcttgcttggcactttagataaaatcgacttataaaatgagtaaaataattaatctaataaatatgcggcacactctttattgctgggcaatgtgtgggagtgtactgtgcagcatcaggtatcgcaccacagagcatccaaatgatatggcttgttgcaatggaggttaggcatgtgcaacctatatttgaaaaatggagatatgccacactgctttgctattgctaatgccaccttccattgacttggaccggttgcgacctggccggaacgagtgagagctgaggtagacatctccaatcaaatactaacatttttctcccttgagaatccaagggatccttgtgtttacataggtataaaaaaatactaaatcatcctaaaaaaaagctgtaggtcaaacttaaccgtacaatttcatcttctacattttcttttcacaatgtcgagcgctctgcggcgttcgcgaaaaaaaggctgtcctactcatttttatgttaaagttgtgcaatatccatactcacatgtcaatatgagtaaataattgcaattttatgtagacttaaattttaaatacgtagtcttagtaagcatacaaataaattcacgacaagcacaagccaacagtaaaaagataaaaataaaatccaaaagtaacatattatatcgaggaactagacaaacatgaccctgagcaacctataatacaaaatcatcaattttcaggaagacagacagaggcaaacaaacgtgtggaaaaacataatcccggtctacatggaagattaacaaaatcctcaatcttttggaagaaaaaacgggggacttccgagaagaaaagaactctagcatctccgtggagaaataaaattgataatgacgatctaaaaagaaaaacacatgatgataggcagcagagaagcagaagccgtcatgccttacggtttttctttttttttttcccggaattgctctaaaacttctgtaagttcttttctcaaaacttttagatttgtaattgtcgaatcgtctctagatttatatatataaagaaaaaaattgctagaagaaattatcacatatatcacatgtaaaatctcggtgctaaccaaccaaaccataatcaaaatataagttttatataagttgttacatattgataatggcaattaaaaaaacacttatgatgataggcagcagagaagcagaagccgtcatgcctcacagtttttcttctctttttccttcttctcccatcgtttttttttttggttttacgtcgtccgatccgtccattgctccattgctgacgacgagcgaacctccatccaaacgctgttcgcaaccgatcccagagatcaaggtccccatacatccaccaccaccaccaccaccatcctcttcctcttccctctcttgcctcctccttttattactctactcatttagcttttggttggttggttcccttcttgagaccccaaaacccaactaggaaggacaaggacacatccctctccctcttccaccaagagagatagagccaagaaccggacgaggtagaagagattgagccgccacggcagtgggagcgcgcgcgcgagttccccgagatccgcgagatctccgtcgccggctcatgccactggtcggttcttggggcggcggcggcggcggcggggggtggtgagtctgtggccgtttcttgcggcgtggtgaggtgaggggagggagaaagagaggctgcacatgtccgtcatggcgcggccccgcttcgaggaggatgacgaggatgagttctttgactcgagggaggtcatgtcgccggcgtccgtctcttctccggcgagctccgggcgctacgacgggcccatgctcgaggtgtgggccaccgacccgtgcagcgtccatgagcgccgtcagaggttcatcaagtccttgggcctctcggattcgagcccctccgccggcggcggcggcgaccggcccgacgaggagccgtgctcgaggtccagtgccgcagaagagatcctcccgtgcagccccaccgtcgagctggtctcagccgtccccagttttgcgtgcagaggcgaggagccgggagcgtcaggcggcggcggcggcgcggaggtgttggattgtgtattcaagaacttggacgatggtacagtgtttgtcgtcgacgagatgggaaaagatgggagtttcaggagcctcagggacaggcgatccaaccggacagttactgcagcggaattcgaacggacctacggctcgtccccattcatctgtgagctgatgcggcgggtggatgattcggatgagtcctctgctgtggagaaggctctggtcaggggaaggagaaggaggaggagatttggatggctgcgcaggctcggcatccgtggctgcgtcgtcgatgtggaggaggacgatgagacgaattcaacatcctcgagttcttgtcggagttgctctgggaaggttgatagggtcaaggtgaggcattacaagaagaggtcaaaggaattgtccgcggtgtacaggggccaagacatcaaggcgcacgaaggcgcaattgtgaccatgaagtttagctctgatggacagtatctggccactggaggtgaggatggggttgtgcgtgtgtggcgggtggtggagggggagaggcccaatgaacttgactttgccgaagatgatccttcatgcgtgttcttcacagtcaatgaaaactccgaattggcccctgtcaactccagtgaagggagtaagagcaagcactacaagaactcaaaggtgtcgacagatccagcctgtgttgtgatccctcataggacctttgcattatcccaggagcctgtgcatgaattctatggacatgatgatgcgatcttggatctttcatggtcaaaaaatagggttagttgtcattgaacaaggtttttccatgtatctgcagtatcttttaattgtcacatggtcatctaacttcactcgccttctttttgcaggacttactttcttcatccatggataaaactgtacgattgtggcaggttgggtgcaatagttgcctgaaggttttctcccatactaactacggtaaaccctttcccccgctaagtacaagatttagcacatacctcttcccagcgtctgatgccgacattctgatttttgtctattatgcagtaacatgtgtgcagtttcatcctaccagtgacaattattttatcagtggttgtatcgacggattggttcgcatttgggatgttcgtagatgccaagtcgtggactgggctgataccaaagagataatcactgcagtttgttaccgccctgatggaaaggtttgttcaactgttctttaagtgtttttacccaagcggccattttctgattttacttaaatagttaaacatgtttattctgctggctttattcaggccgcagtggttgggaccataacagggaattgtcgccactacgatgcatcaggtaatcatgcaatcatgagcacactctatgtatggcgcttgttattggcaggctaatgattttggaaatagtagcttcaatgaatcaacatccttgtttgttaataggtcaatatcgtttgctttcatgacgacatcctagatgtatatgcaaattgctaatgatagaaatgtcttgttttgtccctggtatgagaatagagacagcagaattgttgttatcctctaattgcttcttttgatcctgtctaaactgtatgtgtgtatagattgcagtttactacatgatggaaagataggtcattttatgagatgctagtgttgcatttatttccaccaagtagtactgtccacgagacttttctccagctggtttttatgctacgattttcttaaaaaaaattgatctctgccaaactatctttttgaccaatcactggttggactcattttgtcctgatgaatcaacaaaactatgtcatcaatggagatgatataggaacctttttttttttttgcggggagatgatataggaacttaggaaacggtactattgcattttggtgatgaacaggcaacatgtgctaatatgctattttcatagcaaggtcatgcatgttgatggtagacaacaattctatttttcattggataagaacagataagattgaaatagaaaaacatatattttcttggtttatgttttgaagctaaggtgcatattcctgtattggctgcagaagtcaagtgtactacccttgtttgggtatgatgaaagtattgttggggaaatttaggtctatgattcatgaggtccttaatggttataaccatttcctgcttatagatcttgcaaaacacatagcactggaaacttgttgcctcatgcttcagtcaagattcaaattaatgttccatacatcgggaaacagcaagccagtaaatacgatattcaaaagtctgttgtaatagtagttgatttgtaacagtagcttaaatccgctttgtttaattcagaccaggaactttaacttctttgacttgtgttcttttaaaacattttcaagtatgctcaacgaaaatatgctactagtatgtttctgattcatttgtttttttctaactttaatactttttgcagaaaatcacctggagctggaatctcaagtcgctctcaatggaagaaagaaatctccacttaaaagaataatcggtttccaggtaccttttcttatattgcatgttctaatctatttttttgtcacatttaattcttacaaaagcaatttttcctacatgcattaccagtactgcccatctgatccaaagaaattgatggtaacatctggcgactcgcaagtccgtattcttgatgggcttcacgtaatttccaactacaaaggtactgacaccctcttctaagatcactttcaaaagtatttgtgacccttagtttacatgtctattttccattctcaggactgcgaagttcaagtcaagttgctgcatcattcacaccagatggagatcacattatatctgctagtgatgattccagtatctacatgtggaactatgcaaaccaaatagctcccgtcacaaaccatgtgaagactgtatggtcaaatgagcacttttcctgccatgatgtggccattgcgataccatggaatgcctctcagacaaggaattctatttcactggcttgcagtatcacttcttcacagcaagaagtcttggatgagttccacaatgaacatgatagctcatcatgttctcatactgaggattcccctgatggtgatagtctgtaccaattaccatctggaaatttcactcttagcagtgccttctttgcggaatctgctccaaggggatcagcgacatggccagaggagcagttgccatcaaattcgacaacacagtctaccttgaggaaatctcagtacaagttcctgaaggcttcttgccagaatgctgctacgcacgcctggggccaggtaatagtggctgcaggctgggatggctacatcagatccttccagaactatggcttacctgtgcaagtgtgacatggtactagacatgcatcatttaccattgatagtccaaggcaaaagcttgggtatgccttgagaagtctggctggccctgacgcccgtcctgattcattatttcagcacaaagcgtcacatggctggtgcgtgagctgaattgcttgtggaccagaagttgtatgtagtctgagtggtccttcaagatcttgacagcgtcaacacatcgtagcaggcccgcggaagatgaatcgcctcgcagaattatgcaaaggcatgtggggatttaggcagcaacacgttggtgttctttctttctttctcttctttgttttggctcctgttagggccatccgtaaatatatataggagacatacatatttttgccgagttgaaacttccctcgcccgaaccggatagtcgatggacaatgggcaagtggagagctagaaatcactgttggataggggggaaaaattcagagtggtgggggtgcacatactactggattcgtttcatttgttcacatttcatgattcatagcctggctgagtctatgatggacattgatactggagttgtatgtgttgggatggatcatggatggaaccctgtggttgtggttggacatggtcaggtgggtgtggcctgtgggggacctttgtgcaggcagagggcaggcctttctggatagggatggtgcagttggttctgatgggtttcctaactccaggggccaggcctttgggtatgggactatactatcactcattgctgctgttaatgcctttgtttaaaagctgggtccatgtccatgctcagatcttggccttttatctcctgcttgcactgtcacgtcccttttcttccagatccctccccaagtccttcctattgaggtgatattcccaggaaggtgaaattgccattacaggtttacacttattctttgcagtttactggtcttgtttgtttcaagaaccattgcccagcagtcacagaaataatcttagtactaccgtccatacgaatcttttcaaggttttttttagtactcttatctcttttcatcaaagatctctgcagtaaaacgatggcatcaaaagtacagccatggatgggacaagctcagcgatggctggttctgccgttacaagtactctccccccgttcctgtctggccatcttgtactagtagcaatgggcatagcagcggagtacaactacactcctccagtatcgttgttcaaaaaatgcaggtgccaggacgactgagatcctgacagggctgcccagtggatgatggtgcccatgccatgccatgctctgcagcagcaaggtgatgaaatggaatcatcagcctggatgctgccttgcctcattttatgcaacagtggatgttattttttcggtgccagtccagtctggtcaaggagtaaagatcatcaagccaagcccccctgaggacaatggctctctggtccatcacctcacctgctgtaatttcagaaatgcactgctcattccgtccaaaaaaacaacttagaagtggatatgacatcttccttttatttagatttattgcactacaatggatatgtcgacttttttttagggacagagagagtacacgctcacccgtagcacagttacacccctcctccctacagatggccgaggagtagtagggaggaggcagtgttttaggcaggctagcagtcaccgcagaatgcgacgccggtgctctcatctcatctctccctctgcactgcagagagtacctgtctctcttaggttgacttttttttaaggaacagagggagtacacactcactcgtagcacggtcatacccctcctccctacagatggccaaggagtagtagggaggacagggttcgacttaccgccggtaaccgcgcggttaccgtgggggtacggtaatataaatactacggtaacctccttaaattcaaataaatttaaaaaataatttgaatttttgataaattttgcacggttttatacggtttttcacggttaccgcggtaaccgtgtggtaaccgtgcttgccgaccgggcgcggtaaccccggacccagcggtttggaaaaccttgggagaaggcagcgtttcaggcagtccagcggtcaccgcagaatacgacgccggtgctctcatctcatgtctccctctgcatatggttgcatatgccaagatggacacttgttgctctccaggcctggccaccgctgccttcaggctgcagccgtggtgtatgtcattcgtccgatgggccgccgcgcgattgacatgcaaactgcgagtcttttggcctcgtgaacttgtcattttgatcacccgtactcgtatcatcatatactgtgctggtactacattgttgctactgctggctgctgcgagttgcatttcgctagtgctagctgctgtacaaattgtggcggcaacaaaccgcgcagcctgtacggcaacaggcggtcgtgctcgtgcatgcatcgccttcctctctggtctcatctgctcaacgctgaagcttgatctactgttctattacatttgcagtgctgtttggctgcattcgaataggatccgattatcaaggcaagcttctttgattgtctcctctgctgcatgacaagctagtgacaaatcgtccgttatatatactcccctccatttcaaaatgtttgacaccgttgatttttttaagtatgtatttgaccattcgttttattcaaaaaatttaagtaattatttattcttttcatatcatttgattctttgttaaatatacttttatatacacatatagttttacatatttcacaaatttttttaaataagatgaacggtcaaacatgtgctaaaaattcaacggtgtcaaacattttgaaacggaggcagtatattcagtcagtggtttcatgagtgcgctaaatagggctcggttactatcgtgcgtcgtcttcttgcaaacaatttacagcaatagatatctgtatcagggtaacaaggggacattgtgaatcaatattatcaccattcccctttctgcaggaatccaacagaaggcaacgcgttgccttctgtcggatataatcaaagctttaaaggtgtcatgcattgtttagttcgtgaaaaaaaaaatttaggtgttatattggacatttgaccggatgtcggaaggggttttcggacacgaatgaaaaaactaatttcataacttgcctggaaatcgcaagacgaatcttttaagcctaattaatccgtcattagcacatgtggattactgtagcacttatagctaatcatggactaattaggctcaaaaagatgcgtctcacaatttcccccttaactgtccaaagattcgatgtgtcattttttggaaaaaaaaaaggaaccgagcctatgtataccatcagttatatacgatgatacggttatgagatgatttaggtcctgtttgggggagcttgagattctaagaagctgctgctgagaagctacctggtgagaatctgaaaaagctgagaaacctagcttctggcttctagttcattttacagattctacaactacatattttcagaatctgagtaaatagctggactgtttgggggagtttctgccaactgaagattctaggagaagctgcagctgttagaaactcccccaaacagacccttaacgagtgggtaaacgctatacatagcccgtagccccactgtttcagtcactgacgtgtaagcccatgttaaaattcatctcctagcccgtttcgtcccactgaccaagtgggacccacaggagatcgtttcggcaaatctggtccgttgatctgcacacgcctcccaccaacatcggcaaagcagagcatccccgcgtggcgctagcgagaccgcgtgcgcggaggccggagggggagaggacaagaggcggcgggcg

SEQ ID NO: 58652 - DNA, 671 bp, Oryza sativa
cttgaattcgtcacttgtagttaaggcaccctctgggtcgaagaattctcttcgcatatgacagcactcacggtggatgaagtggcatagatcgcgctgaacatttgtgatgcctgtatcgtcaaagcttgttcgaagttctattcttggcaactgcatgcatggaagataaacaatatgttagtatcataaatatgtgaagctgtctagtccatagtctagagacttacatcctttgtgttaactctgtacctcccattaacactgaggaattcgcacgcgtaatacccgcaaaggacagtgcctctaggttgcttgtgacacttcacgatatatcatagaagaaaatagttaaattttgcaattagtgaaacaattggaataaattaagtgagtggagtattactggccaatatgtatgtgctagtagcttctcccttgttcgggtctgttctccacccttgaacttgtagtagttgtatgcactgtatggatgtcgtatcgttttgcattaaggaggatatttaattataatacattcatattaaaaaaatgcaagagtcagaataacttactactataagattgttagaaattctttgtatgactggtgactgaaatcgagagggtccaagactaccacggttccgtccttcgggtggatgattaaa

SEQ ID NO: 58653 - DNA, 22724 bp, Oryza sativa
ttcggagtggtatttcgaattcttagttgatctggtgactaaagtacaggcattttcagctcaaaatttaagagggaactattggtgattaattgaaagttttttttttcatatgtttgtcagttctgcaatcccaccatttttttccactgcttgtttgaaacagctgttctctgttgctattaatgctccagtgcaccgcactaacactctgttcccactgatgataagaaatttgaatgcagaacatccaatttgcctgctttcttcgtgtttgggaaaacaccattggataccgatgcttgtggccgctcattgttggagtgctcgagagaaagtgataaacgcatcctggtatggtaaacctatttctaatgttctgaaaattatgcttcaattcatggaataagctataactctgatttgttattaccaaagtacagccaaattatggcattacgctttaatttttcctctacactataaaatcaaatcaaatgtaccaaaaaaaaaatctcctttgatttcaattatcgtgaaaaaaaaaagttaaaaatcatagggtagttcttcatacatcatcttcaattttcatggattcaaatatttagaagtgagtgcactatattggtagtcttaaaagcaacctcaattggatcatgaatgagaacttgtcgttttatcatttatgcagtggacacgaattcgatatagacctacagtagctcctgcttgtgtctcatgttgtctacctgtcagtatgttgtgtagacagtgatggttaattaattagctatatctactggatgttatcctatttccaagtaattggttagggttttatatttgtacttctcagtattgttttttttattgagcatttgactcatcgactgttactatttgcatatttgaccatgaaatagctaatgtaagatgtgtatggctagaaatttttatcttcattaatttacttttaatagtctatgatactcttgtcaaacaggttttttatggattagagtatgcacatgcattggatgatcttaaagcagtagttgcggaattatacaaatcacattctcgcagtgttgaagttcagtatgcagatgttctctgttcagttatgagcccaagctctgctgcagaagtggaacacggtcaatccgatggaagcactcatagtgatgatttatctatacaaagtgatgtagcgacatttgtgaataattgttgcaacgtggaaggatccacacgcaagtatagccttggaggactaacatggtctacatccatagatgataatatggaggactatttgttatattggataggacaagataactcagcatttgccaacattgtgcttaccttcaataaatgtgatataggttcgttatcttttcaatagccagtggggaaattatttgaatttgtgttagtcatgttttccttctattgtagtttgcctctagaatctattttggttttcgtaagataagtacgaaccattagttggacaatatgaagtactacatggcatacatcttgctttggaagttattgtattctcatttggctttaaatatctctatccttaacgtttagttatcatgtaacttccagtcaatgctttatattgtaaatgtagctattctaattcccttcttcatatgaatgatctgacaggaggtacaatccgtccagtgtcatgtcataacataattgctttaaagcagagacctttataatgaaatgcattctaatattaatgaacatttttaattttattatgcagttaggtatgatacagtagcaaatcaaccatcaagggatgtctctcatctgatgaaaatacttaggcgcaggtcatcttatgcagcatatataatactttatttttgcgtgaaatgaaagattttttttttgtcattgtagcattatttacaaaatagtttgtatatgcagatattaccttgtggagaaggcgaaggatgcaaatattgttggcattttggtggggaccctgggtgttggtatgtattcctttggcgtgttttattttttgatttgtttcccattgtaaagtacacataggaactgttgaccctattaaatctgtcaagttacgaattaacaaaccccattcaaaatttgccagcagttcagcactatgcaatgttgtattggagaaagaaagggggacactacaattgcagataacagtgcttgattaatatgtcactcagtcagaatagtcttttcctttactcaatccttgtgctgaggctaaattaacacccctaagaaaattaaatggagtatgttgctaatcacaagattattaatcgttatgctatgttaggttgttgagctagaaaatataggctgggcttgtctctaccttgtgaaattgaggtgttatttgaatggtgaaaaaaaaggttatttgtgggctctaaatttctactacatttgaagtttactttggtcaacctggtcgaagaccaaggttgattcaactggatttgaagtagttccacacatgacctatgtaggaaccatccaattacttcgatgttggttctacctgttttaagtaaattgtgctcacggtacaacaacttggtgagtgggtgcgatttagtgcaagaaataaaaaatatgtacaacaacttggtaatggggtgcacatttggtgcctaggaggtgccacacatgcaaactggctgtgtcagctggccagctcgtcaactaggtcacccattatgtgccttcaaccaagattcgaacagactagtagacaatcgctggcagcaaagcttccattgtcttcttcctactcttcataaagttgcacatccatctcatctcactgactgcatcaccccacctcacctttggtgatcaccttgccattgattcgagaagccagaatggcaaagaacttcaaccaaataataagatgttggtgattatgcagagaaacacattgttgaaggcctcagcgtgcccatcgtgcaccacatggcacctcctagaactataagatcaacaataagccaacttgttatagttgatcgtacaatttctaagttgtattcaatctcatctagccatcaagttgttgtactgtgaccgttatttactctgttttggtttgataccaaaaccaaccttaccaaattttggtaatgccaaattttggcactgccaatttttggtgacatagaagcgtgcggtagttgcttgggttgacaccttaacaaatgcaaggtgttaggtgtgatgttttagaattaccaaattttgatgtggtagaagtatttagagtctgtttggtttgtttccttattgtaatgactaaaaatggtgacagatcaaacatacccctattccttttattttcaactgaactgtctatttgttttgatttttatattataaatgctttcactgaacctcactgccactatagctttagcttgcacattattgtcttttaactttattacacactacatctaaatgatattatgtggtacatggcatcattttcatatgcagctggttatcttcacatcattgagcaaatgaaagatctgatcaaggctgctggaaagaaatcatatacgttagtcatgggccgacctaattccgcaaaacttgctaatttccctgaggtgctactgagttctaatatgttttctctgcttttcatgttaaggataactgactcaccattctttttttttttttggtatggcagtgtgaagtttttgtttatgtttcttgtgcccaaactgctctattggatagcaaagattttttagctccagtcattacgcctttcgaagctgtattagcttttagcaggtacacaccattattgcctccgatagtgctgttgacatacttgtgctgttcatttatcaatcatgactttatattaagttgtgtatggtggtctggcctcatgtggatgcaagttcgaagattttttcttacattcttattaagcagtatcacatttatcactttttcaggggaagggaatggacaggagagtatcttctagatttcaaggatttgatcactacagataaaccagaaatttcaagcacaactgaagaagcaagattttcctttatcaaaggtggctatgtggaagataattgccttgaaggtatagcatctactcttgggttttgaaatgatcatgtcaattaattatttgtcgacttccgagtacatataacatgacccgatattctgcattagtacccccgttctcatggctgatgcattcctttacctttttcttccctgttccgcaccatttggtcccacagataacgaggaacagccagagacatcgcttgcacttgctgaggtaacagagaaggcgctaagtataaaaaatcagaataatgatgcagttctttaccaaggaggagcaaagtctgcgatcgactatctcaaggcacgatcctaccgtggtctcaccggagaatacgagggtccagcaccagactcggtcttgacaggcagaacagggagagctgccggttacaacaacgagaaaaaggagattacacagtgaatgaatgacataccttgagtgggaaaatatatatatatatatatatatatatatatatatatatatatatatatatatatatatatatatatatatatatatatttgacttgtttgccctcgatgggcgattgatggagaggcaattttgtacttcagaaagtactgtcagatgcctcagttttgttgtgagccatgaactatgtgttcctttttttttttcttttatgatggaagggaaactccccagcctctgctcctactagggaactgtgtttcatcaaactgttatatgttcagaacgatgttgtacatctcctgccaacatactgtacagtattccatatttgcaaatctgcaatttggttcctctgtaccaaggtggctgtaaatactggcagaaacagccagcaagatcacattgttttgcaaagccggctagatgctccatatgctgattgtaagtttgtaatcatgctatgataatttagcaaagctcatgactgctggaaaaaagaacatgatcacaccacttattggaaatgaaatggtaattaggatcaaccagcaggagcacacctgtcacaaagaaagtaaccgatcgagatataaattaaatccacaaaaatggaaaaaaaaatgttgtctggttgatgtgtcaaggacaacaaatctggttgccatcagctgaaatcagcactaggaaagcaaacaataggactgcactgtacttcttcccttcccttgtatcatggtgatgtaatcgactgatttttaaaagagcttccatgttcttaaaaatgaaaaaaaaaactcagcttcaaggacctagattggcatgaatgcatgaaacacaaaccacacacttcatcattgcagaacccaatcaaatattcaaagcatatgtagtgtacattgtagcacatagtacatttacaaatcaaatgtgcacacacaagcactgcacttattacatgagaccacattatcactcgatatacagataggaaagccacacaagtccaaatccatgagcatagacacaaccattatgctcaaccatagtgccaaaacacacacagaggcagaatatatacaaatgcacaccacacatatatagcagacagaaacacacaattaagtagtagcaaaccaaacctcatgagcacccaaatgcaaaccgataatgggagggacacgatggtgattcccttcagctcgacgtccggtgccgacgcttgtccttggggatgaataggcagcatggcgcaccgtgtagtttgcttccgcgttcccttgtgttttctcatgaatttcccatttgtagtatgtataatgaattttatctttatgcttatcaatggcttctttcacctggttagggagagactcgccgttgaactcaagctccttcaatatctcggaaggttgcattatattgtcgatgccagagaaagacgagttcatcccggtgaaggtccacatgatcttttcgagcttagggacaagccccattgtggaactcgatctcagtgattttaaagcagtgcacaataagatcgcagagttttgggaactcatctttgttgaaggcaagatggctttcatcaaaagactcatccaagagctccaggcagcggatatttgatgtattcacgaggagccatgacgataaggcggcacaggaccagacgaggcccgcgaggagcaactaggctagctcagagcaagttcaaatagtatagccaactactagctccaattcatttatagctaatctaatagctcattcatacaatagttacatactacactattaatacctggtcccacctgtcatacacacactgtgtcttggagtccgtgctatagctggctacaaatctgtagcccgctgctcttttctctcctcatttatcttcttaaaatatgtttgcagctggcttatagcctgctattgtacctgctctaagtggtgagctcattgcctcatcgccgccaccgccgcccaactcccaagttccacggagcaggcggccaccagatctcaagctcgagcttgtcccttctttccacagctccacatggcagaagaacgactgtcctacttcccctacctcgccgcctcttagcctccgcgcagcggcctgtggtgggtgagaattggaactctctaggctatggaaagaaaggaggaagaaggagggagagggactgacgtgtgggtcccactgctaaaatggagagggtagatgaagaagctgttggaatgaaaaacaaaattaactctctattcggttggcaagctagctaaatgagtatttggagaggcaaatttggagactgatggagatgctcttaattagacttgggaccctaggtgccaggacttgtacctgcatggtatgaagtatcaagtaccaacgcctcctctcctcttcttccttcccctcgttttaacccatgttccctactgctactgctgtgaccagcgttgctgcctacaccgttgtaggctctggctcaagaagcgaggacgccgaatgcgtggagtgggggtaggatgactctaaacttacaggaaaaaaagcaaatacgtgggatgacgtcagcctccctaaagtggtatcccatcctctagcagccctgtatcctccattaataacaaataaaaagatattagtcactacaaacactcttcattacctagactcaaaactatcagtttccctgcatagttcagttacactgcttggccaccgcccccgacgtttcccctctcatgaaccctcgccgctgcccctcatcttcctcaactcggcaacgccagagctcgccaccgggtccccgcatggcagctagggcgacggcagcggggcttcgatgtcgggatctgacagggcattgcgtagatggggttttagtttaggtgaccgactggggtggtgccaaagggtggcggtgaggactagcagcgtcggcaaacttggtggtggcgtcggggaggcattgggcggagacggggctagtcctccatccttttctttgtcaacgttggcgagggctagcggtgtcggcggcggtagactttgaggtggcgataggtggtggcaatgttgggtgagatggggctagtcctccagccctccctttgtcaccggtggcgacggcggtgggagaggctcttggaagcgccattctagagatggcaattgccaagcgagcgtcagcaccaaggtttggctgcggataggtgtcgacgacggtggagcatctccaacaagctcatagcagtaagggcatgagcatatcgtgctggacggctccgcgatgctctaaaaacggaggggagttcgatagtttctgaaagatggtggtgatgtggtagatgggctttgcgacgcactagtggcattcagaatacggcgtcggcgtaaggtgttatggacagtgatggtggacaacgaacgaagcagttgatagtatgtggtggttgtgatccgtagaggtgaaaatggtacgacgacgagcggcacggactagttccgactctcccctgcccgacctcttatgctgtggcagaaagaataagtcgccgatggagtttgagagtttgaagctaaacttctatcttttctttttgtgtttgtacgtgcgctttcttgctactctgtgtaagtttggaagttgaaaaactcgtgtattattttggatgcgtatgctcttcgtggatatagatgcaagattaataaaaatcaatttattaaaaaatagagtcaaacttatatcagtggctccaccaccaatctcatggatatatatattgacatgcatgccgaggaagaagcacgcagtagctttcatatcaacagcctactgacatggccaacatgcatggcagcatcccaaggattgacttcgccggaataatcgacctagccgcgttgccgccgccggcagcgccgcctccccccggcgccgaccacctacggccacggtgggccgccgtgcgcgccgccgtcatggacgcgctccgcgcgcacggctgcttcgaggcggtcgtggacggcctcatctccccggagctccgcgccgccgtgctcggcccgggcggcgcggcggagtccgtgctgtcgctgccggcgagcgccaaggcgcgcggcaacgaccccggcgagggcaagccgtaccacggctacgtcggcggcatccccggcctgccctacgagagcgtggccatctccgacccgctctcccccaccgccgtccgcgccttcgccgcccgggtgtggccggccgccgccgccgcgttcccggaggaggcggtggtcgcgtacgcggggaggctggcggcggtggaggcggcggtgcggcggatggtgctggagagcgtgggcgcgacggcgtcgtcggcgggggccgtggaggcgcaggcggcggcgacggcgttcaagctccggctgtcggagtacgcggcgcccggcggtggggaagatgcgaggctggggctccccgcgcaccgggacacgagcttcctcgccgtggtgacgcagaacggcgtggacggcgtcgaggtggagtgcggccgcggcgacggcggctgggctcgcccaacgctctcgccgagctccttcctcgtcttctccggcgacacgctcaaggtatctgtgcatgtgcacgcatgtcacatctctctatctctttcttctttttttttaaaaaaaaaatggattaaaagaaacctggcgatcgatctagctacatccaaatgcatgttgctggaatagaaaatactaaatagtacacaaacttccttaactttcacatttcaaattaagtcaaagtctataccataatttaactagccgaatacaatgtgcgttacaacggttttagataaaatattgtcagttgtaaacttgaaaatattgtgaatatatatgtatcatggaataacaatgttattatacaatcaatttccaacaaaagattcccgccaccaactcaattaggtggtggtagctagttttgcataagactcctccctgctattaccgttggtcaattacattattttcgtgcggaacgtgacgaaacatagacataagatattaatcgaaaaccagttaatcgaaaaccagagtaccacaatatatagcaaaagtattgattttggaaaactaataagtgatgcgcgcattcacagttatatattcgaacctgagttttaaatcaacatttaacgatcagccttcttaaacagctaaatagcagggtaaatgggaaatagattttaattctttgagggaataggttcactcgttattgcatgtcctccaaatagtaaaaaaaattaaaaaaataaaaataaattaatacgtgatgcatgaccggtgatgaccggcagtctgaccagctctgcatggccggtctgaccatgcagacagggcggtctgaccggcattgcgtggccggtccgcccggtcccagagaggaagctgggggcacgttacaattgattaaaaggccggattaattgtgaatttggacatttgtgcccataagtcagaaatagattggagaatccctttgaatagaatatttgaaagatcctagtttcaggattgatcggaaaatttggcggcaagcgttcaaatacattttgcttgatagagaattatatcgccgaaaaatagatagagtacttttgaagtgcttagataatgatcaatctaagattgctatgggagaagtacacatgaagggatttgtggaactcatcaattggcccgcaagatggattggttgcttaggagagttggattctattggccgaaagtgattgatgattgtttcaagtactatagaggatgtgaagtttgtcaacggatcggcaatgttcaattagcgcttaccactgtgttgaatcctatcattaaaccatggccgttccgaggttgggctttgaatttcattggtcaaatttatcctttgtcatcaaaagggcatcggttcgtgctaattgcgatgaattagttcaccaagtgggccgaagccgtgctgttcatgaatattacttacacggatgtaattgactttatcttgaagcatattgtttatagatttggtatttcataaactttgatcaaggagcttcttttgtgtccaaagatgtgagaagttttactgaatcttatgatattaagttgttgagttcttctccttactatgctcaggctaatggataagccgagtctagtaataagatattgttgaaattagtcaagagggatattgaagaacactcaaagaactggcatgaggtgctttcagaggcattatgggttcataggatatctaaacatgatgctactaaagtcactccttttgagttggtttatgaaaaaaagccgttttgccagttgaggtaaaacttggctctcttcggtatttcaagcaagacgacttgttaattgaagatcacaagaccttgatgggaggcaattttgaagacgtcatcgacaagcatttgaggactttgaaagagatggaggcacttcaagacggtgtttacagagaacaatctatgggaaatacttgaagaaatactttcctagcgtttggcaagatgcttaggagatcccgtggccggtaattggattatcgccctaagacaacatgttctatgcttttagatttgcgatgttcataaaaaaggcaggggggcatgtgtttacacccaaatttagcacttatggacgaaataggggaaaattgccaaagtttggaaagtgccggctttctttcacagggccggtcataccgcaagtatgtgggcagtctgaccggctagtagggccggtctgaccgcaggtatgtgggtggtcggatcgtcagggtccgagtccgagtctatttccgtcgggtctcggatttccttgctcgagaaggctatgtttcgtgtttcctttgtttctatcccgagttggacgtagagaagggcctgtagagggcaagactaacccctatataagggacaaggccggttcattgtaatcccccgaataaaatctacttgaatagttcttttaccatgttttctattttaccctagtttagtccatctttgtcggtttgcgccgtaaaccgtccgccgctgctgcgagagtgcgacacctctttgtaggtttgtcctgaaaaccttccgttttgcccacgagatgggtagctatcctcatatcgatctaaatcggcctagaggctgattttgatatctaaatcggctccgctagctggtttagctatttttctataaaacccatcttgatttggccgtttggctagatcgaggtggttggcgactccatatcaccgcaaggcgtttaggtgttgcgatcgtacttgtcgacttgtcacaaaagttgccaacatggggttcgaccgaaccccctggttcgaccgaaccatgggctggcccaaaccagcccatcttcggctggcaacctactggacttcttctctttgtagatttgtgaattttgggccaattgatcgtgtcaattctgagttcttagcccattcatgcataagtccgattctcgacatcgtccgattgatttatcgtctgatttgatgtcgattctcctccacttaatgattattctctgtaaaaggttagtgatccaaatactagtggaatattattattctaacatgtatatgcattacaagtataactagttctcctctattgataatattgacggtcgaaactgatcgctaacgaccgtcaacggcggagcagaaacccagtgaagaggtgagcaaacaccggctaaaaaaccagtgacgctcaccacaccaccaggacgaggagcgtcggagccgacagccaccttgagcaccaaaagataagggacacactagtacaacgagaagacaagaaaataagactactacttacactactaaacaagaggagatggccgccctccccccacatgccccacttccatccttcgtcggcgtcagcggtaagccgccgaagaggaggaagaggggtcggagaaggcgagtctactgtagcggtgagtcacgagagctcgagagagagactggttgagtgtggacgagttccacgagcgtcgagtgtcaagttatccgttctcgtttttgattcttttccgattcctcctctctcctgtctcaccatctttgtctcctctccctcatctcctctcacatggcggcggcggtgacagctgcggaggacgaggagaggctgctgcggctggagtagtaggcggagcactgtggcaccagcggtggcggcttgtgagactatctctgcctcgccggcaagctccgcacacgctgctcgcaggccatccaccaccttggcctagccctcaaattacaacgtaaagctgttggtgtcaatcacaaaacgcacacgctcacgcaaatcacagagaaatcacctaggaactcagtaggaacacacagtcgaacacttggcgggcactctcgtcctacgagaacagagtagagagctagcagagcagagaaacgcagggactatatatttgcgctgctcaactgaattttctggtttttgtctccttttatcatagcaagaacatgaaatgatgtaaacgtgcacctggtagcggactactcctgccaaaatgtaaggattttagatggatggtctcacactgatactacgaatctaaacatatctatccaaatttatattatgcctgctcagatttctaatattagaatatgcctcgtccatttaaaatctcttatattttagatggagagagtaaaatacaagacataatcatatgcgtgctccgtatgatgcccaggttcaagatgctctcccaatgtggaaatagcacgtcttaacatgatgcgaaactgtaaaactgaaaaaaaaataaaggggaaatatgtagtagaaatatggaaactactattggatccaatatgggacgcctgagagtaaaatttttactcttgataaaaagaaatcttacacgttcatttatagattcaccggtaatttacaggttttgcactacatatgtagtttgcactatatatttccccaaaacaagaaactctgcaaaaaaaaaagagacaacttggtacaaaacactaaaagatcgtggtctttgttggacacccaaaaatgtgtatctattcatggaaaccgtaaaaacattatgttctatggacggccaatgtattttattatattatgttcaaatggagagggaaaatttcataaaagataagttgcccatggggcctcctcctcctcacctccgctgccgccaacagtgccaccgtcccttgcccccaccaccctccctactaacaaccactgccaccacctccttctcgccactgcagcgagcactgccataacccggcttgctgctcaacgcactccacctacagggctgcgccaccactatcgttggaccactcgtgccctctctatcaatactcctattgtgccctccaccattgccatgcgcgcgccggcgggggaggggggggggttccacccgtctagcttcgattgtggtgccacttcgctggtctacctcgacactattccagagaatttcttggaaaggaattcagattttttttctctcttcctcaacttgctcgtatattcctccttccatgccattgcatcactcggcactcatgcgcaaccacactctcttcctcaattcgttcatacaattttttctccgttataattagcgggtatattatattatttctaggtatatatagctaggacaatattcaatctcatgtacgggcagttttttaactagggctgaaagccccccatttccattactagaaatgaaacgacgagtacaaaagagttcggaaataaataacaaaagaaaagccaggctagcgcaacccccttactggagcagcaccctgacaggaaagactagcatttttctgcagggcaagctttacagagatcaacagatcagagacaacaaaatgagaaggggaaacctaactgactgccagagcaaaacaaagaactcagcatcactaaactcctaaacttttcattccaagcgtcttgtataaattctccatccaaatctggaactgaagacttcatttgccacttgtctcgccagcttggctcccaacattaagcttctttgtcttgcctccgatttctgcaagttagcccagttttcaatcaaatgacatgtaagatatatcagctcaattggatcattaggccatttttttttatcaaaacacactttgtttctggatttccaaatagcccataatacagctgccacccccaccatcacaagttgtttagaatgtttgtcaaaattggaaagcatatggtttttattcctagcaggtgttatattcagggcgcacaacttcacattccagatcaatctagcaacaggacattcaaaaaataaatgctgtatggactcctctttatcacaaaactggcacaatttatcaccctttctccagcctctcttgtagaggttatcttcagtaagaattttgttttttaaaaccaaccacataaaaatcttgattttcataggtattttgaacttccaattttttttatgggaatgccacttgctcccttttaagagctttataaaaggatttgacagtaaaatagccattcttttccaagttccaccacattctatcttttattccttcttgcagattcaaaagcctccacatctgtttaatcccattccagtctctaagtttgtctccatgcaaagtcctgaatttgatagtctcccagcctttctccttcagttttgcaagagtaatatgtctagtatgggtaatgttgtataaagcagggaatctcatttacgggcatatatgcattcagtttagtaatactaatattactgctatgcacgcaggcactgacaaacgggcaagtgtacaaccctctgcaccgggtggtggtgtccggcgacgaggcccgctactccgccatcctcttctccctcccggtggacggcgccgccgtccgcccgctcgacgaggcggtcgacggcgaccacccggccatgtacaggccattcgactacggcgagtacgccgtgttctgctacttgccggagaacatgacgccggaggtcatgaagcacgcccacaagctggaggccttcgccgccgtgcgcaccactactactgcatctgcatctgcatctgccccttaattagatggtgtagcagcattatattcgcacagagatttttaaaaagaaatgtttcatcgtcggatcaccgttgattatttgtttgttgatttttgtagtacgatatgtggtctccatttatgtatgttatagcttaaaatattgaacaaaaggtctaatgttcgtggttttatgtcttgctgaaaaatatatataccttctcacccagggtttcccttgccgccggtaatcgtggggtaccgtaggggttaccagtggtagtgtttggtgaattttatctaaatttaaaattccgaaaaaaacaaaaaagatcaaaaaaattcatggatgtagttcttgatttgtagtggcagatggtgaagaaatttttgaaaaaagagtaagataaatccaaatttgtgggcaaaaccaaaagtatggaagaaaatagaaaaaggaaataatgtaatgggccttaggttgcattgtttatccgtcacattaaggtccataagtggagaaaatatctccttggtcctctcatctttctctatccctctctctcatttcagcttcacgtggacatcataatgcttttaaaatgtgaggctgttgaattgttgttgttgaactattatgatatgaatgtatcataatattgaattgcttcgaagtctataatatagaaaaaggtcatgccgattttcttttattttacacctaaaagttaggtttgcaagtatcatactatatattcttcttattatctcgtttttttaatgaatcatttctcatgcattacgaagaacaatgaaaacaagaacatatgcatatgaaagtagaggaaaagataagtaaatggatggggatttattttaaagaaatatagtttccaggaaaactatcgagaagtttttggacaatgctgcaaaaaggtattccgttcggactgaatgatacattagttaccggatagcaagcgatatctaagaggtatcatcctgtctgaacaaagtatcagccgatatgtactactccctccgtcccagaatataagcatttttagagttggacacgtttattaagaaagtaggtagaaatgaatggtggagggttgtaattggttgagtagtggaggtaggtggaaaaggtgaatggtgaagagttgggattggttgggaagaaaatgttggtggagaagttgttatattttgggacaaatcttgagggctaaaagttattatattttgggacggagtgagtaggtatcaaacgaaatctctgagatatcatcctatccgaatgtaatactgtttggtagcatttgggttggaatcgccatccaaatttaggcttttttcttacataaactcatttaaaacatactactccctccattttaggttataatatgttttaactttgatcaaagtcaaactgctttaagtttgatcaagtttatataaaaataagtaatactttcgacccacaataaatttattataaaaataaatttaataaaactaatttggtaatgtaaatattactatatcaaatatataaacttaatcaagcttgaaacaatttaactttgaccaaagttaaaatatcttgtaacctgaaacggaactgagggagtaacaaaatttgccacgtaaaagtcagggatgatcacacgttctcacggtctcatcttttcgtttatacttatgtttatcagccaaaatttaaattttcaatcttaaatttaaagttgattttgaggtttttttcgtcgaggtttatcttttagatcgctaagaacacgtatataaaagttttattcacaaattattttgagtaaagtgcattggtggtccttaaacttgtaaggttgtgtcatataggttcttaaactctcaaaatgcatatccaagcctcataacttatcaaagtgtatcatctaggtcccaaattgacacatcctctctaggatcctacgtggcgctgatgtgacatcctctctaggatcctacgtggcgctgatgtgacatgctacctggacgtgacatgtcatttttttttctttttcgttttcgttttcttctcattattctttttttccattcttctgctcgggttacggagaaaggagaacaaagggaaaaaaaggaagaaaaaaagaaaaaggaaaaaaatttaaattggtctcatttgtcagtcaaaatgatgccatgtcatgtccgtgtggtataccacatcaacgccacgtaggatccggaagggattgtgatgatttgggacctaaatgacacactatgacaaattctgggacttgaatatatatttcgagagtttagggacctaaatgatatatccctacaagtttaagaaccgtcggtccactttactcttatttttatttttagtttgcaaatatgtactgtagtttaaacgatgaaacgctcagtgccacagcttactgctggtccggtcctcgcctgctgagtgctggctgctgcagctccaaggcaacaatggtgagtgggaggtccatcacctccggcgccgccgcgccgtgccacctgcgaccgacggaccggcacaccatggccgcgtgccgctcgcggcagcgaccacctctgccccccaaaacaagggcaaagggcccggcgcgccgctccggtaagctccatcgtcaaccgtctccgcgaggcacgcatcgtcatcccctctcctctcctcttctccgccgaggatctgctgtctcgggctcttttttttagggtttagggtacagtgctcgatcctgtaataattctgaaaaaaggcagtgcttttcgtgtctctgaatgccacatcacaatgcccaaatgccacggttgcaccgattttattccgtttctcactgtccaaatgccgcatcacgatcgcgccatgattattttttttttagccctcctcaccagctaacttttattcagataaaagggaatgattttttacagggatgggttattgggggaactacaatacaacatcactggtgaaactgaaaacaaccaagagacaggctaactaaaacatgttcagaaacatcatcaagctaaaccggatttttattcagacagaagggatttgttttctgatttgagattgcagccacatcaacatcaaagataggagatatttcagagcacacaatcttttcgttgaagactgggccacatgatgttggcaagagcaaccacactgttagttagggagaaagtgagcaattaatttaaatatataaattgcccctctgaatcttctagccgattttgtaaataaacgcacttctgtaaaaaaaaaaagatttctaacacctgggtgggtagattgaattgcaggcagaacaagtccaagtttgcaaatccaggagagaccaggattagtgaaaagccaaccaattgatgcttgtcttgacttgacctggcaataaggttaggtagccaaggagtccaatactggagggttgatcggtccgtgttctcttccacacaaatcttcttaatcatcttctttcctagctgttgatattgttcttcctgttgagaaattgacaggaattcatggcgggtgcactggtgagcgcctctacgggggtcatggagtctctccttggcaagctatccagtatgttggagaaagagtacgccaaaaaaaagcggtagagaagaatgtgctgtcctgcgaaacgagctgagcagcatgaacaccgtgatgcagaagtacgcgatgttgagtgagcccgacttgcaagtgaaggcttggatgaaagaggtaagggagctggcctacgacatcgaggacaccattgacgctttcatggctcggagtgaaaaatccaatgagcctacaggtatcagaggatttatcatcaacaatatcctgaaactgagagagctgctctcaagctgtactatttctcaagagattgaaaaactcaagaaccaagttctcgaggtgaacgatcgtagaaaaaggtataagcttgatgtatctgtgtccatgggtaccggctgtgaatcaattgaccctcgcctgccagcgttttattccgaggtaggtggacttgtcgggatcgatgggccgagggacaaaattatcaagttgctaagggagaatgcagctgatgaagattgtggatttgtgaatcgacttaagatggtgtctatcgcagggtttggaggtttggggaaaactactcttgccaaacaagtttatgagaaaatcaaatggcagtttgattgtgctgctttcgtgtttgtatctcaaatcccagatatgaagagggttcttttggatttgctttgtggacttggggcttctggtaatacatgggatgatgagaagcaactcattgacaagatcagagaatttcttcatgacaagaggtttgtgtttatatagagtaacttctactacctttctgttatttcgtatccagacttattgtatgaaacttggcccataggtatataattgtcattgatgatatctggagcatatcttcttgggagatcttgaagtgtgtattgcctgagaacaattctggcagtagaataattacaactacacgtattcttgacgtatccatgatatgttgctctactttcaatggaagtatttaccgcatcaaaccattaagtgacgacgactccagaaggttgttttgtagaagaattttccacggtgagcattcgtgtccatcacatctagaagagctttcaaaagcaattttaagaaaatgtggtggtttgccattggccatacttcatattgctagtttgttggcaaccaaatctaacacaaaggaagagtgggagttggtgctaaattcaattggctcagcacttgaaaatagccatactctacaaggtctgaaaaagatactgttactcagtttctatgatttaccaccacaattgaagacttgcttactatatctcagtatatatccagaagattgcatgatcaactccaaagagttgataaggaaatggatagctgaaggatttatcgcggaagacagtgggaagagattggaccaagtagcagagagttatcttaatgatcttatcaacagaagcatgatcttacctttcgacattactcatgctgatggtgtacaatattatcaagtccatgacgttgtccttaacattatcatatctatgtcgaaagaagagaattttgtcacgataatagatgggcataagtgcagttctttgcaggaaaagatccgtcgagtatccctccagttcaatgattcagaagatgttgtagtgccaacaaacataacaaacagaagttgtgtccgttcactcagtatatttgggattactaagcaagtgccatattttatggatcttcaatctttgcgagtgttggacttaggttattgtacattgttacagaatcagcacattgaatgtttaggaagtatgcttcaacttaggtatctggttctccattctcaattaatcactgaacttcctgatgaaattgggaacttgcaacatctagagatgttagatgtcacattatgttccatacaagctcttccagataccattgttcgattacagaaactcgtgtgtctatatgtgagtactaaagtgaaactaccagaaatgattggaactatgcaatgtttagaggagctgttccacatatcaagcaactctataagattggctggagatcttaaatgtctgaaaaaactgagagatcttgcaatagctgttgaagaccctgttgggacaaagagctctacattgagatacagggaagtagttcggtcatcccttactgaattgggcagacacaacctgcagtcactctcactgaattacaaaggtgatgagaatttcattctggattcgtcgatgggttcatgcttctcaactcagcgtctccggaaacttatcattgggaaaactctttccagggtgccagagtggatgagtatatttgacaatctcacacacttacaactgtgcatctcaaggatggaacagagtgatattaacatactcaaaggaattgactctctgatctttctccgcctcgtatttacagggcatgctcctgatggaaggatagtcatcgacaaccgaggatttcaagctctcaaggaattatatcttctatgtttcattcctgggatgtggccagtgttcgagccaggagctatgcaagaattacagaagtatcacctcactttcaagctacagaaagtacattgcaagaatagtgttttggactttggtctccagcatctttcaagcctccagcacataagtgcgataattattccatctggtgctaccagtgaggacacattggttgcagaggatgccatcaggagtgctacaagtatccatcccaaccaaccaatagctgaaatttttgtcgagtaaaaaaaatggtaaccggccagttataggttttctacgagtcaaaattctccccgaaacaagtagacctcattttcatgtgtctttgtgttatatgctcctctgttctggttgcatttgagaatgtatgcctttgttagtataaccctttcacaagtgaagaactaattacattagtcctctgatactgtagtcctaatgctctttttaggtgaggatagttgtactctaactcttgtatattactgattttatttttgtggttgtatgctaagttatttatttgctcaagcatgcagtttgtttttttttttgacagaaacatgccgttcaattttgtatatgcggccggcaaccctgtgaaagaatatcatgaactgactgaaactgaaatagaacatggctgaat

SEQ ID NO: 58654 - DNA, 1187 bp, Oryza sativa
tttgctgatcaccaaaacctgagaatagatctgagagaatagtaggagtgcacctggtgtaaattttttcttgtactacctttttacccttgatgccacttatttttttggaatttgatactgcagaaccaggtagctgcttccgctgatgcatctttcttgcttgagcagcatgaagggctctagtgaaaacagaactagagccaccaccacctgaaacattcgcacctgctgcaggactgcaaaggtgctgcaaatgcaaaaacataaacaaaacaaattagtaagagatacgatcaaaaaaagactcaaagattaggaaaaaaaatccatcaatggctgccgcgagcttcgacggcgccggcgttggggcgctcctctccggcagcctgcagcctgacactgctataccgtaccaatgtcgggttggtgctgttcatcgtcgccatggccggcaccacattcactgcaaaataacagatgaatatggcaacaaaccttggaactagagttctccatgctagacctttcaacgttatctgcaacgcagccgccggcgaggctactaatctgagtttagatgggttaagaactctcaaaacgcaaagaacggttttagatcgataatgttctgctcaacgggataatcatcctgctttctcgctttggataagcaaactgaagagcgaaaaaaccaccctgaaatatatctggtcagctgtctccgaacaaaattctatctacaacaaactcaggaatcttgattcaattttcgaatctgctacagaacagaaacaatcttgttgaccccaagggaaaaaaaatacgggtaaaagaaaacgggtaaaagtattcgattcaataaacctgttaatagtcattaccattatctgggcaaacgaattgaattggtggcggacagggagggagtagctactcccggtagtagtatataattttcctatatatatatatatatatatatatatatatatatatatatatatagggagcgtatcctatgcacacaggtcctggcgtgtacacaccgtgtacgccaactaaaaattatcgcgaaaaattctagaaaaattcatacatgtactttcaatagcattacatctacgtgcaaagtcgcatctttaaattcattctacatagagaatatcataaaagataaaattctg

SEQ ID NO: 58655 - DNA, 2606 bp, Oryza sativa
atgctctcatgcatagggtaacgtgctttcacacaatatttactattcatatattttgtatgacaggagaatatattggtgcaattttgagagaagtattctcgaccacttcacttttatttatcaagaaaatggtacggcctgctttaacttgttaaatactagatatattggacgaaccaatggctgccatatcttcgctcaaaatttgaaacatatacaattttgaaattttacaatacacagtcccttttgttgtaaatatatgaggatagataaaaccttaattcatttgcacttaagattaagattttttttatctagtacttgtttaaatgggtagttttaacccaagatattttggataggaggaattggaatggtaatttaatgtgttgcttttacatgaaaaacgagactatccatcatttattcttggagtttcactatgcaacatttctttgaagagcattgaagttttcttctggtttatccactccacatattatatctcatatttttgaaaattggattgtagggttgataaaaaaaaccaaaaaacacatcctcgtaggatcatatgctttatgttggaccgtatggttgagcaaaaatgatatgatttttgataaaacatcatctaaatcttattttagatgcatttcagggcaacatattggtttcgatcacgtgctcatgtataaaagtgtgatgaagacactaaggctgtgttcccctcctccccgacacgcaaaacgaagctcgtattattgcatgattaattaattattaactatttttttgaaaaatagattaatatggttttttaaaacaactttcgtataaaaagtttttgcataaatcacaccgtttagcagtttgaaaagcgtgtgtgcggaaaacgagagaagtgggttgggaaaatgggggaagaacacggcctaagagcaggtacaatagcagactatttactagctgcaataaaagatgagagagaaaagcagcggactatagatctgtagccagctatagcacggactataagacacaatgtgtgtatgacaggtgggaccatatactaatagtatagtaagcaattattgtatgaattagctatttgattggctatagatgaattggatctagtagtgggctatactattaaacttgctctaaggctttgttcgttgcccctagttcccaattcacccatctagttttccgcgcgcacgcttttcaagctgctaaacggtgtgtatttttgcaaaaagtttctatacgaaagttgcttaaaaaaatcatattgatctatttttttaaaaaaattagctaatatttaatgaattacgcacaaatggaccgctccgtttttcatgcggggacatgggttgggggttcccaagccagactgccgaacaaagcctaagttaataaaagttgcatgtcataaaatggagtcaatggctatgcaactattcacaaataggattcaataagtttgtgttttatttttctattggtgttagtaccagtgtgcacctctatcggcttggatgcgttctttatgtctttttgtgaggtgtgattgtgtgtagaatttttttaataattggttatagctctgtgagcaaaatcaagaattctattctattattaaaaaaactagcatggtggcccgtgcagattgcgcggctagcatcattatatcttctcgcatatatgttttctcattatattattcaaacatattaaagtaacaacatatttttaaattttgcaaaaactttacaaaactactaatgtgtaatattcatattatattttatgtacgtgttatttattaattatttttaatatcaaattttagttatttgtaaattatatatattccaatatggactctagactcgtattataatatttctttttttaattccgaattttttctgtaaattgtatttctatatagactctgtgctcttcttccagtattatttatttttatttctgaatttttattatttctaattgtatttctttgtggactctaaactcatcttttaatattctttaatttttaatttcgaatttcagttctttctaaattgtattcctatattgaccataaactcttcgtcccatgtttttcttaatttcgaattttagttatttttcaattgtatttttatacgtactctaaactctacttttaattttactatgtttatttcaaattttagttagtttgaaattcctatatggactctatactctacttctaatattctttattttttttaattctgaatttctattttttttcttaattgtatttttatatggactctatactctacttctaatatttcttatttttaatttcgaatttcagttatttcctaattgtatttctatatggactgggtactctacttctaatattccttatttttagatccaaatttcagttatttcctaattgtatttctatatggactctagtctcctcttctaatattccttattctttaattccgaatttcatctatttctaaattatatttctatatggactctgccttttctttttctacgattaatgtgag

SEQ ID NO: 58656 - DNA, 2143 bp, Oryza sativa
tttacctaaaaagtatgttacatagatatttttgaaagttacatataagttacatgcgagttacagtgtaattacatcacgattatactataattacatctgtcaaatttttaaaagaaaatttatcgataaatgtataggtgatcccttactaactaattaatcacgtgttttaattaataaaaaaggattttacctcgacgaagcagtcatgaaagaagaggcggacgagccctgcgccgatgccgcggttggtgtacacagcattcttgacggtgtccttcacaatttgctcagcttttgggcaagaggaactgtaataaccaactctaagccctagggacggcgggcttgggcttgccggagccgggctcggaggagttgggcttggtggaagataggttgtcggcgggctcgggctcaccggtgctaggctcggaggagtcgagctaggtggaggataagtaggcggcgtgctcgggctcaggcttggcgggcttgggtatgtaatgggtgtgggtgggctagcattgccggtatagccttggcatgtcacagagcccaccagagccagcaatgtgagcaacacagcaagcttagccatctctgattctctgcactgaactctgaagtagctacagtgttctgaaactctgaagactctgaactttttgatgaaatgcagctgcttctgcatctccatttatagtcagtccccagccgaagcagagaagaaacaatttggctggcacgtcgcggtgacaaatgcgttcgaagtcaagcagggaacatgggaatcgaacagctagctaggctagttgacatggaggtttctttgattaatttttgccggtaagctgcagctgcactgaacaagtcgacggtctggttggtttaatttcagaggtttttcgtcttgcagcgtatgttccatggatgggttgtttattgtttctgaatcaaatttatcacccagatttatgttcttgcggccgttgaattggcagtttggcattggttttgatgggactcgtccacgccagcgcctacttcccggggtggtggaacgccaagttcgcataggcgatggtgaagatgggcagcgtcaccgtcaagaccgccgccggcgagataaggaagcagtgtcggttcaccaaccaggggcctgtttggggagcttaaaattctgagaagcagctagttggtagccagcttctaagaatcaaagctgggttttccagcttctgtcttgtagttcattagctggattctacaactacagcttcttagaatctaaaccaaaagctagactgtttcgggagcttctaattctgagagaagctgcagcagttagaagctcctctaaacatgtcctagtactaatcacgacgctttacatgcatgcctcaagccgagccagtgaacttaatttagaacaataattatctagattatgtgtcacctgcgataatatttaggatcttatgcaacttcgattataaaacgtgagatttcctaaaattcactctttttatatggtctccattgatcccacaacaaatttaatcggttataaaattacacggccaacctccgctagttttactaatacgactaactaaactttacttagacatgttcttatgtcatatataagggcatgttcacggctggagcctggtatatactagtaggcaatacacgtcacttaagattataaactatactcaatttctcaaatattataagagtatagtttatagtttttctattttctcatgttccctaccctatagtaaaaatttcttctataaatactaagagtctatgtttagcctgtgttaagcttaaatgtttgagaaaattctctctgtacccctaaaaattcatccaatcccttctatacccctaagatttgctcattcccttccataccccaaaatttcaatttagatcccttctataccccttccgttagttgaccattagttgaccgttaaattcatatcataaagtccattttaccctttggtatcaagaaaatataaatttatgaagtatattaatagagtgtataaatttattgtatacgattattatatttatgagtttattttgtgagatattatttaacaaaagtaat

SEQ ID NO: 58657 - DNA, 24257 bp, Oryza sativa
  unsure (1)..(24257): unsure at all n locations
gagttagaaaccctagtctctctcctcatttcttctctctccccgacgccagccctagccaccgctacagtgctcctagtggcgatttcctcttccaaccatgaaaatttgattcttctccatggaatcaaccacattggtggctaggcggatcttcctgtgatcgttctacgatttactatcaaggtagcactttttgattccctctctcggttcattgtgttttttatcccgatctctaaatctgtgaacctagggagaaaaccacttggatagtcttgttcctgctaccttgtagatcaccgatctataggatttgttcacatgcactggctatttttgagacctctgttcttcatttttgccggccggaagttccggtgctcttgcacccggaacctccgggcgctgtccagccagcctgcaattcttgattctctcaaattttgcctaactattgcactccaatttgttgattcctgttgcagtaagcactatgcctcatgagaaaagacagaaagcctctcaggatttgtccggtgatgagagtcctcctattcggtttcctcatggtcgtttgggtaaagagaaagtggttgaaggtggcagtggcagcggcacccgtacttctcctaggtttaccaggcaatccagcaaccgtccagttcagattcgagatattgacagtggtcaaggaagtgatgctccatcttcaagaggtcatgggagaggtggtggtcgcacttctggggctggaagggcctctcatgatttccctgttggatctcgcgagaatcccgttcggctctacaagactcttggatttgacaccactcctttgcaccacattggaagacccaagtccaactaccttcatcagcttgctaagtacagaagggaccgtttgattgatccagagacatagcctgaggagtcacaggatcctcgtttcaggacgttcacccaattggattggtataactcagtgattatggctagagacaatccagtggttgagatgaagtggattgattggacttacatgaggaagaagaacaatgaagtgttcaaccaagcaatgcaagtttgccacaacaagaatcttggagatattcttgccttggagtatgattggaatgaggaggtcattgcacaattctatgcgacagcattctttggtactactaagaagggaactccttatgtaaagtggatgactgagggtgttaggcataagatttccatagcacagtttgctgagatattgggcttagaggatgaggatctcaataggcctaatattcatagtgaagcacccctccccatgatcaagactaagttcatgtatactaaggatgctcctcggacttgtatgggaactactcatggtttgcatccaaactacaaggtgctttactccatctttcgttggtctctgcttccaaaggttggagatgctactgctttgccatccaagcatgctcatcttctcagtcgcatgcgctagnnnnnncctcctttcagtgtgatgaagttgatttggtatgagattgccaacaccattcttgagcataagcgaggttgcatttatgctcctttcattatgaagatgattgagacagtcaccggagtgttctacatctgtttgatggtattttggcgattatatgtgtacacaagacttactcatgatggacaaagcaaacaagcagtttataagttggctagcttatcatttctacgcaatgcttggccatgtatatacacgcaaattcatgcatgcacaggcagctgggatatatatacttggattagtatatgtgcatgtatagttaaccaataactagccgtgtgaagattggctggtgaggcaatcacgtgcatgcatgcatgtactacagtagacggtcgtatgtgtgtgcatgcctgggtgattaagcaacctatgcatatccgagtgattaatcatgggctcggcccatggccgaagacgatagctgcctacgcgcgggtggctggacctctatcccgccaagatttcataagttaatatgtggaagagataaaaccagatgagttaagagataactaacaaaccaattgattttatctctataacaaacttgatcgagttagttacttcgcgcgatcgctggcaaggcgcttatcaccggactgtggcccagcagcagagaaacaaagcgaattacaaataagatatttgacgccaggagaagctaagagataaaatcaaagaaggatatgaacaaataacaaactgatcgatcaagccttatctgcaacgaacttgacgcggaggaaacagcgcgcgaacgcggcgagcaccgacctcaggcccctatataaggcgtcgacccctcggcagccgggggcattcacgaactcatccacacattgatccaccaatgcatccagtatccacaagccacccatcatcaacgcatctgcccatccagcatcaacacatccatccatcaactctcatcggtgatccatccatcgacgacacgcaccggcggcggcgagcgacttcggccggagtcccggcgtccggcaggagagggcgcgcgcggtgatccgatcatcagcaagcgcaggagaggagcttgatggctagtcaaggtaaaagctagcaagattgtttcgttttctttcatctacagcacgcacacatccatgcatagggatccatctgcacgtattgtcatcgccggggaagtcgcggtggccgattcatctatgcgtcacagaagcctcatcgatgccggcgtctgttcgagccgacacagtgctacttgtccctggactcgaacctgctaattcaagccgctggtgatgcatctactcgaagctgcgacctcgccgagatgccggacgtccttgatttgcaagcttcaccgcactggaacgggctaaccatggaggaggtcgtcgggaagccgccctgccggagtgcaccgaggatcgccggagctgccgccgactgccaagatttctatccgttcccatgccggaggtcaagcatcacgcatggcgtcgaaaccagcggatgacgatagaggcaagtatggctgcagtacagaggaaggacgacgggaggacggcgagctagtgctgttggatggcaactaatgcaatgttgattaagttaattattgtggcaacgtggccaaccaatcggaggacgacatgtcatcgctgctacagtgccatgcacaaaccaatgcgtgggctgaagaagtcctattggtttttcttatttgtcccaaatgagatgccgagctttgattaaatccggttgccgtctacatcaaccatcttcaataatttctccctttcctaatctaatctcgacgcaactgctatgacgtcaagtcgttcaagctacgcaacttcatgcatgtcttcactaacaatctacatccacacgttgttcaagaccgacgaggctagacgacagaggacgggcgaagccgatacgaaggccatgctaccaacaccggcgcatggaccgacgaggccgtggatcgctgccggcgctcacacatacacatctacatcatcatcacaaccatgcatggagaacgcgaagcgaagatgacgagacgaccacaagcaacttaatcggaggttctcttgcaggtctagacctacgaaggtaattaactgggagcttttcgaggccccaagaaccaggagaccacatcgcacaagtcagatctgtccaacgatagattgtggagcgcatatacatatatattacattgggaattcgtatttatgatcttttaagattagtaaagagcatgttccttatgttttgtttacattgtgtattttctctctaaacatagagggatacatatattcgtatttttctatcctaaacaacatcaaagatgggtgccacaatccttttcatcctcgtgttccaccttcctcttctccagtggtacctagatccatcccttctacctcagctggtccttcttctagtgccccaccgcaatcctcgagctcttctcccatcaagaaggcacttcaggcgatcttctgtatgtgtgctaagactgcaaagaaagtgaagaagatcgaaaggcgtcagaaggaagatagaagagaggctgggaaagaagtgtcagatgattctgaagatgaggtctatgtggatccttttgaggcttatgaggcagcccgcaacgttgccggtgaaggtccatccacctatttcaatgaagagtcttcccgatcagatgatgatgatgatgaggatgacgccgaggcagctgctgaggatgctcccactaatgttgacaccgctgcacagtccgatgagtctcatctctccagcgataccgaaattgttccctctgatggagatggagatgagtgatcctcttcttctcttcatggtttcttgctttttggtgccttgatgccaaagggggagaaattgtgaattgaagggggtcatttaaatcattttgctgccttaactgctgtctggtcatttggccggaagttccgggtcctgtgatccggaggttccggccaggcagattccctccctattatctctctctatggacatgtaatcgtattcttttatggttggatgtaatgaatgttagatgctttattatcctttatgtcagtaagttagaccatatgaatgttgcattttgatgtgatgtagtgttcttttcatctttttgagtgattgccatgtcatctagtctttcttcttgcgtatcacacatcttttaagcactcacatctgcatcttatttgatgagggtagtgtgaagtttcttttgaggtttccttcatcttatgcatattgtattcatctcatttcattatatgcatatctttagggggagctacatacttctctcatcattccaaatttaaattctattatctttttgtgtgctttaaccatgttgtcatcaatcaccaaaaagggggagattgaagatgcacttaaaccccctagtgggttttggtgattaatgacaaggtggttaaaggggactaacgtgtttgtcaagtttattcacaggagtttagttccaaagcaagttgtgatggctaagaatgcaaggagaccccccaatttgaatgttcctaagtgcgaaaaacatcgaaggtgattagactaggtttttcactttcgaaattgagtgtaggaaaaaccatactattaagaggggtttcaagtgtggttctagggtatacaaagtgctcttagtcatatccatgagtctaaaggtttttggaatcatttttggaaatgattttccctgggacagagaggcctacccggaggttctggccggaacctccggacaccatagtttattttctccccgggacagagagggctacccggaggttctggccagaacttccgggcaccgaagtttagctagatttttcctaagtattgcccagaagttcctggcacttttgcccggaacctcctggcaggtttctagttcaaacttgtgagtaacggctagatgacgtcacctagccgttatatatatggatttcgtccccagatcaccctttggccattccacttcagctctttcatgttctagggttttctagccactccccagcttcctttgcttcctccactcaaatctagagcctatcttgtgagattgagagattagattagagtttaggagtgttttggagatggcttgaaaattaggtttgattgagcactttggatatcttgtgggctgtcacttgggcttattactcttggagatcttctcctagacggttaggtgtcgcccgtgagcttcaaaagatcttgtggatgtcccgggaaagtttgtgaaggttttcctcacctccgcaaggaaatgaggtaagtgagtaaagattcttgtgctgagttttcagaggttgtcctaggtagagcaacttgcacttgtggtcttttctagaaggaattgtgagttggatcttggtggtcactcaattctagaaaatgacctagaagtgttgagttgaaggctgtggactccttctgggatctttgcataagtgaggcaaggggttaatcgagacccggctctttgagcacctcaacggagagtaggatccgtgtgatccgaacttcgggaaaaaaatcgcctttgtctctcttgtgcatgatctgtgtttgaatctactggtatcttgagatctacatcttgtgcaactctgtgcctgatcatctctagctaggacctgttttacttcccctaatttcgcttttctctgttgcctggaagttcctggctcaagaactccagaagttccgggctactcatcctacccggaagttccggtgttcatcaccaggaggttccgggccctgtcaatttaaccgctgcaattgttgagaaaatttcaagaaagcctattcactcccccccctctaggctacatctctgcacattcaattatatgtacttagtctagttttcctttaaccagaaacataatatctgaaatcagcagccaataattgtgtcgcttgaattttcgcacacatcaccaccggcgataggcgtcgaaccaaaacagaatataatgttgaacagtaattgagctgtatatcagtaattcgcacagatcttgccaccgccatagccattgaagacaatttgacggagacatagatagatagatgagaaaatatctcgtcaaaacgatcaaataagtgaatctgtaaaaagaatagacataaaagttttctgaatacatgaaaaaatctcgagataagaaggaatgaactacattttaccaaaaaatattaagtccaaacttattttcatctggttgaaagaaaaaaattcacatgaatatggttatgattttgatgccacaaacattgcagtacatcggaaattaaaaacaaagattaattttgtagactgtatcatgcttaaccatgtcttatacagtaggacagatggtgtagttatatcgtaggcaccagttcgcctcgtacccctttaaattgtaaatggatcggaataattcttattcatggacggattctagagagagcaaatgatccatatattctgatagctgcaatgtatgagaacaacaaaaaacaatgctccaagaactgcaccgtttttaaatattgaacttacgtaagacatatttggtatgctctctccactcctaacatgtgaatcggaaaatttgtgtgaaagcacatcgacaaaagcatgagagcccagcatgagaaagatgatccgatggtcatttgcaaatataaatggcaccaatgtatatggttaaccattattgcttctctatatctaaattcaagacatgggaggaaaccaaaagtatttcattaaagttagtgtttcagctttagctatgatataatcatttccatgttatttgttttttcttagttttaacacttaccaacttaattgtctactactaaagattgtcgagcacatctagctggagtggagaataggaatgttaaacggataaaaaacttaacccaaagagttttgcttaataatatgtattggctaattggggctggtgtagtaggccaatatgagatctatgcatacagaagttatagtgggaaatgtgaagctataaaacactgtacacaggtgagtatcaaacacgtagttgataagttcgatcattgaactaattaagcacatgacattgctaattatgctttaatttgtttcaattcaaaaaatttaattttgctatagatagtcaaatattaaattgcatagatggaaaggaaccgctagttttcatgttaattagattagccaacgtccgtaaacatcagcacaatatgtgacaatgaaatattaaatgtcatcattcattcattgtttctcatagcaagtttaatagtatagccaactactaacttcaaatcatctatagtcaacttaatagccaattcatataatagttagttacaacactattaatatctgatcccacctgtcatacatatattgcattttggagctgcaactgactacaaatctatagtatgttgttcttctttatcatcttttatctccttaaaatatatttatagctaacttatagtctgttattctacctgctctcgtacgtccttgtctgactcgtataaacctcatttgtaagtcctcactataaggctacaggacggggtaagtctgatgcatagatggatccacatgcctaagatgtgtgaatgtgtttggacttcgaagccgacgtgtgcttgacatgggggctcgggacagatcagagaaccaaatggtgtcattctgaagctgtttggatgattgtggtctcattgacctcggcttcacgggggccaagttcacttggtgcaacaaacaagatgcccaaagcaatgtcaaggtccgtcttgaccgtgcggtggcgaacggtgagttctcacatctttttgatgactattgtgtggagaatgtgaataccactacctccgatcaatatgcactcttaatattgctttcaggaagggccaatagaggtacgggagccccgatacagcagagctttcgctttgaggctgcgtggctccgtgcggaggactataggggtttcgtggagaatgcttggcctgagggaaggatcgattctccccctcttcaggcagcatggtctaatctccaacggatggccgactctctccggagatggagtaaattgtcggcaatgtccgtaagaacattcaaaaactggaaagaaggttaagttcgctgcacaccttacatcccaatgataactctgtcgaggaagagaaattgattgagaaacagctttgtgaactctttgaaagagaagaagtcattgaaagagaagaagtcatggcaaggcagcggtctcgagtggatgggctgaaagagggtgaccacaataccgctttctttcatgcccgagcatcggcaaggcaaagaacgaacaaaataagaatgctcaccagagaagatgggtccctatgcgaagatttggaaggaatgaaagggatggcggaacgtttctatgctgatctctttgcttctgagtgctgcgattcgatggaggaagtgttggagtccataccacgcaaagtggatgatttcattaatgaggagttgtgcaaaccttactccaattctgagattaaaatggctctcttccagatgggaccaacaaaagctccgggccctgatggcttcccagccctcttctaccaaacacattgggagtttattgaggaggagatttgcagtgcggttcgtagcttccttgctagggatttgattccggagggcttatgtgattcggtcattgttctcatccccaaggtcaacaatgcaactcacctctcaaagtttcgtcccataagcttgtgcaatgtcctttacaaaattgcttcaaaggttctgtcgaatcgtctaaagcctttcctgccaggagtggtttctgagttccaaagtgcttttgtaccgggacgactgataacagatagcgccctagtgtcatatgagtgccttcactccattaagaagcaacagtgcaagaagcctttctttgctctaaaggtggatatgatgaaagcctatgatcgtgttgaatggtctttcctgcatggatgtcttttgaagctgggcttcgctgatccttggattcaaactgtcatgcgatgtgtcacctctgtaaggtatgcagttaggatcaatggagagctaacgtatccggttactccgtcgaggggtttgagacaaggggatccaatcagcccttatctctttctgctctgcactgaagggctgtccagcatccttcaaaagaaggaatcaatgggggtgattcagggcattaggaacggtcatcttggcccaccaatctcacacctgctctttgcagacgacagcatcttctttgctaggagcgatctgcacagtgttcaagggctgaaagatgctctccaagcatactgcaaggcctcgggacagaaaattaatcttcagaaatcttccatcttctttggtcagaactgtcctgaggaaataaagaactcggtgaaggagacactccaggtttcggttgagatcctccaagacacgtatctaggcatgccaactgaaattggaagagcgtccattggctcttttcttttcctcccggaaagagtgtggagaagagtgaatggttggaacgataggccgatgtccagggctgggaaggagacgatgctcaaagctgttgcgcaggcgattcccacctatgttatgagctgcttcaagctgcctgtgacaacttgtgagaaaatgaaatcatgcatccttgaccattggtggggcttcgaggacgggaagaagaaaatgcattggcgttcctaggagtggatgacgacgccgaaatctctggggggggggggttgggtttcagagacctgggccttttcaaccaagctatgcttgctagacagggttggagaatcgtgactgatcctgattcgctctgtgctagggttctcaaaggaaggtacttcccgaactctgatttctggaatgctcccaaacccactgccgcttccttcacctggcgtagtattctctttggaagggatttgcttaggaaaggtgtgaggtggggcattgggaatggctcttcggtaaaaatcctcaaggatcattggataccgggaatcaaaccttcgatggtgagacctctcctccctatgcctgatgatgtcacggtggacttcttagtcaatgctgcgattggggagtgggatgaggataaggtgttctctttctttgatgaaactactgctcaacagatcctacaaatccctgttagtgcacatggaggagaggatttcatttcctggccacacgacaaaagaggggttttctcggtgcgttcagcttacaaccttgcaagatcagaaatctttatggctgcgcaaagtgaaaatggcaggggaatgttgtcgggtttacaagagagtgcaaacagatggaaggaactttggagaatcaatgccccagggaaaatgttaaccaatctttggagaattgtgcatgactgcttgccttcaggtttccagctgagaaggcggcatatcccagctactgatggctgttgcttctgtgaaagggatgacagaatcgagcacatttttctcctctgcccttttgctgtatgtatttgggatagcatcaagcaacattttgatttgaagctatgcatgactgatctgtcaaatatgaagcagtgggtttttgatttcctggggagaagttcaaacatccaaaagacggcgctggctgtcacgttgtggcatatatgggaggctagaaatcattccaggaataatcctaccttagctaatccaagacaggtcatccagaaaatcttggcttatgtcgagatgattgaacaacactgttgctgtgctgtgcaggcggttaggggtgatgctcttcgtccagttcccagatggaggcctccgcctgaaggtacgattcttattaatacagatgctgctgtcttccagtcagtcaattcttttgggttgggatttctatttcgggatcacagcgggctgtgcttgttcgctgctaatgagcgacactcggggtgtatccaacctgaaatggcagaagctttggctatccgctgtgcgttgcgcacggcgatggaggagggtcaccagaaaattgttttggcttcagattgcctagctatcatccaaaagattcagtctggagcacgtgaccgttcaatggttggcgctcttgtctctgacataaacttcctggcggctggttttttggattgctctttcattcatgttaatcgtgtaactaatgctgcggctcaccttttagctcaatgttctgagcaaacagtttgtaatacctaccgttctgtaatcccagagactcttcgggaggtactgctgtctgatcttaattaatctatgagaagctgcattatctcaaaaaaaaaaccttttgattttggcccaacgcaacacgttttccaaaagtgacaaccatgatcactacaacgcttcagattcattcacagatagtatgccaacacatggatggagactgccgctagaaagcatcgctatattggcggaaggaactacggatcggttcctgatccatgacaataaaaacagggcggtcaactatttcagttgactgcccacgaaacatcaaagttgaaaagaaaaaacatcaggtaacggaaacatcaacttagtacaacggaacaaagctagatatttttacaacgggaagaaaaaaatgatttcctttacaacggagtatacaaacaataacaacgaaaagaacagaacaagtaaaagatattactacgaacacagccatcgaaatccttatttctgcaacactgaaacattgttactgcggttattgcaacatcaaaatcgaattagtgcaacatgaaaaataatcgattacaacattgtgaagcaaattgcttctgtaggttaggactgtcattataaacaatccaatcatcccaggaagaaacacaaatccaagaaaaagcaatggccacgctgggcaccaccaacaactccacttctcaccgttggtcatagactcatagggcgcttagagctcgccgcgctgcacgagcagtatcaccacccggatgtgatgcagtcacggccggcagaaacaactggtacaaaggatgcggatatggcactgtggccggcgatgcccaccaccaccaactcctgcagacgctatgcaacaccactgcagctacgcgttcgccgccgctgcagccacgcatcgcctccgccgccgcatctcaacatttattttgcatgtctgtatggcaacagctaataaaatgcagaaatcatctctctcgtttaactagcaaaatgaagcactagcgacgaattgcccccacacgcatcttctcctccgttttctattccgtgctgagaatcaaggcatggatgcatgataggatggcggaaaatggatgggtgcaactactcgactgtgtttctcccttataaataatagagtaatagagtattatccatgacaaacatttcatattatctatgatagagtaatagagtattatccatgataaccatgcatattatctatgatagagtaatagagtaagaagttgccttcgtgcagagccatgttgctctttttttagattagttaatattttttctcaattgtagccaatattttattacgaataattccgctagaaattttggttctttcttatttttcttattacctattacaatatacccatgaaaagtgccttctccaacatttattgcccaagcggagagcggacggctttcgtggaaccatggagggagtctcaatcgatcttttctaagattccaactcacatcacgcgtgaagattaacattgatatgatttatatccttagttttgtgttccgtatgttctgtgttcgctgaggtcaagtgtgctgtgaaatttagcgagaggttcgtgccgtgatgggccctagctggtttgccacttttgcaatgctcctcggagaagagaccagatggtgataggccagttaggcctgaccagcacaactgggtataaaaacatggaataaggtcactttcgatctctcaatttgtcatttagtctgaaattcatccatgaaccaaaatactagatatagctaattgcccaactcacaataccatgttaaatttggtccctcggtagtatagtcatcggtttttgctgacgtggcgagtgggaccactactatgaaatatcaaataggtatcagcactataggtgccggaagtgctaaaaccgatatctataaaccttttcccactaccgcgggttgaaatcgcaaaaaacatgcacctttaaacaattataggtgccggttctaaataagaaccaacacatattctataggtgccgaaaaaccgacacccatagaaatcgagccgagccggcaggccccaccacaacgagtagataaggtgggtctcgcatctctctctcgtctcctcccttctctctcgctctcttctcctcctctccaactcccagtctcccacctctctctctctgaggaagcggcgggctagccgcggggaggcatctaccggcagcgggctcgcggaggggatgcgacggaggactcgctggcgggaggcggtgttctagccatggggaggagccctcctctccgccatatctggtgggaggggaggcggcggcaggggcagcgggctcactgggggtaggtggcgtcaggcgcgcgggctcgatgaggggaggcagcggagggctcaccggcgagagacggtgatcttccgcggggaggagccctcccctccgccagatctggcgggaggggaggcagcggcaggggcggcgggctcgccgggggtaggtggcggcaggcagtgggcttgcggaggagacgcggcgatgggctcgccggaaggaggcggcgggcccgcggaggagacacggcggtgggctcgccggtgggaggtggcaggctcaccggtgggagtcagcgggctcgtcgacgggaggtggcgcgacggctcgaagacgaccgaccgtgcgacggcaacgatggcggatcttaagaggtgtgattcttttttttattgcataaatttgagtgccaaaatttgtgttgtggatgaatgttggatgaatgttgtgtctctagatggacgaccgtacatttccatgaattcatcttctagctatcatttgccatgcttgtattagtgcatctttaagggtacgtacgtattaatctttatcaagtacgtcccctgtcttcttcttctggatattttattttctttgcacgttgggtaatctcgtcatttggaataaaatatcacctcttttgatccggaaattataaaatattgtcttcggtgtcctacagttaattacataatttttagagtgtccatcagccgtgtcatgtttttgcgttgtctctcagccaattacacattttttttagtgtcttgtagtaaattttgcatttcggtttagggatgaatttcaaactcagcgataaatagaaggatctaaagtgaacttttccttaaaacggaccttgtagaaccggaagttttgtatcctgcttgctcggcccatctacagatggaatacggccgtagcccgttagaggtaagaatttttttcgtttttagatttttttttaatatttatagaaataatctatcgaccaaaaaaattgcagaaatagcccctgccgccctaatggtgggcggcaagctgacgtggcagacggtgggtcgaccgcgccatctgccgccgtcggccaaaattgcgattaggcccttgccgcccatacagagggcggcaaggggctaattgcaattttggccgcccataaagagcttgcggccgtactttttcatctgggtctcttgccgccccaatagagggcggcaagggacccagatgaaaaaagtacggctaaaagatttttctatgttatgttaataataaataaagaagtatttattggtaaaacttgttaatattgttataaaaacgtattgaagttggttgttgctcaatttcatatgttaagtgaggtattattttgtaccttattcgacgtattagtactcggataatttatataggcctatcgcagtctgggtcgtagaaacattatatagacttaaacaaggagaattatgtaacatgaagaaatagtagtacaatttgaacatgatacgactatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggattcatgtaatcaaaatattcttaacatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtattacgaagaataaagcgattgcccatacggaatgaataagcatatgcagataataaaatacctcacggtcatagttagggcacctaaaacagcgccttcctcgaatatcaggattcctcgaagccattagttggcatcgatcaccgcataggcagagaggacgctggcaccaaggtggtagtaggtatacacaaggatcgctacgccagtttggatcctcaacaccccggcgtctagccattgacgaaagcccgtcggatttgtaatgaagcaagtggggaagagagtactgaatgtgactgagttctgaaagattgtgaggcctcactcgttaaggcgacttatataggtgcaaaaaatcaagtgatacccctgacatgtgaacgtggtggggtatggtgggtacgcctgattggcgccgaaagatacatgcatgatcggcgccgaaagttacattggtcgtatgcgccaaatggcgggcaaatactcgtatcacacgcgaataaaggaggctgcatcggtgcggcagaaagtagtcgtgcatgcgccgaaaggtatcgtgcacatataacaacaacgtagtcattacacaagcatacaatactggaaagtgaagcaagtaaacaaagagaagactgctctactggccctgccccgcgccgcgaccacgcttggtcctccgggcctgtgctcgcacgtggtcctgggagtaggtgaaacgatccggtagcacagcacgggtagcacgagtgtcccgcggaggagtggcctgcgcctggtcctgtgtctgcaccggcggtgcgcctcccagctgtgaggggccaatgacgtcctctgtcgagcctgaagcgaagtcgaagtcagtgatgtcgaagagcaaggtggaaggcagcaagcggtccgacgaggtcccagcatggtccagtggtggaccctgactcgacgtgccggctgcttgtgacgaagtcccggtgtactgccagaactgcgctgagtgcgaggttgacacagctgcctgagacgctgaccctgcagcctaggagaagtgggcggcctgcgtcatagcgaaccgtcctacacatcgacaacaggacccttgtaagctaagacataaaatgtatgtaaattgattgtcgaagtaatgttgtttttttaagtacctgtggggggcacaacagaaggcctagctgagaaaggcggggtgctgaacggtgcacgaaaccctgaagcaatcggcaagtgaaacggctcacttatatgtgcgaggcatgtacagaaatagtaataaaaatacttacctccgtgcggagggggagtcagcctaggaacgtgcgcagctggacggggaccagtcggtacgggtggccgctgtacagctgcatgtgcccgagcaacgtcgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaacgatgacccggttgatgtcgtcgacctacatagttaatttgttcgtaaatattcgtaaaatttgacgaagagaaagacatgaaaacataaaggaatggtgcgatgcagggtactcacagcacgagcgaagtcctggtcgtggtgcctggcatagaggtctctagtgctcgcaacgtggggctgctgctccaagggagcgaaggtgaccctactacgggtgcgtggctggtaccagcgtaggtaggcctggtacgactcctcagtgtgtggctctccctcgtggtccacgacctcctcggttgtgagcaaccagtactcaacaaaagtcgccaacttggcgggccaggcgggccagtcgccagctgagtgctgacccttgcgcgagtacctgcgaattaatgtgtaatattagtgtgaaacgacagatgttacaaattattgtgaacaggcagattttaatgcaacaacggaaagcgtagtgcaagatcttaccggtgaacagcagctgggacggtggtcggaaacggtactggaaagggctgacggaagccgaactgccgcatcacacggaaaggggcgtgaggctcaacgcagatgtcgaagaccatcggaaccgtagtcatccagtacgcctggtccctggtgcagagtgtggacagacccaacggcgcacgagcctgggtagccgctgcactgtagggctcccacacgacgtcagtcggcagaaggcggtcgaactccataacaaactcaggatacgactgcctaacctggacgtgagcccatcggcgctgcaatatgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtctacctcagggcggccgatcgcaatcctctcagctgcccagataaaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcagcgatgctcctggcgtagtgcacgagtcccttgtcgacggcgtgcccgtgaccgccacagaacatcacccagccaaaaagccagagcaagtacgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaacactcacggtgaactgaagcagccacctcttcgtaggtccggtgttgcggtggtgtgctaacggctcgagcgggaggtgcggtgcgcgctgtactagtgcgaaacgtgccatcagattgtcctgccagtccacagccgtggtcactggcccaacagcgtctctcgcgagcggtagccccaacaagtacgatacgtcctgtagggtaggggctacctcaccgcacggcaagtgaaaagtgtgcgtctctggcctccatcgatcgaccaaagctgctaggagggacctgtccacagtccatcgtctggccgggtccgcgtcgccggccgcagcctccaccagccgacacatcggtacgaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtaccatctctgaaaaatatagtgtttcgtgttagaacaattcaaaaaatagtaatgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagtccgacgttacatcacgagacctaaagacatgacatgccgaagtctgacattacacgacgaaacataaacacatcgataagatcgaaacgaattacaagcaaatccacatgccgacatagaacataagaactacaccacgtagccagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccatgttcatcgcatttgctgcaacgcttcaccctgccagtctccgactcgtccatatcattgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttggttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactacagctcgatgtttcatggcctttttacgcaactcctctagctttttctgcatgaaagctccaaacaaaatgctgttgttcggcatagagggaagaactgcctggaaccgatccgtaaaatacctgcatgtcccatgtaaaatgaactccactatgccaactagtggcagtccacggacaccgcgcatcacccagttgtaaacttctgtcaaatttgttgtcataattccatatctagcaccacctatgtcatacgccttgccccatttctcttttggttcatgcagaatccactgagaaaatttccgaatctccaatccagtttttctaaccaatgttggactatccgttgggagaggtccaagagcttgaggaggctcagcaacggcggtcgatggagccgctgcacgctgatcactgcatttggctgtcaactcatctaatctcttccaaagctcattgaattttttctcctggttttgattgcacagcctcttgaacatgttcatgagctctttgttcttgaattgcttgaagaaattagctcccatatgacgcatgcaccacctactctgtacatcttcccaaacaccggggtatactcgttccatactcccaaactgcaactcttctatcgctcgcagaatgccagcgtgcctatcatgtatcaggcacacatttggcctcataccaacaacttttgttttaaccaatttcaggagccagtaccagctgtcggtattctcactctcaacagaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgctaggatgttcaattgaggggaatttcttcacttcgtaagagctcccagggtttctttcctcgataacaccaagcaggcgtggcaaattgtcatacgaggcttcgtaagttcaaaatctcatctctattattttctgtttggccctccagaccttggcatagctaatagtatacttgtatgtctcttcgatgtgtcggattattgaccttggttcatatgtgagattatcgatgacatgcacatacatctcagatgcaacaaatgcacaagtaatgttcctgtggtatttctgaacaccaggtagaaaacatgtatgcttggtaacgactgacactgtccaataatccttccatttccccttatacgcgtacactctctagggacaaccatctttttccttaacacaccgaacttcatattgcgaccagttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgccaactggagctactagcccccgtcctctcgtgcgttgaccttctccacataagtctcgtttacttcagcacttggtccctcgccatcatccatgttcatctacacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctcaagccctttattaaccatccttttatagaaggtacactcctctcagccggtctatcaattcccctttctgatacaataaaatctgacagatctaccccagttggcccgtaacggacgtttcctggtccatggtaaacttggaatacttgtttgttcgacatatctgtcaacgaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaacactaaaaatataatgcatttattcaaacaaatttttaaagaatacacgctatttaacttaatagtcacatatatgatctatgaatattacctgaaattggcgtctgaatccggcagggcttcgccccttcttctcttctcctcccctctcttcttttttttttcactggaattgaggagagaagaatgagggctgggggctgggcagcaggccttttataggcagcgaggcctgccgcccggccagagggcggcaaggggccgcctgcaaaataaccggccccgactggcttttttgcattcgggccccttgccgccccaccagagggcggcaagggttttcctgcaaaaaaaccctccctctgtcaccgcccgttcctcccccgtttgccacgtcatcttgccgccccagaggtgggcggcagggtctatttttataatttttttggccgatagattatttctgtaaatatttttttaaaaaaatctaaaaccgaaaaaaattcttagaggtaatgccgctacgcaaagaaagcgaacagaattgcgagcaactgagacttcagtttttcttctcactagcacatgattatcggatgatatgcatgttactcgatactgctagcatgcatacatacatacatacatacatacatacatacatacatacatatatatatatatatatatatatatatatatatatatatatatatatatatatatatatatatatatatatatatatggcaacatatcctatgcacacaggccctcacgtgtatacacgtgcacaccaactaaaaaatattaccaaaaaatatagaaaaaaccatacacatactttcaattgtattacacctagggttaaaatct

SEQ ID NO: 58658 - DNA, 7150 bp, Oryza sativa
tatattttcttgataccaaagggttgtcatagataaaaattatttttgttttcccttcgcgaggcgaaactaaaatattacttttgttaaataatatctcacaaaataaactcatacatataatagtcaaatacaataaatttatacacttcatcaatatacttcataaatttatattttcttgatagcaaagggcaaaatggactctatggtagaaattttgtggtcaactaacagtcaactaatggaaggggtatagaagggatccaaactgaaatttaggggtatggaagggaatgagcaaatctcaaaggcatagaaaggattgtgtgaagtttcaggggtacacagggaattttctctaaatgtttcactctcctttctctcttcaatgtcagtaaagagccttctattaatattattaacagatgttgtacatgccctaaactagaggtcatgccaactttggattcctttttttcagttagtaataatgtttaaggcctcctttggaacaaaggtttttttaaagaaatttaggagaaattcaatccataacaaagagtatggaaatttttcctccatggccccttttgattaaaggaaaagccatccgaaaatcctacggaattcatttggattggctcaaaacttagaaacttcggaggaaatgtccaacctcttgaaaaaagtatactttgtgtgtgtatctccgattctagcatttttcccgtgctccatccacatggttattcttatagtttccttacatttttttcaatctataggatttgaaatgttagtgcgctccaaccctcttttttttcttatttccgtgttatgagaaattgagaatcctacgtttcaaaggagcactagttttttaggcatttataactgaaaataccaggtattatgattttagaaaaccacccaaattatgtgcaacccatttcagttattaattgggtaaattaagaaaccgtgtacaacagtccaaagcggtattgtattcaaaagggaaactattttgatctcttgaagggatgtctcctcgttatttgcatgccaatcaaatggttataaaaagaatggaaaattttgagaagatgtattaacatgtgatataacactccacaagaatgcatgttcaaattcaacttttagatctcgcaacggaaaaaacaaattaaacagcaactacataatgtattgtcatagtcaattttttcttgttgcgagatgtagaagttgaatttgaacttgcatgtttatggagtgatatatcatatgttaatacatcttctcattttttttcataaccatttgagtgacatgcaaacaatgagaggatatcccctcgagggatcaaaatatacttccatattcaaaattcccttttcataattaaaccacactttttataatataaaaattatatccagcaaacagacataccctactactagtagtcagtctggcaagtctatattatcatctttattttaaaacatagagacaattgacatacaaaataataagagtcaacacggtgcgctatgtgactgcgtggtgagcacattagcagaccgacactaatcactagtattactagtacactagtctcaaaactaaactataattgtcggtgccccatgaccttctatgagtttctataccatcagattaacaacacaaaccgacagtcaaaactgaattagaaacacaggccgcgaagcgtaattagtgcaatccggtagttgcatcctacagaggttgcatcccatcaaaacctaaacaatgccaaattgccaatccaacggctgcaagagcataaatccgggtgataaatttgattcagacacaataaacaacccctccatggaacacactctgcaagatgaaaaacctctgaaattaaaccaatcagtatcaggccgtcgacttgttcagtgcagctgcagcttaccggcaaaaattaatcaaagaaacctccatgtcaactagcctagctagctgttcgattcccatgttccctgcttgacttcgaacgcatttgtcaccgcgacgtgccagccaaattgtttcttctctgcttcggctggggactgactataaatggagatgcagaagcagctgcatttcatcaaaaagttcagagtcttcagagtttcagaacactgtagctacttcagagttcagtgcagagaatcagagatggctaagcttgctgtgttgctcacattgctggctctggtgggctctgtgacatgccaaggctataccggcaatgctagcccacccacacccattacatacccaagcccgccaagcctgagcccgagcacgccgcctacttatcctccacctagctcgactcctccgagcctagcaccggtgagcccgagcccgccgacaacctatcttccaccaagcccaactcctccgagcccggctccggcaagcccaagcccgccgtccctagggcttagagttggttattacagttcctcttgcccaaaagctgagcaaattgtgaaggacaccgtcaagaatgctgtgtacaccaaccgcggcatcggcgcagggctcgtccgcctcttctttcatgactgcttcgtcgaggtaaaatccttttttattaattaaaacacgtgattaattagttagtaagggatcacctatacatttatcgataaattttcttttaaaaatttgacagatgtaattatagtataatcgtgatgtaattacactgtaactcgcatgtaacttatatgtaactttcaaaaatatctatgtaacatactttttaggtaaaacggaggtcgtgggagctaatcctctcaaatgtttgcacacagtgacttttttcattcttcatttgcataaatcttgaaacaatctaacggtttaaaattatgtgaaagctatatgcaagttacattatagttacagtgtaattacactccgattgtgctgcaatcgagttagtaatccacgtgattaatgtggctgtgtattgtctcctttcgattgatcagggctgcgacgcctccgttctgctcgacccgacgacggcgaactcgcggccggagaagctcggcgtgcccaacttccccagcctccgcggcttcgaggtgatcgacgcggcgaaggcggcgctcgagagcgcgtgccccggcgtcgtctcctgcgccgacgtcgtcgccttcgccggccgcgacgccgcctacttcctcagcaacgccaacatcgacttcgccatgccggccggccgctacgacgggcgcgtctccctcgccgacgagaccctcaccaacctgccgtcgccgttcgccgggctcgaccagctcaagaagaacttcgccgacaaggggctcgacgccgacgacatggtcaccctctccggcgcgcactccatcggcgtctcccactgctcctccttctccgaccgcctcgcctccaccacctccgacatggacgccgcgctcaaggccaacctgacgcgggcgtgcaaccgcaccggcgaccccacggtggtgcaggacctcaaaacccccgacaagctggacaaccagtactaccggaacgtgctcagccgcgacgtgctcttcacgtcggacgcggcgctccggtcgtcggagacggggttcagcgtgttcctgaacgtggtcatccccggccggtgggagagcaagttcgcggcggcgatggtgaagatgggcggtattggaatcaagaccagcgccaatggcgagatcaggaagaactgccgcctcgtcaactagccgccattgatcatcggctaatgatcacagttcacgtcacagaataagctcgtgatttttgtttgtcatatattttccaccgattaaaggtttaattagttagtttaattttgccattcttttgttgtaattctgcatgtatctaatattggaatttcagcaagttttaatgagattattattgataagtacttccctttttaatgagattattgttggttgtgtgtttgcaaaatttaacatgaaatgagcgtagctgaactgattatattacttatggtaaaaccagcccacctagatttaaattttagatttgacacgacacgggtgtttgtatttactgctaattattttttcgatggtagatgacgtacccgatgatagcggtcgcaacagctgaaatagaagccgccaaaagcataaagctctcaaagatagtccttgtgtcaaagataaggaaagaggccaaaaattaggctctatcaggagcaaaatgattctgagctcacatatcttaactattttttcctttgtacagttcttctcttacttgtccaatctttttgatcctgctatatcgaaaagaaattgacactatagatgcacgttaaaaaaatcatttgtttctcgagcttcctgaagccattaatttcttagtgtcaaacatgctagaagcagacaatattgaccggagatcttcagaaacgagttatcaacccttgcaaaacgccgttagtagttcatgtctgtagttcacaggtattgagaaattcgcctccgcgaacttggcgttccaccacccggggaagtaggcgctggcgaggacgagccccatggtgtccgccgccgtcatcagcgccgcgtccgatctgaacagcacatgctggctcatcacgttcttgtagaccagtgacgaatctagaaataaatagcaatgggatttgagtaaactagatagagttacagtccccctcctatctacatatgataaaaaattttagtggggtcttcgtgggggctctcatagtcttcacgtcagtagtgggggctcgagaccccgccgcccccatgctggatccgcccctgcttgtagtactggttgtccagcgcgtcgggcgtcacggcgtcttgcgccaccgtgtcgctcggcgtcgtgcactgccgccgcagggacgcgacgaggtcggcgtccatgtcggagccggaggtggtggtgccactgggcggcgggacgcggtcggcgaaggaggagcactgggagcggccgatggagtgcgtgccggagagcgcgaccatgtcgacggtggagtcgggctgccaccaccgtagccatagccgccggtttggcacgcaacggaggcgagcagcgcgagcaaggtgaggacgacgacgagcttagccatggtagcgggaaactattttcatccctcgaggggatagccgccggtttggcacgcgacggaggcgagcagcacgagcaaggtgaggacgacggcgagcttagccatggtagcgggaaactattttcatccctcgaggggatagccgccggtttggcacgcgacggaggcgagcagcacgagcaaggtgaggacgacgtcgagcttagcctcccctcattgtttgcatgtcacccaaatgattatgaaaaaaattaagaagatgtattaacatatgatatatcactctgcaaacatgcaaattcaaattcaacttctacacctcacaacgaaaaaaacaaatttgactgttaatatatgataactagttgtagttaattgttttttcgttacgagatgtagaagttgaatttgaacttgtatgtttgtggagtgatatatcacatgttaatatatcttctcaattgttttcaaaatttttcatcactatatgggttgacatgcaaacaagaggatgtcttctcgagggtgaaaatccactcccgtagtagctagctatactgagcagtgagctcaagagtggcaagagagggatgaagaggagatgctgggttgcatggctatttatagtcaccggacggcggccggggacgcacgccgacacgccgtacacagtacgtactgctgcttgggaatgtttttggcgcgcacgttgtggtggtggtggtgtggtgtgtgcagggtcaaccgtccggtgaacgtggcgagcagatcgaatgatcgatcgaatacccaaagctagcttaattagtgttagctagctagtgtgtgcttgcattctgcacaagtcatagctatagcgttaacatgagctgctcgatcgatgacgttgtaggtgactcgatcagagaagggaggatctaccagaatcccaaattaaactctgaaactctgaatgtcaaatcaaattcacatccctttgaccggagaacggcgtaaaccggaacgtgcggcttggctgggtcggagcgggaatccgacctccgtgcagctcattttttttgggttaggaatttgtggcatataattagttatgtgggctcagatctgctcttgacgggctttcattaaaggcctggcccaacccatcacggagacaacagtcttcaaatatgcttataggggtagaatttacgtgcgtgcgtttatagggggtgagtgtgtgttgtgcgttgtgagtgtgtatgtgtttatggtgtgtaattttttttaaaaaaacaccagatttgtacattacacgccattactaaacgcgccgatcgatcgatgcagcactggtatcatcttcttgtcgggcaaatattctagagaggaaacaaaatagccaggaaaatatttttagataaatagggagtactagtatagtacacgcatgattacatagcatgcagccgccaaaataagaagggacgcagtatcatttttgtctccagcctcccaacagctgaaagccacgattatacgtaccttcatgatgtcaaaccaaacgtgcaagaagcagacaatatcgaccggagatcttcagaaacgagttatttttcctcgcaaaacgccgtcagaacaacccaactaaatacccctaatctagacgcccgttcgaacatatccattgtcggagctatattagccgttgaccccggcaatgtcaacttctgtatagctcgatcctgttcgatcgatgatctataactgcaaatcgtgctcccatgttctgccggttgataatcaagctgctaaaaatgattagaatttcttaattaattatacacacaaacattccctccaatgcatgcatgcacatattctgatcgattcatcgatctccatgctataaatagactcacagaacagcagcttccatcacactaacacttgaattaacacggagtagttgtgata

SEQ ID NO: 58659 - DNA, 2542 bp, Oryza sativa
ggcgctgttgtgggtacctctccccctttcttggcgagttctcattgggtgaaaaccacatctttcttagatgggcgatagcggcgtccttgatgtcgtgacctccatgggggcatcgtttttggagtcttgcctttgtggtgttgttgtaggccgggcggcgatcagccatgcttaggggggtcattttggtgctcagttccattttcagtggattgtgcttgtgtggttagcgtgtggttcttggaggtgccttgtgcacgtccgtacttgacaacttctgtcgtgtttttcttagtaactttactcctctttaatatactcggatggcctccttcggcctttcccggtgaaaaaaagataagtcaggtgagatcttgttcatcctttttatcaattcattacccctgaggccctaaattaccaatcagtgttgtccatttgtcattgtaatttggtttcttgaaacctttgaagtctgaactcccttttgcatttgcagaagttccttgctggtatccgcatgactttggacttatttcaaactgtgggaactgaaaacaaatatagactccaggcctctcggaagtgatgatgagagctgctctcctacacaccatgaaaattatccacctcaatgtctcaatctcattgttcgtgctgtatgaatctagtaatgagctggcttttcagcatattctgtggtccaattctagtcacatttgagaaaatcaccaggcacgctcattggtgctattgcgcactaccatttgttgtgggatacagacaattcgtatgcggttggttgtattgcaattgctcgcctattcatttttttttaacaatataaatagatctcctgttctgcttattttgaattgctatgggttgtattgtcgctggtagtggcttgtgtctgacgatagcctgattttctggtaaggccactcgagcaatcttctttcccgatcagatcaggcagtggacggctcagatcgatctgtaccgtatgaactatgcataattggcgaatacttcacattctttcttgatcagatcaggcggtggacgtctcagatcgatctgtagcatatgaactagtatgcgtaattggcgaatacatttcgttggcggaggaggtcaagtcgtggcgaacgaccactctctgcaacaaactctattttccggtttcatgaaaatggagcagtgggcttcccctgctatttctggattatttttttaataatggaatagataacatcccggtctttactcaacagagttacagccaattgttacaatctaatactcgaacaaagaggaaaaaaatatttttgaaacagaattatagatgaaatcaagatcaacaccaggctccaaagacaactctctaaacgatcaaatagagtccaagagagcataaacatatccattcaaggcaaatctaaaatgcagtcatgcacaataaccaaaatacataacggggcatgcttttcaacagctagctctaattaatttatgcccgggcatgattttcaacagctcaaattaatttatactccctccattctaaattgatctacatatttcataggtacactaagaccaagaaaaattaataattctctcatgttatatttactctagcaacaaactcaatgcatgcaccatccccaatatttcctagccaatagcaaatcaagatattgcatatgggttataaatacttgtgtgtatggatgcatgcatcaatgtccatttactccaatacacaaataacgaatagactctactaaatgaacacaaatatgtagatcatttaggaataaacttaaaaactatatgtaaatcaatttggaatggagggagtaataatttatgctcgggcatgattctcaacagctctaattattttatgcccatttagtttcactccaaaggggcatgcatggctattccaagtccataggattatcgctgtcttcagtttcgtctttagttcccaaaccaaatccaatatccagttgcaatggctcatgcaagtccataggattatcgctcctgctgattgtttcacccagccgcttgtgaggatattgcgcatgaaatttcaaaggtctcttcaggtttccctttacacctgcacccagtaaaacagcaaaacaaagggcccatgagttagtgcatatagcctacacacaaatgtaggtacatttgtatgagagtgacaaaaagaaaacctacaagagcataaaccaatttagttcaagaatgtttaaaaaatgcaagagcacctaaagtggtcttctctctccccactttgatgggggcagaaatcttgtttctgttttcatttctgacaatttcttttaataaaggctcactttgtttaattatgtgcatgttcttgatatagcgtgcactgacaagaaaattttgatatgaaggcaatctagaatccaaaatgcagttgcatttggctgggtttgtgttccacatagcttgcatttcatgtactctggagtacatcttatctggaact

SEQ ID NO: 58660 - DNA, 3655 bp, Oryza sativa
  unsure (1)..(3655): unsure at all n locations
cgaggggaaaggattttgctagtaataactctgatgcggattntatatcattatagattatgaaacaagatgttgaacaccaagatttggtctttaaataagttggttgcaacatcatggctggagggaggatccttgagcttcaaagcacctggttggaaacatttgctaccaagggacccagcttcaacctccaaatggccaatcagttgccatgagtttatcattgaaaacaatgtgcagagcctttgttcatgttggttgcagacaagcatactgcctacactttgaacaggttcagacttgttcagatttgcagctgaagcagtgcaatgaatcagtgcaaatgtgcaatgcatcagtgctaacaggcactgtgctgcaacaggggaacacaacaagatccagtacagttcatgtcatttggctggatggagatccagacttgggctgcctccaagaaaagccggtaagagtgtggcatttgcctccatgacaaagttggattaggcagaggccttgacaaattgtcgcggcaaaacataaaagatggcgaaaccaagaacaggctaaagaacaacccaggattggatccatatatcccatgcattgcaggataagtgaatggtgctgaagcttcagttggaattgacgttttacaggctagctcatggtaattcaggaactttacagagctcagaaccagcaacctcaagcttacgttatgccactgctttcagcaacttcttcctcacaagaacttcagggttttggtcatctccttgacaagatagtattcagagagagctgtgacaaaactactatccatgataatcaaagcattcaaaaaccacatcgaatccctctccaaaaaacctacatcaaatcagcatgacagcgtatgaattgaagcccttcatcaataatgctgtttactgtggcagtgtggtattctttcctcctccgaaaggatgtagtcattcagaggaagttgcatgtacttttcatgactactgatcacctaagcacttcatcaacatgcgcgaagagcagcattatttgagggtaatgtcatatatgactccttcaagatttgagatggttgttcttgtcccatccacctctttgacatgcattccatgtttttcagcttccttgagcactagaacatccatgctggtaatcaatgagagcagcagtgtcttagttaaggaacacacaagttatttttaaatgatctatcaacacttgaagtagtacaaaatcaattaaagttagatggagagtaaaataacccaaaaaaaaaacatgggatgacttattgagagttgggattgctccagattttactggaatttgttacgagaagctccaaaaggtcccaactaagtgaaagggacaacactaaatagcttaattattttttaccacctttctgtattgcagttttttaaacagtacaatctggacataccaagtattatgctggcagtatgtgcaagatgtcagtacagtaatcacattctggcagtaccaagtaaaatatccacagtatgctgctacctgttctagcccagttaattgtaatcaaactactgcaagccaacctgtatattctatttgctcatgaatgcaactggagtactggacaatcattttgcagaggacaatgaactgtcaggtgcagagtatctcaaacaagcgacaagctgacgagagaatgggtgacataacaccttgttgccatgaaaatctgcagaacttctgtagatctacatgtcactaggaaaaagatttgcctgtgaccatcctctctaagtactaattaacgctagatcatatttcagatgtttaatctgctttacatttgaatccatcagatcaatatattttggatgcagcattttgattatttggtgctattgatgcactcctgatttcacttgtatatatctttgatcagttctatcatgactactcagctacctttcatactaagatattcattattccatgtgtagcaaacccagacctatagtacaagcaagttaatcggtatattaaaaagaatcaatagctaagtcagtccttgttcttggtagacacaataaggataccaccaataaaaatgtacctattccatagttttatcaataaaaggtacaatcatttatattttgatcagaaatgagacacgcattaaattggctttcctaacttggaacagcattcgggtacacgatttcacaaaatattagaaactctggtaaaatatgctcggacaggaagatgatgagttattgagttgagaaaacacatacactttagctcgtgatacataagccaatatgaatctacatttactagcctgaatacgaagaagcctctctacagtatcaaagagacaggaaatgctagattgctgaaagctttctgcgagtcaaggttcacaaaattcacaagatgcaacaatcgatatacgattatatgtcagaaagaatagaaagagaaaggatcagaactgaaattaaatcacgggaaagtaagaaagaagaaatcacagcaaagtaagaaagaaggatataaatatcagctccaaggatgagatcaaatccagaaggatgtttctcaatgatattgcttatatgaacatagtttccccactctagcttctctgctgtcaacactgcaacaaaagtatcagttctatttgatatctggaagatttatatttcagtgattcacataatgatgaaacataattaaccagaagttaagaagtggtaacctgcattggcattcccagaacatgactgcatctctatattcttctttataatctgtcaaacaatctttggaataaatagatgcaacatttatatagaataagtagatatgcaagtggcacaatggaatcatccttgaatattttataatgtatgactatgacaccactttctagaatttgaagataaagcagctgcaccgaataatatgtgaacacaatgtgaaagtctcaatatcttctgtattttgtcaaactaagtgacatcactggaagatattcgtaaggtttgaagcttgcctctagaacttcatcattgtgatcagtcaagacaacttctttgcaaaaacggctgcacaatatgccagtaatgcctgaagcaagtcacaagctcacaatactgtcagattttccaagatcacaaagtgaagtaaacatgagaggagaatgccctcaccaaccccagatcctagctcaattattgaatgatccttcacagtctcaggatgttcagacaagtaggtgttcatcagaactgcacctggccatactaactgtccagtaagatcataatcagctgccacaaatcattagaatgtttgtaagtgttggccccatgataaggaaacagcaaaaatctggcgttatgaagtgcaatgcagcattgtgcccagagcaaaaatacacccaaacaagttaatgtactgatgagaggttctagtttgtaaataagattgttcatatttgtccactgcacaaatagaaataaacttgagtatatcatgctcagatctaacttttgtgttccacggaagagctatctccagataaatgatagattgatagttactatgttacacaaagcagcat

SEQ ID NO: 58661 - DNA, 7791 bp, Oryza sativa
ctgcagcccatacatctagtaaaaggtcttggagtagaaaacgataatcatatttgcatatggatctcttagaggaacagccatgaaaattgattttcacatacggttgtaggaccgtctacaaaattgacgatataaatgttggagacgttgaactaaaataataagcgatatctctttcttgatcaagaaactcaatttgaggggtttttttatataccggtaaatattcgctaccgtattcgttccgtctcgtattcgctccgtatctgtattcgataatattcgatttcatttccgtatccgagttttcgatttcgattccgattccgaaaaaaatatgaaaacgaatatgataaagctagtttccgtccgtttccgatccattttcatccctatgtacggccggaagcgcggcgaggtcgaggctggcgtggcagtcgtccaagcccccttacggcgagcagcgagagcgcgctgagcaccacgagtagagtgttcaaaaattagtggagtgaataaagtctatggaattatatatttaaatatgaagggggtaattttctcggtccaccaaatatgttataactcatgcggattcacggaagaaaatatgttatcaccatcatgttgtgttcaacattgttatcgagcgatgatacgtaacgtgcatgaggttgcttggttcagttaatcttttttcccttaaagaagcgtgtttaaattctgccgcacacacaacagcatcaacgcaagatgtcaggccttcatgcttaaccaggtgcgtgacaaactaacaatcaataataatctcattaaaaagggaaatatttatcgataatagtctcataaaaaacttgctgaaattccaatattggtacaagcagaattacaacaaagggtgcaacaaaagaatggcaaaattaaactaactaattaaacctttaatcggtggaaaatgtatgacaaacaaaaatcacgagcttattctgaccaacaacatccccgtcgtcggagatgtggattaactgtgatcattagccggtgatcaatggcggctagttgacgaggcggcagttcttcctgatctcgccattggcgctggtcttgattccaatgccgcccatcttcaccatcgccgccgcgaacttgctctcccaccggccgggaatgaccacgttgaggaacacgctgaaccccgtctccgacgaccggagcgccgcgtccgacgtgaagagcacgtcgcggctgagcacgttccggtagtactggttgtccagcttgtcgggggttttgaggtcctgcaccaccgtggggtcgccggtgcggttgcacgcccgcgtcaggttggccttgagcgcggcgtccatgtcggaggtggtggaggcgaggcggtcggagaaggaggagcagtgggagacgccgatggagtgcgcgccggagagcgtgaccatgtcgtcggtgtcaagccccttggcggcgaacatctgcttgagccggtcgacgccggcgaacggcggcggaaggttggggagcgtctcgctggcgagggagacgcgcccgtcgtagcgccccgccggcatgtcgaagtagaccttgttgccggagaggaggtacgcggcgtcgcgcccggcgaaggcgacgacgtcggcgcaggagacgacgccggggcactccccctcgagcgccgccttggccgcgtcgatcacctcgaagccgcgcaggctcaggttcgggatgccggccttctccggcgccgcggcgctcgccggcgtagggtcgaggaggacggaggcgtcgcagccctggacgaagcagtcgtggaagaagaggcggatgagcccggcgccgacgccgcggtcgccgcggccgccgcggatggcgttcttgacggcgtccctcacgatctcctccgcgcggtcgcacgtgcccttgtagtgcccgaccgtgagacctccggcgatcgagcccggactggtatagccatcgccattgctgctgccgagcaacgcgagcaagacgaagacgacgagcttattagcagccatggatgccatagctagcttaattacaagctttatcacaactactccgtgttaattcaagtgttagtgtgatggaagctgctgttctgtgagtctatttatagcatggagatcgatgaatcgatcagaatatgtgcatgcatgcattggagggaatgtttgtgtgtataattaattaagaaattctaatcatttttagcagcttgattatcaaccggcagaacatgggagcacgatttgcagttatagatcatcgatcgaacaggatcgagctatacagaagttgacattgccggggtcaacggctaatatagctccgacaatggatatgttcgaacgggcgtctagattaggggtatttagttgggttgttctgacggcgttttgcgaggaaaaataactcgtttctgaagatctccggtcgatattgtctgcttcttgcacgtttggtttgacatcatgaaggtacgtataatcgtggctttcagctgttgggaggctggagacaaaaatgatactgcgtcccttcttattttggcggctgcatgctatgtaatcatgcgtgtactatactagtactccctatttatctaaaaatattttcctggctattttgtttcctctctagaatatttgcccgacaagaagatgataccagtgctgcatcgatcgatcggcgcgtttagtaatggcgtgtaatgtacaaatctggtgtttttttaaaaaaaattacacaccataaacacatacacactcacaacgcacaacacacactcaccccctataaacgcacgcacgtaaattctacccctataagcatatttgaagactgttgtctccgtgatgggttgggccaggcctttaatgaaagcccgtcaagagcagatctgagcccacataactaattatatgccacaaattcctaacccaaaaaaaatgagctgcacggaggtcggattcccgctccgacccagccaagccgcacgttccggtttacgccgttctccggtcaaagggatgtgaatttgatttgacattcagagtttcagagtttaatttgggattctggtagatcctcccttctctgatcgagtcacctacaacgtcatcgatcgagcagctcatgttaacgctatagctatgacttgtgcagaatgcaagcacacactagctagctaacactaattaagctagctttgggtattcgatcgatcattcgatctgctcgccacgttcaccggacggttgaccctgcacacaccacaccaccaccaccacaacgtgcgcgccaaaaacattcccaagcagcagtacgtactgtgtacggcgtgtcggcgtgcgtccccggccgccgtccggtgactataaatagccatgcaacccagcatctcctcttcatccctctcttgccactcttgagctcactgctcagtatagctagctactacgggagtggattttcaccctcgagaagacatcctcttgtttgcatgtcaacccatatagtgatgaaaaattttgaaaacaattgagaagatatattaacatgtgatatatcactccacaaacatacaagttcaaattcaacttctacatctcgtaacgaaaaaacaattaactacaactagttatcatatattaacagtcaaatttgtttttttcgttgtgaggtgtagaagttgaatttgaatttgcatgtttgcagagtgatatatcatatgttaatacatcttcttaatttttttcataatcatttgggtgacatgcaaacaatgaggggaggctaagctcgacgtcgtcctcaccttgctcgtgctgctcgcctccgtcgcgtgccaaaccggcggctatcccctcgagggatgaaaatagtttcccgctaccatggctaagctcgtcgtcgtcctcaccttgctcgcgctgctcgcctccgttgcgtgccaaaccggcggctatggctacggtggtggcagcccgactccaccgtcgacatggtcgcgctctccggcacgcactccatcggccgctcccagtgctcctccttcgccgaccgcgtcccgccgcccagtggcaccaccacctccggctccgacatggacgccgacctcgtcgcgtccctgcggcggcagtgcacgacgccgagcgacacggtggcgcaagacgccgtgacgcccgacgcgctggacaaccagtactacaagcaggggcggatccagcatgggggcggcggggtctcgagcccccactactgacgtgaagactatgagagcccccacgaagaccccactaaaattttttatcatatgtagataggagggggactgtaactctatctagtttactcaaatcccattgctatttatttctagattcgtcactggtctacaagaacgtgatgagccagcatgtgctgttcagatcggacgcggcgctgatgacggcggcggacaccatggggctcgtcctcgccagcgcctacttccccgggtggtggaacgccaagttcgcggaggcgaatttctcaatacctgtgaactacagacatgaactactaacggcgttttgcaagggttgataactcgtttctgaagatctccggtcaatattgtctgcttctagcatgtttgacactaagaaattaatggcttcaggaagctcgagaaacaaatgatttttttaacgtgcatctatagtgtcaatttcttttcgatatagcaggatcaaaaagattggacaagtaagagaagaactgtacaaaggaaaaaatagttaagatatgtgagctcagaatcattttgctcctgatagagcctaatttttggcctctttccttatctttgacacaaggactatctttgagagctttatgcttttggcggcttctatttcagctgttgcgaccgctatcatcgggtacgtcatctaccatcgaaaaaataattagcagtaaatacaaacacccgtgtcgtgtcaaatctaaaatttaaatctaggtgggctggttttaccataagtaatataatcagttcagctacgctcatttcatgttaaattttgcaaacacacaaccaacaataatctcattaaaaagggaagtacttatcaataataatctcattaaaacttgctgaaattccaatattagatacatgcagaattacaacaaaagaatggcaaaattaaactaactaattaaacctttaatcggtggaaaatatatgacaaacaaaaatcacgagcttattctgtgacgtgaactgtgatcattagccgatgatcaatggcggctagttgacgaggcggcagttcttcctgatctcgccattggcgctggtcttgattccaataccgcccatcttcaccatcgccgccgcgaacttgctctcccaccggccggggatgaccacgttcaggaacacgctgaaccccgtctccgacgaccggagcgccgcgtccgacgtgaagagcacgtcgcggctgagcacgttccggtagtactggttgtccagcttgtcgggggttttgaggtcctgcaccaccgtggggtcgccggtgcggttgcacgcccgcgtcaggttggccttgagcgcggcgtccatgtcggaggtggtggaggcgaggcggtcggagaaggaggagcagtgggagacgccgatggagtgcgcgccggagagggtgaccatgtcgtcggcgtcgagccccttgtcggcgaagttcttcttgagctggtcgagcccggcgaacggcgacggcaggttggtgagggtctcgtcggcgagggagacgcgcccgtcgtagcggccggccggcatggcgaagtcgatgttggcgttgctgaggaagtaggcggcgtcgcggccggcgaaggcgacgacgtcggcgcaggagacgacgccggggcacgcgctctcgagcgccgccttcgccgcgtcgatcacctcgaagccgcggaggctggggaagttgggcacgccgagcttctccggccgcgagttcgccgtcgtcgggtcgagcagaacggaggcgtcgcagccctgatcaatcgaaaggagacaatacacagccacattaatcacgtggattactaactaattattaatcacgtgttttaattgtcgaaactagatttcggcaataataaaagggggtggctatcaagctcggaaagtgtatgggtttggagacaaaggatttatacaggttcaggccttcttataaaagaagtaataccctactcctgtccggggatgaatccgccgagtgtattattgattgtatgattcgggaaaaatcagcatatatccctagaggcgcccggaccccctttatatactggaaggagtccggattacaaaagataatctatattcctaacggaatatgaagatagaggtaaaatacagtcgtaaccgactaagtctcagggtgtttccttgatacacaagttaagaaacaaacccgagatacagataagatattctatctacattaagtatccggtacccagttcgaataccatcgccgtgtagatatgggatacccataatctccacagtagcccccgagtcctttgcagtcgaccatcatagtcttctcaaagataataatccgagtacttcaaactcttcaagccaaaatctgccgagtggactgtaaagggcgaaaaaaataaagaatatggtgcatcgaatagatgcacctaattaggtgtagcccccaactatgtgattagttaataaactaaacatatagttgaaagacaaaataataacacaattgtgcattatatgacaaaagcatacgcggcgcctaaataggcatactagccgactgctttttagccaccataaaagaaatccgagtggtttacactctaaaaggttcacgaatgaacacacttgacaggcatccgaataaaaaaattctaaagattacccatcaagtattataaagattatggtaataaataagtcaaatagcctaggccatgactatttaccatgaaaataggcatataacacgccaaggaaatgactataataaaaacaagtcattcctagttaacccaaacagcttttgtagcctaaaaaagcttgcaaaaacagcatgacgcctttctgtcgggcacctttttaatttgcattgcaataattccaaagaattatatgaccgcataaaaaggatttgatcagcattgggcaacactgttgtgcgcataatattgccaaagcaaaatatgcctaagtccctaaggaacacaatgggccacgctgttaaaagtattgggctgaagtactgtgcaggcctaggcccattagcacctccgatacccttaactgaaaaatcctatatccaagcgacgcttcgtcttccccgccggaactctcgccattttccccactccttgctacagtgaaaagctgcgccggcgaactagggttcacaactccggccaaatccacctccgaaaaacgcatcaaaatccttcccgtgatccaccgcctcaattcctcacctctcccaagccatccctcgaatcaaaccagcacatttgagaaaaatcgatggcggaagagagagaaagctttgaaggccaatgggcggcgtccgatgtgacagaggagaatctgaaggagatggtggcgcacggtgttctcccagccaaagagatcatcgggtggcggccagcgtacggtgaggcatttccatctccagatacgcatgaaattgtagtcttctcgcattt

SEQ ID NO: 58662 - DNA, 10374 bp, Oryza sativa
atctatcgttttgaggaaatcgagtgaaacgatcttggtttcaggccacggtgggtggcggcgcaggccggcgaatcgcaccgtcgtattcaggtgtccgcgggcgttgctcccctcaaattttgttttattttgcactggttttgacccgggaaatttttggtcatgttagggggttccaggagcaatctgataagattcagattaatacggatgcacgaagcaataaggtgtgctgctaattcatgtgcttgtgaaattcgtatctacaatgtattgctgcaggagtgttcccgctcactgatgatctccttggatgtctcgatgtgagttgtgctttgaacagattggtgagatcaggaattgctcctttggtgaggtatgatatagagatttgggacggatggagtagggttcacgaatcacgaaagaacaattgcattattacaactgcgaaatgactacagatgaatttctaactttgtttgccttgcagatatgttggtactttactgacacttgggaacaattccgtatcagcggattcatagatgtgattgatggttcaaaccccgaacctgtcaagctacaggttagaaccagtatagcatactgccttagtgctctgatctagtagtggtctgtatagtggaaatgccaaatgtcctagagacagaagcataactgtagtgcacacgtttggttgtgcaacatatagtattttgttcttttgcgctgtatggctgaataaatgaatgatttgtgatatttattcgatggtacaaacaaatgaattaactgttataaagttggaaaagtgatttaaatcggtattctaagaaattcacatatagagagtttttgagaaaaatgcaccgtttaggagtttaggaagcgtgcccgttaatccattcatccattaagcagaagagaacagtccttgaggtttattcatctcagaagtgttactgtgttttctctttctactttcattgattcatttaaaatcggttgccatttctatacacagctgagagagagagcttggtttggaagctcagtaaaatcgagattgcagtacttgggaccatgcccaggtcttcctattccggatgatgatctcattaaggatgctcatcttgatccatcagctggtccagtagatgccttttgccttctggttcttgatccagaaaaggtaggtagctattttcgactttttgctggatctagaaagatgttgatgtttgctcatgctttcttagtgctatttgtcagcaatcctttgatcctgcaattgttatactgtacttaggtcgattatttgaacttgaaaagcaatcaaaggttaatgttcacaagaaaccagaagggagatgggaccaacagttggatggccgaaaaaattagcccatgactgtttgcggattctattgcagctccaaatttgtttgtggatttatcatggtaagaaagttgtcttgatttgagtatgttttctagcatttagaatgtttaggttggagcaatttgggatatacatcgccagaatttctaccatctataagtttagttgacttgaacttataagctgaatggatattgttattgaaggaatgttattttctgagaatgctaatccatctagccacttcttagctgggtacgagcttgcagaactgcagctacctgtggcatccgagagaaccaatttccatgttcaagttttcatcttttataaaacgagggaaccgttcctcaagttcccttataaacacctgaaccttttcaggtaggaaccaacacatagattgtccagataaactagtttatcttttttgtttccctcgaaaaaagaaaacgagttacccttttatctttgaactgtggtgttatgatttcttccgaatgcgtgttgtatggtgcatgtttaatttagtgacagtagaatttgaattcctttggtgtgaacatggatgatgcaggtctactagtacctctcttttccgagcaaactttaggggaactgtgatgtgcactagggttcccgatcttccaaaaggttctgataaacaacgatttgggcggagtcacgacacaaatcgatccggcttcttgaacgcgcacgctcttgagccccgcaatcgcagcaccacgtctatccgagttagtgatgtccgcatcaaactgcatatgttattcgttaacagagggaggaaaaagagtcaatacagtacaaataaatcagagattaatggacagtgcaaataaatactactactataactcttgcctgtacatagtcattttttcttgtttctcttgatattttatgtattccagtttccttacaggaatgttaatgccataccatggatgttgtcctggccttctaggcttgtttgttgtgtcaatgtcaagtaaggtcattgtggttttaggcatggcaaactcttctccctgctatgggcatatggcccggccctttaacctctgtgcttctcagccttccttgtgcttagacaagacactatcagatgcatattgcccttgttgtggcagttatggggttgaacaaaagctccagctataagccataaatcagcatacgcgtgaggcgttgaagtgtgttgttcaccgttatacattgatgagcagagctggaggtgccggtctgctggagatcaactctggccaggccatgaatgcagcgttcaaaagttagttgctgttatctccatgtataagaaaaacacatcacatgatctatttgctgcggaaagcaatatattgaccgatacgtcttcaagtcgtggttccagtgagcactggctagtggtgtgcactgcgcagctgatggttatgaacagttctgctcctgctacaagggaaaagttgtcaatcgcattatctcattgcagacatgaaagcagaaggaaactgttctctgttctgtgcatgctctgattgagccgagcactcagctgcaggtttctctgctggtcttgataatgctacatatcgtcttttcttgttcttggcagtgaattattgtttcatccaaacagagactggactgcaacatcttcttccaatcatcttagagcagcatgtgacatttcgctcctttctgggtctccgttgcagttgcgctgatggcagagcaggggtcaaatgtggctgtttaattgggtctccagcttttctttttcattcaaagtcatcaaggtagcagcagtcagtccagcattagcatttcggctgtgccgaattgaggtctcatcctgacgctttgcagcgcacacaaggaacgcttttatcttactttcgctgataaaaaagggtgtctggttgaggtcaaccgcaagaccggccctcctcctcaagttgctaatggcaggtccatttcaaaggctgagaaggccttaccctgtggcttggattcatcttttggcaatcatttttattggccaccttcctcctactgggccttgctgctggtctaaaggcctggaagatgtgggccatgtacagctacccatcctcacttagcactacacaagtaaggttacatgtcacaatcttctctctttttgccgaatgcatcattaaagtggtatgtattgacgagcttgttactagtgatgcttacttttcgtagaacctatgaacatcactcatcattttttaagtaatactctcatattgttttcatatccccaaaaagagaagcagaccctctttgagagaaaagaccctattaaattgcacctaaaataggcatgccttcttctgtccctccggtcaaccttccttgccccttaagagcaggtacaataatgggcgttagaagatccacgtaggattttctgttgaactggaggagagaggggaggggagagggcgcaagcgggcgactaattagtcgcccggctgtatgcatgggccgaggacgtgggcccgcccgtagcgaacgatgcacccgtgctactcgccgttgcctgcgtcggagcaccaagtccagggccgcgccaccatcgtcgcgcacgtccgcgtccgccgccgctgccgcctttgtccattgtgaccaccgctaccctcgtccttgtcaaccgtgctcgtcgcctctgtatgtcgctgccgccgaccttgtccaccgcagctgtcgccaccaatttcgtctgcctcggccacggctgccaccgtcatgcagttgccctcgccctcgtcggtcgatgttgcggctctcgtccaccgtggccatggagggcaagtaggagagagagaccaagagagcacaaaagcttggattgagttttgaggccttgtgcttatgaatcggctttgatggtttgcccgattgcttaacttctatcttccaccgttccgcgtgcagaaggccagctcaacgccggtcgccagacgatgagctcagctccggtgacccgttcgctctatccccagctacacgggcagcgtgagcctgcacgatgagctgtttctattttctgatggagaaaatagaataacatctttctctagaaaaatcagatagcttaagcgaagtaatagcatacgtatgtgtatatattgttctgtaccgattccttccatgtagatgagcagatgtatagtacaaaacggatgtgtatatagccataaatttgttcatctttttagccatggatgagcttggatgcctagttcgtgagaagcaatcgccggcgagaacaagggattaggagagagagagagtggggatagaagggagattaaaataaaatttcttgtatagtgtgggtcatagtagtatagcttgattattgtgtttactagctacaatgttacctataggtgagatggaggtgagatggattaaaattgaagtaaacagctggctgcactgttgaccttgctctaaggttacttctaggctgcacttgtagactcaagtctcaatctgaaaataacaaaaggttttaagctactccctggttggaggctctgtaataataactttctggggaagccttgtgctgatgatgctgtagagttttgtcattgtcattgagctaggacatcttatgacccacactgcactctaatctgattacactgcaaaagggataacaattgatgttatcactgtacctccttggatggaaacacatcacctagttcttgtcccatagggaacgcactgccccattttcggtggcatgtgattctcaaggagaaaagggaaactcgaatttttcgagtggtcactcaccaagacacagtcgtttgccatgccaagtcgcacaaaaacaaaaggtttcggtttctgagtcgcaaaaggaggcttcggtttctgcagcatccacatcggcagcggccagccacgggcgcaatcatttggatgggggatcacaaccagctatccaatcgaacaagacaattcatagatgcatccacccatgcaaaaactcccaccaatcaaccatgcacattgtacttgcacgcaacaaggttagtaccagtaccagtacatgtttccaatgcgtgcgtgccgcatctcgacacgtctgctttctcctgacatggtgaacagcaaagccaaaggcacacatacgacaccgagtgcaaatctcactggcaatgtctggtactcgaggacaaattacagcgtactgtatactagtattatatatctcggaaatacaatcactaatataattggctgctactgctataatgctacagatatactactatatatttatacactggtgctcatactactataatatttgcaggttacatattgcatgaagctgtatatatgtaatgtggaacaagagaaaagacagtgatgcactacttcctccatcctaaaatataagtatttttaattgttcaaatttatagataaaagttattatattttaggatgggtagtagtaaaatacggtaaagattagccagtcagctgtgtcagggagcggaggcatctttgctgtgtctgttcgtgcagagcagcatggactcggagatttgccacagccgctcggcctcgtggcggttggtggcggccggcgacggcagggcctcgttgcagtcggcgaagtagcggccggacacgccggccagcctcgggtgggccgccacgtagcacgtggtcgccgcagcctgcgaagagccgcgggttttagtaatgagcggtgcaattattactcgtaagcacaaagctcagctcacagctcggctgcctgcagctgcagtcagagcgagcgagagacccaacacatggaacagggcttaaattaacagatttggtggacggtactacgttaattaatcacctgagggatggttttcagcagcttggacagcagcaggaacaccagatctgcaacgccaaaataattaatctgttcttaagtcgtttgatccggctagaattacagtggatcaaacagagtagtagtaatagtagtagtattcacctgtgacgaggccgtcgcggtcacggttgagccgcgtcctgacgatgcccgggtgcacgcagttcaccgtcacattggcgcccatctcctgttgggattaaccgagccacacagcccccaaaaaacggaaggaaaggtgagaaacctgccacgaaaaactccatccggtgccgaaacgaacggaccttgaggcgcacggcgagttccttggtgtgcagcacgttggcgagcttggacaccgcgtacgcttgcgtcgcgtcgtaagctctgagattacagcgatcgccacacacatgcatgccaagctttagcggacagagagttcacgagatcgaggaggaagaagacgacagataatgacgctgactcacatcttccggcgggtgacgaggtcgaggtactccgcccagtcgccggcgaaccagctgtgcacgctggacgacacgttgacgatgcggccctgcacgccggtcgccgccgccgtctccgccatcctccccagcagcagcttcgtcagcaggaaatggcctgaacaacatacgatcgatcgatccatacatcatttatacaagtatactgagtagtacgtacgtagcaggagtacatacctaggtagttggtggcgaacgtcatctcgacgccgtcctccgacagagcgagctgcccatgcgagaacttgccggcattgttgctgcaaccatccgtccggcgatcgaattaagcacgagcacaaatgcaaaaaaagctattctattagctcccatggatttagctcgtacgatcggcgaattgaagcaggccacaggagatcagtgagagtgacgtacgtacatgaggaggtggagcgggaggccgagggagaggaagcggtcggcgaaggcgcggacggaggcgagcgagctgaggtcgagcggcagaacgaggacgtcggcgcccgggcactcgccgcggatgcgcgcccgcatgtcctccgctgccttcacgttcctcgccgggatcaccacccgcgccccgcgcttcgccagcacccgcgccgtctccgcccctatcccggacgtcgcgcctgcatgacaaaccaaatcaatcaggccaaaacgggagaccgatcggctctgccggcgctgcaaattgcaacgcacctgtgatgatggcggtgatgcagccgaggtcggggcagacgtcctcggcggtggacttggagccgaagccgttggcgccaggggaacccagcaggtacttcgccgcccgcagcatctccgcctcgccaccgatcgcgcgcgcggcgggcggcggccagcgacgcctgtgagctagcaagctgacactgtagtccgctcacgcgcgggcgcggcgcggcgagagctgagggcgaagaacagtgggaggaggaggaagtgaaagctcggggaggagcggaggccgcatttatagaaagctcgcgccgcatgaggacggcacgggacaaggtggtggtgccgatcgaagaaaagtggcaagtacgccgcagatggagatggaattattactactagtccatttgcggaatatgtgaccataactgtgcgacctctctccgcctctgcttctgcttctacgagcgctgtaataacactgcactgaagatttttcacgttgttttttttttgaaactcataaagttttattgcatattaaacatagtacattggaagggaacaacattccctgaaacatcaccttgcaagaaattgataacaacaaacgttaaggaccatcttcctgaaaggtaatgattgaatgatggaagcaaacttccagatcatctgatacagcagtagtagtgaatacaatcgtcggagatccgcggcattgccgcgacgattgcacccaagggcctcttcaaacgtgcttcccatttgacctgccagcgatccctccggctgcctccacggatttggcactaattgagctttggagttgagtcgtagatatgttggtggcttcaccggactcaaccaatgattgccatggaagtcatcgttaaatctgaggaacactaacaatatccctgccgaccaaagtctaacagatagtcggtgctcaacccgaacgataacctcaacatggatactgctgcaaaggaatgaaataaaagatgcatccaaaacccagctgaccttaagctttagagaagctagatggtggcgatgataaagtcttacgaacttaagatgtatcccatgggtgaggattgagaaggagacttcgttgccggcatgcacagaattgctggaccagctttgccttgttgtgtagcttgttggttgcctgtatgatgcaggggattcatggcgtgctccttgctggcccatgacttgtgctgctgcttggataattgatttaggcataattgatttaggcacagcagcaaattgatggaggtgttgtctgtcgagacaatgttcgggatgctcgcatgagaggaatcagcaagcacgaactgctccaacagctcagctaactctgcacctccaagcccaccaaatatgacgacgatctgggcatgtgtgagcccaccctcaccggacacgacgcggctgagtgcatcgctgaggaagggcacagcgccaaggattagatggacaaagaggtcgcggaaatcggttgaagccatccagatccaccgcaaactatggccagcgacctcaaagcttgaagactttcggccaccggcactgtagctgaattttccacaatcaggcgtcgctagggccgacgaaatcgaggtctggcacagcaaagaccgacctccctggctgatccacccacaatatttcagatctgaagaagggaatactggactcttcatagaggaccaaagacaaagaacaggaaggacatagaacgagactaacttgactacgagactaacccgactaaactactatacgaaggagacgcaattgagcctgacccctctccctcccgtcaccggcggcgagccaccggaatcaaggaggaagaggggccggagatgaggctttctttttctctctgtctcgggcaagctaggaggttcagagagctcacaccccacgttgttttttttttgttgttgttgttttgtccattgacgcgtcaagttggagggcaaaaggggagatcgagtggacagtttattgtagaaataatacaactttaataaaaaaaagtgtaaaaataggtgttggttgatagaaatcaaatattcagtaaccagtcgaacaatcatatttcaataaggtatctatcaaacaaccattgttcgataagttacatgtcgaacaatggtcttttgacatgttaattggcttgattgacctatcgaggtctcacagctcgctcatatgcatacacacatatcctaagttcctaattttttttaaaccctgtcaaataatggttattcgataatgtgctaaatctgtgattttagacaatcaacatctatttttataaattttcattaaaattgtactatttttttaaaaaaattctcgagtgggtgttgtttggctgggccggggctgaaatggctgatgctcgggggcatgcagcagcagtgaaacatctcgctgacaatcggctcggaatctccactaggaccaccgcacacagcttcctgtggataaggatatgtagggcttttgctgatccactgatgcatgaggtcaagaatacagaatctaccgagtcctgggctcctgcctgttcctgctgatcaatatacagtacgatctcatcttaccgtgtggcaatctcgctattgctctgtcaaaaactccattacttatatcagttattccatgaaagaggagaggcgagccacacgcttctaggagaagacattgcggctcgatcgtttgtg

SEQ ID NO: 58663 - DNA, 9012 bp, Oryza sativa
ttttttgacagaaacatgccgttcaattttgtatatgcggccggcaaccctgtgaaagaatatcatgaactgactgaaactgaaatagaacatggctgaatgctaaaacaaggattaccattacaaaatccctgaaatgttgattatgcattcatgaatcatgtagttggcatatgacctcgatcagtatcctatttttgtatgtagcatcttcgtagctttattgatctttacaaatatagcttcaatgatcttagctcgtacaaaagaacaacattttcatggtcatgtaaatctcttgtgattttagttgggtgaatagttccatatttcattaaatcaagaaatgaaacaagttaaagagtgaattgcttgcaacgatttcttaaccttgctacttttggttctgtagatgttctgatctaatgatgattacagttagcgtgtagctggacggtgtggtttcctgtgaaaatacaacagggactcggaccttgatttatacatgtatttgcttcataaaatttatacgcccacagacaaatattaaactttcatatggatgaaattatatacttcgaatcctactgaaacatcaatttttctagccgtcgtcgacggaactaagttgctgaacgtcagagaggttatttaagttagttagtccgatgtatgaagttatatatttttaaaaggcaattgttctttgtccggtttgagaagttcaaaaaaaaaatgacttcactaggaattcaaagaaagagaggtgcagtttaacctttaggtgtattttaaatctataacttggtttagctttttggcagcacgcaaaacggcatatgagtattaatcattacaaattctaacaattgatttatttgatttttttaaaagaaacttctatataatttttttcaagaaaacacactatctaaccatttaaaaaacatgctaacgaaaaaagggaaagaaaattgcagtttgaagttaaagaaaagaaagcagcattaggccttcttcgaaacgcagcatagaaaaaaaaagaataggaaaaattctattaaaaacaaaggaaagtagtggagctcacaaagtaataaaggaaaataatttccaagaggttggacaacttgcccgtgccgtgcattagccatcacattcatcaatgcatgaaacaatgataagaaaacttaacttgcaaatttgaaccaaatatcgctttacaatgtcaataacaagaacacgacttcaaagcacaggaacattgtcccaaatgctgcttcaactcactcaggtgaatctattgcctattcctcatcagaagagtcgtccaaagggatctccgtttgttcattcacaacatcagaggtctactcattgaatagaaagtttagttagatcttcaggcaaaggagttaccagtgtcgcctaatgcaaataatgctaaatcaggaggctttacctgcattttatcccaatctttcaatttcgacccaagcatgtatgtctcgcgtaggggtgcccacccaggttcgtcttcgtctttgctattgttctgaagcacatcaagtgtgagaaatatccaagagcttcttaagttccaaatacataaaaatatgtataaaatatgttccgaaataaaatgaaattcagatatggcgcacaagagcagccaacttgtcacaggttaaatcattttacatctgatttagttaacttatggcatgagaaacagtagatagtttattatatatctgatgaatcacaggtacacatacagaaacacagtccaacttgtatattcttaacacgtatattcttaatgctaatgctgaggatacgggtgcttatttaaatgatgtcagatttactcattgttgaacactccctcatatgaaatccctccaactgtaaatagatgtgttgaagacctatgttgccccctcattacctcaagtttagcacaagacccaccttactaccaaatcttaaaataaaacatgaatctactcccttgagctactgaactaattggactaatgagctggtcgcttactagacccaatcaacatccggaacttattattatgatttagattaccactaaattaatcaacatctcttattgccttatggctcaaggaaaatccatttttttcaaatttgaaacttcaaaaaagtagcatcatgtcatttctggatgcaatgaatagacgtgggagacagacagctgagatactgaatgggcagtactataacaacacatcgacggtgtcaatagaaaggtgctgcccgacacaaaatagaatcgaaactctgtaccgaaacaaaaagagccccttacatagaggggtttcacacagattgaactagattatgatgtgtccacaataccatcggcacgatcatggttgttaaggcgtcgctgtagcagtaaggcggttgcggaggtcaaggcgtccactccgccttatgtttcctccaccttagaggcaaaacgagtagagaaagggaaagaacaggaaaaaccagtagagaaaggaaaggaagaagaggtaagctcatcatggaacctagttggcttgtagagaaagagaaagaagaagcggccagagacattgatggcggctggtgcctcttctcgtcatggcggctggtgcctggtggtgtacgatgtctcttagggcataaaacacgtgggtatgaagactaatgttggtctttggtgggctggttgcctggcttagtgggccttttaccaatttcctttttttttcttcctaatttctctaccatatcctccactaatcacgcctcaatcatctcataaggcgtcgcaatgttacgcctcagcgctatggcgctaaggcagtggtgggtcgccttaaaccgccttaacaacactgggcacgattcaagtgcacaacaaaatttggggtgactttgctagacgatttcaattctcatgttaaatcgcataatggacaatatgtcaagcactacagctatcaactaatacatttggacaatgaagtgtatttgcacgttgaggttactttaattgctacggtcttgatgtcaaaaaataattgctattgtcttctgtcacgcaacatcttgtattgcagttgtccgttttgatttatttgaggctgtaatttgcatcaaatttagcataactaatttgaacaacagttccaccagatatgcctctgagaacaactaatttgaatttgaagatacaacacaaatacttagcaacagaagtctataaaatgaaatggagtgtttttgagtaaagagagaattatcatagctaccttagaaaagttggaagatgccttgcccttttgactttggttagatgttttgcttaattctgtgaggaaggcctgctttgtttcttttgccaacactgttaggattaacacaaaatgttcagaatattttcgttagtagcaaaaaaatgcatatatacatcaaaataaaatacaaaacataagtacggtgtgcagaatgacaatgtcatatgatagtatttgctgtcaatgaaaagatcatgacacatggtgtttccagctggcctcaattatgcttaacttccgcattttgtgtcaaacaaaaggaggtatttcatgcagtcagaagcacataaacaaagaggtcctattcaaaccatcttgagttgatagtagtcttgcactcttgtgtgtctcccaccttttattttttagatgtaacgccccaacactcgttgtttttatcaggctaactagtagggaggaaggatgcaaagaaaatgcaccatcaaggatgcaaagaaaatgcaccatccaatgaataaagagtacatgctgaaccagtagttttactttttcataaatgtagaatcgatttctttcatatttattgattttttgaagtctaaaatccaaactatcaacctagtcacaacaggttcctaaattattagaggtagaatgatggattacatggtaagtaaaccaacacacctttggcgtctttactccttgatgggttcaaacctttccgacaattctgcgccttgcttacctggaaggaataaagtaaaggcctatcaaatcaatcatcaaatagctgctattttattagtcctgctattacatggaaaaggtacatgcacatgtccgtgagtgtgttcccttaacacaagctcatcaaatattcaatataaagcttcgaaagcacctcacatatacattttcactgtgctaagtaggtaaatacagaattaaatgtgctttacagcagtaaaattaaaattttctttcttcaatgtacttcagtaataaaaactaagaagacaagcaagagctgtcttcaaaaataaacaaatatgagatacatctgtatcatggaaagcttgatgtatcctatgatatggagagtaactgagcctcagtgtgacgttataagcagaatggcaggataaacaaggagacaataaggtttcaccattgtagggtcagtcgaagctcagtaaaacaaagaaccatgatgtaaaaagctatacatgcatacttcacgaaaatataagatagccgtgtgcttaccgagttgaacaacctgacgactgaatcaccagcagcaagacaatcggtgtaaaaaaaatcaacaggagaggcatccaattagctaacaaataatatgtagtttgtgatatgcaaaataacagagtagaaaacagaagattacccccttgggttgcgattttgatgagctccttctctttactatctaaatgatttgtgggaatgacatggcccttctctgcagcctaagcaaatcaaacgcattcaatccaattcagcatttcagcacagaaacttctacaaggggatgtagaaattatcgagcgaaacaagccgtaccatgcgcttttccctgcggccttctcccttgggcttgtgttcttctgcgtcctcggccaacttggcggcgaccagcttcttgtgcgccgaaagaattggaccctaatgcggcggcgcgaaattcatcagtccattgaaaagaaaagtaaagaaaagaaaagcattattcttcttttgtagagagagatggatcgaaccagtgggtcgtcggggagcttcttggccatgatcttcgtgaaggcgacgcggaacgcgcggcacccctgctcgaacctggtcaccgcgccggcggcctcgtcgtcaccggagccggaagccccctcctcctcctcgtcctcatccgagaggcgctcctcgtcgtcggagtcgtcggagttgtagtcgcgggcgcgcttgcggagcagcttgaggaacctgtcgctgggcttgctgcggcggcgggggaggtcgccggggtcatcggagcgcctgggcgtcttggcgaggcggccctttcccttgcccttccccttccccctcgccgccggcttcttgcgcttgtgggggttgttcgacgcggcgccggctgcggcggatggagaggacacaggctgcggggcggtggcggaggccatggggctcttccaccgggagagcaaccgacccctcgattttgttgaggatggggctagctggccggcgaaatccctcgccgccgccgccgccgtacgccggtggggaatcgcgtcgtcggcgaggaaagaagagaggaagggaggaggcggcggctgggccttggggtggaggggattctagggtttatggtaggattttggggttattgggccggtttggttcgatgatccggtgagacgtgtgaacaaatggacttctttcttgtatctcctcccaacaaaatgcattttcaatattgctaaaagtattgccctaaataaaatatttgtatacttatgtttttttagtaaatggtactagaaaaaatatctgtgcattacaacaagtaaaaatctttttttatgatagattaaaatgttgggatcggtacacattataattgaaaaagttaataaaaatccttactttgttttgggctaaaagaccattctttcgttcttttttcagccctaacattgtccaatacctacccccgctcggtctgtctcttcggcctggtgctctgtcatgccggagctgatcctcccatcaaatccgaccgaatctttctcgatatcccaaaattggttgattttttatccactttatattctctttccgttttttctaaaatcggagataattcgcaaaacttattaaaagactcgatattaaaaccggagataattcgcaaaactcaataaaagactcgatattctctttccgttttttctgaaatgggagataattcgcaaaactcactaaaagaccaaagaagcttattggttggccatcttcaatagagattaaattcgatgaattaaagccgaattgaaaggggaaattatgagaaaaatgataagagaggagtgaggaatcgatttgcaatcaattggaggagaaaacagtggaggcagatcgacgttaggattgtgctagggttcagcccaggaacgaacggtgcataggatctcgtgggaggagacagaagaaaaaatttcggaatacctacatatttatttcttaaagtagggtcgtgtttagtttgtgtgccaaaatttttttagtatatggacacacatttgaagtattaaacgtagactaataacaaaacaaattataaattccgcctgtaaactgcgagacgaatttattaagcctaattaatctgtcattagcaaatgtttacggtagcattacattgtcaaatcatggcgtaattaggctcaaaagattcgtctcgcaatttacatgcaaactgtgcaattggtttttttatccacatttaatgctctattcatgtgtctaaatatttgatgtgacagaatttttggaagtttgaagagaaacactacctaggtatagatttaaatttcttcaagagtaaattacacaagactatagttattctgactaaactatcacaaaactcaaagatttaatactaaatttgttaaaaatatataaatttaaggacaagtaacataaaactacatatttaatattgaagttatcacatcactacaaattttagagtttaaatccctagaaccatcgatacgttggaactatatattatagttttgtgactaaatttgttctaaatctgtaattttgagataattttcttactaaatgtgctgttttttgacactccatgttaaatatgtagttttgtgatactatctatagttttgtgaaatttactctttctgaaatttgatattatctaagcaggatggtaaataatagaaacccattttatatcattttggaccctcgaacttcacaccgaaattggagccctgtcaaataggtcataaactaccaaaaattttttaccatcaactttcaaaactagataattaacaccctgcaatatatttttttgttttttaaataaaggtggttttcctggttcatatatttattatccatgttcttctatgtaaatgtcacttaattaggtacagagccatgaaagcctattgaagttcatattattgaaaaccactttcacatagtagttcaaaccatcatgaaacttggtttataatgttatttgctcggttttgaaatgttgagggtttgaagttcacattgctgagaaaccaccatcatatccatcaaaccatcacgaaacatggaatacggtgttatttgctaggttttgaaaagttgagaatgaaaaacagccggtttgcagtttagggtgaaagtacactttgagcaaagctgaagggacaaaatggatttgtcttctttcccctcttcattttttacgcacagcaacacgagaataatgtaccaagatgaaacttaattgctttttaagttatagataataattcatataacatctacaaagattggcacaactaaatagaactacggagtactcaggggcggaggcaagcctagggcaaatcatgataaattaggttaaatcaccatataattttaaagaaaaatcaacaactcgttagttgagccctaggttagcccactctttagtaattgctagctccgccactgggagtacttatttaaaggagcattagaagggtgattgtctaacaaaatttttaggtgtcaaagagtgtacatctatatatatatgtaacaagatggatatgatagatatatatcatccatctcgagaaggagtgttggactgtgtgcatgtgtgtattgtggctcaagatgcccatgtacccatatgcttgtatatgtactagagtaagcaatttagaatagtacactggtactgaagcttctagaaaaagagctatctaagttttcaactattactgactcctttgaaatttaagattaccatataaattatggataattcagccttttgatgtatttttcggattcattagaaaaggacaggaaatttgccataagattgtatgtctatcagtctatggcttaatttgattggaaaataagcaagttgtctaacttcttgcaaattattttccttttactatttgagatccactacttttctatcctgcgtttcaaagagggcctaaaggttaattgcacctctctctttcttttttatacatagtgaagtcgattttcactgtaaacttttcaaacaggacgaacaacaattgcctttcaaaaatagataacttcgtacatcagactaagggggagtttggatgggactaaaaaattttagtctctgtcatatcggatgtttgagcactaattagaagtattaaacgtaaactaatgacaaaactcattccataaccctggactaattcgcaagacgaatttattgagcctaattaattaatccatgattagactatgtgatgctacagtaaacattctctaattatgaattaattaggcttaaaaaaattgtctcgcagattagctctcatttatataattagttttataagtaggatatggttaa

SEQ ID NO: 58664 - DNA, 87866 bp, Oryza sativa
ctaacttaacctctgacgttcagcaacttgatgtttcagcaggattcaaagtatagaatttccatatactttgtatccctatgcgaaaattctgaaagctaaatattttctatggacgcatcattgatgaagcaaatacatgaatcatgaagggtctgagactctgagtgactgctgtatttcacgagaagccataccaaccagctaggcactcgctgaaaatcatcattagacaagaacatctacagaactaaaaataatactcccctgtttttttaatacataatgctgcaccgttgacttttaacacgatgtttgaccaatcctcctactattaaaaaaatttatataaatggcatttattttgttgtgatatgttttatcattaaaaaaaacttcaagaatgacttacacttcagcaaatttacactaattttttttaataaaacgaataatcaaacaaaaaagtcaatagcatcatctattttaaaaacagagatagtataggttgagaaatcgttacaaattcacattttaacttgtttcatctcttgatttaatcaaatatagaactattgaccaggaaacactcaaccaaaatcaccaagaggtttcgaaacagttgttcttttatacgaacaaagatcattgaatttatatttgtaaagatcaataaagctacgaagatgcaacatacagaaataggatatatactaatcgagctcatatgccaagtacataattcatgaatgcataaccaacagagtgacccggttttttcaggactttgtaatggtaatccttgtttcaacactcagccatgttttatttgagtttcagtcagctcatgatatttctttcacaaggttgctgtgcatacaaaaattgaactacatgtttgagcaaacaacttaatgtacaaccacaagacatcaataatgtagaagagtagaattatacttagataaaaagagcatttgactatgactatatagtatcacaggactgaagagatcagttgttcccttgaaaaaaacaacctgatcaaaggggcatataacgcaaacaccaacaaggccacaacaaaagacacatctatctatctatctatctatctatctatctatctatctatctatctatctattatctattatattatatatactaaaagtccattacattaaactccctataaacgctctcaagccgccacgtgagcctcctaaaatccctcctaagctgccacgccgcacttttataatttcatggtgtagcaggtgtgggcccccaaggagcaagcccaaactgccatcgctcttctgccgctagcggcgtgcgtatagtagacgaggaggttgcgaagcgatcgcctgttcccaaatccaagggatacgcgagattgtcgccgtgacctagcagtctagatgaacccggctcgccgccgccttgcctctccgttgcaacggctgcctcgcgccgtcgtcacccccatcgctgccggcccgccggctgctgtgagtccgtgaccgcatgcaactgcaagacgagcatgcagtcgatcgatgatcgatctgctcttgcttatctgcatgtgaagaggaggtgatcaggtgatgatcggagcagatagcagcaagacaagccaccaacaccacgttgcctatttgccttgccatagttgcctatctgcctcttgccaattgtactatttagtgacagacacatttgcctttgactaattttctgattgactccatcgaggttagcttggagccttgcaggcttggacgaatcgatcagtcaatcggcgacaatcgactgaactaactggtaagatctagagtagtttcaattaacccgatctttttgttgtttcgtaactttgtaatacatatgagttcaatcactaacatgttaatagtttcagttatcagttcattctaaatatcaagtcatcgagaatgtattcataaggtagcgtaaaagggggaaaaaaagaaattgctctaaattgttgaacaaccactacttgagatctaccatgtcccaataaagattaaatggtttggcaattttatgcattgaaaagaaattggtagatgagatttttcatatgtagaaatgtccaaagaaaattctatggtaacacgtagaacgtttttcatataaatattgcttttagatacattttaagtgtttattggtaatcatgtttcttgattattattttggggttgtattaagggcctccatgtttagtttcgcactaggccactaaaaccctagaaccgggcctgcacacattagaagtatatatcatcctacctataatacagacgtacatatcctctctcccactgtcccacattgcaagtgcaagtacgtacgtatacttatagtacgtacattttctccttcctctaatcctccctttgtgctacttatataatcttattctatagctaataaaatttcaagcatagcaaccaatcttactatagaaaatataaaaaaatgaaacatctaatgaaaccatcgatttttacttaaattgatgtgtccaatattttaaactattagattagatatattatttaaaaagtaacaccttcctcctgtattcgtataaatgacaaatgtattactgttggcccaagaaaacaatactccatacgtacgtacgattgaagaaagaaacactattgttcgccacgagaaaaaaaatcataagcatgtacttccaataaaacacgatgaaggcaaaaaaaaaagtacgttctatgtgtacaattggaaaaaaaatcaacgtgttctaaaataagatttatacaatttagagataaaatatattactttacaacttacgcagttgaacctgatctacatataatacaaatataaaatatccaatcaatgcttttaaatgctctatcttttaaattattttaaaattatatatctaatttatgatcttatatttatttagttaaataaactactgatgtctatggtcctaaatacatcataacaatgtagtggtagcatgtaataattaatatcataatagttttttgaataattttacatcatattttagtttagggtgtatgcaatgctaatttaaatctacatatgtggaaaaaaatgaaaacaacataatttagttattgctaagtacatatgatttaatttcaatttgtcaaaaaatcacattttttaagactatttgattggtatttgaaaagtgagatcataaatgttacatagatgcgaaaagaattatcaaaaaaattttcagctaatgatcttgctatagtacaacccctcgatacatcatgatatttatggccattatgtatgtgttttcttttccatatagttttaataacaaatgaataatcaagcaacatgtgtgtaataatctactcatgcatgatatattttcttatggttgagaaattctaacatgtcaggtataattgatggaggtatgtcatacaccacactgacgtggctataagtatacttcaactaattagttattgtaaataagtttgaaaaataaatgcatccttcaaattagtaaaaatgtctcatatgattatgaacaataggtgtagaaaacaatcctgacattgcactatagatatttataaaaaatataaacaataaatggtgctttggaatcttgatgatatttcaaaaaatgactttgtcctggttacatataaattcctctaattttgacataaaatttgactcctcggatttatgcgacggagggagtataagcaatataagtctatctttagttagataaagtagtctgctacattttaatgaaaaataatttcattaatatataataaatcaataaagtcatctatagcacacaagaaaaatgttagtcaaattttggaaactgatacgctaaatattctaaaaaaatcacacatagtacaaacaaatatgaaccaactccattattgtgacacaatttttttcataaatttaaggttgtacggttgccaataattttagtatagactttatacattgtaagggtaatcaaaagaaaatcataactaatgtccaaaccaattattagccaaaacatgtttaaaatggagtaaaaaaaatttcaacaatgtcatcctaacatttataataaaaattaaagcaatattaaacaaggtacccgtgcatatgcgtaggctatcttcctacaaacgctctcaaatcatcacatggaactcctacagacgctcctaagtcgccacttgacaatataataaattggtcgacccattatctgtctatccatttgtcgtgtgatttctaacaaaaatcacccagattttttctacctttagattacatctaacgaactacaaaagaaaaaaaatacatatttacttacacattatttttttcaaaattacagtgcacttacatgtcatatcaactgaatttataaatgtaattttagttatataggactgtaattttatatttcaaaatatagttttaggtatacaatactctaattttatattttaaagaaaataacaaatacatatttatatataccaaaattatagtacacttacatgtcatatcaactgaaattacaaatgtaattttagctatataggactgtaatattatattttaaagaaataacaaatacatatttacttacacattatttttatcaaaattacaatacacttacatatcatatcaactaaatatacaaatataattttagttatataggattgtaattttatatttcacgatgacgagagggatggtgtcgcttgccgaatagcattggccgtactgccggcggccggctcgccagtcagaggccgcgttgccaccatgtttctccatcatagtgaatgcatgggctagctgacacaggccgtgagctaccgctcacatcacaagtggtgcatagcggccaaaaaaaatgtcaaatgccatagaaaaaatcacacgggagatggacatcaaaatcaattaaatttatcagatttatctttaaaaaaatccatggcccacctccctctcctcttcttgcaccggcccacagcccacccttcgaatacgttccgtacgtaacatacgtacgtgctcctccctccccttctatctgctctccccttcttcctttcctttagttattaaaattttaaataaccataatttctcaaaaaatgtagtcataacttttaattacacataaatatttttactcttctatattattgtatccgttgcagttcattaacaattaaaaggcaatataacctgtaatttaacttgcgtttttatcatatccatgccattaaaattgttatataaaatagaaaatatgataatgtatcacttcacaaaacgtgcataaataagttagatctatgatatgacaaatataaaaagaacttaaatggcgagtaacattaaaaaaaatcctatcctaacctccttttgatataccatctcagttgtaaaaaggtttacgaagaacatgataatgtggatcatatcatcatatatcacttaaaaatataattagatattaactgtaatatcacaaaataaaataaattaattgtaataagcactccactcccaaaaaaaacacctccattctaaatatcggtatatcaaaataatgttatcttttatgaaacaaaataatgttaattaaatctaccatgaaaaatattttgacatcattatatgtttaatattaaaagaaatctatgatattgtaaaataaaaatattttaattgcgattagcatttcaaaaaaaatattaccatcattctaaaatatccatatatccaaacaatattaattagatttgtcatgacaaatatttggatatgattttaataattaaagtgaattcattataaaaagaaatcatcaaatgttttcttcaaaactttatcgatatatcttaattaggcagaatatggagcatgtatgtcagtattttcctcttcattctttggagtttaagccttattaatctaatctttgtataaagtatataacatctagcgtactcgacccatatatggcttaccttacgtactaattttgtatgacactcaaacccattttatcaattctacttacaaaccgctattctccaataagtcaagtatattgataagcttattgtgtatcaaaatgactatgtgagatccgatgaacagctatgctatcatgtagtgtaggagaagggcaactggcaatatagattataagagatataattgtatatcagttcataaacataaataattatattaggtgtacaatctcatggtataaaattaaaactatgtcttcatgacttttctttaaattggaaaaaatacatgtataaaacaaaatgataaacaaaaattgaaaaacctcaataatatacaccctacatacaattaaaaacgcaaggctaatctatgtggcatataatctatgtatttattggtcgattaacacatataattaaatagagaaagtcttgaaaactttcgttatgtaagcacaacattctacatgtaacttatcattagttaagtggtcatgttattcttagatattggattatttgtacatctctattatgttaatacatattatagctaaacaaattagaaaaaaaatcaaggaatttcacaggtagtagtgaaccatcgtaaggtatttgggttatagctaacgaggaggaaaaaaagactatgatatccattattaattaaaggtatatatagtttcaaagaaaccaacttcatggcggcaacacaatatttctcataggttcaaaactgcatggtttcacacaattttagtttacaaattttttttgctgcaaggataattagaaaatcatagccaacattcaaagtaatcccaaataaattgtaatacagtagaaaagatattttaattaaagctcaccaacacaaacatttgtaataaaatttcaaacacattatacaagatgcccgcgcacctttctagtgaaactaaagtctcaaatactgtttcccaaaaaaaaaaagcagttaccaattttttttactggataaaaatttgttggttggttgggatggatacttgtagcactcctgatggcatcctctgcagcaaatgtgtcctcactggtagcaccagatggaacgataatcgcactcatgtgctggaggcttgaaaggtgctgcagaccgaagtccaaaacaccactactgcaatgaactttcagtagcttgaaggtgaggtgatacttctgtaattcttgcatagctcctggctcgaacactggccatatcccaggaacgaaacatagaagatataattccttgagagcttgaaatcctcggttgtcgatgactatccttccatgaggagcatgccctgtaaatacgaggcggagaaagagcagagtggagattcctttgagtatgttaatgtcactcttctccattcctgagatgtacagttgcaggtgtatgagattgtcaaatatgctaatccactctggcaccctggcaagagttttcccaatgataagtttccggagacgctgagttgagaagcatgaacccatcgatgaatctagaatgaaattctcatctcctttgtaattaattcagtgagagtgactgcaggttgtgtcagcccaattcagtaagggatgatagcactgcttccctgcatcgcaacttataaccctctgtcccgacagggtcttcaacagaaatcgcaagatctctcagtttggtcagacatttaagatcctcaacgaatcttattgagttgcttgagatgtggaacagctcctctaaactttgcatagttccaatcctttctggtagtctcgctttagtactcacatataggcacacgagtttctataatcgaacaatggtatctggaagggcttgtatggaacataatgtgacatctaacatctctaaatgttgcaagttcccaatttcaccaggaagttcagtgataaattgagaatgaagaaccagatacctaagttgaagcatacttcctaaacattcaatgtggtgattctgtaacaatgtacaataacctaagtccaacactcgcaaagattgaagattcataaaatatggtacttgcttagtagacccaaacacactgattgaacggacagaatttttgtttgttatgttggctgggattacagcatcttcagaatcgttgaactggagggacagtcgatggatcttttccggcaaagagctgcacttttgtccatctattactgtgacgaaattatcttctttcgacatggaaatgataatgttaagaaccaagtcatgaacttgacaaatttgtatactgccatcatatgcaatgctcacaggtaagatcatacttctattgataagctcgttaaagtaactctccgctacttggtccaatctgttacacctgtcttcagcaataaatccttcagctatccatttccttattaactttttggggctaatcttctagtcctctggatatatactgagatatagtaagcaagtcttcaaatgtggaggcaaatcatagaaactaagtaatactccgttcatttcaaaatgtttgacaccattgactttttagcacatgtttgaccgttcgtcttattaaaaaaatttgtgaaatatgtaaaactatatgtgtacataaaaatatatttaacaatgaatcaaattgatatgaaaagaataaataattacttaaattttttgaataagacaaatggtcaaacacatataaaaaaaagtcaacggtgtcaaatattttaaaacggagggagtggtatctttttcagaccttgtagagtatggctattttccagtgctgagccaatagaatttagcaccaactcccactcttcctttgtgttagatttggttgccaacaaactagcaatatgaagtatggccaaaggcaaaccaccacattttcttaaaactaggaaggaagcccgcgcagatgcgcaggcaatttatttttgtttatataaaaaactactgaaaaaagtcttatatcatcatattaactataggaacaatagattacctcgtaaccttaccataaaaagaagggaatatttatattgtgaaatagaccatataatttgatatagtaaatgatagtgtctatcatattcaaacaaaaatcactttgttttggttatatgtaaacttaccatcatcatcctttgcaaacataatatgagttttgatgttttttcttttattatacatctaattcacctatgcatgttcatgggtaatgtacaaggaaatactctatattatcaaaattatttttactaattgttaacacaatttatatgagaatgacataattaaaaaggataaaatatgattccatatgacatttttgattgtacatatgtacataagtttttttcgaatggtagtctctcgtatgttcattctttttcatgttttttttgacaaatatttttctctcaaaggaggtagggtgttcatatgtgtattcatagtgtgggtgtgcacacgtttatatgaccgcgtatagttgcctttcacattgctagtcaaaaaaaatactttcaagaaaattggcgagggtggcaataagcggcgacatggcagcgtggcttcttcgtgaacctcgcaaagattggtcgctacatatatgcataatttgaggaaaacattagggccacaaagaaagaaatagaaaactacaagatggggtggaccatatacacacacttcttcgttatttttgacatctattgtatatgtacgtgcatagagagagattagctagttttaaggagcgagggcttatctgaataaatctaatttaatggttgaagataatggattcaccagtttaagtgcaaatcgatggctagatgttttgtttttcccttatattttttctaaaatttcctcctatttattagagcatcacatgacattttacaagtatttgtagaagtataggaacgctattgctcatactcacaatcaacttgcagtcaactattggttgttgtgattttgtggcatcctctatatatccatcatctttttgttaatgggttcccacttagtatcatcctaattattaagtgaattgtgcatgtatgtatcataaacaatataacttgacgattgtgacactggtttgtatatagaacttattacatactataggatttatcggagacatacgattgatatattatactattcttgattcacaaagtatattatgtactacatatttagttttagtgcataggtaataaatttatggttaagttctgaagtgcttatcagagtggctacttcgttatttatcatgaccacgtttaccaaattgctaaatggtgcgtattttacaaaatatttattattatagattttttttctaaaaatacaaataaacccattttgaagcttgtaatatttaatactcaattgatcttgtgctaatgacttgtgtcttttcgtgtgccctagataagctacgtcaatgagctagatcgaacgaaggctatgtaggaggaaaaggatattgacatggtgttaaatgaatatatttaaacttcaattttctaataatgtatgaaaagagtaaacataatatgtaaaaatatatttatgataaatttagtaacatccttttcccatatcagtattttttacaatagagagtgagtaatttttcaaattctacacacacttgaagttgtttttattttggaaaatgtaattttaatttaacaatcacataaactatgctttttatttatttatatttttatgggtgtttcaatgacatgcgcttaatttgaatacaactcgaaatagcatatatttttacaacttaaagtatagttaatattaatttaaattattagtttgattttccatctaatctaaatgatgataagagaaaaataaggatgtgggacccggcatgtgtatgtactgtacatagaaatagttgcgtacgtactctacgtaggtacttaagaaggaatacctacaaacctgtgcatgtataggcattaagatgtgggcctttttacagataaatataataactagtttctaagatagatctaatagttgaaaataatgggtccaccagattaaatgaaaaccgattaattagtagatttgcttttttttatataatttctatgatttattagagtgctatatgtcggtctatgagcaattatagagtactatgtggcggattagaagcgtttgttgaaagtttatcctcttgattactttttctccctttttctctttatgaaaatatttacaacaataatttataaataaccacaaccttctaaattatatatttatttgtaacaatatattttaatttgtcataatttttaacttttaattcgtacgttcaattttttacctattttggaccattgtgttatttatgataaaaatcacaattagaatttaagtgtatgttatctacttcactcgtaaaatgtatattcttctaagttctatttactatcctttgtatgtcatttaaacggatatgaaaaactataaaaagaaagtgactatatattatttcatccagtaccacttcacttgcatgcataaataaaagatcgactttttaaagcctcaccaataagaagaatgcccgcgcagctgaaaacatatattattttttttattgtacgttttttaccatatttgtagagtaataagttttgtttttctactatagaaaatactattttaaaaaactatctatttttgtctactaacgcatcgcatacgtacatttttttttctagtgaaccgtacctttttaatagttttttttatcgtacgtacgtatgttcttttaaattttaaataatcagtacctaaagtttttgttttcttttcaattatgtgctcgtacgtagattttctggtatagacggttccactcgtgtgcactttccggtatatacggtttcaacgtacagtgtagtactcttttttggctttatagctgcacgtatgtttgtttgttctttttaagccaacagtacttaagggtttatatatccgatcgaaatataagttaattgttctcgtaaaaattctcatgtataaagcttatatgttactccctctggttctatattaattgacgttttggacaaagttaaggttaaacttttatagctttcaccatcaataactttaaaaatatttagtttaaagaaactagaaaaacatatatagatttgtctttcaaaacactataataaaagtaaacatgcatttatttatttattgtatatattataatagaaaaataaggtcaaaggtatatagtgtgtcattgtccaaagcgtcaattaaaatgaaaccggagggagtaagggtgtagcaatgactttttaaatagatctaatctaatggtctaaaataacgggcccaccaatttaagtgaaaatcaacggttagattggaaaataccatgtggcggcttaagagcgtttgtaggaacgccacatggcggcttaggagtatttgtagggagattaatggacttttagtatgtagtagataatagatagatagataagagataatagatagatagattgcttttgaaagttctactagatgtgatggacaggagtgctcaccatggaaaattcttttacaaaacaaccttctggagtcactttcacttaatggttccaggcggtaaatactgcctttgaaggtagagcaacataacgccgctatatcaagaatacgtgtagttgtaattattctactgccagaattattctcaggcaatacacacttcaagatttcccaagctgataagctccagatatcatcaatgacaattaaatacctatggcccaagttcatacaataagtccggatacgaaatagcaggaagaaataacagaaaggtagtagaaataacacaaacctcttgtcatggagaaattctctgatcttgtcaatgagttgcctctcatcatccctattaccagaagccccaagtccagaaagcaaatccaaaagaatcctcttcatgtctggcatttgagatacaaacacgaaagcagcacaatcaaactgccatttgattttctgataaacttgtttggcaagagtagttttccccaaacctccaaaccctgcgatagacaccatcttaagtcaattaacaaatccacaatcttcatcagctgcattctcccttagcaactttataattttgtccctcggcccatcaatcccaacaagtccacctacctcggaataaagagtctcactccggtgtcttctacctagagtagaaaaaaatctgaaccgttgatcttatttgatccaatggttcagatctatttctactaccaccacacttagtggtagtagaatcgtggaggggtacttttatccaggaaaaattatctgcggagggatattttcgtccttcccgaatcgcgcatctggagccgatgcggagagaaccctgcggctcccatcaccaccttgacgacctcgcctgctccaccgccctcgacgcctcctacttcctcgcctccgtcgcactggctgcctcagccgccctcgacgagctcgcatctccgtctgggatcgccagagctgcgccctctctgccgctcccccgcgtcggcccaccttccgacgagttcgcctcccggatctccgcctccgacccagcaccgtgccaccggccgccgccaagacctcgtccacctcgctatccccttcctcgtcgtcggcctcctcccccacgctcggctccagccctgtccatctccgcccgccgttgatcccacagccgcgagggcgagcccccaatccatcgcctcccaagcggaacccgcagcctccagagccaatgaccaccaatctctcgacctccgaatcatcatccaagactcctctcgctggctatagcgctgctctccaacggattagctgacatgagaagactctttttctgctttgcaagtcagatttgatttgtttttcttgctgcttgtaggtttgcagctcgaacatctgcactgaatcttcttttttgttggcctctagttctcgaatagtttttctgcttgtctacttaagttctgcagttcttggtcataatttttcctcctagaagaagggattcaagttgaatgccagtaaactgaatccggagcaagtgagcttgttcagaatggctgagcatgacaaggtggacaagctaatgatcactacgtcaatcaacgcttgagagattcctggtgtgctatgtcctgtaattcctgtgaattcattatctcaagatggctttgggtggctttggcttgttactgatggccatgtttttttttcaaaactatagcttattaacagcttgtggttttgaaagtgcctatctgtatatatcatcgtttttgtacgtggttcaatgtatattacttgttgtaattgcaattgtaaagtctacgtaaaaaacataccggattattcttccgttgccttgtatctgtcattgctggattggagtgtttcgatttgtccatcgtgtgtaatattcagatatataactaatatatttaaatttcacatgaaacaatcaagctgaatggaaaccaaatacctacagcaagaaacatctatggaacgcgatgcacaagcgccggcggtggccggacctcgcgatctgcttttctttttctttccctgcgctctcctttttgatggagagcgactctgctcttcgatggagagggatcgagcgacgcttgaccataggacgcacaaatgagaaaaaaattaagtgtcagatttacccctattcggttttagcactttactaatttaccctttaaaataaacggtcgagattaattctacttggagtagaatactgcaagtagagggcaccggagcgtctctccggaataaaacgctggcaggcgagggtcaatggattcacagccggtacccatggacacagatacatcaagcttatacctttttctacgatcgttcacctcgagaacttggttcttgagtttttcaatctcttgagaaatagtacagcttgagagcagctctctcagtttcaggatattgttgatgataaatcctctgatacctgtaggctcattggatttttcactccgagccatgaaagcgtcaatggtgtcctcgatgtcgtaggccagctcccttacctctttcatccaagccttcacttgcaagtggggctcactcaacatcgcgtacttctgcatcacggtgttcatgctgctcagctcgtttcgcaggaacagcacatccttctctactgttttcttcttggcatactctttttccagcatactggatagcttgccgaggagagactccatgactcctgtagaggcgctcaccagtgcacccgccatgaattgcctcggtttcttgacaggaaggacaatatcaacagctaggaaagaagataatcaagaagagttgtgtggaagagaagataatccactactgggctcccaggctatcaaacttattatgaagtcaagtcaagtgaacccatctcatggagacttggacttgttgtgcctgcaattcaatctatccacccaggtgttgaatagaaatcattttattttaactgagcgcgtttagtttggaaaatatatggtggtatatagtggaaacatagaaactaccattagatcgaaaaatagactttcgagattcgtttacgtcatcataagtaaaagttttacttgcaaatacacccatgagtaaaaattttactggtgatatgaacaaatctccgatgttcattttttgatccaacggtagtttctaagtttccacttcatatgtggtttacaccacatattttccccgttttgtttaccagatcagcttgaagattgaaatggacaactttatatctttaaattcatagttcactttctctataacattgtggctaccaatttccaaaatcatgtggtctagtcttggacgaaaagattgtgtgctctgaaatatctcccatctttgacgttgatgtgtctcctgcaatctcaaatcacaaaacaatcccttctatctgaataaatttcggttagctttgatgattttttctgaacaaattcagttaagcttgtttcttttgttttcagtctcaccagtgatgttgcagttcccccaataaccatgctgttgtagcctgtaaaaaaaaatgatcccttttacctgaacaaaattcagccgttgaggaggggagaaaaaaacaaatcaggaaacattaggcgagtaataatggacaaacttggtgcagttgtgatgcgcaatattgggcagtaagaatgagaaacgaaataaaatcgatgcaatttaactgctgctatgtgggattggagggatttgggcatcgagaaacgaaataagaaaccgacgcgattgtgatgttgcggtcacagatcggcggcggcggagaggagaaggggatgatgtggacctcaagatggcaaaattgcgattacggcggcggccggcgattgggttagggtggggtttgtgttgtgtgcttgggtgggtgggtgggtgtgggggggggtgctgggctagcacatgagttcatcaaacattctatgcagacgttattgtacatttgtactccctccatctatgtttatgtttttaggatatgtcacatccacctaaaatcccttatattttagatcacacccacccaaaattccatatagtttgggagggagggagtaaccaacacttagttcatcacaatatcaaacattccagattgattggatattccaacttctaggtaagatcgagttagcttgcgtttcggatattccgggatgatgaacattctgaactcaatgtggtaagtttccgataaaagttaaaagcaaggggaaaacttcaatttgccagaattgcagacaatccaaaacattggatattccaatatttcttgaaagctcacagcagagagttgggttggcccttaaaaaaagaagaggaaattccgaatgatagatactccgacaagattgttgggtattccgaccagaaaagcaatggcactttaagaaaattagtcattgagcactagtgtcaaactcaattatatatatgtggcatcccttttaatagtatagcatatcctaactctataaagataaagagtaaaatggtttaccaagaagacatgcctggatacttattttcgtgctaacaattggacaaaataaagcattagataattctagttgtgttgtcattaattgtccaaatcaaatagtgggggcttgcatgcactttcgattatcttagtaagaaaaagcattgttattttggcattgcattagtgatatagacctaaccaactatttcatcacatcctttaattgagaacttgtagctagttgtgttgtggtcatccactcaacttcgcagcttcaaatgtctttgtgttgactttgtgtttggttgagttagctttcctcccttgggagatgctctattttaagcccctaaggacctgtttgggggagttttagattctgagaagcagctgtttggcagccagcttctgagaatctggaaaagctctgaaacctagcttctccagcttctggcttcttagttcatttttcaaaatctaaactgtggactgtttgaggcagtttctagcagaagcagctgggacaagctcccctaaacagggcctaagactatctccaacaggctaggctaggcatagcagtacccaaacccaaaatacgtgctccaggggctactgtagcaggaaaaaacatggtccaacaggctaccatacaaaggacctattttgcgtgccaggcgaggcggaacccaaatatgagcgtcctctctcctcgaccgaaacttcatcgcaagcccgcgaaggaaactatctgcattgcagggttttcttttgcgttccctgttggagaaggcaagaaataggtgcatgaccttttgccgcagcgtgacgcataacgtccaatgggtctcctgttaagggcagtattgttggagatagtctaagttgccctttgtctaaatagactttgaggggctagttaggatacaaatcaaacattttaatcacccgatgaactatttcttacttttaagtgaggggatttatttagtatttatttagcacatgtttataagtatatcattgacattacccaaattaaggatttatggatttctaatctaccgctaaaatagatatatggatcatatatattatttatatggtatttagaaatacggttaattatattattgtaaaaccgataatttctataaaaaatacgacaaaagcagttggtacaacatcaaaatcattccatttcgcatatttcactattttgttttttgtgtttgtcagttattgtttccacatggtttaattagtataacattttttttaaaaaaagtataaacgtagacactcacaataaatgcacactcatctcgcacccaagcacattctacctctatgaccacatccggaaaactagaccgacatatcttgagattgataaagtcaccacagacacctcactgttcacgggtacgttatttatcattaaaaataattagcagtaaatataaacacccgtgttaaatttagaacttgaacttggatgaattgattccaccataagtaatctagctgttaaactacactcacttcgttaattagtagaataccaaaaatgactgtcagtaggttaggaacttctgctaccattttcggcccctttgattcaaaggaaattcataggaattttggtggatttcaatcctataggaaaattttctataaagccctttgaaacaaaggattgaatcatatccaatcctttgaaattcctatggaatggacaatcctatagaaattttagagaaaatttagcaagagcttcaacctcttggtaatttttctttaagactatctctctcatccaattcctgcgtttttcctgcggttcaatcaaacggtaattcctgtatttttcctacgttttgcaatcctccgttttatacttatattcctatcgaaattctacgtttttcctattcctacattttctcaaaccttcaattcaaagagcccttcacctctggatgcaaggatcgaggaggttgcccatctccgataaacttcaggggaaagaaatttaagcctaatgttagtgcctatcggctatcatcttatcatctatgtgccttcaagtttaagaccggagtatacttgtcaacagtcaaccttcttcctcttttgccgtgtcctgctcctccaccaaactcacctttttcatagctataggttcgaatcttccactgcaatgatatggttaattaacaatgcatatggccaaatatttgcaacacccgtttctttttcttcttgtgcaccacggcaccaagtcaagtcaaggaggcacactatcatataaataaggggacaattgcgttttttactctattttaaagactaacggctaatttggcccctgttttttcgagtttgctcatttgatccttttttagaaacgaagataagacttggccctattccgtgaaggcaacatgatgttgttaactcaagacaaatattccatttgtacccttatgaatttaacccaatttctcaaagtattttattcaatgcagttttgtgcacttattagtatatattaaattgcctcaaacacaaatacatggcacaaatttatgtctaccaaaaacaaaaataggcaaaaaaaaacatgtcaagtggcaggacaccgcgcagctgacgatgatcacctgagcccatccgtgcggagcagctgccgccaccactcctcactccgcccaccggctctgctgctccgaccctccgcgagccaccatgcgccgccgccgccggtgctccctccctccccacagaaccgctgtctccccactaaagtccaccaccgccacgccgccttcgccgaaccgtcggagcaagatccatcgcacgcgtgtctcggcactgcgcgcatgcctcagcgccaccggatccgtcgtctcatcaccgagtctccgccggatccaccctgccgccttcgcccctcctcctcatcgtcgagacgccgctgtcactcctccgcctcgtcgagccgccgccggcccttctcctcgtcaagccaccgccgctcctcctcttcgtcgagccaccaccatccctcccatgtcgccgccgctgtcgctcctccgcctcggtgagccgtcgctcctcctcctcctcttcatctagccacttccatccctcccatgccatcgccccgtggctgtcattgcacgaggagggtggcgggaggaagttcctctcaaggtctggtgagagagaggagaggcagaggataaggatttcaagctctggtgagagagaagagagggagaggataagggaacaatattgatgtgtacaaagggtattttggtcaactgtggctcataaaaaacttttttttttctattttctaaatgaaaccctaactgttttatgaatccacggtcagatggcaactcaaattttaaaaagtagggtcaaacaagcaaattttaaaaagtatggtcaaattagtagttatgcttcagaacagagtcaaagaagcaattgccccaaatataaatggagggagtaactaagagttgtcctacaatgccagtgagaataattcggccaaaagattcgcgtctgaaaataggttttagaataattaaaacttaattaatcatatactaatagcttttcgttttaagtgcgctaacttaatcttcatcttcgtgagtttcaaacaccactaatttgtttccaaatgagctctccatttttagtttaaacaacacacatttggggctagaggtaatcgttgggggtctgcttttcatcactatcttggttcgtggataatcagggagacagtgagaccgaggagtcgtctaaacgttaacgaggcaaacaaaaagagcaaagtttagaaaatcctaagctccatgattaaagtatgaaaaatattgtaacgtgtggcacataatcgcaggtatcatttcagtatatcaaatagaattttgaaaacaatacaaatttaaactatcaatcttagtgaagaacttaattatgaaaactctcatatatacttatgttttttaatgttaagtaaattcatactcaaaataagtgtcaagttctgtgcatctttaaaactataatacctaatgatgtcacacgccatgcaacataatggttttacgaatttaatcacaaaacataggttttctgaaatattacttccatcatatagtaattgcatttctagacaaattaaccgcaaacgcaatttagcacactaaccctaataattacaccgctgtacatttgaaaggaatgtttttcatatgtaaacttaattaaaaagaaagattggagtgcacattctatttgtttgttgtgttccatgttatcgtaaactagatgaatatcccgctgcgttactgcgattattaaaactaaaacaaattaatacttatgaattttgaaaataaaaataattaagagtgcatggtgttatcagaaaagaaataagagataatttgaaccatagatttatcattcaaaggctataaataattgaggtgatgtggcttaatgagataagagagaaatgacattaactgcacttaatgaggatgaactatataagtattccctccatctcaaaatataagcatttttttttactctggcacggtctccgagatgctactttgattaaccatatcgatgttctaataaaaaaaagttatatattatgatagtttgtttaatgataaatttagaaatatcaattttacatgatttatcttttttatatttttgctattaatacttaaagtttaaaatgtttgacttgtcactatgctaaaaatgcttatatttagggcgagtatatatgattttttttggacaaattttgaatgtgcaatcattatgggacgcaattattactgaattaaaaacgaagactttgtcccctgaagtcgtgaagtccggcgtcccctgctctagtgctctctagttttatactccatctcgctcgctcactcatgtcactcgtcagccacttccggtgtccatccaattccccagcaaccgcggcgccgatcgagttcttgggctccggcggcagccggccggtgttgggcgcgcgacggagccccggccacctgcagctagccgtacagccgccggcggccggtgtatacaggtatctctctggattctgtttttttttctttttttctttttcttttggatcgaatcggccccatcgctcgctccgagaaggcggcgttgatccgcgccagcgccacggtttcgaggggctgtgtgtgcccccgatttagcggaggagggcacggtggtttcgaggggtcccgagaaattcgtgagtttttcatcctgcacttcactttgttttcttgcttatcgccgtgtttggtgttgctaatagcagttattacttattcttattactattactattattattattactcactccgttttataatgtatgtgtttagatttattagtatctaaattaatgtaggcaatgttagaaagtcttacattgtgaaacggagcaggtattatttttggagtaaatttcagaaatgggacaaagttatgaaaaaccacgggtattaatgacgagtggcacataaccacatatgacatatttatggtctcattgttttctaaaacccaacctttattggaattttgataaattccagcatatctatggtttagaactttaagtaaattcacgcttaaagtgcataagggtgatattttgtgaaactttaaaatcataatacctgacagcggcggagccaaggcccggccagcacaggcaggcgcctaggctccgccacatgcatccatgcattagagctaaatatagcgtttagccattagcctagcttcacatacaccattagattagcactaattatcatacttggttattagccagcggcctaatttcgcttcttattcatgataaaatgctatatgtatttttgtttacttgttaatttgttatctatcgttaggtttgcccatgcctaaaaaaaattctagatctgccactgatacctgaggttgtgtcatgttataaaacctgtggttatttacaacttcaccaaaaaacacaatgttttctgaaatttgttcttatttttattataaagatgcatagccaccactacggggtttcccaaaccaccggggccggggttaccgcgacccagcggtaagcacggttaccgcgcagtaaccacggtaaccgtgaaaaaccgtacaaaaccgtgcaaaatttatcaaaaattcaaattatattttaaatttatttcaatttaaggaggttaccgtggtatttatattaccgtaccccgcggtaagcccggtaaccgtggtaaccgcgcggttacagtcggtaagtcgaaccctgccactacccactgttctatatgcacacacctgtaagcaagtccacttaataaacacaaagtgacggatgtcagaagcaaatttccaacctcactataaaatagtattaaaagggtacttgtgtgcttgcaatattgtaggtataagtattgatccctggtgtgtgaagtcatgtatgaaatattttgttatatgccattttcgaagatggcattcagatgtgcaagtgcacaaacaaactatagttgtggtatattaacctgtcaagctattagctaaacttgaggggagggacctaatgtttttctttgaaccaagtgatgggacctaacctttacagcctgtttggcaacaattgggaggaggaatgagagttcagttaaccagtaaaatactctctgtgtatcttacactggttttgggccaaaataaaaagaaaagaaaagaaaagcttccaagcaggtcctagtatgtttccgacattttctagcttatgtgagctagaaagtagacatgttcaaacgttattctccttgtgatctgaaacttaaagactctgtgtactcaatcaagtaggattataggaagctacttagtttgcttcaccttgaggtcttgtgaaaatgttgttcatcattttctttttgttcacatacatgatggatgtccactattactgttttcgcattttggattgagttagcaattattctgaatattttgcaaaaaactcaacatgaatagaattccccttacatggtgagtgattaaacagctagatgatggtgggagcaacggtttcagcttcagcgggggtgatgaactctctgcttgggaagctctccaccttgctggacaaagagtatacaaagcacaaaaatgtggaaaaggatgtgatgttcctgcaaagggagctacccagcatggaggctgtgctgcagaaacatgcaatgcaggacgagcttgatgttcaattgaaggcctgggtgagtgagttgagagagctggcatatgacattgaggactccattgatgctttcatggtgcgcattgagcactatagtgatgagtctgctggaattaaggggtttatgagtaagaaaatccacaagctcaagaagctccgttgtcaccataaattttcggcggtgtttcttgaactaaaagagcgtgtcgttgaagcaaacgagcggcgaagaagatatgaggttgatgggtccacatctggaaccacaaccagtgattgcttgttgattcccggttgccagcactctattctggtttagatgagcttgtaggaatcaagggtccaagggattgtataatcaagttgctaacttatgaagctgatagtggcccatcaagacagcaactcaaagtagtgtccattgtgggatgtggaggtctgggcaagacaacacttgccaatcaagtctataaggaaatcaatggccaatttgattgtaaggcttttgtgtctatgtcccagaaaccagacatgaggaagatcttaatggatctactatctcaaatactggggaatggtagccccatgtgctttgatgaacagcgactcattgacaagcttcgggagttcctaaaagataagaggtattaaaactgaactttattgtttcataattgcaagataataataaaattattgaaaaaaaactgcaatttttaaaagtatcaggtgttaacattctgtaaaaaagtccaagtcaagacaaacagagagagatattaaatgtgaactatacacaatacacatatgtgtatacatcccttacatggtagaagagtccttaaaatcttcatttgtgccttaatctttggacatgtctgagacatattagatctgtctggtctatgtaatttcaccttatcaatacttaattttccttcttttttaaatgacctattggattagtgttaaccatgccattttgtagtttcgtatttttatactcttgtttcttcttcggatcttaaatttttttttccgtagattcaactggattgtagtttttatttataagcaagtgacattgtgacatggggatactgtgaaatagctattgacaataaatcaaatattaaagtccctacaagagatgataacaggaaattaggagtgaactttgaacagtttttgaaaatgacttggttttgcgccttatctaaagcaatatgaaatatggttttcaacggaaacgtacacagctagttgtcatgtgccatggaatattaggtacagagcttatttgtattccagttaagtataggccctatacttttagagtaaggcgtctagtgaaaacgatggcatctgcggagtcatgtgaaggagattgacttgagtttttagcaattacattgttaagttcactatgacagcccggccaaaaaaagttcactatgaccattgtatttgttttaaagctccatggaagccccaattgatgcaaaagacaaggcattgtgttcagttagctgtttgggagggcaatgtgtgctttattttgtgtagaaggactgctatatttttttgtgttgtctgcatactgcttattcccaatttcaaacagatgcatcaataacaattttgcgtcttaagtcaccttagagaatttggtcagggcttcccctcatatacaagtttcggtaaaccttgggacattttgtatgccattcagatatgtcatgagaaaatcagacctacataaaacaagtacacacacagatgcagtattattttagtaaaaatatatacatgtaataaaaacagttcttataaactgttcacaaatttatgcaaataggttgtgatgtttatatcataagaataataatatagtttttaatatttcagaaacaccattggcaccttgtaactgctgatatatctctcaattctgctaagttctacctaacgcttgataaaatgtcaccaaaatctgtacaggtacctgatcgttattgatgatatttggagcacatcagcatgggagattgtgaagtctgcatttcctgataataatcttcgcagcagaataattacaacaacgcgcatcatggatgtagctaaatcatgttctgctaatctccaggaatatgtttacaccatcaaaccacttaatcatcaagactctagcaagctgtttgttaaaaaaattttcccttctgggtgtggtgttcctcaacatctgaaagaagtttcgaatgcaatactgaaaaaatgtggtggtttgccactggctatacttattatagctggtttgttggctagtaagtatgataggaaggatgagtgggaggcagtgcataattctattggctctgaacttggcaaaaatcatactttggaaggattcagaaggattttgatgcttagtttttatgacctgcctcatgatttgaaaacctgcttcttatatctaagtatattcccggaggatgacctgattgtaagaaaacaattggtgtggaaatgggttgcggaagggtttattagaaaagtgcgtggtaaaagaccagatcaagttgcagagagctacttttacgatcttatcaatagaaacatgatccaagcagtgggtgttcagtacaaaggtaacatatatggttgtcgagttcatgatttagtgcttgaccttatcagatctctatcagcacaaatcaactttgttatcgcgattgatgataaagggtatgaatcttctcctaggaagattcgtcggctgtccttgcaagctagtaatttggaagatcaagaaatgcagaaacttgtgagtaatcaatcccatatccgctcactcattatgttcagggcctttaagaaagcacctgatcttttcaagttccatgctctgcgtattttggatttatccgagtgcaattgtttggaggaccaccacattacatgtatagtgaatatgtttcagctgaggtatctgagcctcccttgcagaatcactgaactccccgagcaaaccgggaacttgcaacatctagaggtactgaacatcaggcgttgcatgatcaaaacattgccagaacccattgttaaacttgggaaactcatgtgcctacacgtgaagtctggggtgaaactgccggatgagattgggagaatgcaagctctccaggagctggagagtatctccatcccatgtaactctgtgaggttaattgaggagattggtaggctgacaagattgcgaagacttactgttgaaacaacaagcactactgagaaaatgggagaccaagaagtgaggttcagggaaatgttggtcagttccctcaccgagttgggcagaaatggccttgagtcactctgtatcagctaccctcatggacagaacttcatcctggattcattgtttggctctggctgctctcttccaaagtttcatgagcttgacataaagaattacctttgttgggttccaaggtggataactatgcttagtagccttgtgcacttatgcctatccatgtatgatattgacgaggaagatatgcgagttctgaatggcatctccaccctgctatttctccatttagaattaaggaatccacctgaagagaggctagtcattggttgcgatggactcagacatctgaacgagctacatgtgttctgccaacattccacaatgccattgacgttcgcgcctggagcaatgccagagctccaccgtttacgcctcgaattcggggcgagggagacgttgcgcatgtatggtgattttgatttcggcatcgagcatctttcgggactccgggatatcagagttgacattaactactactctggtggcactgacatggatgcagaagcagtggctgccaaggatgctatcaccactgcttccatcatccatccaaaccgccccttacatgatgtccgaatgcatgtcaccatgatgtttaccctgaaggaggctgctcagtcggttgggctccaaagcgccacgaaagaattgaatttagggacggattttcagcgcactttcgtccaaattggtaatgaaacctctttgccaacttactaccaatatatgtctttcctgcttgttcagtttagttacaattccttttgtttttaaatccatcagaagaccttgataatccagaagttctgcgaaaactacagcagctattatcacctgagtcttcgacacggaaccagtagcttgggacttgaagaaacaacgtatgtatcttctggaaatctggccatcaagatcaggtgcgagtatggcaaattgattgaaattcgtataaaaatccaggagattcgcaatgttaatgtgaggtatctaagaatctggcttggaaatactccctccttttcatattataagtcattttgtctttttttcctagtcaaatttatttatatttgaccaagtttctagaaaaatttatcaacatctacaacaccaaatcagtttcattaaatataatattaaatatattttgataatatgtttgttttatgtaaacatgttactatatttttctataaatttaattgaacttaaagaagttcgactaggaaaaaaatcaaaacttataatatgaaatggagggattatcttgatgtgggataaaggcaggagctctaccatatcaattgaagtagggcggaaaaaatgagtgtcatttttcttttacaaaatagaagtcaagaggagagccaaagtactttttttttataaaggaagcttttattaatcgtctgagattacaaaactatctttatcagttgtacttttacagaatagaagtcacggtgatttgaggtttcagccaatgatggttacaagcggccattatgagctctccgtaaatttgcatccccatttagcttttgtgcgctttctagattaatgttcttttttcaaagtcttctagtataaacttgcatgaccatttatcatcatacaatatttgtgtatatggaaaacgataggaaatgtgatattctggtccaattaggatacggcatgtgtgacccataaaagttgtgtgtgcatgttaagtatcatattgctagtttagtaagagtaaaaccaacttataagggtttgtctctcccaacgtaacacttctgagttaatctttttacacaaaatgaaaacgaaagtataagtggggtggtatatattggccctctttgtttaggcttaggcttattggcctagacttttaagtcagcttattggcttatatgatttataagccaatggatttaatgtcctaagtttagtggtggagtcatacatctatctcatataagccaaaaaagcttctccaacctagcttttggcttaatagtgttagagtggcttatggcttcaaaaaagccaaatgaaaaagctgcttgtttgttttgacttagacttttcaacttataagtaggcttataagcctaaacaaagagggccataaatgagtccatccgtcggataggctagactgtgcggttttggagggtaggtagttacaggggtaggtagttacagggattgtgccggataatgttcttgtcttacaatggacttgtcactgccttctgcaaactgatccctagtctgatgttttctggataatactagggattgggtgatcaaaatgttttatttgaccgtctgaaacatcgaactttttgcatttgtctcgtgaaacgaagagttagtcattcaaacatttaaaagaaatgcgaaacacaggtgaacgattttgctcttgcgcataagacattgaattgtttatgcatcaggggctctccttttcttctcgatgattctcttcttcccttcaagcagctgtaggagctccttagaaatcaatcttgatataatcagaaaataaaatacttagaacttgtaaggaacattagatgcatctcatgaaaagagacttgttgtgatggacacatgttgctttcctctgagaaaaagtcagtgtctgcacatttcctgtttatgcattccttgacaaaaacgaagatgcatctacatttcgacagatcacaagagtaaataactcgacacatgcgtataggaacaagcttggcatcctgttcggcaactcattgtctggattttttatattttggctattttcaaaaacttattttgtaaatagatctaaaaaaaattatcgtaggaatagacccttttcgcgatgccagtaaccatgcatcaagattcaatatctaggcgccagcgccgatatccttgtcccccagcagctgagatgtggagggtcggtgccaaacatattggcactaaagatctatttgtaaaatatatttttttaaaaaagggttaaaatgtaaaaagtttttcttacaaataggttcatatcaccaaagagactgagtgtctatttgtaagaaaaaaatatttacattttgacccttttaaaacttttatttgcaaatagatccttgataccgatctcttttgcactaatcccttcacatcagcgacttagctaccaaggatggtgaggacatcaccatcagtgccattgacactgagacattaaacctgagcatcaataactctggcgtcgagaagcctcaccccttctaattatttaatattaggtccttctctaatattcgcgttttttatatcctcgaattttggtatggatcattttcataccctttttgttagttgaccatttaattcctatgaaaaggtctattttgtccataggtacagaaaaagcatataaattttgtagagtatattgtttgaatgtaaaaaatatgttgtacgagactattaaatttataagtttgttatgcgatatatttatgacaacatttatttttagatgtgcataaaaataatatttgttttttaattattaaaaaaatgtacatatagcatattttcttacactagtacaacagattttccatctgttttatattttatttaaaagaaatattgtactacaaggctaattgtttttaacattaaaaaaatgctacacataattttcttgaatactatattaaattttctacatttaatgttttctcatacaacaaacttattatggatattacattcacgcaacaaatcaccatcagtagttttctcaaatttcaaacattccatgcatgtccaagggtacaattgattttttttaagagagaatctactccatggcactaagtttaccacagttcaacgattttcactaacattatctctttctaaaatataccagtgactttctcaattgttctacaatatatcattgggatagattttttaataaaaaaatccaaaatacccttagatacatacaaggttaacaattaatttatcttattataagttttaaaaaatatgaaaaaaaatgtagcctccttacaaaacatggaaacttgtatataagattttcaagttttttttggtatatttattttttagaacaaatatttttctgtggtataagagagagaatttgtttacacaaaatataatagcacaaaaatatcttatgtaccatatgaaagattatttatattaaatacaccgacaaaaaatattttatatagcatataacagataagtgatatttaaaaaaatagaaatgcaaaaaacttgaaacttaaatacaaaattccatgttgtgtaagaaggctacatgaaaattttcatattttttttgaaacttctaatgagataaaccaattgttaatgttatatgtccatacagatatttttgggtatttttgaaaagaaaacccggttcaatggcgtattgtagaataatttgtaaagtagccaatatattataggaagagacaaagtcaatggtaaatttttaaactcggacaaactcagtggtatagaatagattctctcttttttacttgttaaacggttaactaacaaaaaggatatagaaaagatcaaaagtaaaattaaaattcgagagtatataaaagaatgagtaaaactcaacgacattgactaatttaacaatatacaagggattttctctaattagaatatcctaagaacattctaaccaatagtctatgcagcatggaccctctcactctccctttcatttccaattttctgccacaaagttttgcaacacagttctattgtttctctaataaaaacaaaagctatctacttcaaatatggaatatttactctttccatccactaaatagtccttgattggataacaaaggtaaatgctatctactgcaatctgaaaaagaaaaaaaacacctaatcatgctgcactagcacgtgaagctgctgagcttttttttttttttgagaactgctgctgagcctgaaactcggcgaacaatcctagaatgctggagcagcaaaaaaatcagccaagtagccaaatgctgacgaaaattcaatcttacacaaacactaatcccatcaagccaccaagttgccagctctctgaatgcgttttttttttaacaaacactacaatacaagtgtaaaaataaaaacaatttgctctgcgaatcaaattatggaaacaataaggtttgattactttttccatatatcaaattcagaaatatattttccatttcaacttatcatccatttgtaattgtttcatacttcgatctacccaaaaaaaaaatgagctcccaagtagtgggagaggaaagtgatcgtaatgagccgatgactcataagcaatggtttggttaagagagcgtaacctgtcggaattgtagcgaaagcgactcttaataggacaattttcactacttacggagatccgaacttaggtgatttatccatgactaggataaaagtcagattgaaactatcctgcttgatgtatggacatgctcttaactgggaaaaaaaatcagggagcacatctaaaaattaggaatcatgaactgattgtggcctaaaatcgtagcatgcacctccctaaaatggtctccaagaaaataagatgcatgctgttgattttaggtgccctaaaatccttcgatcacgagcaaataaaaaggtcaaattaactagcgagcacaacagtacacaacatgcagatcggaatgaacccattgcaaacgcagtaccaggtaacaaatcaacttcacctctccggaaagacttctctctttatgggaagtaaggcagcgttcgagagggtgagagagtgagtttgtttgtttcgttttccgcgcgcacatttcccaaactactgtgtttttttacaaaaattttctatagaaaagttgctttaaaaaatcatattaatccatttttgaaatttaaaatagttaatactcaattaatcatgagctaatagctcacctcattttgagtatcttcctaatctcctcaatccccttcttctcaaacacaccctaaacacaccctaagacatgtactaataatgagtgtgactgattagtcgcacgtgcaacaagaaatataattattatatgattaattaataaaaatgaaaaataaatttatttgattttttaaaccaacttctacataaaattttttatactaaattaacaattggagaaacatgctatagaaatcgaaatcgaagaagtaaccaatccgttcactttagaacagagtaacagactccctaaggaaaggagatcaagaattcaacagagatgggccgacccaaaaatatagggtatgttcactttaatatcatttttaaccttaccaaatttgagtattaccaattttagcatagttaccaaaattttggcaggatttcttatatagttatcaaaatttgacagcaaactaaatgtaaccacttttttgacaattttactaaaatttggtaaggttgaaaatggcatcaaagtgaacatgcccatattagcctacaaaatttcaggtactgtgtcctagtggattccagatccgacaaagaaacaaaagctcatattcgtgcacaaatcttgaagagaaatggacggccacaaaattcaactaaaatttgtgcagttcccagtcacctgaacactagcaaataccaaatatatacatgtataattctatctactactaaatagtacagtaagtcctaagaatccgtctggcgagatcatctgctccgcttttcttgtaaatcagatgcaaattgaacgcagcctctcttcgtacatcgcaataccctggcttgagatcctgctgggcacaggaattctcctcgtatggaagcctgggaatagggtaatctttcacctcaacggctaaagccttctcgtagtaaattgctgccaaggtgttgaggccaacatgatgatacgcccgagcgatgttgtacaaggcttcctacaaggcgaaaacatgattaacaatgtaccttaatttatctgtaactgctatttattcaacttgaagtcctgtttaactgacaagctagttttctgttttttgtggttgcaagagaacaaaataacgatatcaccccaagcacctaaacctcaaatatccaaaataaaggtgtgctctaccatctatttccagactcctagccaactaacaaccatgagatttgattatggatttgcggcgtagcaatgaacactgaacaagatggatgcaaggtggcccataagcccatgtggatgggaaggttgggcattgcgcacatttcgcaaattttggcaagcacccgtgcatggaacaacacaagaagccagatttaagcaaagaaaagagtaacagagtggatgtaaaacaattctgtgtttcttatcccacttgcattatattaaccaaaaatgtcagaaatggtaaaaaatggtaaactttgaaagtaattgtcctgaaggaatagaagatctttttggtggtacatagagagtttggttaacaattgatggtaaatagggcatttgttttgtgtaaagaccaagtgtaaacaattctctctttttttttgtgtgtaaatagggcatatcaagcttggtgtagcaaccaagagtgcaagaaggatttagaattcctatgtatggccttatttcagtgtgcattagtattgcatactgaaaatcaaaggcaaacccaaccgaaaccaaatgcaggaccagaccaggtcaccttcctcgattcctcgattgctgctgtaagccttaacaccagcttttaaccatgggctcctataagtaggtcagctgaggtgctcccagtctggtgttataaattattccacccaggcactgaagtacggaaagcaagtaacggatgcatatgcttctgccctgtgatttgtttaatcctgtggacctgacctgccttttggggcgacatgcatcacaaagcgcttacagcccaggcccaaatgatgcaagtgctcagcactgcaggctaaccccagccattaaatttggtaaaaaaggaaaaaagctcggccactaaacccataaggaaacagttgagccttactagcagcttagatgctgaaaatactagagcattatccatatggattataaggacaaaacctggctgttgtcacaaagacgcagatatcgaaagaggaatgccaaagcttgaacgatgcactggttcttattctgaagcctaaagccaagggctaaattaattagagcagatcctgcaaatgattgaacagctacagttagtactcttatatgttgatacgtgttaatgttaatacttaatgccattgttttggtggcataccaacacagagatttataaatggattttctgggttcaatttataagcttccagataatcacgagcagctgactgatgctggctgatagccgtaaatcgatggccagatatgattataggaggcacacagtcagtcttttcttctcttgtccgtagaagaaatttatgatgacgtgagaacctatcttctattctgcaaagaaaatgtgaaattagaacaagtgaacagctgcttttgatttcaaaattttcatggtgcaactcgatatatacagactatattgtttgagtattatcagagagtagtacaacggaaactggaaactgaggagcctagcagggcaagagcaatgtcatacaacaccagaagggctattggggaagtcctagtggatattgcatataaaaaaaataaaaatgtgttgaacaaaagcatgttctaacgaaagtggagattaaagcactacctgttttttttttgaaagcagggattggaaaactaggactgaccaacaatcagcattttaacaagccaggtgagaggtttcaaattcggagttgattaggattcaactgaatatgctaggtataccattttcaaatactctgtcaaaacatgaagaattgacaacacaactcagccctttttcatggtgtttatgccaaaaagtgcaaaaaggcaaaaaccaatcagccagctctaggataccttcacccaattcacagctgggttttgtggctacataagattgttcaacactgtttatcgctataatctaactgaaacgaaattactaatgctggcaaaaaaaaaagtaaaaggtctttcaaccggacaaaaaggaaccaaaggcctatgccccacaaattgtatacaacatgcaaaatacagaacatatgtagtgtgaccagtataaataaatgcaaaaaaaaatcaatcataatcattccaactaataaatgcaaaaattcaatcataatcattccaactattaccttgatgtcaccttgtagtatgagttccatgcagcaagggaatatggatgctgctgaactacatagcggacataattaaagccatgtctagggtctggagctctataagctatttctgcaaaattgcaagaacaataatatcaagtcaaacgaactgtcataaatattaccaaataacctgtctcgattttcataatataataagaaatcgatgaagtgtcagtgcgtgctactcaatcactcattaagagtgtcaacaaaatgacactaatatagttgcaattggcaaccagattcactcatacaatatcaccctggtctcattctttaccatttcctgccccagcagcacctctccattgggcctacccgccactcctaggtacagccagaacatagcacttacggcagaaggcatgggaattccaatgtggagaacttcaagaccagctctgtgtcccacatcagttaacttttattatgaggtgtgaggtcattctgatggttgcaaatcacataattgaatggaagttcctagttgcaatagttgcttgtttggttttcccacactgccaaattctatatgtttttctctagctgtttggttaattgccacaattctgacgtgatagtctttttgccctagagccccctttcatacacctgtatgcctaaggtgtggccagcaattagttttatttaccaaaccttttttttagaacatgcaggagatctgcgattaaccaaacctttgacaacatgtgaaagggaaaaaaaattaggaaggttcaaacccatcacttcttgacatccgtatggatggatggtgagcttacatcaactgggctactgcacttagatgattagaaagggagttaacttttttcagaacagagcaaaggatttgattcttttactggacctttatctgggtgagccaatctgtcacatttcccagactgaagcaaaccatgttaatagacagtttggcccaatctgaccagtggaaaggatgatcatcacatggggaaaaaagaggttaatcatttgaaatgagaataatggaaatgttggatcaaaaactgaaatctatagtatgtcgtcagttacaatgaactaactgcatgtagcattttatcaattgaataatacatagagctgggaatagatcttacgagcacccaaggatctgagctcctctttgttctcatcagcgagagtatcatttccaagtttaagagtacggttgataacttgtagagcctcccagtatcggtgaagcaaagctaatgtttggcaaagctacaaaaccaaggcgaagttaatagccagagtatgatcagaaaagcagcatcaagaagtgagctatgtcaatgtagaacagacatcatggaaacaatcaaacagttggccaaaataacagggtacatataaaacatgcctgctattatgtagaatcttattttaccattgcacattaagctatgagcactaaaatgtacaccacaacttagtgtttgtgatgtaagcagtatgtctttgatggggcaatcacaataggcctataatggtgaactaagacacgatttactgaggtccacaaacttgcatggatgtgacatctaggtccttgtactcgaatttaggtgtggtgggtccctaaatttgcattacagtagcacttagaaccccatagttgtaggcatatcaatttccaagtcaactaatgtttgtagttgacataaccttgcaaagactaccaatgtgagcagctcatgcatgtacaaaattaatcacaagccgggaataattacatctccaattccttcagtgcaatacctcaaaagctcagaatcacagcttcaaatcaagtacgagaggggatttagaaatacaaagaggcaaacattagtggttagcacctaaaactgaacacagtaccagcaagatattcgaatatgattatatgaataaggtgcgaggaacaaatggaaccgaaacttatttaagactgaaattgtgctgcaaagggcctacagtctattaagtaggacttgctcaaaatgttatgaataaagcgaagtgtcaattgcaaaataaaacattagcaaaaaggggtagggaaaggcatctgccaggtacggacatgtaacacaagttgatggttctctgcattcgtaagtagaccagatatcggaggtatttgcttcgacctttgctaaaaatatcaaacaaggaaggcatgagtaatttggtttggggaagaaatacttccaagtagaaacaccagcatagaaggaaacagataccagatcatcttttatcgtatcttcattcgaagctgctcttttctctagcaacttctttgctctgcttgccttttgtctagtaaaaagtttaacaagcgtcaatacaaacacagaaaaaagatacgtcaggcaaaggtgaggtcaataataaacatggccctaagtaattgttgaatgtaatcaaatcagaaggcagcatgataactgataaagaactaaagactggtgaatatagtacatgaattcacagttgccactttcctggcatctgggtcaagtggaggtcaagatataaggtcatgggaccaggtcacgggttgctaaaaatgtgggccatatgggggtattagtcttcagtattcacgacagtagtgcaggatgcaggacgtgatcctcatgaattagtgaccgaattatcaagcaagtagttacaatatgatccaagaaaatttctacaaaaaagacaacaatagcaaaggaatagctaggaatagattgttctagattgtgtgcatcatcagaactgacatggaactccacctgctaccatgcgtgcaaaatacatttgtggactgtggttctgtgtattctacctaaaaggccaaagcctatttatggctctcaaactattcccaactccttttttcatccttagtttctaaaaccacgcaaataacaccttacaccctattctgtggtggtttttgttgataaatattttcggttgcatggacttgtgataaactagtctgataaaaataaaagataagtaaattgcatcgccggcacacgaacttgtcaggtgggtgcaatctagtgcacgaacttgtaaaatgctcgttttggtgcataaacttgtctggtgcgtgtggaggaaggcgacacggctaatcttattgatttaggggctgattaggatacgatgtaaacatatatctgagaaggttgctagacatatacctcttcaataaaaaatagaataagatatagtgatagtagaaaaagattaaaaaaactgagcaatgatataagggttagaaatatacgaaattcatcatttccatgatgaatgataaagtagagaccaaatttataaatattgcatgtcttatacatactcactactatgcacgtaatatcttaataaacatcaacttcgtaaataacattgccaagttatttttatcctcgtttggacaaactagacaagttcgtgtactgaaacgagtattttacaagtttatgtactaaattgcacccacctaacaagtttgtgtaccactaatgcaatttactcaagataagtaaattatgaaataatagcatgcttacaactctgccggtgatgctattggccttaatccttgaaacacgctttctggacgttgttcagctaacactttggctctttcatatagaacattagttggaagttttttagctttcctcacctgattgaaatgtcacagaaaatacataacatgaccttaacacattaagcttcataccccaagagcaaaccataaaccgctgggcatttagacatattgttatcaagaaacataaaaataacttgtatatctctaccacatattaaaggaagaataaacaaagatgtatgagaggaccacatcatcctatctctccaccacctgttattcatccattaagggcaaatagaaaagcactacattgcaaataaaattatctagaaaagcgtaaaagtgcacaatagaaaagtgtaggttcctgaacctaccatggttgccatgccatgtgccaatgtgtaccccgtttggtcaaccaaaaaaagcattacacgtatataaaatttacagaaaaaatagttgcttcatagtcaacacatgaacaaaatcctagtttacaaaatgtcaactcaactattgcagtagtacccaaaaaaaaaagtgccccaagtctcacaggtctacacaaattctgtattaaaaagcaacacaatttgatctcataacaagaaaaatatttggaagaacaaacaaaattattaaaaactaacacaatattaaacccagcatatgtgccttcctaatcaaattcctggaaagccaagaaacaaatcaaacacataaagctatttaacaaatttcaaagtgattcaacttcaattaatcttagtagaaagttgttgtgcgcctggctaaaaaagaaaaagaaaaagaaagttgttgtgcatgagttacacaaaagcaagcaggctgatttcatagctcatataattgataagacagtaaaggaaaaaaacatcaggtggaatacagatcagcaagaacaaaaacaaatactaacactgtcccaaaatatagcaacttttccacctaccgcttcttctcaaccaatcacaactatcccccattcaatttcccctatctccttaatccccatgaaaaactctagaagtgcttatatcttgggacagagggagtagatgtgcaatcattgatcaagtaaactaaatgtgaatcaatgtctctacctttcgattagcatactcaatattcagtgtttcaagaatgggtataagaatggtgcccacaaagtcctcgaacatgcctttattgtaatatatgttcgcaaggtgcatctttactttcccatcaagccaccatggcttcggttgatctgtagcagactttgaccctacaaatgccattaaaaaaaactgaacaacgaaagcagctaattgcattgaacaagctagggatagtatacctgaattgttaggaggagaaagcaaaacaatagcttcgtcactcttatccacatcaacaaaaagagaggataaagttattcgcacatcaatgttgtcctccattctttgcaaggctatgaaagaataaagaaaactacatcaaagattcaaaattgataataatggaaaaaactaactcaaaagaaattaaataaacaaaacctcatgccgaggatgttgaattcccagcattaggggtaaccgctcctttacatagattcaaacctcacatatgttctaaaaattctaaatgaatataccttccaaattcacaatcttatatgttatggacattgattcatggataggataagggtctgaaacagggataaaggtgagatcgctctcatcggtgttagccttgtcccgatcatcaggagacactaatacataagtttaggcctagcttgatcagagtctcctagtgatcaggacgagcccagcaccaacaatagcaatattgtttacatcccaactttgaataattgtcatttctattgcacaaatctcagagcaattcaaatggatagtatagcaggagtacatgaaagtccagaaatgtggacttacatttctcaaaagaaccttagaaatacatgtaacaccccagcaactacaataagcctgagacgttactaaacaaccatgaaacaatgccaaaacattgaaattctgcagaatcttctcacaaagaaaagtattatggaagcatcaatatatatatatatgatataatctagagccaacagcatgctaacaagtaaaaacaaactaagcaaagttagataaaccaagttttacgtctcaagtgttcatttaaactattaactccataagtacatctattcttcataaatatgatagcacaacatttaaaaattaaataggaacatggcgtgcaaaagttttggtactcccaacctctaaagtaggcatgccacatcaaatacctggaaaggctgtaagggtgtgaggataaatctcaactagcgaacagctttaacaaattctttaaactacaagttcattaggtcatgatataaatacaggagtacaagatcattttaagtaattgtcattctgtcagaccataatgaaaacgaaatttccgtttttcttctagacgaatacgatattgctatcttttaaagatactttaggatctaggtattttactagttagtcctggtaaagctcccagacggcgtatttttcgaaacgaggtcctcagtaacgagacataaagactcctttttttttccttttttttctttttcgtataaaatccaaatgaaaactgaaaaaacaagttaaaacttgcaaataaacaaacttcataacttcatgagtgaaaataaagcaacattgtgagaagcaaacacatctcaaatataactccaattgtataacttccataggagaattgcaataagttatgtagagtggcttccataggaaaacacctattgcagttttgctagatgttatacaatcggggttatctttgagaagagttgcttcttgagaagttatgcagatgtggctttactttcaccaatgaagttataaagtttatgtaaaagtttaacttaatttttttaatgaggttgcactctcgtatttaaataatcacctaatgaacttgtagcttaaataaactgttaaagcagtttgcttgctgagcaatccttctaggtacttgatgtggcatgcttgcttgaggggatgggagtagcaacacacttctgcacgtcatgttcacatttaatctttaaatgttaagttgtcattttaataaaccataatgtatttattgagttaataggctaaatgaacacttgagatgtaaaacttagtctatttatctttgtttaggttgttttacttgttagcatgttttttgctcctgattatattaccagcatcttaggcttgttgtaattgctagggtgttacaatattttttttatatttgttctgttttgtcttaggcttgttgtaatacaatttttttttcatttgttctgatttgtcttttctgtatggccatgtcatgtctgcatttctcagaatcctagaatgtctcgtgactcttgtctatgatttaagaaactcaatctccataaagtccattcaaataacagtcaccacccctgacaatagaatttattctctcttttgtaataccatattctaacgattttgagaacaatgcatagaatctggtgtagggaatgcaaagcagaacaattatggaatattatgagaatatcagaaagcaaattgattcagaaaagaagagacagggcataagatcctctccatgtaatactactttcaaagctccaacaaaacattgctgtgacggattttcaccagcattatctttttatgtatatcttaacttcttaagcaatctcaagtttgctaccaaagaggaagggtttcatgaaggaaatagaacagaacctttctgaaagtaaggaattgctttccttttctcccctatgaccatgtagcattgaccaactttcacatatgaactaccctgaaacaagttatagtatatcaaactagagaagggtgaaggaaataaaatatacatacaacttcctcaatcccttaatggactaggtgattgcgatggtgtgctttacacccatcctttcatttccaaaatatcatttattgatggatttctgtaggcatgtatttatagaatcttttatgaaggattgcatcctttgtacatgtgtaagcaagtgactagttgatccattgtgaattagaatgttttctgtagatttttaaataccttttttttatgaagcattaaagcagacaaagcccattccccattcctgatcatggtaccattatcaagccttctaaagagcatgtacattctaatcaaatttggaacatttgtggctagctagaagatctacatgctgttaaaagcacattctcaaatgattaattgatttttttatcatatttatgttcaaatcagctaataggaactgctttgcccccaacttctttcagtagcagttgcctggcttcacctcttctgggttacgtagttacataattttattccactataactcacgactaatggataggttcaaatttattatgttgagatgggcttccttccccttccaaaaattatactcattggaatcaaaccagatgtttgtttccaattaccaagtctatcataatcgtattatgcacttatagcattaccttgataagttatatatgtcaaaagattcacaggattgaattgatcttctgaagacttcacagcatttaggaaaaagttcgcttaacactttgtggttagtcaatgtggacaatgacgtggtgggtggtgttgcttgcatgacacacacaccaaagcatgtttcacccaagtttgcccaagcaatcactttctttagtcagcaagcccagaaaccacctccagtgctatttgtacttcttctccaagctattctgctagttaaaaaatatttaactgaatccatcaccatgtcactgttctcgtcatcgtccacatggggaaaacacttacaatacaactccaggggggagggggggtttcaaatagttgttcatgcgttggggagtagaatatcaggttttgtacttcagggggttaagtagaggttttggctttttgccattatttataaatcatatggtcctaattatcatttgttccatgcttaattgaacgctagaaacatgtaatagtgaaacagaacttcaaaatgaagcaaatcggctacttacatcattatgaacagcaacatcttcaatcatcaggtaaaactttattgcatactcatattgtcctaaattttcgagagtgctagcaacctccttgatcacatcggtgttatcttttgaacgctccagatgcacattctgaagaaacacctgcacaagtaataccaattcaataactaagaaactcaaaactatacgttgaagtagtcttggatacagtatatacacaagcacaatctaatcttgcagagtacaacctgttatcagagcaatttatagtcatatcgaggatttatagtgtctaataaaccaatggtagcaaaaggtgggttttgactaatcaaggataaattatgtcaagtgtgtgctataatggaacagaactgggacaaacctcggcatgcttcatatctccaagataagcatggcagattacagcttttgcctgcaattgtactggcaaattgtgttgagatccaaacactatatgtgctctctcaatcagcctcaatgcttcattataggcattatttctcagataaagggatatcagtagatccagatgattcgagtcgatgtttgtagtttgagcattcacataatcctccaataaattaatagctttatcaatttgaccacagtccctgtacatctggacaaaaaagtcacaaagcaataagtggaagtctagaactaactcagcagtccatattgttatgtactggcttcagtgattagatagcagttcagatatatgagttcttagttgtgtcatgtgcatccaggtgtctagagtcaagtcttagcagttggcatccaggagtccaagagtctatagaagttaagagccctcatacttgcttgtgccttaagctaaatagagataagtgtcctgtttggatggtgctaattggtcttgtttacatgcatgtctagggacctatatgtttgtattcattgactcaaatagaggcatgaaagatcattatatctgtatctccctcttgtccctgactacaatggttccctgccgctggctaccaggaagaacctcattcaccaacgctactagcccataaaagctaaaatcaatttgtaatttatatgcaccacaaaataacgcaagaattgttataagcaaataaacctgtgctgctgctttacgagcaacaatgtttgaaggataaattctgactatctgctcgtatatctctccagctttctgatagtcatgcaaagcgcgatatatattagcacaatcaaacttcagtcctacatcttcaggatctgctctcatcgcttttaaaacacagtgtcttgctaaagcagcatcttcctttttcctgacaaatataataaagtagtcaatatggtccgttatattattatttctggccattgtatgccttacctccaagaaaaaattatgctaggtaatcagcaattaaggtactttgggttcatgtattaacaagaactagaggcttcctgaaaattagtatcataaaacataaaagcaaaattgaggtctgaggatgagaccatattactgaatgcaacatttgtactctgcataaatcaagctaactactgtaacaaattaaaagtttatgaatagaattaaaaaaatgaaacatagaaaaaggaaaaaggattagcattaactcacaatgccatgtcaatgagtttcttccacaaaaatacatcctttggagaaacatatgcagcgagcattagaaagtttatggctttatctagttcaccgcactctttataaatgctaccaagtagatggtatgaatttgacaaattcggcgcgatccgcacaacctcatgtaatataggaattgcctgcagtttagtagagtagacaaggtaaaggttactgtcatcctaatcaaacaacataatagaaattgataaagttagattgtaaaaatttctaaaaattctatagtgttgaaatcacatattttatggtcataactgcacagaaccctatctttcatgcctaatgttactaaaccccaggtttcttggtcataaggttctggaacaaatgagtctgtaacaactagattagtcaaactggcagtgatactatttacactgctggtttttctgatgaaccggactttccttacatcaacaattagtttcacctagcaacccccattgctaccacaataaattgtagtttggttaaaggtgggatttcacaaaggattatgagtcttaacaagctaaggctgtgtatttgacaacctgccctttcattgatctgttggttgtagttgaaggttttgaaatttctgaaataccctcaatcaaacggatggctgtcttgtttgatgattaaggattaacattacctgattttttgttaatcttcatttacttgaaattattggtatatgtaaattgactgcaaagataatggttgaatgcggaatctcatgaatttaacattttctgtcttgttccaagaacagtatatctgagctgtgttttatccaagaaaccaacaggaaatcaataagaaaacttatagtatgtgttataaagcaattcttgcaacacaggaaactcatctccagtaagaatctgaccaaatggagcaaaactcttaattgttctaatcatcagcgagcaattgcatctattcttataaacaaaggaaacttctaactcaaatggatataataaaccaagcctattttttggtgttccacaaatctgtttcttcagaagtggttcatcagatgctcataagaactccagaatcagaaatccgctctgtatttcagcgacttccaatatctaaacttgaatagtcaagaaatagcaagacgaaaagtcacaactttatgttcattgatcatctccagttcctaaggaaagatgggaacaggaattacaacaagagttaaacatgacacacaagccttggagaacagaaatgtgttcacatggcattcacatctttgatgaagatgaggtgactgcatgatggtgcagaccttatcaccccttgaaactgccatgccccgatctagtttctagaataactaaaaaaaggttgttcgttctcaatcttgtttccttagtaaaatatcctgcctgttacgcttcctagccaagttttcatgcctagcgcacctaatcaatagttaggcacagagccccagcctgccacctgaccagcgcctagtacttggattaacacgactacacaagattataatcaagcataagcagatcaattactaataatccttgtggagaccagctcatataatctttgaagacactgagaacttggacagattaaggtgaaaacaattccaaagcatactccataacaaaagtttgtaccaatagtagacaacgaggtcaaatgaacatgcaaaattccaaatcatccagctgatccatttagtgatcatgcaacttatgaatgacaagaagaaaaaagagaacttccagtctttagctaaatcagaagcaacagtcacaatattgccactagaaaaattgagtttgccacaacaacacaaatacacaataaacgtccttcaaaccacttatccaaacatagagcatgtaattaatatcccccaacaactattgattagactaagaaagatagagattagacctccttaaatctgctctctgtaaaaagcagtgtggcatcacccaattttttagtaacttcaggactgtacttattccttgttcctttctttcttccccttttcctggcctgatgaaaatgaaaatataaaaagtaaaaaattatgttgatcacttatgaactgcattgagaacaacactcaatctcaagtgtaaattaaaacttaggcatttacaccaaatattttccaaatcaactcaagaatagtttctacaaagatttcatttctataagattcaagacaaaaatatacttgtgttgtgcacatcgtagtcaatgctacaagggaattttttttgcatcatttgtgctgacaaattaaaaaaatggtaccatacatctttggaccttcttttcctacgaaggccaaagccttccattagttggtcaaacacagtcgctgcttccacttctgaaagcccatcctgccttggcttctttgaagatgcatccctggatgatgaccaagacattgaaatgtatactcaggaaatgcaattgctttgcaacacggtatgtgatgaggaggtgatacaatgcctggaacagacaacttaaaacagaacgcaaagacaaaaacaagctttaattatacttcgcaagttcaaagatcatgacatgaggagaggtgattgataaaactaaatagaaaagaaaaaaacaaagatatattttaagaagaaatgcacgatttgctcatgaaaccactactagactagaagattagagtatagaaaaacagtagcatcagtggaattacaccaaactgtaacgaaatataattataaagctacttagcaaagagaaattatcttagggagcaggttcaacgagatcacctttcggttcgctcctcggcgagggccttgcgcttgcgcgcggcgagcgcctcgtagtcatgcacgccggcgtcgggggcactccgctccgccatctccacgcactgcatcgcctcctcggcgtcgcagaactcgtactcctcctcctcctcttcctcttcctcctcatccccgtcagggtcctcctgcccatcggcccccgcctccgcccccgccgacccgcgccctagacggcgctcctcctccgtgtccgacatcaccggagtgcgacggaatagagggttcggcgcagcagcggcgagctaccggggccccggaggccggagctgcggttaccaatgttagtgaaacctaaaggcgggaggcgcggtggtgcaggcgagacgccggggagggagaagacgagaggtcgacggcgatgctgcggcggcggaggacggcggcggcggcggctggctagtgtgggggcggtgcgaggcgggggagagcaaatatgggccggatttagtgggcttatgggccgtaaagccatgcggattgatgcgaggcgccagatcggaatggtttaattactaagttgatcgaaaatattttaatcttttaaaaagctaaaacacaaccaaatcatcttcatgaaacattttgctacaatgtatgaaacaaacggtttaaaaaaatcgggtgttgtttcaccatatataaaacaatgtttcagcaaatagcgaaaggatgttttaattcacggcaacatttaatccatacaaagtgaaacattataagtacacttgctgaatcattgttagcggaacaaagattgaaatagattcccttagtagagagttttcataatatgtgggtaatttgttgcaacggggcacgtggtgggaacggcacggaggcccgggaggcgcgggaaggggcggacgcccgatttttctggcactgatcgggtgcctgatccctagcattttcgagattgatagcctcaacggatcttcaagtgctcattcggaattcggaatggagaagcaacagggaaaaattgagggctttttttagtttggaggacaaaaataaagctcaagaattaattttatgtgagtgttattcgttttgtataggaaaaattacgaattaccccctaactattgcgacagtatgaattacccccctaaccacaaagagaaaattcccttcatacccttgaaattttagccaatcctttctatgcccctgaattttcttcactcccttgtatacctctgaattttgatttggatcccttccatacctttgccgtcaattgaccgttagttgaccgtttaataggtataaaaagtcagttttaccctttaatacgtgaggaatatgtagaaatttgtaaactatattgttggtagtatagaaatttattgtgtgattataatatttgtaagtttgttgtacatagaaattttaatatatattaaaaaagtatgtgtagcattttttctaaatgatagacatagttttggaaagcattcctatataatatatacaacatgaaaaaatgttcaactaccataaaaatgctacatatactcttttaataagtaaataaatattagtttttatgtcattatgtaaaaataaacttagccatgaataatacctcatacaataaaatcataaatataatagtcttatatgacaaaattatacacttcaaacaatatagctagtctacaatttccagatttccttcatgtgtaagggcaaaatggtcagtttcatagaaattaaacattcaactaactaaataggcatgaaagggatcaaaaccaaaattcaggggcataaagggggtgggcaaaactcaggggcatagaaatgattggttaaactttcaggggtgtagaagaaattttctcaaccacaaaaccagacatattaaacctcgaactattgtaaccggacaaattacccccccccccctcgactcaatccagagtggttttgatcgtacgtggcgccgatgtggaaatccaatcagcaaaaataaaataaaaaatatagggcccacaggtcatactaagcccttctatctgtgtgttgttggcgttggaggcggcagcgagcagcagtgggcgcggctctggtcggcggcgggcgcggcagggagggggaaccggtcggtggcgacggacgcggctaggcgagtggcggcgggctaggcaaggagggagaatcggtcggcggtgagcggcgacgagtgtggctgggagtgtgctccaagcgacgactggagcggcggagaggaagctttggtcgtcttcccctccgatctccctcccctcccaccccccaaatggcggatcccggtgacgccgccatgcgcgccgacctccccttcaacctccacctccatctccatctccacgccgcttccgccgttgtcccatcgagcccgccaccagtcggagccgcccagtcacggccgccaccgctcaccacccagcttcgaccacggccgccgctgtgcgcggcgccgcgtcgtgcgtgacgctatgagcaccaccgtccacgccaactgcctgcctgcccgcccccgcccaccgctcgtccgcgtgctgtcatgcgcaccatcttgcgccgccgcccacctccagctccaacgtgtcggcctgtgagagagtgtgtgtgaagagagatggaaggggagtatgacaggtgggtctcacattttttttaataaataaaatgctgactacattgccacacgtacgccacataagacaaaaccgctctagattgggtcgaggggggtaatttgtccgatattgaaagttcaggatgagcaatgtctggttttcgggttcagggggtaattcggtcgaccgcgatagttcagggggtagtttgtattttttccttttatttttatatgaatgtaagtatagtaagactaaaagaaattttctttcctataagtcgtagaagtgtgcatgcataactatttctctatttttcactgtagcattactcggatcactgaaaatcggttctatacgttggaaaattttctaccctagcgatatcacgggaagaccacagggaataaacctcactaggctatgtgcagttgtgtccaaaatgcttgggtgggatagtagctactagctagcctcacgtgagtattgtgactcgctctggaattcacgcctcagctggacggacacagccacaggaaatgtcaagaatcaaaatcaaatgcaaaatactgcataattcaaatcagaacaattcggaactctcctaaaagcaaccaactaaatactgtattttagttcagacagcggatgcaattggcttcagttttgtctcacagtggtgaaagagattatctgcatgttaagtatagggaaaatatcttcgttcctgaatatagcaaattacggcctcatggagaataagcgaaacggtatatttacaaacaaaaataatttatgaataaaacttttatatacgtattcttagcgatctaaaagcaaaggctgaaaaataaacttcgataaaaaaaaccctaaaatcaacttcaaatttaaagttgaaaattcaaattttagttgataaatataagtataagcgaaaagataaggccattagtactgatgggatgtagtatatatactagtacttattattttaaaaaaatatgtgactgatggtgtgtttgcgagtgaccagcataattgtagtgtaagttttaattaaattgtaaaagtaggatttgactgttttctgttcttttgcaaaatgtggagccatgatacagctagtcccaaaatatttatcgctgaatcttaaaatatgcatgcataatttccatgttattctattcatattgtttgtttcaatagtcacactataaattttgtataatacacatcatatatgagaattaggaagtaattacttacctactaggaaggagataagagagtagataacaatcacaaagagaaagatcaagcaaaatgactgaaatcaagaaaaaaatgatgcgccatatttttagctaaaccgattaatttttctatactttagagcttattaaacttaggaccgagcctatcaacattcacagggaaattattgaacgtgaaaaaaaaacatgtgaacagaaatactagagctacctgcaaaaggaactaaactcattgccttaaaaaaaagcaataaacaaacatgaggccagcaaggctctactagagttcaagcatcaaaccaagcacaacaaaacaaggtataaaactatataacagtagcacagaaaaaaaaaatctatggacaaggcctacccagtacccacctcaccctgccctgccatccccccttgtgatgtgtgaatgtctctatcttacttgtgatagccagtatcctcacctcacccacagcccaccaatcacagcactcctttgtattctctctcctacatgcactcccctctacaaaaccacaaccagcatttttttcttttttcacaatccccttgacagcacagaggcaacagcaaaacacactctcatcagtgtcaggtctccacaccacacccaagtacaggtacacacaagacaatcctcccactgaactgaatcccatccactcctttatcatcatcaccatttccctccttcccttttcctcccctcatttccatttccagttgcagcaagagctgcctcctagctctcttcctgccatccatggcaaatgcttccctccaatcctttcttcttcaccaccaccattctttccttagcaatggtatccatgagggctcctccccttctataattctcaagctcacaacaaacagcaacagcagcatttcattcaagctcttctccaacaccacctcctcctcatcatcatcagtgaccaccacagcatcaacccccaactcaccggtgacccctgctccggtaacagcctcgtctccgccaccgccttcgctggagctcctgggcgcccagctcgccgagagggattaccggcaggccgacgagaccacccgcgcgctcctcatcgagctcgcgggcgagccagctcggcgccgagggtacgtcttcttctcggaggtgcagttcatctccgccgatgacctccgggccatcgacgcgctctggcaggagcacagcggtggccggttcgggtacagcgtgcagcggcggctgtgggagaagtcgcggcgcgacttcacccgcttcttcatcagggttgggtggatgaagaagcttgacaccgaggtggagcagttcaactacagggccttccctgatgagttcatctgggagctgaatgatgacacgccagaggggcatctccctctcaccaatgccctcagagggacacagctcctgggcaacatcttcacacatcctgcctttgaagaggagcaagaagatgaattagcagcagaggagaatgacacacctgataacactggtcagagtaaggatggcagcaaagggaaggagaggccaaagttcatgagagatttcttcaagcctgactactccttttgagattggggggtaattaaaaagcatgggagtttgtgatgcagagatgctggtcatggtgcaattgatttagaaaaaaaaaaaaaggaaacatgtatccgtagttcatctggattgttatgtcctgtaaacatgcgtgggaaactgcacaatatattatgaatataattgtttgagatgtttgctctgcacatgaatgatgcatgtaaagaagagagaaaaaaatagaatattctaagggatgcatggatgcaatgcatttgcatcctgcactcttgcatgtatatagattgtagggcaatgggccaatggcacttgaaatgcatgcatttcctttcgatgtgtaacatcctagcaaataccataggatgattcacaggtatccatattcccttcttttgcatcaaccgttgcacagtttgcaaaatggcgatttcttgttgggacaaacaacagggacaaagtttgctttgctcatcaaggagagccatcagttttaagctgatcatctccacttgtttcctggcaagtgattgtgattgatgtgacctagactgaccttggtgatatctcaggaattaaacgagtctcaaaaaaatggaagagccttttcagggaaaatacctcttatgagttatgacagcaacaacttttttacatttcacgcacaaggacacagccttcgggtatgttgatgtgaaccatcacatgtgagccgctcatccatctgcatgtacaagcatgctcctggattctgaaatagaagtaaaataaaattagttctatgtttttaccatggaaatgatgtgttatatcagcaatgtaaagcatcactatgtaactgacatgcaagtgaacattgatattacctatctcatgtgagatttaatgcttaaaatttaaagtttcatgtgttaataaataagtattgaccattttcaaaatagtacatgcgtaaggacttccaatgatgcaaagtaagaaatgtagaattctggaatgattaagaatctaaattagttcaataaacagataaccattacagcactactactacctagcaaacaaaaaatcagttcattgctcataccaaattgcttggagcctcatctacaacttgagcaggttgatctggtccaagattgctgaaacaaccacttttgcatctcatatatttctgcaaactggtttgaggaataaaatatgagcaaatatatttctacaacaagtatgatctgataatgccagagaaataaagtgtccacacgaaaaaagttgtgttgcgctagtgtgtgcatgggaaattgtttataatcaacatgaggatgtgctatcaacctgttgaatgtaatcccgtagcaagaaccatatggaaatatgtagcatgatactatttggcaagccagtatgaagataaacacaaccaaatatctcattcataaatagtgttgttaacagagtgatcaattatcaagttgatgctagcaaaatctcagaaaaaaggttttttttttcctgaagaatactgcggatcagcagttcagcacaacttcgttttccagccaagctgtcacacacgatgttaaatccattatgaataaacaactacagtgcaaaatattcagattctgcaggaattaggctgtactacgctactttcttagctttcgtagttccattacagcattacatatattgcaacaagcagaatttttgtctctgaagtcttcaatagttatgttgtgctccatttgttattttcctagtcacatgtgcatcacaacacgatatgaagatttacatggctgtctataactaaattactccaacaaggaaaatgataacaccacattctaatagaactgggaatagcaagtaaccactgtggctctaggatagagcaaaacagctaggagacaattggtcacccacaaagactaactacattcagacaatcgaaagttcaaaaaatacaaaatatagacaagttatgaagtataaataagtggggaacaactttgttacattatgttttcaaagtcaggctacaaaagcaaaatgtgttggtgatggcagattgatcatttgatggcaattgaaacttgaaaggccatgtaaatacaaaacgatattcaaaggttttcagttagacagattaaatgctccaatttaagtagtctaatactaactctttcaagttactttcaccgtagaaacattccaatacaaattaagttgctgattattcaaccacagaccaaaaaactgggtgtacatgtaatcatgcaaaatcattattaaaatattatttacttcaaaaactcaagacaatcaaaatggagctagctacttcgactagtcagttaaacttcagttattctggcaggattagccattttaaggacaataaaaaaaactacaattttctactgtgacacataatttgaagatatatcatgaacaaaagaaaagagacaagtaaacttacatctcacatttgttcagaacagaaagcctgcttggaacacatgattgtccttttgctctgcacacagaactacaagattcgcccctcctgaaatcaacattgatatcatagagcaattgtgagggtgttccattcactcttcctatatagtatctcttaaattggaaaaggccttaccttcctatgctgatgttaatgccatccagccttggtccagaaccagaatcagctgatcctgcaaaataattttttataatcatttcccccctacgtaattaaagaaaattgcaattgtactagtagtgaataaatggtagcagcttttgtgctgcctgggcaagctcagctcagattaagctcgaaacttaaaacaacatgaatacaatgaatcttagttcatcgtaagtaattaacatactcagaggaccagggatgaggcactagattggggatagggagaggtgatcatggagaggtagaccaattcacctttcttgcttacatcataactaatagcccaccaccttatctctaatataacaagagatagagatcttaaaaagatcatatattcaaccggactcatcttatctcaataaaccttactaatgctatctaaactaatgagcatacatcgaactagattactgtctaattcgctggtgaatttcccagacctgcatcctgttatggcccaatggactgcaagtgttttaccagactattggcctgccataacatgcaagcgacatgttctgatatcttggttccttcattctgtgaagttaaaatactgttgtctcggttcttatttagtgttgtaacttagttttccccacaaaaatgttacagggtcacacattctctcgccttgaaggggaatggagcccctgactttgttttggacttgttggccagtgatctagctgtcacatccatttaatggacttattgctgaaagaaggtgatttacatataaataccggaaaagattatgatttatgtagtatagccacaaaatacagtgccaaggctcatatccacccctactgggcagttatgtttgaatctcacagggtaactgtaatcccatctacctgaccaattaatatatcccttcatttcaaagaacaagaactactttgagggatacaaggactgaggaaaggatgaaaccaagagataaaggacttaaaatgaccatattacctaaactaaagcaccttggaaatatgagaggatgagcagtgatatgtttctaatcaatacagtagtaagactgaaaagaatcaacaacttcacatgaatgtcttctattttgcaataaaaaaatctaagctttataaaaagaaacagagagggcaccggacattatcatgaacagtaatataccaagatagctagcattgtaatataaccaatcaaaatgtgcatacctgaagaattctgctgcagcaagaagcaatgatggaagtcacttgcatacgcattttcatgtacctggttgattaaacaaaactttgattgaagaaaatgctgtttatcagaacattctagcacatagattttgtgaattgttgatttataacatgctagcatgacaagcaccaccaggatgtaactgcaccctgaaccttggttccttatttcatatatggcaggtaaaagtggaaaaccatttcatagaatattatgaaccgttacaatagaacactgcaaaaaaaaaaaagaacagtaccacacttgcagaactatggcggcatcttcccatgcagaaatcgaagacatttctgtaagttcctggagataaataaattgtgaactcccagcacattctagtatgctacatccaccaatcgatatcaacgagatcttaccagaagtaactggtctagctaccttcaacttcagcacatctgtttccttggtctgtccaacatgagtgcaaaatttaggaaacaacttgccaaacccaggattatacgtaatagagaaaattcaaacttactcttgaaggatttaagcagcaagaaacacaatattcataagaatcacagcactgtaaatcgagtttgcaacccctggttggtgccatgaagattgttaaatttataactgtacccatttattgcggtgcagagctgaaagtgaagtgagcaacaaaagataagaaactcactgacaggaaaaacgtgaccctgttcttgggcaacaccgagaccatggatcgatagataaggaagaacatacataacctaaaaaggaagtaattatcagcgggggaagtctagaaggcaaatacactgcttaccaggcagtatatgtgagcaaaatgagatgggcagggtgtcctaccattatcatctgatatcaggtgccgcccttgcacagtgctcctgcacatgatgggtgctgcaagaccaatgtccttcctgcacaatattcaaaatcaagccgcatcattagatatactgaaataaatactccaacatccatcctatattcaggatggaaagaaagcatgaatggcgtaacagtttgggcacgctaataagcttgacacacatgggtcatgggttcaaaggccacatgatgccatatacaatgaactctgtcccaggctactcccagttccagaattcagttgaaagcacaattagataagacaacccgttaactcgtagtctcgtaccacagtatttaactgaacacctgcacttctataactctattctgcactttgtagaggtcatgtattagtcagcaagaaaatgtaggcacaaaattgcattttgtgcactggtaaggtctgggcattactaacattcatcaggaaaccatggatgttagcaaggcactagtacatacacgaacccaacagagccaccattcctctttaacccaagcatatttctcccaaattttccctccatccttgccagctccatccatcatttcccactctttcactcccaatctaggttgatgtgtgcgttgaacacataaagctcacgattacagaaacaaaagaaaaaaaaaactttctgatttggctaggtatacatgccaagatttgaaaaaggatcatcgccaagccgagtaaatatcacaaggaatcacccgtgcgagctaagacggacgcacaacaatcggaacgcaccttagaccaaacagcaaacagggaggaaaaaataaattcaaattacgccgcattttcgggaatgctgaacgtggtgggggaagattaaacttgaacgggatctagctcaccgtatgccggcgacgaggccggggaggcaggcgaagaaggcggcgcatacgatccgagggaggaggtggaggagggggagggcggtggtcgccatctccgtcttggtcgaggagatcgggtgcagaggaggacgcaggacgccaaggaaacctacaagggttttgatgcaaagaaaaaaaaaacatgtgggccatctacgcgcaaaaaaagaagaagaaattccagttcagcttttcgacggagcgccggatccggatccctagactagtatgatatttttccgccaaatgattcgcaccgttttgccaaactttttgccatgttttgacaaattttaatcaaatttcgattgccttttactccctccattatcgtcatattttggcttgacaccaagactaaggcccttttgtttaggtctaggcttattgtcttaaacttttaagccggcttagtagcttatatgatttataagcaggtggatttaatatcctaagtttagaggtggagtcatacatctacctcacataagtcaaaaaagcttcttcaacctagcttttgacttaatagtgttagagtggcttatggtttcaaaaaaagtcaaatgaataagctgcttgtttgtttaggcttatactttttggcttataagttggcttataagcctcagcaaagagggcctaagaaaaacaatcgtgcttataattctactcgtaagcgcttatcagccaacgggccatgcatgcctcggcccacgcttcggcttcgcgtatttagcggcgtgtgcggcaacacttcagcttcacgaccgcagccaccacccccaaaacgcttcggctctgcaaaaatcaacacaaagtagatcaagtacatgaacatgtgttaaaaattaaagtagcaattcaaaaacactatcaatatgcctagatatattgttttcatataggaaaaggtaagtgattttcaacatggatagtttgacatcttcaaactcctcattgtcagaagccttggcaggaatcttggcaaatccaaatccatgatcatagccatggctgatccaaagtatgtccatcgctgcgtcgttcatgtcctgattgtgatctccatataagcaaggaaccatgataggaagcatcaaagttgagacgtgataagcctgcgttgtgctcaccttaggtgccatgatgatgtaaaagggcatgttccacgtctatatccatgactccttcgcatacacccccgacaacattgagctcgctctcggggacagcaactaggacaccattaagctccatctcggccacagccacaatcatcgccattgtttcatcatgtgtgccaagtacgatgttgacctcgctctcggtcacagcaacagcagcgtcatggagcttactctcgatcacatcatggacctcgagctttgccacagtcaccgcttagacttccacggcgacaatatctgcaacgtcgtggagctccctctcagccatgatcacatcttccttgcgtacggccacgacggtgtcgacctcgctcccgaccacatcaacaatagcgtcctggagcttgctctccatcaacccatggagctcgagctcggtcacggccaccgcttggacgtccacggcaacttgggtatcaggaaattctgtatcaccggcaaaggagtcctccacgacatgaacctcgtcgaaatcatacaaaatcacctcggcaccatggtgttcgcttagagagttcacttcctcgcaagtcatggcattggaaacgtattgctgtggttattaggatggagcgaagcggagaagagtttgtcttgtagaagaataggaaggagcaattgatctactcgatgatctgttgctgcgcacgcggagcaatggtgcaatgcattggccgggcaacggcgcgtagtactcccgagacacatgtgcagtgatggattaactccatgagcaaactgaaatggcgagcacggagtactattttaaatttgcattctcgaatacctttgaaatttcaatcgagatctacttccgtcctgcgttaaaacctcaaaatttcgtggttagctatatgcggtataactaatgaggaattattattattgattgagctgtgatatattttaataagaatacattaacaatatcataacttatgagttgcatttgatacctatcaaccatgtgacacacttgcacgctattttctaaatacaaatgttgatttatcgcgtgccatgaggctatttgctatcattaggtcatgcgacttgtgaatgtttcatttggtatgtttgtttgtttatatccgttctatttgtgttttgtctggaattatgcattagatgacataagcttactaatatctgccagatctattacaaccctatgcataattttacttatatccttaggcatcagaagaaatagaaactatatgaagttggcctgtgtcatataaatgcaacatagttgtcccatttagtgtaaacaacttgagtgacacatgctagatttacacatagagtgcctaataaaattaatgatacattaggataatttataaaaactaaggaattaaattgcacctatcttgcaactggaaatatcacagtacattttaagttgtacaatggcaatatgcatatataaattgatcttttcatactaactctgtgatctttaggttaaagtagagtgacattgggttggggtgaactatataacactatattttggcttagggcaacagtgtaaaactaaagtatagtttgaacctggtgtgagagagaaaaaataatgtataataaaatccacaaatgtatatatattgatatcaagttttataatagacatagattacttttcatacaagtcatctatgataatccaaatgtctcgtggcctaaagaattaagtttctagtgtttgatatttttttaaaaaaaaatcatatgactcatatgaactaatcacacccacatcacaattaatttctaataattatacgtctgaccttattctgaagattaaccatcagcttgactcaattttctttaactttgctcatctcttttttaaaatgaagctgacattttgccctattctaattacaacgtgggggaatacaattagaaaataatttagagaatgaagaaaaatgaaatatcccttgacataaaatacaactcatccttcaaaatatcgtcaaacatacaattttcctttaattttttttacctattctcatcatcgtcaaaatagcttctagagttttaatcgctaacacgacctccactaattaacaaaaggaaatagtaatacccaagcgaaaaggaaacagaaatacccagcatgaaaaaaatcagttgctattcgaatataataagtactcaatgccttttgttcgattacagataactaaaccccgttgaattcaatgttgtgcaaattcgtttcaatcgtactttacaaggagaagaaggtacaatgttctgaacgtgtgaaagaacaatgtcccacgctgcaaaccgcagcaccacaagccaagggccacgattccagatcaaacgccacaaactaaaaaataaaaaaaaaatcggaagaatagagagagagagagagaaaaagaacgatgagagcctccccgagcgcgcccacctcccacggctccggctaaaaccctagagcgcgcgcgcgcgagcgcggatgcccctcgctctcctcgcccgcgccgctctctcctccacctcctcctccatcgccatggccaccacgcgctcctcctcctccagggtgcttcgtgcctcccgtgcggagctcaacccaggtgaaacgctcgtttctttcttcttctcctctagtagtaccttttcttggggagggcggggaggaggaggaagctcttgtagcctgtttccattcattgttgccattaggggtattctagattgacaggtcagattagtatccgaatatatttgggcatttaggtattccttttctggataaaaatgtgaaaaagttgaggtatttctaccttggtgaggttatttcttgaaatgtggcagatagatgcttcttccagtctttattgaagggttgctactgatgggaggggtggattgtccattttgtttagtttctgtttataaagctgcgttgattaagtgttggaagttttgtggtgttattgtgcgtttgcttctggaaagtcatcctagaaggggaattttaggaagggtcatctcatgatttttttttctttaattgccaacgaaaactagcttttagtatgatatatgtattttattctgcttgttcttgatggaaaaaaaaatgaaatgaaagttcctgattcgataacaaaggcgcgagcaaacatggtggctaggtgagacctgctcagagaagcctcacagcagaggttagatgcagttttgggaggtcggtcaactgttatgcacccatttcacttgtttatgtggtttagcagcccttcctagatacatttgtgcttcccttcagccctcacatggtctgcaactgcaagaggcaaaccacaattacgaattggggccagaggagctcacaataagaagcataaagtccaaggcggaggctggagttaactgtgttgaccctgatggagatttaccactcatggttctttgctcgaatgcttgggcagctttcctctgtttgagcaacgaatgggttgggttcctttgcttttgttttgggttgatgatattcatgcgtttctcaaagtgtccaattatttatcagggcattactcacataacatagtttgcttgatgcatgttatttcctgaaagttcaactttaattcccatgacttcaatgtagtcgaattacctaacagtttcatactgactctgggaaagtatacatccattaactgccaacttaatctatctgccaactctgggaaagtacatatatggatttttaaagcaagtttagtgtaaatgtgtaattgattatttggtagtatgccttttcaggtgctaaagaagtgaaacgtgaatccagtgtttcttttgacttgaccaaaactgaagcggttgcttccatgagaagcaaaaatgtgaaacgggtgcttgaagtaactggggaaaatattaagaaagaggttggtgtgcacctcttcttggattggtgatgtttttctctctatcaatgaaacaaggcagagcttctgtcttttttttttcaaaaagaagaaaggaagacgtgcctactgaccaaacaccaggccatgtctttggtagttctattttaaaaaagtttcctgcatttctattatttctgtcggcttttttgtccccacaatttaaattctagtctccttaagaccagtcactctaagatagtatgatgtaaatacaccttttctcttcaactgcagttgtgcatttagcactcactttagtagttgctccttttctgccctgttggttggtgaactgaacagaacaattttgcccatatgcaggttgatatcgttcctgacattgaagattttcgatatggcaaggcatcgccatctttaggtaagaactaagaacagttataccatatagttaccaaattataatattcttaacactttgttccatgtcttgcaaaaaagcttacttttgctttcttcagttaggttggagaaaaaggtgagagtttcatctgctataaaaggtactcagaagactacctgatgagagaagctatgcatttcttgtttaacatctttgtaattttcttgttatgtgttagtttctttctctgccagctgatatcaagttaaatctgtacaaacaatattgacaatactttactgaagttttcagttatatattttatatattgctaaaatgtttatgctgctctggattgcaaaaataaacaatcactagattatgacttgcatcatcttaaccagaaggcaatatagtactacatattggttcatacatgatggctattcattcctcaatttcccacacacatcattcatggaatatctaaatctgttgttaagttcaaaattttcattgcatgttcacctactattaacaaaaataacaatcctagctgccaaaaagctgccaggttggtagcagaatgttcaacatcagattcagtgtatccttgtgacacatattagtgattatgtggccattatggcattatcaattgctctaccgtttaaacacaatatatgtcaagacaatgatttgttgtctattgtgtgaaatttttttcatacatttatgcagttggagctccagaaaattgggaggcaatccttaagggtattaaaaacatgaggttatctggcgaggcccctgtagatacaaagggctgtgaaaaagctggttctcttcttccacccaaggtaggttttgtgtttgcatcatctttctttttttgaccaaatccttgcatcatctttcaacctgagtgtagtatctagtgcagagcctatttattgtggtcagacccaagttctccaaatgctcattgtaggtcttgcacaggcatagtgcatatgtgattcccctattttattgtgctatgttgccatatcaaaattttagtgcaagcggtacacttgtcacacttcactactatgagtgtttcctgccacagaaatcatctgcatattaatatattattactcccccatccatttaactccattttttcattgttaaaaggttttcagccaactactattgtgtaactcttcttcatccatgtaatcatatacacatttctttcccaggaaaggagattcgcagttttgatatcaaccatgatgtcaagccaaacaaaagatgaagttacacatggtatgtctcatgaagatttcttttttggaattggttatacactatttttgctagccttgttatagttttcctatagctaaaatgtgaaaaatgaaaaagagcatgtgatctattctgattggagtgttatgcatactctgctgtgcaatggttcagatgataatatgttcttaataattgattggtagtacagaacttcatgctatgtgaccatcctgtgtctatacccttccatttgtttccccattgaactaaccttgtcataaacatcactttatgtaccacaactatgtctgtttgctgcatctgtactatattctttcatataaatgattattgtattttggatcaattgttatcagctgctgttgaacgtctatctgagaaaggtttacttgatccggatgctattgtccgaacagatgaggccacactagcgaatcttatcaaacctgtaagttgcaagaactgtttggtgggaactttcccaactacaataaattactgctctgaactacccaatataaggattgatcctacaaatgtacaaaagaatatacatgatctgcatatcacagtatgggctctagcaaatggtaacaaaccaaactttgaatgcatgcaatttagttgaagcataaccttgatttggacctcagaagacaagaagctagctagagctgtacctgctttgttaattgtactgttatagtttcttgctggaaattactcagctcagcctttgacatcatactggttattgtttaatcaggttggattctatcagaggaaggccaaattcataaaagaagcttctaaaatttgccttgaacgttttggaggggatattccagattctctgaatgagcttcttgctctgaaaggagttggtcctaaaatggctcatctggtagtaatactcattatatagtcgaaatataagcctatttagcttcacaatccctttttaataacaaaaactaagcaggtgatgagcattgcatggaagaatactcagggaatttgcgttgacactcatgtacatcgcatatctaaccgtcttgggtgggttttccgagagggaacaaaacaggtaatttgtgagttatgtcttttgtgcctttgaagaaaacaaattatacatagggaacatccattttgtcactgacaaattgccccttgtttactttgctcagaaaactacaacacccgagcaaacaagaatgtctcttgagaagtggctaccaaaggatgagtgggaacctatcaacccattactggtatgaatcggttcttttttccaccgctgatgttcaatttctaccatgtaaataactacataagatagtgtcatttgcttttaacactacatatctgaatcctacctaaactgcagaaatgtaagtcttatgtaaattgaaattattgtttttaaaatcatgcaggttggatttgggcaaacaatctgtactccacttaggcccaaatgtgacatgtgcggcataaacaacatctgcccttcagctttcaaggaatcatcaagcccaaatccaaagcaaaagaaaatgaggtcatcttagaactttttggcagggatgccttgtgtactttgtgtacatgcattatttactgacctgctagtgctggaatgctcttctaaaaggttggcatatttattgcctggatgaccttcctgcagccatctatcattttgtatagccattatgtagcattttgtatagccgtaatctattgagacaatgggtagggacacattgatcttgccagttatttattatgggcaaacaactggcacttggtaggaaaaagcttttgtaaacagtataactagaacaaaacggaggacgttcatcaattaccctgcatttgcctctgtttattgcagatttgcagttctcatggcgatcaacattgccgatctcttgtagaaatgagagttaatccatggaaaatgtaagatatttgaataacaaaatgtgttcagttctcatggcgatcaacattgccgatctcttgtagaaatgagagttaatccatggaaaatgtaagatatttgaataacaaaatgtgttcaaatcagaaaaaaaaacaggatcttcgcaagcactaaaatgggactacaagaatatgaagataacttttgagattcctaacaaaggaattaaagtgcatcaaccataaaagaattgagtgcgtaagattaactaagctattcctaccatctgtctctctaccaagatgctaataataggtttttttttttcaaaaaaaaagataagaaatactatgacagtttatccctagctaatgtatacacaaacacaaaaagatagtaatagctgaaaatgcagcagccgtagtagtaatcctagacagtaaacgccggcgatttcaggtccggcaagccggcgctgcgccggccgaccacgacgacgttcccgtcaccgtcggcgtcgacgatcaccgagtcgccggcgcagatctccccggcgagcatcttgtccgtgagcgtgtcctccagcagccgcatgatggcccggcgcagcggccgcgcgccgtagctcgggtcgaagccttgctcgacgacgagctccttgaacctctccgtcacctgcagcccgatccccttcccgccgatccgcccggtgacctcggcgagcatgatcccggcgatctccttcacctccagcttcgtcagctgccggaacacgatcatctcgtccagccggttcaggaactccggcctgaagtagcgcttcatctcctcctccaccatgttcttgatcaccccgtacccgccgtcgccgctgccatcgccggcgaacccgagctgcctcccgcccttctcgatgacgccgctgccgacgttggatgtcatgatgatgagcgagttcttgaaatccaccgtcctccccttgctgtccgtgagccggccatcgtcgaggatctggagcatcatgttgaacacgtcggggtgcgccttctcgaccttgtcgaacagcacgacggcgtaggggcgccgccggatcgcctccgtcagctggccgccctcggcgtagccgacgtaccccggcggcgagcccaccagcttcgccaccgtgtgcttctccatgaactcgctcatgtcgagccgcaccatggcctccggcgagccgtagtagtacgccgccagcgccttggcgagctccgacttgccgacccccgtcggcccggcgaagatgaagctcgcgatcgggcggcgcgggtcgcggagcccgacgcgggcgcggcggatggcgcggctgatcgccgtcacggcctcgtcctggccgacgatgcgccggtgcagcgacgactccatggcgaggagacggctcgactcgtcgacggtgaccttctccacggggacgccggtccagctggagacgatgtgctggacgtccgcctccgtcaccgtcggccccggcgactcgccggagtccaccgccgccttgctcatctccttgctcttgtcgaccagcgacatgatctccgacttgagctccacctcctcgccgcgaagcgctcccgcctaatttttgtcgaattcaaatgaattaaattttgattcgatgttcttatataccaataaatttacaggttgattgattgattcaacgaattaaaatttgtatttataaaagaaaattaccttctcgaagtcttggcttcggatggcttcgctcttctctgccatgatcttcttgagcttcttctcgagttctttagcttcatcaggtagctgtcaatatggtaaaagtggtcagataaaaaaaattgtgaacattattaatatgatgattgtgcacattaggatcgattcatcaaaatatgatgattgtttctacctgggcatttcgcagcctgacaagagaacctgcttcatcaaccaagtcaattgctttatccgggaggaaacgatcactgcaaaccaacaagtctgtcagatgaaggcagtgaaaagaggcacatagcaaaaaaattgctcaaagatccacatttcgtaacttaagaagtcaaaagatgcaattcttacaacacatttagaagaacaaaaggcgtattcactgcaagctaaggctgtcagacgtgagaaggcagtgaaacaagggaatggaacagttgaatttataacttctcatgaatcatcatttcataactaacataaaaaggaaataaaaagatgcaattttcaagacatgaagaagaaaaaaaggcattctaaacctaatattcaactagttggtagtactatcatgggatccaagagtttacatgatccattaatcttaaattctggcgcctcatcttttcagtctagagtagccttgaagaaaatttcagtactatgacgagtaaaaatagcagaaaataaattaatatacattgtgagatgcttaaagccacactgattatcttgcatgagacctgctgctgtaacagttctgttatcacaattcacaaacctgatgtactggtatgagagccgagcagctgcgatcaacgactcatcagtatactggaccttatgatggatctcatatcgctcccggagacctttgagaattcctatggtctcatcaacagttggctcagggaccttgacaggctgaaaacgcctctccagtgctgggtctttctcaatgtgctttctgtattcatcaatggtagtggctccaatacactgacagtaacaaagttaccttgagcacttggcaaaaattaaatgaactagaagctcatgactgattttataatttgacaagtaattttaatgagattccagagtaaatattttagtgttaattagtggacctgtggtaacataactcagacaaggtaacaccggaggtataaaatttacactagaaatatggtacttcccaataccttctcaaggactgtgaaaaattctaatttgatagaaataaaaagaaacagatttcaataggtagttattgtgttttttacagagaggtcaaccatgtacctgtagttcacctcttgctagcgctggcttcaggatgttggcagcgtcgatggccccttcagctgctccagcacccaccagggtgtgaacttcatcaaggaagagaattatctcaccattctgcttcacttcgtccatcagcttcttcaatctctcctcaaactcaccacggtattttgtaccagcaacaagtagacccatatcaagggtgataacctggaaaggatttcctacagtgagtaatttttcatctctactaatgatgtcatcaattgttcagatgtgcatgcaggatagatatcaaatcaaggaaagtgtccaaggtactgtttaccatgcttcctttctggtaatctagaaaggtaactcttcgcaatctcatagtgctcaaattgtaaattctgatcagtgagaactgaaactacagtagaatgcctaattatgctgataaattccagttccatagataaagccaacatgaacaggaagcttacattgctacacattttagcttgcaagaaattggtaacaaacaaaaacagaagtatactgagtctcaagagataggacgatcacaaaccgttttcccatcgattgtttcaggcacatttcctgcagcaatgcgctgcgcgagcccttccgcgatcgctgttttccctactccaggctctccaatcaggcaggggttgttcttggtccgcctgccgagaatctgcactacacggtcaacctggttttgccttccgacaacaggatccagcttcccctacaaaaaaaaataataataaagaacatcaattctcggttacttaaatttgtccctgaaatgtcctcttgtattgcaacatgatacgtctgtcaaatctgatgtagaatgctacctcctctgctagttttgtcagattagtaccatactctaaaagtgtgggtatcttagttgtactgcttcctcccccaactgcagcactaacaggttgatgatcttcagaggtgtcactgatcattcggataacctaagaggcaaatatatgaattgatgatatgtgtcaacttggattgaatttataaggagaacctccttttctgtctaaattcacctcactgcggatgttgctgggatcagcctgaaagttcttcagcacaacaagcgcggcaccatgctcacggagcaacccaagtaggaggtgttcagatccaacatagttatgccctgaacaatgtaagtaggttcagtgctagagaaatgaaaaaaaaaatggaatactttccttttttttttccttcaacaggagtagtaaagatatactagcagtaaaaagaactaaaaagtcaccatgtttaatgtcagttcccattaaaaagtacagatgcaaatggtcattaattcctcatgatcagtgttggtagactgatacttaagatcgctcatgtacgactgtacgagctgtttggtgtaacgaagaataacaacacggtgaatatacaaaccacccattgctaattgcatactaactattcccctgtccatagaaaatcaagccaatctggacatcagcattatcttcgaaatgcaattttgactgcaataatttctattgcaacaatgtctgtgtaaaatcaaatgaactagtacaatactacacaaaacaagactgcactttgtagaaatcaaatctacacatctatgtaactcgcatgtgtccaatttttaaatgttttagaaatagctatgcataaattttaaatgtgcccacatttgatttgacaatatatacctagctggtgcgcttcttcttgggaggcctggaggacgttcttggcggcgggggtgaacttgatctccatggggaccatgccggggcccctcccggccatcttctccacctcggcgcgcgccgccttgaggctgagcccggcgcccctgagcaccttggcgccgatgccggtgccctccccgatgacgccgaggaggagctgctcgctgccggcggcgtggtgccccagccgccgcgcctcctcctgcgccatcatgatcgccttgatcgccttgtccgtgaacatgtcgaaccccatcctcgccaccacccgcgcccccctcctcctcccgccgccgccgctcgcacgcccgtacgacgccgccgcgggtgaacggaggccgagtaatattggcggcgcgatcgggggagcgtggagctctcgccggcccgcggccgatgccttgacgaggcgggcgtgccgcatcggcggaggcgttgggatcatagtagccatggaggaggagggcctgatcctggtggcggtggtggtacggcatgccggcgatcggagagacggcggcgggttcagtagggttctctccatggtcgccgaggagaagcttctactctacgcctcgatcaatctggacaagcattcaatccatgaaagatcattaggttaaacggatgcgattaggtattaagagaggagaggaggagacctgttgatggtcggggcaatggcggcgcgcggccgggcggacgtcgccgccggtgatggggcggcggcgggttcgccggcgacacggaggagagaggtacgcacgcgtgggtggcggcggcgcggcgcggcagattccggtctattaatatatcaagggaggatttcgcgaaatctgtggctggagtgcacgcgtggcgtccgtccgtgatgtggatcggacggctgagatttgtgcacctgccttggccgcggagggacacgcaataagtcctttttctctgttatactcctatttttctgttggactagcaaagcgcccgtgcgttgctactcgagggaaaaggtacaccaaattatagctagagaaaacgaaaaacatgaataaagctacaataaaagcaagtgagaggatcggagagacgaatatggacatattattttaatccatatacgtactcaaaattcgtgactacttacgtcaaactacgcatggactatcaatagtcaaatcattttaaatcaatatcgacaattgatccaaaacatgagttagagctatagatttttctgaatttatgtacctttgtcgtatgttgttttgaaatcgtgacttgacacaatttagatgatggagagaacagttgggtttgatatcaattttgagttcgatatatgtatttggctctaattaataatgggtatgaaaataatcagcccaccttccaatcgtggagattgcttttcaaaaaagaagttcttctgcatatgtgcagaatgaagaatcctctcaagcaactggtttatgattggatacaaactatataggaatcatgtttttctttctcttctgtttttttctgtaactttgtaaatattctctttcatttataaaattacactgctgggcaaagtcctagcagttttcctagtaaaaaataataataatgggtatatagagataaataagtttatttggaaacttaagatgccttttaagattaagatttttatgtggtatctctttaaggggattgttggaatggtagtttgagatattgtttctgtatgaaaaatgaatcgatttaccatcttttcctagattgccattttgccagatttctttggagatctatataattcgcgtttggattataccttccacatagtatatctcatgtgtttgggaattggctcgtggatgttaataaaaagataaggaacttattcttgtttgagcttccgctgtatgttggctctctgacttagtagaaatgaaatggtttttgatagatcactttcaaaatctttgcaggttcttttcagggcaacatattggcttcgggaataggttcaattataaagacatgatgatcatatcaagctaataaaagatgcgtgccgtaaacttgagtcgacgatcatgcagctctttgccaacattgggtggagattcaccaatagaatttagtagttgtggggtctttacattgtttgatttttattagtttgcttctacttttggttttgttcctttggctacatactatgtgagtttgcttttgtgtgaaccttgtaataattgactgtagctcttgagcaaagcccaacatgtttcattctattatctagaaataaaatcatgaaatagagggtagagacttggatacaaaagagttatttgttacggttttgaagatatcgcgatatagaaatatatatctcatcatgagttatgtatatctctgtctcgcaataactctagacatgagtgattgaagatactcgttgccaattatactttaattttcgattgaaagactatagagcaggagataattgactccgataagtagggcacagtaaaccaccgatttcacaacatcttgtgttctccactcctcgattgagtatgtatgttctaaaccaaatgttcaacggggcacgacccaaacctcgtgttaatactacctccgtccgtaaatataagggatattcactgttctcgtataacgtttgaccactcgtcttattctaaaaatttgtgcaaatataaaaacgaaaagttgtgcttaaagtactttggataataaagtaagtcacaaataaaataaataataattccaaattctttttgaataaaacgaatggtcaaacggtgcaagtaaaatatctaaatcccttatattcacggacggagggagtacttgataagcaacataacatgaagtgaggttgtgagtctgtgactatctgtccacttgctcatttctttctgttttgacccaattgatggctttgtcaagctccgcaggtagggaggagtgccatatttcagtggtaccagtcacggtctcgacgtaacatggttcgactatgtcagtgtggcaaagcactgatttcactcacttcctggccacccaccctagggactcgatcgtagaagcatagcccagacgcttgtcttcttttatttcttgcggtttctgttctctagctaggtattagctatatgttccttgaccatcatgatgaacaagcacatggagattgagcagattttttaagataatagaagcttttattaaactcagtcaattacattaaattaagatgataaaattatcctaagaacattttgcgcagataaactatctcgacttcctcgtgtctttatttcctacatgtccgcagtggctagccgcttgaataattctccactcggtggttatgtgatattctctccctaagatcaagaaacacttgaccgaaatgcgcacagagacgctagctcgacttcctggtgcctccatttcctacgtgctgccctagccacgactagttgctctcccattttaagatatttggatcatgcaattttatttgaaagagggggcttctttcaaaaagaatgtaattaagagggataagaagtttcatgttgcattgcctcgcctttgtgatatatatagatacaaatatatgtagaaaatgtttatcactagaagtagctgggtggatgaacaaatgtgcatgaagatgagaaagtatgaattactagctagcaggcactaattattatcagaactgcaaagtggacgacattaatttgggtatgtgcattagtctatcatggacatatactgtcccctggttgtaaacttctacgccctccgtttgatttattttaaagtcaaattttttatgtttgattgagtttatagaaaaatacagtaaataccaaattagttttattaaatctaatagtgaatatattttattaatagagcaattttaccattcagcattttgtacttccaggccgtatatatcacattttacacataaaattttggtaacattaggtactaagcatcttgaggtattaaattttacactagaaaatgattcgatgtatcaaaaatttatggtaccttaaggtagcaaaagttggatgttaaaattacttattttagtaacatatttcttttttgttgaaaatactactccatttttctataaatatggtttgactagctattgtgaaattgggaatgctacatacaatatatataaacattcaaaatgaaaagaggactgcaactattgataattgataccttcgtcctgcagttttttttcatggaatatccataaaggagatgagctgttaatttaacaccggtggtgttttcattagtaaaatactcaatttattacatgtcatcgcgcaattgtaacagcattgtacatgtacgatgacgatacataacagtaaattgttagaaggaaaaaaatccttggaaagttggatcttccaatgtccaaaatccttctgtcaagtaatcgtccattccgaaagggggtctaaactagtccaagtccataaatacctaattgctgcacaaaattgcaaaagtgatggtgtgagcctatgctgctgaacaggatgctggatcatctctgctcggaagagcacgtccactgttcagcttcaatcgttcaaccagcttgaattaaatttataaatatactgttaatttgtttttgacaaaaaataccgtcggtctcgcacaacggttacgcgagaatgacgtgacttgacgccgcagttggtctcacaagatagcatgagaccgcgcgtgagacagcaagaccaaacggtctcgctaaaataaaagagctagagcgaacggcttgcctagtgagcagccgcttaattagtgactaattaattacccaattagcaattaagcaataataattagtaattaattatcctgattagcttactaaataattaattaatcgataattaaacaacttgaactgccccagaccccagccattcggtctcgctatttcttcgcgcgaggtcgcgcgtgcgaaaccgcctgtgacatcgtgcccacgttattttcacgtaatgtttgtgtaaaaccgacagtatatttctataaaaaaaattgcattccgaatatttatgggaaaaaacaaatcaacagtatatttgcaaatttaattccaactatgttcttgggagtttcaagctttttgactttttatcgaagtaggggctttttgggagaactaattatctccatccattttatatataagtcgttttttatattctttttcaagttaaagttatttaagttcgatcaaactagtagaaaaatatagtagtattttcaacacaaaataaatatattatcaaaatatattcaaaatgctagaatcaataaaattaatttagtatttcataccacctacatttgactattcgtcttattaaaatatatataaatgttatttattttggtgtgacttgttttatcaataataaaactataatattaacttatacgtttacatatttatactaaatttttaataaaacgaatgatcaaatattatattatgcgaaaaatcatcaacgtcgtagtatgttgtgatatttttctacaaatttagttaaactaaaaaaggtttgactaaaaaatcaaaatgacttatcaaaatgaaacgaaaagtgtagataaagaaatatacagatgaactttaacattgtgaacataacatgtattgtacaggagctctcatggcgctcataagccacaaagtaaaactgatccaccaactatatataagcccgtctcatcaatcacaaaagtttaagcaatcgccttaactcttattctctctgtttgaattttgtcccttaaaaaatcaacttccaccatcctacctaactcttacattatctaaaaaaaaactttttaaaccagaagaaatataaaatggttttaatcctaagtagtacagtacataagctgttaatctaattgggtaacagtactcctgattagtacaaatggttctgaatttgcaaatgcttgattgataaattgcctgactcatgagctgaactgccggcgttgtcagaattctgaagcacaactgttttcaggttgcattcttcatactggcgactctgggaattcagtagcaagtgacaaactctgcagaaccaatagataaaagagcaaagcacacatataatttttgaatggaacaaaagcacgcatcctagcatgtgtcttcaacaattctgctgaaactgtatgcatttcagaacattagaatgcacaaaattaagacatccccacttgcacgttgctctattggctcaacgatttggtaatactgccacttttcgcacggttatgaaacggtgttgaacaagaaacataccaacacaaatttctgcataatgcaactttttttaatagataatagaaatgaggattacatttttggcctctgcccgtgggcatagttaaaaaatctcaaaagtaaataggaaggaattttaaaaaaaggcatgatgggacatactcctaacttctgccaataaaatgatttattaaaataacgttttcaaaatcacatacattttataacaaaattatgtagataccatgccatccaaactagaacaaaagttctttggctaccaatttcaatcgtattgtgtcagggttatggataccacatacccaatagtaatcgactaagcacggcggggtccaccacataccatgtcttatatgggaacaaacctcgtatatagaaggagttccggataaggaatgacgagtagagttctatatggaaacgacaaggactacttggatcgtatccatatttatctccctagttctacttggacaagagggcatctatgggtataaatacaagcccccctaggaggagaggggacacagccaacatgcaacacagacgccacaaatccacaagccaatacgccaccagatctcgacatcagagattagcctagccataacccatccggttcctacggaagtcggcaagagggatctagcgccatctctgatctcaccgagtacagattcgaggaggaagactgccctgtcatcaactacgagctggttatctagccgccaagttgacgatagttagataggttatcccaaatattgtatttgtgtaatccagatgaataaagagcaacaccggctttggccaacaggatgtagggctattacctgttagataaagggcccgaacatatataaaaatccctgtctccatctcttttacctcaatctcgtatataccttggtaccaacgatccccataccatctaaataccctagtcgcgatctcaaacgtcgacattgttagatttgttttatggttaaaaactacatcattacagtaacgtcagattaaccaacataaaacactagctccaaataaaatcatttcttttgtgggcctaggcactcccattagccagctaccaaaaatatcttttgcattgtgaagagggggatattgaaggcaaagaagacaaccaaacaaaacgtgtaacatggcaatcaaacaaaagatgttagatggtcacttgtgtattaaaaaacaacattgctgaatccccttcattttctctttgacaggatgctaaacatcattttgtactaaactgtagcacaaacggtcttgtgtctacctgcaagcatggggtggcattcatttggcatagcacatcttcggtcattcttcactagtaattttcttgcaaattagcaggaggtggagaaacttctcgagtttagtgactaggaagatgatatggtagtctaaggtcatgtttccgattgatgtgctatcaaaattttggtagtgccaaatcttgggtaaattttggcactaccaaaactttggtagggtagagttaaaaatgttcatttggattaaagccaaaatatgccgataagacacaagttcatgggcaaagctaaatttgtggcataaataatgctttgatagaggtgtttggtttgctaccctaacaaaatattggtagggcaaattttgatagggtagcaatccaaactagccctaagtattgtctcttgcttctgccaactggtgaaagcaaggccagtccacccgtacaaagccatgggccctaataacaagcatttcaacaaccggcaaataacacatcatgtcccgtttcatcgtgttgtgtgcatacggaaaaagcagtccaaatttgtaaatgttgaagtttggagtcgtatggggatgttgttttcctgatttgataggtttcctatgtgattaggagccatagttctagtcggattcgtggctatgggcaaccccgttatgggtataaatagaagaggggttgaggctagaagatattgactctttgggagagaaaagttaaagtttgcttcaaggttccaaccctaatttaaatgcactttgtaaaacacatattgatacaataaattttatctactttcaagaattttatcgatacatgtttttcttggtcttgacggtcaaatcggcatatgacgagcggtccaaccggtggcagggaggcggtctaaccggcagcaaggctggcggtcagaccgatggtgtgcaagccgccagaccggtgggagtactgtggtcagaccggtggtgatgtactagtgtgaccggtatagcttcgtcaagtttgcgggtaacttctattttcgctaaaagttatttgttttttttccttccattcgctcctctctagtaggcttggttctgtattcgattctacaaattaatccttgatttctttctcaaatcattcaaccctgtcacatactcagaatccattcctgtagaacattatttatgcttgcttaattgtccctagttaagcatgaagagatacttgatgttgcagggaaattggaaaaaggaaaacactacaaataagcggacggaaagttttaagtacccaagcaacatacctcgagtctttgatgttgagttttcatatactacctgttggaaatatggtcatatatcggcatattttaatccaaaatgttaagacaataatcatggcataaacagtgttggatgatctagtgacaacatgtagcataaccagtagcatgctaaaggtatcataagcatcatgaacatgaacatagtaagaacgcaattgacttgagactaacaggactaacagcgctatgaacgaatgagttaacagcaggagaaggatataccctgagaatggccctccgctagattgtgaggcagaattgcttccgttggtgttgacgttcgcaacggctctggctccagctccaggcgcgccatctccagctccagcagcagcggcgccagcggcagctccggctctaggcgctgctccttccgatctctcatgcacgcaagctatcagaagcgaggaggcgagaacagcacatgcgcagaggaggaagaactaacacccgggaaagaagcaagcgaatcgttctgatcggactagcggcctccttctatagcaggagagaggcagtcgtgggaacgtgggatcgtggacgcgccgttgcggaggcagtcatgggaacgtgggatcgtggttgcaaaagaatagcgacgtgacgtgacgcacgcacgccagccagccagccacgcctcgcccacgccctcgccctcggccttggcccggcgcgcgtgcgcgcacgtgtggctttccgactcccacctcaaccggtcaacagggagcctccaataactccctatttaggttgagatactcctcgcttaaatcctgaggtggtattattatccttaacacttattatgggcctttaagattttaataggataaatcgggcctagcccaattattctaacaatccccaccaaatttcaaggctcataagactcaaggttgtgcctgtttgatataccagtgtttcggtggagactgttaagttgaacttccacctaggaaatgagctacatcagaccacaactgaacaatggactatgccttgaattgtcagttttgtgtgatcaggtttcactcaaacccttgactggtactgggctgccgttcgcatcccctctatttggagcatataagtcaaactccaggcctttcatgagtatctagaggtcgcccaaacctcatagactgtgactagcagtcgaactcatataggtgtgttccttctgagatgttctgcaggtcaacatctctgcttggaaaagccactcggatcacattaaggtatgagccatcctaccatgcaggaaagaagagaagtacatcatgaaaatgagcccttttcaagggtctcttctctcagtcacacaatagtttgtttcgccatccaaattcacgggatctccgatcacaatggacaggtttccactattgtgcaaccttaggtgggtatcatgcccatttccctcgatgcactgtctatcacattacgtggtagccccttggtaaactgatctgccagatttctagccatttggacatagtccaatgctatcactccggagtatttctgctttctgacagatttcgtcttctcttgatatgcctagatgacttcatgttgtcctttgaactattcactttaataatcactgtttgattatcacagttcattaggatacttggcactggttttttaaccaccggcaaatccatcaggagttcacgaagccactcggcctcaactgtcgcagtatctagtgctgtaagttctgcttccattgttgaccttgttaagatggtctgcttgcaagacttccaggaaacagcgccacctccaagtgtgaacacatatccacttgtggcttttatctcatcagcatcagatatccagtttgagtcactatacccttctagtacttttggatacctggtatagtgaattctatagctcatagtgccctttagatagcgcattattctttccagagcctgccaatgatcatcttccagatttgagacaaaccggctcagcttgcttacagcaaatgagatgtcaggcctcgttgcactagccaagtacatcaatgaaccaatgatttgagagtatctcagttgatcccttgctattcttcggtttttccttaatagcacgctgggatcataaggagtaggagctggcttgcagtcactatatccaaagcgactcaaaaccttgtccacatagtgggattgcacaagtgtaatcccaccctcatctcctctttgtagtttaatgttaagaataacatcagcctctcccaaatccttcatttcaaaactcttggacagatagtccttgacctcctcaatcacattgaggctggtcctaaagatcaatatgtcatcgacatataaacacaagatcactccttctctcccaccatagcgatagtatacacatttgtcagcttcgttcacaacaaagcctgcagatgtaagcgtggtgtcaaacttctcatgccattgcttaggtgcttgcttgaggccatacaaggatttcaacagtttacacaccattccctcctgaccttctagtacatacccgtctggttgatccatatagatctcttcctccaggtctacgtttaggaaagctgtcttaacgtccatctgatggacgagaagaccatgagaggctgccagagcaagtagtactctaatcgtggtcaagcgagcaactggtgaatatgtgtcaaaaagtcctcgccttccttttgggtataacccttggccacaagtcttgccttgtacttttcaattgtaccatcaggccgaagctttttcttgaaaactcatttgcatcctacgggcttgcacccatatggacgctca

SEQ ID NO: 58665 - DNA, 10574 bp, Oryza sativa
ttctcaccctgtcatacctagacaagtagaaggtgatgaaacaatagtgagcatcgacaagggttaaatggtacaaaattgaacattgacaatgaaagcaaacaaagataagaaatatttacttgtgtaattcaactccagttgagatgtcctcaaccggccaatcttgtttcttcccgaactgtcgcatgacacggtgtggaaggtggtactcaactgcccagaaacaaatcaatgggcactggtacatgaaatagtcagagtctcgattgcacatcaagttcagggtcaggcttgaagcctcatttgtgtggtatggtaaccactcaatctgcaaaagttgaagagatgtcgttggttagtatctcaattaaagaagtaaatgtctaactagaagtgatattggaagtacttacatgttgaggctgtaagcagtccatctcattgacataatgcttgtatgccacatcccagtgagcatgtgcagtggcagtactctcaaaaaggtaggccactgtcttctccatgtctggctcattgtagtaccaaggagtgaagctttgcctccacttaggccttccaaccggtagtcttaaccacatccatatctgaatcaatagcacacaaccactcatgttggatgatggtgcctgacgacaacaggcctcacagagctgtctatatgtccacgccaacactgctgagccccaactgaaacggcccagatcaccaaggttggcgaccaaaggaatccatatcgccgaagcaatgtcacccccagcatcaggaaacagaacccctcccaacaagtgcaagatgtatgcacgggcataacactcaacacgccatggctcagcatcgtcgtcaagatgtgagaagttctgactcagccaagacaggggtattccattctgcttcttcttccccccttgcccctgctcaatgttcagtggaatgccaaacagctgctgcacttgtgcatgccatccaggagtctctgtcctgcccgtcacggcatgcccccgtaatgggagggccaagatcatagccacatcctgtagagtgatggtcatctcaccactggggaggtggaagctgtgtgtctcaggcctccatctgtccacaagtgctgtcaacgcaggagcgttgaacactggcattcctctgctcacgaccaaggccaccccgagcaacccggcagcccttaggtacgggatgtacctatcgtcgaacactaggggagcatgagctctgactcggagcggttgaagtacctgcattagcaattgtaaatcaattagttaatataatgtcaaatacacgctaccgatacttattgacggagcgtggggctcctcaccgggagaccgcgtaggcccccctttgccggttcggccggggactcagggtgagattctaagctctctgtatgtggaaggttcgcgagacaggaaacacacaagacacgggcgatgtatacaggttcgggccgctgagaagcgtaataccctactcctgtgttttgggagatctgtgtatgaaggagctacaaagtatgagccagccgctcccttgttctgggttccctatctggaaaatcagtcccctctctcagtgggctaggtcctccttttatatcttaaggggataccacatgcaccatttctctcttttttgtgggacttaccctaccttttcataaatggacggagatttgtatagttgccgtccgagtcatcttctgatgagacgacccacaactacctccactttcgccgggagcaggtgcgacgtggaatcgtggctgtctgctgacgacatgaccggtgtcagacccgtcacgtcggtcattcttgtgcaccacgtgtcagcttagcaatctacatgttcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcatagaccggataaacgagtgcactgcactgtgttacatgcggcgtgacacgctcagccaaaccgcaataaatgtggttaggtgagccccactgtgctcacctaacccatacacgcggagcaaaaacccacgaggggtcggggtgcctcggccctcggggccgaggcgggtgtggcccgaccccctcggggggactaagaggagggcgaacacatcaccctcgggcccgacgtccctcgggggtgccaggccacgtgtgcgattgtgtctgcctcaaacctctagtcatgatactcctgatcccatgttaccgacagtagcccccggcgttatgccagggcgatcgccctctttaagggaaacggtcgggcgtgacgccactcctaaggcctggtgacaggtgggaccggtctccacaattgggcagaaacccaacggtcacaaaccacgcacatcggcaatggtaactcggctgtcaacaatgagcagtctcttcaagactgccacattacttgagtagcacacgaatcttgacatggcgattcgtttcgtctggagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcgctcgctcttaatcttctctttctccggcgccatggcacggggctccgctctgcttgatggtagcgtgctgccgccttcccgcatcgtgagtgagaggcaggctgggctgtcgcgccgcttcatgccggaatctgccaccggccgggagatagtcacgctgggcgagggacgcccggcgccagactacccggggcggtccgtcttctttctcccctttgcaatggcagggctggttccgccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagtcggtggctgctacttccagccacgggggccggtgctgaaccgctacatcccctgcgccctccgcaagaagtgggacgactggaagagcgactggttctacactcccctcgccgacgaagcgcgcctccgacttccgagccagcccccggcgcaggcctccagctggcgggcgccggtagatctgggggatggctatgacgccgtcctcgaccgcctggcgggcctgcgatcccaggggctcacaggggccatggtgtacggcgactacctctgtcgtcggattgcgccgctccagcgacgcgctcggggcgcctgggagtacaccgggtccgaagacttcacaaggacccaccagggagtgagatgggactgggctcctgaggacttcaagatattggtccaacgggtgctgaatctcaactccgtagaggcggccctcattccccgaggaatcctccccctctgcagcgatccagaccgcgcctccatcctgaccattatgatggcggttggggcctcagaggagcgagctccaaagggccacgacggcgcgggcgggagccgcaggggggaacaatctaccccgagagggggtcgtgcttctgggtcccgcgacaggggcccggggagcagccgccctgccgacgcccgggggaagaggaagcagggaggaacacctcccccatctcctccccgagggggcggggcggcgcgtgccagcagcaggcgcccggagggggccgcgccaacatcgcagcccgagggggagcgcaagaagaagcggccccgtaagatgggggagacagaaccatctcggggaaacctcatttcccctccaaagtggtcgtttaaccgacctcctcgcaggttcatctctcacccatcgtggctgtattcattctctcaacgcgagttttcactcacccaccttgttcgtcttctggttttttttcttttgtttcagcgagatcccgtcgcgtccctcccgccattccaagtccggccagtctgaggccgaggatccggcggccgcagaggccctcaggcgggaatctgaccggcgagaggccgtggatcgcctacgggaagccaaggaggccgcccaggaggccgcccgggctcgccaggccgaggaaaccgctcgggaggaggccgcccgggcccgccaggccggggaagccgctcgggaggaggccggatttcgccaggacgaggcgatggcgacttccgaggcaactcgtgacgaggccgcgggcgcgtcgcttgggcccactccctcgggcgacgctcaggcgacaacttccggggcagctggcgacgaggctgcgggcgcgtcgcttgggcccactccctcgggcgacgctcaggaccaaacgggtccgggggacatccccgagtccggcacttccatcggcggcccgagccgcgtggcatcctctccaaggcggctcttccccacgccttctatcgccccactgaacgcagagccccttctgcaggccttggccgccgcaaacaccacggtgttggatgggttaagtgcccaggtagaggtcctacaggcagagcgggcggagctcgacgccgcgtgggcgcgtgtcgaagaggggcgacgctcggtggaggccatggtggaggtgggccgtaaggctcaccgccgacacgtctcggagcttgaaactcgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagctcgacgccgcccagggggtgcttgacgctgccgctgcccgagaacagcgggcggcggagaccgaagcggcgtcccggcggcgtgaagaggcccttgaggcgcgcgccatggcgctggaagagcgcgcctgcgtcgtggagagggatctggcggaccgcgaggccgccgtcaccatccgggaagcaacgctggcggcgcacgaggctacctgcgccgaagaagagttcacgctccgcctccgcgaggacgcgctcactgagcgggagcgagctctcgagggggccgaggccgcggcgcaacagctggcggtcagcctgtccctccgcgaggcagcgcaggaggagcaggcgcgtcgcaatctggaaggtgcccgcgccgagagggccgtactgaaccaacgggccgctgagctcgaggcccgggcgaaggagctggacgcgagggcgcgcaacggcggggcggccacgggcgaaagcgacttagccgcccgcctcgcagctgccgaacgcaccatcgccgatctgcagggcgcgctggactcgtccgccggggaggtcgaagccctccgcttggcaggcgaggtagggcccagcatgctttgggacgccgtctcccgcctagatcgcgccggtcggcaagtgggcctctggagagggcggaccgtaaagtatgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgttggatgagttccctcctgggaccgaggaccgcgcacgcgcgcaggtccgggatgccgccgaccatatcgtcgacagcttcgagggctcggcccctcggctcgcgttcgcccccaactccgacgaggagggcaatgccggtggtgcagacgacagtgacgacgaggccggcgatccaggcgcatcggattgagcccccagacccccgccattcttcagttttttcttcttttctttcttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggcttgtgcccaggttctggtcctcaaaaggcgcgggtcggggctagtgcctggggagatccacatgtcgagactggctaggccgggaacgtggtgaccgagggttatgggtgacccgattgtgggtttttgccgattcccccccggagttcaccacgcctcggggcacggctcggttctaggccccgtttggcgattttagccgacccgagcctccgagggcaggattgaggacgagtgacctatttcaagtcaagatttttcaaaaggaaaaaacagcacagatacagcctttaggaaattgaaactgcttttattgaagtactgagaaaaaaaaaaggaaataagaatgtgcatgtgtggcagcccccggccaaccctacacgcccgagggggtgcggggttggcccgagcccaaaacctgacacccgacccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtgacgctgatggtagcgccgcaggctctgctggtagcgcgcggctcggagggccgcgcgccgccttcgctcttccaagtagtcgaggtcatctctgcgaagctgatcttgatcagcctcgcaatacatggtagcccgaggagacctcagagtgagctcggatgggagaaccgcttccgcgccgtagacgaggaagaaaggcgtttccccggttgctcggcttggtgtagttcggtttgcccagagcactgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcgatcgcgacatacagatactcaaacccacctggggcccgcctaaacggtcccaggatatcgagtccccagacagcaaacggccacgaaagtggtatggtctgcagggcctgggccagctgatggatttgcttggcgtggaattgacacgctctacatcgccggaccaggtcgaccgcatcattaagagctgtcggccaatagatatcctggcgaaaagctttaccaaccaaggtgcgcgaggcggagtgggctccgcattctccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacgggcctcgggggccggtcaggcgcatccgtctcccctaaggggtcgggtcgcgccgacggctgggtaagcctttcttcaaaggcacccggtggggtctgggctcgcgaggacgcgagccgtgagagttcgtcggcaatcatgttatcccgtctgggcacatgccgaagctcaatcccgtcaaaatggcgctccatacgccgtacttggcgcacgtaggcgtccatctgcgggtcagagcaccggtactccttacagacttggttaacgaccagctgggagtcgcctaacaccaggaggcggcggatccccagtccagctgccactcttagtccggcaaggagtccctcgtattctgccatattattggtcgctcgaaagtcgaggcggaccaagtatctgaggacgtctccgctcggagaggtcaacgtgacccccgcaccggcgccctgaagaaacagggatccgtcgaactgcatcacccagtggacggtgtgaggcagctgcgaggggtccgtgctggcctcggggatcgagatgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactactgtgacccgatgcgcctggaaataatggcgcagtttcctcgaggcaatcagaatagcgcaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttgtcttctgtgctgatgacctcggggtcggaggataacaggggcggccttcccatagtggcttcggggccgtcctgggggtcgggggctcctggcgtcgtcggacaagcgggcaaagggccaactccggtcgtcaggggccttaggcctccgttcggctcgggggcctcttctccctgctctttcccgggtcgagtcagcacagggttagcctcggggtcaaagggcgataggtgcggccttcccacagtggcctcagggccttcctgggggtcgggggctcctagcaccgtctgacaagcgcgcagagggtcaactccggtcgtcgggggccctgggccaccgttcagctcgggagcctctcctccctgctctctcccgggccaagtcggcacagggtggggaggcgtgaaatgagaattgtcctcatcgcgctccacaaccaatgccgcactaactacttgcggggtcgccgctaagtagagtaacaagggctcgtctggctccggggcgaccagaactgggggagagcttagacatgccttcaactgagtgagggcattttcggcttcctccgtccaggtaaacggtccggagcgtttgagaagcttaaataagggtaacgccttctctcccagcctcgatatgaaccgacttagggcggccatgcaaccggtgacgcattgcacatccctaagtttgctgggggggcgcatccgctctatagcccgtatcttctcggggttggcctcaatgcctcgggcagagaccaagaacccgagaagcttgcccgcaggtacaccgaacacacacttatcggggtttagttttatgcgggcggagcggagactctcaaaagtttccgctagatctgagagtaaagtttcctggttgcgcgtctttacaatcaagtcatcgacataagcctcaacattacgtcctaattggctacccaaagaaattcgagtagtacgttgaaaagtaggacctgcattttttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggaagacctcacggatgaatccggcctccagaagtcgcgccacctcctcgcggatgaaggcttgacgttccggggcctgccgccgcactttctgccggaccggccttgcacccggccgcacggcaagacggtgctcaatcacctccttggggaccccgggcatatccgccggtctccatgc

SEQ ID NO: 58666 - DNA, 1663 bp, Oryza sativa
attatagcactgcatatgattttcgcttacatatgtgtttataaaatagaagttaatgcattaacattatttaaagtacaaagattaatgataattacttggaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaagtaaatgttaaaaactctaattaacatatgaaattgccacttgtgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtactcaactccgacgatttttcttttgcctgggagaaccacttgacgcttaggctcatcaggccctctgcccttctttcctttgctagacatgtccttcacgaaaaagacttacgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagatgttccatcgtgtcccatggcatcgacacgaacaacgctgttttggttcgtgctctccatgtcttgggctctcgtgtagaatgtatacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatccgacttaccgatgttcctggcgcgaactagagccaagtgcttctcgatgtagggagctaccaatgaagagtgttgcagaacagtgaaatgggctttacggaataaaat

SEQ ID NO: 58667 - DNA, 14733 bp, Oryza sativa
gatctgtctaagtgataactgtggaggagaggataagtgatagggattatataatacatatttaattttagtctcggttggtactactaaccggggctaaagattatcttgatctttaataccaaccgagactaaagtggtgatctttagtactggttattaacaccaaccgggactaaagatcctcggccccctgacatacatctgacaagggatgaacggttggtgttaccaaccgggactaaagataaaaatttttataaccgggactaaaaacaatctttagtcctggttctttttggatccgggattttgccggaccgaccaaaatggtttctccactagtgattgtagtgaatatccacggcttagagtagcattcgagcgaatcctataataacaatgagcgaagcagctttttaaggatggcgcatatctaaatttctcgttattttctatccaactgtatattccaatattggacggctacacgatctaatccgcacgtgagccactgcaatctacttcacgtccggacagcatggatcgatgaccaacagcatggatcgatgaccacatatcggcgcctctcctatacatgcagtcttccctccactcgaatgaattgttgtatgcttgccatcaccgcttgtgtgttagagtaggtacataaagatattgagaaactaagcaatacccctttaccacaaataaataaatagtccactttgactccttcatagtgttccaaaactaattcctgaccctgaaccgtaaaatcagatatcttaaccccttaaactgttaaaaccggtcaaccagtttgactctctcggtagtttcggagagcggtttcgctgatgtggcacgttacgttacggtgttgacctggtctttgtcccacgtggcactcacgtgacattagaattaaaaaatatatatgagcccatttgtcattaaaaaaattgtggggcccacatggcggtctatctcttcacccatctttctctgtctctctcatcttgttacccctaggacatccccgacgagctcgacgcggcggggctattggcaccggtggtggctaccctggtggtgtccactggagctccctcgccgagctctatcatgctaccgtcgccatccaccactagtcatcgtcccgtgctccctcgatgtcccacgtgaataagaaaaggagaccagcggtggctaccccggtggcggcacaacgggcagtggcttgcttcaccaggcatggccagccaacgtctgctccttgtcactatcatcatcctgatggagctcccgcaggcagggggcggtgttgaccacctatgagagatggagctcgccgaagctcctccaataccacccaaatctaaccgaggcttgagagcgaggcttggcgtcgaccaccctccttcttacgtcaacgttagactaggtcaacattgtcacgtcagcgaaaacgctcttcaaaatcaccaatgagtcaatttgcactagtttttaatagtttagagggtcaagatatctggttttgtggttcagggttatggattagattcaggtcactggttcagggttatggattagatttgggtcacttttaagagagtccagttgaactttattcccttcttaaatagaacgaagtctgagcccgtatatgaacccaccctgccccctctcttctctcatactcgtttgggcttttgcaggagaccaattgcatattgcgtattcgcgatcccccgggtctgctcactgcgtgagaagaagagatgatgcaatcgatggtgcggtcggcggcgcggcacgcggtgtacgtgctgcggcggttcggctgcgtctgtgagagcagagccgccgcggggagaagcctgagcaacgtacgcgccggtgagccgccggcggcgctccgggaggagaagaagaagaagagattattttctttcaggatgacggaggaagagaggtcgagggtcttccacgccagcgtcatctggggcgtcgtattcggccaaatagtcatcttcacgatgcataagcctcggtcttgcaaagaaatcatggccgaattagaggctaaggctgctgtttcgagacaaaattccccgaattaagatgctaggttccatatcgttggctgtttaccatgtactactagtatttcttgagtaatttgagtattagtatttgcttatttgctactgttcccttctttggaattgctagataaaattcgttcttttttttgggcaacaatacatgattgtgctggcaatgatacatcgaacgaagagtcgaatgcgccgtcggcgccgcctgtcggcacgcactggtggagaaaccatctttcgtcggtcggccgatttccacaatagtcccggatgcaataaaaaccggggctaaagatcatctttagtcccggttcaaaagggtaacgggcatatttgatctttagtcccggtttgtgtggaagccaccgagatagaaggcgctggagtgttgccttgtgttatcggcggaagagccagtttacatgtttgggcctgagtgagaaggttaagaatggaaagagatgggattttttttaatcggttaactgcacatgacattcagcccttgcaggagtaaaaagtctatatgacttaacgtcttagcatagcttttcttttaaaaccctgtataagcaaccgggactaaagatcatctttagtcccggttcgaatgctgtcaggacctgtcaggccccaccaggatctttagtctcggttggtattaccaaccgggactaaagacgtaactttagtcccggttggtgttaccaaccgggactaaagatcccggtgatctttagccccggctggtgctaccaaccgggactaaagatcttaactttagtcccggttggtaataccaaccgggactaatgatcccggtgatctttagacccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgataccgattattattcaaggccccaagcaacctggtaacgacatcgacgtgtacctaagaccactggtcgaagatcttacatagttgtggaagaaggaagatgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcactttgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttgaacgtacgccacgcaatcgacgtgatgcacctcactaagaacctttgcgtaaaccttcttggcttcctaggtgtatatggaaagtcgaaagatacactggaagcacataatgatctgaagcatatggaacaacgcggcgaccttcacccggaaccaaaggagaaaggaagccattacttgagtccagccagctacactcttagcaaggcagagaaggaaagtatgtttgaatgcttagagagcataaaggtaccatctggatactccacgaatatcaagcgaataataagcacgaaggagaagaagttcacaaatctaaagtctcatgactgtcacgtgttgatgacacaactgctaccagttgtaataaggggtatccttccagacaatgtccgggcaacaataacaaagatatgtgcattcatgaacgcaatttcgcagaaggtcatcgatccggatagattagaagcccttcagaatgaagtggtgcaatgtctcgtcagttttgagttgatatttccaccttcatttttcaatataataacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcgggaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacaacaacatctcatgggtaacgagacgatcaaccaacaacttgccttcctggcgaggggaccgtctgggtcgatcgcgacattccagggatgtgagatcaatgggtacacattctacacgagagcccaagacatgaagagcacgaaccaaaacagtgctgttcgtatcgatgccatgggacacgatggaacaactggcacgtattacggtgccatcgaggatatatgggaacttgactatggtcctcccaaggtccctctgttccggtgccaatgggttaggttgactggtggaggcgtaatgattgatgacagtgggatgacaacggttgaccttaacaaggttggatactcggacgaaccttttgtccttgccaatgatgtaacgcaagtcttttacatgaaggacatgtctagcaaaggaaagaagggcagagggcctgacgagccgaagcatcacgtggttctcccaggcaaaagaaaaatcgtcggagttgaggacaagactgacgaggattacgatcagttggatgggcaaccccctttcatggtgacgattgaccctagcatcctcctatcaaatgaagacaccccttactcacgtagcgatcacaaggagggaacaatagtgaggagaaagtacgtgcggtcaaccgttacggccaatgtattgccgtaattatggtgtacacgatgtaaactattttggatgtattcattatccatataaatcaattgttgtatgacatatgttaattacgtacgattattagaggttttaacaattttaaatcatgtatatgctagttatatgcgataattagaatttttaaaagttttaaatcatgcatgtggcatttacatatgttacttagagtttttaacaattttaaatcatgcatatgctagttatatgcgataattagaatttttaaaagttttaaattatgcatgtggcatttacatatgttacttagagtttttaacaattttaaatcatgcatatgctagttatatgcgatacttagaatttttaaaagttttaaatcatgcatgtggcatttacatatatgatttctaaaagttttaaatcatatatgattattagaatttttattaattttaaatcatgcacgtcgtatgtatatacatatgttaattgcaatttttaacaatttaatatcattcatatgctaattatataagattattagaatttttattaattttaaatcatgcatgtcgtatgtatatacatatgttaattacaatttttaacaatttaatatcattcatatgctaagtatatatgattattagaacttttattaattttaaatcatatatttgcttattacgttttatccacttaatttactacaaacaacaataatttttcgaagtaattgtcattaatttttcgactttaaataattttaatgcattattttctattttagaaacacatatgtaatggaaatcaatattcaatgcgtttatcagtagtcccggttcttaaccctaaccgggtttaaaaagaatttggaaatagcgggaaaatatctttagtcccggttgatgagaacaaccgggagtaaagatatagggctatatatattcccgatgcgcgccctcatcttctccaccaacacttagaagttttttccccgatcgatctcccttggcttctccttcgccgccactacctagggcatccccgcgccgacgccgccgtcgtatctcgccgtcgtctccgccgccgccgcatctctggggtgagagccgccaccgcctccccctctctctctctctgacctcgatctctctctctctccccaaaccaccgccagccgcctcgttgccgacgccgccgccgacgtcatcgcggccgaacacgactccgccgcgccgacgatgccgaccccgacctcgatgcggccgtcaccggcgacgacgtcgcgccggcagtgccgacaaagccgggccatgccacgcccgccgcgccacgacgccgagacaccacgacgccgccgcggcacgccaccgccgcgcaccgccgatgcccgccgccgccgccgcgccatgccgcagccgcgccgccacgccgccgctccactgccgccactccgccgctccgttgctgccacgtgaacgaacgaacgatcgtgaacgaacgaaacgtacgtgaatgtgaacgaacgaacgaacgtacgtgaacgtgaacgtgaacgaacgaacgtacgttaacgtgaacgtgaacgaacgaacgtacgttaacgaaggaaacatacatgaatgagaacgtgaacgaacaaacgtacgtgaacgtgaacctaacgtgaacgtgaacgaacgtgaacttaacgttgtacgtgaatgtacgtaaacgaacgaacgtgcgtgaacgaaaagtgaacttaacaagaacacgaacatgaacttaacgtacgttaacgtgaacgcacgtaaacgaacgaacgtaggtgaacgaaacgtgaacttcatgagaacgcgaacgtgaacgatcgtgaacgaaacatgaacttaacgagaacgcgaacatgaaatacaatatatgttactttgcgtttatcctaatacatctttttgtatgttgcagaaaagacgttgtcgtcaccatccctcaagccggagtggtagctagccctcaaaggaattcgcgcatgcaagtgatgtaaatatatgattgttagatttttaatgcaattaagactactagagttaatatacgacacttaaacttagcatatatgattatctagggttgtaatgtatgacacttagacaacttagcatatatgattacctagggtcctaatatacgacacttagacttagcatagtataagattattagatttgtaataagacttagcatataagattgtgtagggttctaatatacgacagttagacttagcatatatgaatatttgagttttaatataagattattagagttttaatacaagattatttgagttttaatataagattattagatttgtaattagacttagtatataattattgtctagggtcctaatatacgacacttagacttagcatagttgactattagagttttaatacaatattatttgagttttaatataaaattattaaagttttaacataagattattagatttgtaataagacttagcatataagattgtgtagggttctaatagacgacagttagacttagcatatttgacttagcatatatgattgttagcatataagattgttaaatcaaaaatgacctatagacttagcaactatttcttgtatgaacagatggttgatcgcgatgaggaacagataatgtacgatacaatcgcggatggaagcaaccagtactagaacgaagaagaggggaacgaggatccaaaccagtacttgaacgaggaagggaatgtggagagggatgcggaggggaaccaggaggggaacgtggagagggatgtggaatggaaccaggtagaggaggctagtggaagtcaaccctccgctggacagaagagggcacgtgggcaacgaggtgccgcgaagaagctagagggtcggcacatcataacgaaagtggacaaagacggctaacctagtgccccggcggaagcagccaagaactacgtacgacacagcggttgggttgtgcgggataacgtgcctgtcagtacgaacatgctaagtgtttcatatgtaatgtgtcacgaccggaaataacccaacgggcgttccttacgtgcgtgcattattccttgtcccaggaggcaaggtacaccaaaagttgatacaattcagagttcaacaagcggaagcgtaaatagttaattattacatgggcagcgaaggcccggcacacacaaagacaaacgagaaacagcggaagactagggcgacgaccacaggcgcttgacggcaggcacgagctagacaccaaaaccttcatcttccagagactcctcttctgggtttgggaaaaaattgagcaagactgagtacaacccccgtactcaacaagacacacccacaagtgcataataaatgcaagggagtacaagggaggtataacataaagggttaagggtgcagtaaacagcatttaaagatacttagttgctcaaagctattttgtaaacacgattctagaactatacaatattatttatcaaggccgtgaacccacacgaacctgccttaacccaaggcctacgatgattcagaccgaaccggcaacccgaccctgggtcccacctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacggatggaagacgtgacatagttcccaacccatcctagccataaacaagagtaccgacccaaccccacctacggccggaacccccgggacaggtaggcaggactgagcccccagcagcaggacaccggccctgtgccatgatatctcgactaccgggccgcagctcgtgtagccttcatttgtcctagagatgtccatcgacccccgacttcgtccatctccatccgtgtacttttgtttataaccagtctgagctacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggcggtgtgaatccaattccacaatactccaacaattccaaagtgtccaggtgatatgaatatcccaaagtctagagttataaaaccacctaatgttgcctaattaatcagcgaagcatctacctaaattcatactagtgggaccatgaatagagtacccactagttggggttttgtttatcctagggtgaacaaggtaataataaccataacaataataaggtcataacaaaggtaaataggcatggctagataaaacagtgataacgcgggaatttaaataaagcgataatgcaataattttaaagcaacataattttataaactgggattcaatatgttcaaggatgatgtgacttgccttgctcactttcccaaacgccggcttcaacttccacgaagagcggatcttccgaagctgcagcgtctacacgaccaacggaaaagaaaaggcttttacactaagaaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatggatttattgcgtcagccgaggggaggggcgcgcggaccgggtccactggggtggggcccacgcggcagccccacggcccacggtggaccgggcgcacccgggctcgcacctgccggcgccgtgggtcccacgcgtcagccgcacctaagggcgcgggcggctgacagccgggccccacacggcagccgcggggcgcgcccgaaggcggccacgccggcacagccgacgggaggcggcgcgcccgcgcccctatggtcgccggcggcggccataggtacggcggagcggcggccgagaaaggggagggaagggggaaacgaatcggcggtccacggctcaccccgggtcgacggcgacgacgggaacggcgaccggagcggagcaaagcggcggcgcggctcgggtggacggggtcgacggtgctccggcggtcggcgagcgaaacggaggggtggacgaggtcgccggggatgcggtgaagccgaaggtggcgacgccgatgcgggaggtggtccggggcgacgccggcggcggaccggagctcggcggtgacggcggagagagagagcgacggcgcgagctcgattccgacggggagacaggtcggcgagtggcgcaaccggtgaagggaggcacggggaaggtttatatagggttgggaggggaagagagcggccggacgagggggaaacgggcgcggaagatccgcccgccattgatggcgccggcgaggttaggggaggggtttccaaacgaatccgagggagagagagagggaaaaatggggggaaagagggagggaatcacggggaatatttcccccctcttgattgcacgcggggcggacgggggcggcgggattcgcggcggcggcggcggcgctagggcgcgggcggggcggcgggagcgacgggaggaaggggatgacgggtgggccccacctgtcagcgagggaggcgggcgggcccgcccgtcagcggcacgccacgggcaggaggccgaatgggccgcggggagaggagagggagggggagggagctggccggaccggcccaagagggagagagggagggaaagggaactttttagggtttttctttttataaaacctttttaactttgtttatttcttcttaattattatttgtgctctgaaaattccactaaaatttatttacgccttttaggcttttaggaaatatacaaaaatcctccaagccttatttgacttttaactttgcacattttaattgttggaggctttcacacggattttaattattctaggcataatttcgaggatgtattttagagtcgttttgggacgcgacataatgcatcccacgcacattgcagattccactgggtctttttactcttcgacctggaggcctgcaccgtcaacgtatatgactcaatcgataaagaagagtcgatgtttgacaaggtttttgaacttatagacaggtactgtcataagttcctatgttaattaagaatcttgttatatttaattactactacgaatcatagctttaaactccatgtagggcttggtatcggttccgtcatttggtccgcggcaaatggagagaaagacttaggcggaagttcaattttcctgtgagtacacatgctctacatttatattcaatctccaattcaaatacataaaagtgtatattaattagatctctcgccgtttgtcatttatttatagtgcgcaaagcaaaagcagggaactaacttgtgcggctactacgtgtgcgagtattgccactaccttgcagaccaaatcatcaccacaagagagctcgatgtacgtacaaataatatgaaaatttcattgcgtacgtatcgatttgttgtttaattactaattaatttcatacattcatatagtttattcgcatgagggataacctgatcacacacaaggaatttatcgcggcggttcaagaacaactcatgggattcatcaacgaacaaatccttgatcccaagggtgaattctactacgacggaaatacaattcataggtccttagcttctgagataacgactactactacgtcgaaatcgtagctagctaggacatcataatgaattggtattaatacatgtctatttttctatatgcatgtacacattttctttaatgtaaatatatattttgggcatatatatatatatatatatatataattctactacgacggaaatacaattcatagttccttagcttctgagataacgactactactacgtcgaaatcgtagctagctaggacatcataatggattgtaattaatacatgtctatttttctatatgcatgtacacattttctttaatgtaaatatatattttggtcatatatatatatatatatatatatatatatatatatatatatatatatatatatatatatatatatatatatatatatacacatatgcatttgcataacatatatatatatatatgtataaatacatatatattatgcatgtatatgtattgaaacatatatatgcatggtttttatatatatatatatatatatatatatatatataaaccatgcagcaacagggccatgcaaaaaaaaaaggtcagctcgatctttagtcctggattggtagtcccggtttgaaaaccgggattaaaggggggttacgaaccgggactacaaacgctttctccaccagtgtcccttaacaacaaaaccagaaatgtgtacccctaaactcactcaaaccgttcaaaggaggtcccatggcagtatatatgggtggttttcattgacgtggcatccaaatcagcaaaaaaaggggtccacattgtcggtgacatgggaccgggggtatcgtgactagaggcttgggcagccgcggtcacccacatggcctgaccccctcgggggggtcgggcccgagggtgacgtggccacccctccctctgtctccccgaggggtcgg

SEQ ID NO: 58668 - DNA, 7260 bp, Oryza sativa
aataaggccaagagctagtttgatctcgttgatttgcctcatctttgtgcagtttatgacttgttatattccatcgcaatggatgaatccgtggggaactatatgataaacttggcaaacatttatgagtttttcatctgaattgaatgtccgcacgattatattagcgaaaatgttcagtaagaactctatgaatgctgtagttagcattcgtgcttagagcatgaaaaatggtagttcgatcttgttgatttgcctcatattgcgcagttcatgacttatagggatggtttggtttgggggtctaaattagccttaccaatatttgacaattttaatagcgtttagtgtctatttggtttggagtcaaattttggcatgcctaagaaaataagtcatttaaatagttaatttaggctattttgacttcaatccaaacacaactttgccttaccaaaattatgcatgccaaaatttgctaaaatttagcattgacaaaaattggtaaggctaatttaggccacaaaacaaaccagcctatattgatgtggaaatctttaattgaaatggatgaatctgtgggaaagcagatgataaatttggcaaacatatataaattcatctgaatattgcaaggtagttagcatgcatgcttactagagcatgacaaaatggtagcaccaagaataaaattatttgcaacgaggtccgtcctcgccgccggcggccggtgagctcgaacacgcggtggccccggagctccggcagttttgtctgctccgacgagacgatctggccggtggagacgttcgggacgccgtggcgcctgtggccgaccaacgccggggttggaaaccggacgtagccggtgaggcggtgacgtcacccgttgaggcccaactaataatatgggccggaagttcgccacagcaccgtcccggcccaactagcattacgggcctcatatgggccaataccaaactacggcaggccgcaccgtcacggcccaactaataatacgggctggaagttccccacaacggcccaactagtattatgggccaagctccgctccggcccaatagctagcactccaggtcggagggagcagcgcgtccgtgtgttggcctcacgctcgctgcctctcctcttggcccggagctcacccacgcacgcagccgtctcgtctcccttcttctctctcctctcctctcttctccggcacaccacaccccaatcctcccccgatctccccaatccgagagctccggaggagcagcgcggaggcggagatggcgctgcggcgagcgctgctcagatctgccgagatctcccccgatcgcaaggtccgaatccccgcccttctccactctcctccttcccccccatctctctccggtctggatcccccaaccacgaggggcgcgaacgctgttaccgcctttgcgagaatctgagaggagtgcgcgtagcgggtttgagctgtgggagggtggaggagggtttgcaccagtcgatgtgtgttggtggtgcgcgcatggcgacgaatctcttcttcttccgggagtagaggataggtcgaggggagaggagtaaccgatgtagagcatggaatgccgatggacagttaggaggggctccatgtccgtctcttttgcatttcgtattagttctgtagggatttctggctgtaaagtgtttacgacttgatgcttaggatcgagtttcagtttgttgcggatgtggtttcttgttatgtcgtggatactcggagcatgccgtaaattgcttggataggccattcaaaatctcatttgtgaaaaccgaaaatgaccatgcagttgcagactagttactacctctttgtattcggtattgctgatgaaaacatgtgctacactcctttgcttgattgaaatagagaacaataattcaaaagctcgtttttgaactgaagatgaccattcagttacaggcttgttgctacctctttgtattcaatattgctgatgaaaacatgtgctgcactcctttacttgattgaaacgcgaaacgatctttactctttctactatattagtgtttccctgatgccccgagcggaataccagtattgtggttatcttatttcaatagattaaacaaacatggtgcatttatgaatatgctacattctgtagggatataaatgtgtttgatattggtatttcgtggcttctcctttgggtacaactaagaacacaacaaatgatacttcacctcaaagtgatactatcttttatgcctttcgtaggcttacttagtttttactttgcatataaaaccactactacaaataggaaaatcgtattgcagatactgaaaacctgtcctttatcaggacaggtatgctctatgctgcaatgagattatcaaaaacaccaacttgctgccaactgagcatttgatcttttctcttgttacttagatacttctaaaataatgctccaacattgtaggcacctgctgggcttatatataattcatgtttcacttatgggctgatatatttgaacttgatgtatttattttggtttctaaatctgcaaaattgttcccattctattcgttgatttaccatttacctgcagcagcaagtttgagttgaaagtagagatccttgtcaccatgttctaattactctattctagttcacttaactagttaaaaactgaaggcaagagcatcagaattctgtatttctgatcatttcttgatgttcatgttgttcttaattttgcttctttcaacacttgcttggatacttagtcagctttcaaatgaagattactttagtcttttgcttttgacaagtattggcgtattgtagtaaagtaactacaaacttttttttgtcctgaatcacatctcatggatcaagctgtgataacaaattggttttttttttcttgtcaggctgcacttgagtacctccattatctatcgagagcacagcctactcgttctctaacaggtgctggcctttattctgctggcaaatcattcagcactcaggctgctactacatcaagcacaccacaacctccaccaccacctccacctccggagaagactcactttggtgacctcaaagatgaggaccgcatttttaccaacctctatggtcagcatgaccctttcctgaaaggtgcaatgaagaggggtgactggcatagaaccaaggatttggtgcttaaaggggcagactggatagtgaatgaaatgaagaaatcgggacttcgagggcgtggaggtgcaggattcccttctgggcttaaatggtccttcatgccaaaggtatctgatggacgcccttcttatcttgttgttaatgctgatgagagtgagccaggaacttgcaaggacagagaaatcatgcgtcatgacccccacaagcttctggaaggctgtttgattgctggagttgggatgagggcatcggctgcttacatctacattagaggtgaatatgtgaatgagcgtctcaaccttttgaaagctcgggaggaagcatacgcagcaggtcttcttggtaagaatgcttgtggatctggttatgactttgatgtgcatatacattttggtgctggtgcctacatttgtggtgaagagactgccctactggaaagtctcgaaggcaagcaaggtaaaccaaggttgaagcctcctttccctgccaatgctggcctatatggctgccccacaactgtcacaaatgttgaaacagtggctgtgtctccaacaattctcaggcgtggtccagaatggtttgcaagctttggacgcaagaataactcgggaactaaactattctgtgtctcaggtcatgtgaacaaaccttgcactgtcgaggaggaaatgagcatacctcttaaggaattgattgaaaagcactgtggaggtgtgagaggaggatgggacaacctgcttgcaattattcctggtggttcatctgttcccttgttaccgaagcatatatgtgatgatgtgttgatggactatgatgcactcaaggctgtgcaatctggattgggtactgcagcagttattgtgatggacaagtccacagatgttgttgatgcaattgctaggctatcgtacttctacaagcatgagagttgtgggcagtgcacaccttgcagggagggaacagggtggctgtggatgatcatggagaggctcaaagtaggtaacgcgaagcttgaggagattgatatgcttcaggaggtcactaagcagattgaagggcatactatttgtgcccttggggatgctgctgcatggcctgtgcagggacttatcaggcacttcaggccagaactggaaaggagaatccgtgagcgagccgaaagggagctactggcagcttcggcttaggacactgtcaatgacgatcctgcactagtttcctgatttctttcacagaaataatgcaaactgatggagctcatctctgtatacgaaatgcagctcccctgatttgtttaaacctttatgtggatgtttatttaatgcactcagaagctggtgaattttgatggactgatgaaaacttttttaagtagaaacaaaatgcagttactgtaccatgtatgtcacatgagccagcaaaatatgatggtggatgtggacgtgtaccctgcttgtttttttttcactgttaaactatgcattgtttgaaattgtctagagttcgtgtgagctggttgaaaccatgtctacatctggggcctatgtttgcatctaatgagccagcataatctcatctgcatggcatattgttgatctgcatacttctatagggccaccggccctggcatgcatctgttcgtgattaaccaccggatgcttcatggtggttgggatatctacaaatgtattctggacctgtgtttattgtactgtttggtacagcacgtatccatcagctggtatgccgtgccgtatccagtagttgccaccgtcagatatctctggaatagttgggcttgccggttactgttcttccattttgtctccaggaatctgaatttgcaatggaacagttgagttgactgtgtccagaagatgtgtaataccaaactattttataatctctgttaagtaaaacatgagcattaagcaatgacaattcaactaaggcttgtttagattcaaactttttccttcaaactttcaacttttccatcacatcaaatgtttggacaacttttttatcacatcaaatgtttgtacacatgcatggagcattaaatgtggacaaaaaaaaaatcaattgcatagtttgcatgtaaatcgcgagacaaatcttttagtctaattatgccatgatttgataatatggtgctacattaaacatttgcaaatgacggattaattaggcttaatagattcgtctcgcagtttacaggcggaatctgtaatttgttttgttattagtctacgtttaatacttcaaatgtgtatccgtatacttcaacaaaattttggcacacgaactaaacacaacctaagcaaccaaagcttcggccactcatcacatatacgagtagaagatatgctgatttcagggtttaacactgagggtgtgtttagttcacgctaaaattggaagtttggatgaaattggaacgttctgacggaaaagttgaaagtttgtgtgtaggaaagttttgatgtgatataaaagttagaaatttgaaaaaaaagttgggaactgaaccaggcctgagagcctaagtcactactgcatctcacttccacttctcctttacggcaaacagctcactctctgtaagtagaaccagatgtaaggtagtaaccacaaaaaggggaagccaggccaaaatacattacttccacttcttggtcatacatcacatccttcaacctcattccaaatattagctgtatacacaattaaaagcaacccacaaagaccttttggcaccaacaaagattaaaaaaaaaccctgaaatttactcaatcagaatgtcatttagctgcccataatcccttttttgaacacttcttgtttatcttgactactctctgtctctggttgccgctttcttcatcagtttctttcttgtcctgtattgttacatcaactttaacgatgtgatgatcagatgttccttttgaggatatgaccgtgtaagatcctggcacgaacttgtagggagagtttggtgaggccagtatgtaatccacccttgtgccatacttgcatgtcccttgtacatctgaagttcataaaaagttcagatattcagtaaccactatacagcaacagcgagtaactgaaaaactaacaaagatcttgtgtttcataaggtagctgaaattggttgtgcaatgtgataaatgcaccttaggtcatcaatttttagaggaaatcatctaaaaatgaggagctgcagtccatcatatacatcataggttcagtaaagagcagattaactgaaatgaaactactttgttggccatatggtatctgaacaagctgagaaatgtaacctctcaccttgccctttagcaacaaccaccacagcctcacattctcctgcaaaatccttggcatcaacatactgcttccccttcaggtacttcatcacctccgccttcggcgtcggcttcccgatctcctcatagtactacaaaaccatcaaaattttgcacaattcctcaagttactcatcagtgttccagtttcagcgacacaaaaaaattcttgatacttgaacactgactgactgctgctaccttgacgatgtcggcccatcgctcgtcgcagtagtcggtgccgtcgagcgcattgagccctccggtgagaatgtgagggccatcgctggagcgcagtatggcgttcatttgcttcatcctccagctctcatcaaggtggtcgagatgtgtgcagtgtaagttgacctccccggctctcggaacctcaatggtggccctcagcacgttcctgcatgatttggaaaacaaaattaacgcttaataatcacgtggagggaccatggatgggaagcagaggcaagaggagttatgttcactgttcagatggccaggcacaatcagatatgttgctgtcatgaattcatggtgttttttttttttgctcccgttttataggctcatagctcgttgaaaggtgacggttttctgtttatgatagcaacatagagtgtaattgcagagcaaatttctctaag

SEQ ID NO: 58669 - DNA, 16970 bp, Oryza sativa
acttctaatattctttattttttttaattctgaatttctattttttttcttaattgtatttttatatggactctatactctacttctaatatttcttatttttaatttcgaatttcagttatttcctaattgtatttctatatggactgtgtactctacttctaatattccttatttttagttccaaatttcagttatttcctaattgtatttctatatggactctagtctcctcttctaatattccttattttttaattccgaatttcatctatttctaaattatatttctatatggactctgccttttctttttctccgattaatgtgagaatttctaggccatgggagcgaacgtggatgctcctttttctattcctttaataatataactggctgggtggcccgcacaattgtgcggctagcacccaaacaaaatcatatatattagtatgattttacttaaaatttattaaatagctatctcattgtattaagagtttgaaagaccaaaccttatcatccctgtgtttctaattatattgttttttaaaagtcacaccaattgctactcctcatgtcatctccttctttatttgcttgctcgatctaccactatttctattcattctccttataacctttaaaaattggatcttatagtttttagagtttattgttacgttgggtttcgtttttataatttctagacgtccagtcaaacgttgctattatactcttctatagcccgtccactgtctcttctctttattatcattgagattttaaaaatcgaacataattatcgtttgggttcatttttactttttagaagtcccgccaaaccgtcagcggctttgccattgtacttctctatggctcgtccgctgccactgttattgagattttaaaatcgaacattattatcattgtttttttttactttttacaagttctgaacctttaaaaattgaaccttgtagcttttagagtttatttgtcttgttgggtttcattttttataatttttagaagtctcgtcaaacgatgccactttgcttctctacggcccgtctgccgcctactctttattgtcattgcgattctaaaaccggacataactatcgttggaattcattttttattttctagaagtcccgtcaatcgtcggcggctctataactatactccaatacacaccgcctgctgcttctcctttttattgtcattgagattttaaaaatcgaatatgattatcaatggggtttatttttttttactttctagaagttccggtaatcgccttgctcgtttacttcacgaactatctgtcatcctccttttaatcgtcattaggattctatttagtgctttattaatagtttttatatgtcgtatcaaccgccaccactctactcttttataggcctgttacttaatttatcccgtcatatgttttagatgatcttttatttcaatagtctttatttttatcataaattttagttatttataaattgtattcctaattgaaatcttatttttctttttctaatttcaaaatttatttttttttcaaaatttaattaatatcgtattgtgttcttttaatatatttttttattttcaatttcagttgtttcaaaattgtattcctacttgaactctcttttagtttttctaattttggatattattttatttttattctaaattttaattaatctcgtattgggttcttatatgtattcttctttcaatattgcttatttttaaatacgaattttagctaaatttaaattgtattcctacttgaactcttctttttttttatagtttcggatattatttttattattattcccaattttaattaatctcgtattaggttcttatatggactcttcttttaatattccttattttaattccgaatttcagctattttaaaattgtattcctacttagactatcattttcttttttaattttggattttattttgaattttgattaatcttgtattgggttcttatatgaaaacttctttcaatattgcttattttcaattccgaatttcagctatttttaaattgtatttctacttggactctcctttttttttctaattttagatttttttatttttgttttgaattttgattaatcttgtattgggttcttatatggaaacttcttctaatatagcttatttttaattctaaatttcagctatttttagattgtatttctacttggactctcattttcttttttttctttttatccgattaatgtgggaatgtctaacccccacaacgaatgtggtgtgtcctttcaaagctgttttaataatataatagatagatagatagatagataaatagatagatagataaaaaaaagaagaacaagaagggaatagggcctcatctatgtcgctccctctccagggcgacatgggcggcgaccgaacaaacaccgccgccatctccttctttctcctcctaccttgccgctgcccaagcggcccaccagcaaagccgccggccacgagggcggtggcggggctctctctcccattgaaattttacgtgtggacttgcatgttgtgcataagcaaaatttaaccgaacatgtgtctagtgaatagtggtggagttctcacatcagcactgtaattccaatggaccgagtatgaatgaacccatggaatcgacctattaatcaagccgtcaagacgaaccaatcactcgttcaaaatctatggtgcataattagctttagtgtttgaaacattaaatatttcagaatgaatcatcatatggttttttgtagggaacatcatatgatttttgtatgaatcgaattttgttttgtttctatgactaatggaacaggggttttgcccttatgatcgtattgaaaaaaatgtacgaatcagcaaagacacacactacttgttcttaattgagtctggtgtgagaccgtatttgatattgctcacagggcttgttcgtatgaatgtgaaacactatgatacagacgtgacattgatttcaaaaagattatcatatattatacatactgtgtgccgtccatattatcatgtggtaaacgtacggctgctgcacggctgcacttccatctttcatgcactcatacatgagaaagaatgcataaagcttgagctttatgaccagccaaattagtcagaaacgtagactgttttaattgtcaactgtcgtaaggtcagagacacggcaacggcgaccaaccaaactctactcggctcctatgtgtgcaactagcatatgttcgacgttaggcaccaacttaaccataactttaccttcacctataaaatcaagatccagcaaaacattgtccaagatagctcaacatcatctaagaagcttttgaagattgaaagaaagccaatggcgacggcgagggtggtgttcttgctcctgtttctggtgcagatcgtcggcgtcctcgcagccgcggcgaggccgttggaggagaacggtgtcgatggcatcgcgacgcagatgctcgccgccgtgaaatcgaggggcaacaggcgcacacactgctgctgaaggcaaatgtgttgtaagacattgatgatgtacagcttagccattcttgactagtgcagagaaaagaaagcatagaagttgtgtgagggtgaccagtccagaggagagaaagcagagcagaagatgtgtgcggcaatgccaagttagtgcttcatttttttttgttgtaaaaagtgggatgatggatacatattcattctttatattattcttcaccttttcaccatagacacataaaaatatttggagattaatttggctgactattttttgtttcaaaaatcaatgtgttatatggtgtcgctaactcactatcagtttttttctcccttctttcttcttaattgattccacgcctatgtataactagaacgatagactttgtaaaaattgtactgagattttgaattagttttttctgttcgtttcaaaagaaagcttagcatttttttcccgaaaaccatggaggaaaacagaatactgtctcctaactagtagctaagttctcctagctagtagctaagttctctcacaattgttaagtttattttttctagttttaagcttgtgttgagcaaaagcactcatggatgtgggtggtgtgtactagtgtatatctgttaacaacagaattttgtttcgtatgaacaatatcttccatgataaattaaaagataaagcaagatctgtgtacaaagttggaccctatgtatagtgcggctttttaatggagactttgaaccataaaaaaacaaagtaaaaaaatcttagaaacataatatacatgcatgtttcattttaatgtatatatctaaatgataaatcatttattttgtttgatagagcaaacataaacaatatgagtaaatagattggtctgtacaaaataatcccatcagaaaaataaataatgattatgggttacaattaatcccaccttgataaaaaaacattatttatgatatattgttagtccgtgttaataagcattatagaggtaacaaacagcataaccatgtcagtgtctgatggttgaactagacatcttgcaaaatattatatttaacaacaaaaaatatgaattaaattataaatttcgtagtttagtaataagtttatgcaacaaagaaacttattagaatattaaaaaacggcataataacccatattttcaatccctacattttgtcacgacgttttattgtatagtggttcacttcaatatcttgtatctcatgctatagagagttttagcaaacatatagttcggaagaaagaacaatgtaagaatatgagctatcatgcagcaaaatatgttcaatggtctatctagcttgcattgcattgagagagagagagagagagagagagagtgtgtgtgtgtgtatatatatatatatatatatatatatatatatatatatataggaagcctatattctactcccaggagtagctactcctattgtaaccatcggacacctgtccaactcacatcagggtttcgggcttcaactcactaacggattgtgagaaaagatccattaaaccagcgatgcagaaacttgaatattctttttttttttgaaaattcggatcactgcgctgtgttctgcatggtgagtcattttgaatgttctgcatgcatggtttgttacccgcacgcatgcacgaccgagcgaccaagagagtagttagtgtggaggttgttgtattgatactctatttaagttgacggtgatggaggacagaaaatgaggaccacaattatctttcggatttgtgaggaagaagattttgttctgcaggtttttgatggagcagaaactctccggtggaaagggcagaatgtcgtcggcgaggtctgttgcgtcgccttccgcggcgcgagtaggcggaggctcgtcggcgcctgatgtcgagcagcagaagtcggtggcggccgtaggcgcgtcgtcgccggtgagtagtagcaagcaccatcatatggcgaaggcagaagatggaaccattacagttaatggtgacaagcagcagaatcctgccgcagataggtacacattgaagtttagttttagtttatgttctgttgaaattttttctcttgtttgtttgtttggctctaactggttattgcgttatttggtcatcaggaatggttttgtgcgttgcatggatactgctgcccggagtgaagtgatgaaccactctctccaaaaatatgtcattcatttcgatggatgtcatcctcttcccatgagaaatcctaggaagagatgcgcttggtgctcactccgtgatattcgcgcggcttgcgacatgaatttcagaagcaacgaaacaacccgggtcaacagtaatggttgcgaacatgtgtccaatgaaaatatgtagacaatagtgtgatgatcaggaaaattgtaataagggcttgctttctgcacggtcgtagattagtcgtacgaactgtctctaattttgtatggtattttctatgaggaaaaagcgagtagtatctaagtttagaaatctgtatcttctgctgtttgggaagtgaaataaaattgagatgttatcctttcatttatctatttaagttgtgtgtactgcaaactccctgttgtcatcgtgaatgcaatccttcaccaagatgaagttcttcgagcagaatattgtacaagaatggagcagagatttcgaattggtttctgtgagtgtagcgttgcgtactcggaatgtttgttatagatgctatttttgtggcggtatggtttcatcagaattcgttaatgttgctagtggctgactttccggagtccaataacatgcttcgcacgtaggagccttgattttcggggaggttgttgaacagctaatggaaaataaaccggaattatttgtcagtatatatccaaccagctggaaaaaatgacgccctatagcaaattctgtttgccaaaaggggtagctaccagaatccgtgctggacagaaacaatattcgcgaagatagctatggaggaagaaggctggccggagaaaggtggcgaggatcatagtggacaacccatggacgtagttccgttggaaaggtattttttatgtcagtgtgattgtagtgtacaatttccctttctgcattgttagctgaattctcatttttttgatcctaggatcgtggttgagggggaggaagatagtgatctgctgcctatttcactctctgacccagccattctgttgccgaaaattgggcagaccttcaatgaggactctgatggctatgcgttctacaatctgtacgctaggttcactggttttggtataaggagatccaagaacagatacaaagatggaggcgtgaagtccatgcaagagttctgctgcattcgcgaggtaaaaatctttagtgtattcttttttttttttttgaaaaccatggtttcgtattctcgtaagattggcaaggttctatagtgtgatgcgtaggatcatcatttcataggttttacgtagtaaggtgttcctgtaatttatgcagggtagagataattccgtcactggtccgccgaccaggataggctgcaaggctatggtcaggttaaatcgttcttctgaaagtcaaaagtggagagtttctgcattcgttagtgagcacaaccatgaaatgaaacgggacctgcagcatactaaacacttccggtctcataatttcattgatgaagggacaaagaggaacataaaggaaatggtagataatgggatgacacctacagctatgtatggattactttcaggtatgcacggcgggccatccttaaccccctttacaaggagggctgtgacaagaatggcgtatgccatcagaagggatgagtgtagcaatgatgtgcagaagacactgaatttttttagggaaatgcaatgccgtagtaagaatttcttttacaccatacagattgatggtgcttcaaggattaaaaatatattttggtgtcattctctttccagattaagttttgaccattttggggatgcaatcacttttgatactacatatcagactaataggtacaacatgccatttgggatttttgtcggtgtaaataaccattttcaaacagcaatttttggttgcgctttgttgagggaggagacaatcgaagcattcaagtggcttttccaaacatttactgatgcaatgcatgggaagaggcctgtagcaattttaacaggtatatgtttatttggatggatcagtggtgtgtttaatgatatgtcttctgtttttaatctcgaatggttgtgaacttcttttttagataactgtcatcaaatggaggtggcgatcaaagcggtttggcctgaaactattcatagagtttgcaaatggcatgttctgaagaatgctaaggagaacttggggaacatttacagtaaaagaagcagtttcaaacaggagttccaccgggtgttaaatgaaccccaaacagaggcagagtttgagaaggcatggtcagatttaatggagcagtacaatctcgagtctagcgtgtatttgcgcaggatgtgggacatgaagaaaaaatgggctccagcttacttcagggaattcttttttgctaggatgtcaaccacacaaagaagtgagagcatgaatcatgttctgaagaagtatgtaaaaccatcctcttcgctacatggatttgcaaagaggtatgagaatttctacaatgataggattgaagcggaagacgctgaggagcatgatacatacaatgtatgtttttttttaattatttccatatgatatatcggtgtatggtactttctgctgaacatgttataatatgcttgtcatttctcgtgaactgtaggagaaggtttccacattaactagctcgcccattgagaaacatgcttctcgggtgtacactaggggtgcattttccaggttcaaggaacagttcaagctaagcttttcatttatggtttatcatacttctgatcagcatgttctgcagctagtccatataggtgatgacacattgcaaagttggggcagcaaagaatttaaggttcaggttgacctgactgaacaagatctgtcatgtggatgcaagctttttgaacacttgggaattatatgctcccatattatcagagtaagtttgaatattaagcagttctcataacgctgttgtgtttttgtgtgttaatgcatagtgtttttgcaggttatggtacagtatggtttcacggaaataccgaagaagtatatcctgaagaggtggacaaaagatgctagagattcaatcccaaagcacttggaggagtcgtacttgaaggataaggaggcggcatcatcgagaacttatcggaacaccctcctgcacaagtctgcacttgatatggttagacttggtggtactagttcagaaacatatgagaagacagtggaagtgttgacaaagctgattggagaacttcaggtcatgtgtacttcgcaagttgtaaacaacaaggaaattcactacggagatagaacaattgggaagaaacctactggtgtgcaattggatgatagtgtagacagttctgactcggagcatggaatgtctgatgaattttgtgtagccgatgaggacggcattggacaggatgtttctgctggtgaggattcagttgatgtggacatgactgatgtcaacgaagaagacatactccctcctgaggttagaagaagtcgtggacgaccgaggagtaccagactgatgtcgaagggagagacatctagcaaagcaaagaagaagaaggctagtgagagtacctccaaggacgagtcgaagaatcacgccaaaggaaaaaaagagtcaacgaagcagattaggtactgcaagcaatgtggtggtcatggccactataagagtacatgtggtcggaaatctagttatgagaggaagaagtgagtgtaattattctgttcaatgttctgcagggttgatgttagcatttcgtttagcatacaatggaaattttattattattaaatttcgtcagcagaacatgtagttcattttgaatatttacatttggcaaacattgtaggaaatttgcgaacactagttttgtattttcctattttctgttgtgcctcagagtatgtggtgaagttgtagtctttggaagcatcctattggagcagaacatggctaattgtttctgctagaggtagtgttggacgaatcttcgtgggagccaaaaacgtttttcatcatgctctgcatcgggagcagaacatgaaaagagtgcgtgtggtgtttttttagatggggtttagcacggtagcagaacatggctagtagtttctgctgttgttctggtgggatgttttctcggcagcagtacatggctaatagtttctgctgttgtttggtgggatgtatcctcgtggtagcataaatcaattggcatactgttctgctctgggagcagaacttgtctttttttcgccgggcatgcactgatttggatcgtgtcatgatctgctctctaagtttggaggagagctgatcacgtaatgtacggcaacagaagatgtaattagtttgtagtatttaatttgccataggtgaacatcatggatttgatgttgggaaaatctaaatttatgatatttggaaggtaaatgacaaattcattaatttgggaagagaatagcagagaacatgaagccttgaaaaatgttgaataagaacaagacaaatattattgggacctaacaaattttagataataatgatgtaactgaatgtaatctttattttggcatgcttgcataacatgctcagatcttgttagataacttcaggcagtgaacgacgaagtccggcagaatagcttcgttgcctttgaatgacaataagttggacagaaattcctttcgaagatctcgttgatcctgttgttaatatagaaaaatatttattataaaaggaagctacttcaatgaaacttaagttgaacctagtgtgtacataaaactcacagattttggggggttcacaaggcgagttccatcccagtttcgcatgtagtagagcacgtgaaaggcacattccagcctaccaaaattgttattattgtaatgaccataaatgagtagaatggaaaaattaatttggatcaaattgggagcatgaactggaacctattgtttatagctgggatggccgaagggaactcagaaacccagtttggtatatcctcgtcccaatctggaaatgcaagcttcatgcactccttcagagcagatgaaatgtgaaattttgtttttaagtgtctttctgctgtatcctctgatcttttcgaggcgtctctcagtgggtcaagaatgcataattttttttctccatatcaaatgcgtatagagaatagtgcaatggttgaagtagtggaataaatatctgcaaattaatattgacattgcaaaagttagtggcctgaacatttgcacttgatgtactgaatttttcaagatgctgttaattatcaaaccaggtggcaactaggtacgtcatatggtatcagagagtcatctttgaatgaggggagatgatcctctgggttccactggtcatcaccagctgttgcaaacatctacagcgccatattgtgttaaaacacaccatatttcagaattaaaatagtctagagtaattggaagcacttactgcaaaatcttgatttaagaaatgtctccagcatacaaaatcagttcctccaaatctctgtatctcatccgctgctaatacttgaactgcaacattgaatgtttcttcttgcatttgagtgtctagccgaatagcctgttgtatgtcatgtaggcttaatgacatagggacaggttgggagatgtgaacccagattttcctgttaaatgtgatatctttacaattagtggtgaaagaaaggaacatttcaggtaggtggcttacattagagcttatgcataagcgattgaagttgtatatgtctataaatcatcaactgtttcagataggtggcttacttaagagcctctgcatcagtgagtgaaaccgcatatgtgtataaatcatcaagtgccttctggtcatgcctgacgaaagagtgttgcttgctcagaaatggtgatttcaccgaatggcttggtttaatcgacctctttggccgatcgaatcggatatcagaaggaccgccgataattctcctcttggatttatgtgggagctttgtacatgcgtactcctcacgcatgaaaatcctcgccccactcgtctctttcaacatagagtacggagagaaactactaagtttagtttgttggtcacctattatgagacacaacagtaagagtgagacatattatgcgcatgtggttggttatgaatgaaaatgaaaaactgatacaggcttgggggtatcattacctccatgcgaagagggagttttgtgcactgcattaccttatccggatttgtcagaggcatctactgactttgagattggctgatctggggtacgtgctaaaaagttgagttcttgttctttgtcagagtcttcagccacattggagatgtcatgacctggggtacatgccaccatgtttgcttcttcgatatcttgtgttattcctagattaaagcttgggggctcgatgtcagacctggcatcgtaggtacgatccacatggatagcctgtgtacagatatatcaacaattcttatggaaaaatggattctttttatattgaatagattgacaaactacatgagattgcacctctatcaaactccatctgtttcactagctctttttgctgatcaccaaaacctgagaatagatctgagagaatagcaggagtgcacctggtgtaaattttttcttgtactacctttttacccttgatgccacttgtttttttggaatttgatactgcagaaccaggtagctgcttccgctgatgcatctttcttgcttgagcagcatgaagggctctagtgaaaacagaactagagccaccaccacctgaaacattcgcacctgctgcaggactgcaaaggtgctgcaaatgcaaaaacataaacaaaacaaattagtaagagatacgatcaaaaaaagactcaaagattaggaaaaaaaatccatcaatggctgccgcgagcttcgacggcgccggtgttggggcgctcggcgtgcacgcggcacattggggcgctcctctccggcagcctgcagcctgacactgctataccgtaccaatgtcaggttggtgctgttcatcgtcgccatggccggcaccacattcactgcaaaataacagatgaatatggcaacaaaccttggaactggagttctccatgctagacctttcaatgttatctgcaacgcagccgccggcgaggctactaatctgagtttagatgggttaagaactctcaaaacgcaaagaacagttttagatcgataatgttctgctcgacgggataatcatcctgctttctcgctttggataagcaaactgaagagcgaaaaaaccaccctgaaatatatctggtcagctgtctccgaacaaaattctatctacaacaaactcaggaatcttgattcaattttcgaatctgctacagaacagaaacaatcttgttgaccccgagggaaaaaaatacgggtaaaagaaaacgggtaaaagtattcgattcaataaacccgttaatagtcattaccattatctgggcaaacgaattgaattggtggcggacagggagggagtagctactcccggtagtagtgatatatatatatatatatatatatatatatatatatatatatatatatatatatatatataaaacgacgcttaacacggtaaccagacccacccccactccacccattttgattatgatatttgactactacacgtcctcagtcccacgtgctgcgcaaccctcctccctctccccccacaccaccaatgcgtatccccatagtaccacacatattgattcgcgagttaaatctttactactacatagctcaccatacatactcatatttagtcagttaaattttatctaagtgttattcagcaactataataaacatcacgtttagtcatgtatatttttttttcaaattttttaggaatcattttgactcacattgaaacaaatcagttattttttaactgccatcgaaggtagtctcttttttttttcactccaactcatccgacactaagttattttttaactatgaacacaattaattgttaactacgagccattttttttaattttttccaggcacaatgtatacagcagcgatttttcagtcatttcaaactattgtagttatcgtctccccacttttttcggttagttttttttttctcgccggcgacagtgagcgcccttcttctctcgccgcctgtgcagcggaggtcgcccgcgccgccgcaagttccttccaggcggggataagcggctgcgaggtaacgtgctacacaacaccgccccaaaacattttcccctattggatggcgacttgggcgctccatcgactgctggatggcaccatgcggttgaggctgcgacacccccccccccccccccaaatggcaccgtcggctgcccctctgtcaccgacatccatcccatcgccggatctaggagagcttcgcccgaatcctcttttgattcttgcgtgtcggtggtgggtggagagcagcggtaccaacgacatttgaagcacagagggtggcaggattcggagaggaggctgcggatctggggtccgatgggtcgttctccctcctcccctaaagcggtggcgaagaatgtcagtaaattgtcgttgccgtcgtgcgcggcaggtcagcgccggcaaagaatacaggaggtccgtgtagcagctgtagtcaattgaaatctatttcaggtacagctcgttagttcctatcaactagtagcgttatatggtatcagtagtttttttatcagcctgtattggattgcaccgtcgttttgattttggatgagctatgtgcctgtgttggctgtggggatgcggttttgttaagattgggtagtaaccactgattaatgcctgccgacagaagggcatgcgtttctcaattggcggccaacgtgaacctttgtttcacaggcaacttcattcctagccaacgggatgaagttaatatatgtcaggtacctaacagaactaatctttctgatgttttgactgatctttgattcatgtcttttgtatccgtgtattgagtggacacatccaacctaaacacattagaagttgtttggtggatggcttcgcttggtgctataagtgtatatgtgatgattcatgcatgcagggctgttcttagcttctgaaaacaacagaagaactaggatgatctgtagatgtgcacatgtggcctagagtcagcttaggtgtcgcattctctgacaaacgattgctttggtaaaccaagactggtgttttttattagtactaatttggtttatttgattagttgtatatacaatcaattgtttcctgtaaataattttgactgaacgttacaattgaagttattctatgtcctccatggcattcagatggtaactgaaaatatatgatcgctggtaggactatgtgctttcaactctgtagcttgcagcagttctcttggtaaaaacgagccaaaaattctctaataagcttaatccacacgatcaacaattcataagcctcttatcaacgctttgccacttatccctgatatgtaccaccaaatgcccatttcgatttcccatgagcttgcacttgcattaatttttggcttttcagcctgcaaacatcaccatgtcctgtgcaatgctcagttgctcatagcctcatactatgagtcaatccactaaggcatgcctactcatagtgcatttatatatggcaaattttggtcttgcaggaacacaatgtaacccggtggactcgaagatgatgaaatgcatcatgcggtgacatgggaaacattgtcgctagcgccggaggtataactttcaacaatcactaataatgcacctctgttggttgttagtgcactaatcttttgaggcattactgattttatggtctgcatgtttaatagcggccatgcttgatcctgggctgcccatcctgattcctaatgctaccgccacacagtcctgttctacgctggttggttggcgagccagccgcctccactacaacattcgtccatcaaagatggatcccgtggagaagaggaggatctgctgatctgaatttctttgatgatttttgttggagtgtttatatcctttgtaatttttttacttttgagtttaagcatgtaatttgtttattgtatagtgtgtgtctgaatgtaacagaacccgtgtgtaaaagaaaatattgttaatatctgaccggcagtgatttatttactcacgggctgacatactgttgtagggtcaaaacaagtaattttttaactcaccgtgttaggctccaaagtaatttatttactcgcggtctaacagggacgaaataacaaggaatgatttttttactggaggaacggaaagaagaatcgaacgagagggagagaaaagcgggagtgggagcgtgcgccaaaataaaaaatttactcgtggctgtaggctccaaagtaatttttttactcgcggtctaacaggaaagaacggaataatagcagaaaaacttttactggaggaccgagaagaggggtggaacgagagggatgcggtgggattttttttccgggatcgggaaaaaacggaaaatccggaggccagcagtgatgagagtcgcgctactaactatcgtagcgccacacacgcgccatgtagcgctaccgtgtgtgattacatacatacatacatacatacatgcatatacatatatacatacatacatatacatatatacatacactggtggagaaaccatctttaatcggtcggccaaaatacacaatagtctcggttgcaataaaaaccgagactaaagatatctttagtcccggttcaaaaggatagagttttttttttatcttaccaaccgggactaaagatctacactaaccgggactaaagatctctattatctttagtcccggttagtgttaccaaccgggactaaagatagatctttagtcccggttggtaacaccaaccggaataaaagatcggcatgcgcaacatgggcggcgaagagtacgagaccaaatcgaggaggaggaggagcagttaatatattctatctcctc

SEQ ID NO: 58670 - DNA, 1956 bp, Oryza sativa
  unsure (1)..(1956): unsure at all n locations
ctagaggatcccccacttaactaagtctgaaaatagctagcataccacttagtctactttgcaccttcactaaaattagaccataattcctttagtaaaactctttgatcagcatgttaaacataatgcactctaccactatatgaaattacttaatctaattcaaaatataaccacatgaaatgacatatataagttaaacagtacatagagatgcaattttttttatttttatttcatttttttgatatttttttcacacttaggagaacataggaaccaaccgtataaaaaataaactcaaacggataaaatatgtgacttgtagaattttccaaaactctaccgaaacggacaaaatatgttatctattaaaataggcgtaactttctcatacgcactcagaatcaggcaaataatatatgcacggacatctacagaaaatgttacatccgattcttcccagctttgctgggttcggcgatattaaaacctccaaattccgcttgcaagattgtgttttcgaggagagaagtttttcggtagaactttggaaaattccacatgccacatatttcgtccgtttgagtttattttttacatggttgattcctgtgagttcctaagtgtgaaaaaaatatcaaaaaaataaaataaaaataaaaaagttgcacatctctcctttgcactagttcggagagagaggagaggagaggaaaaattctacaggtcacatattacgtccatttgagttcaatttttctatggttggtttttgtgtgtccctaagcgtgaaaaaaatatcaaacaaataaaacaaaaataaaaaatttcggggggggggggcgccagccactctggcgcactccctagccacctcagcatcgccccgccacatcggcaaggggacggcgccagagaggctggcgccatcctgttggacgacggcgccagccactctggcgtcccaaaaaggaccatttttgggataagtttttctaggggtctatttgcgaaataagtttttcaaaaggaccaaaatgtgaaaaatccacagtgtagtaccaagatggttttcagttttcacctgaggggtgatccatgtgacagacgtacagtagttgtagtacctttgcaggtgttctgaaccagtattctccattatagtgccataattgacaatcggtacatgataatcggtaatgccgtgcagagtgttttttttttctgaaccagtattctctatgtcctaccatgtgtactcctaatttgtccaatacaactatactgcatttttactgctacatatctgcaatctgttagcaatccaaagtcccagagcttcagagagaggggggagttggaaggaaacctgatgcaggatagcagtagcaccaatggtcagaataagagcagacaagctttatatcatcctaacccaaggaccactattgatctaaccgtaaagacaaaacaatgacaaaatgacaagagaaaaattagagctttgtggtagagaccatgtgcttgagttccccagatgagcaggtttcaacactggctgggttcttgcgtcgtttgtgtagtactccctccatttcacaatgtaaatcattctagcatttcctatatttatattgatgttaatgaatctaggcatatatatttatctagattcattgacatcaatatgaatgtgagaaatgctagagtggcttatattgtgaaacaaaggaagtactataatagtggaaaatgctagaatgacttacattgtacagcggaggaagcactataattctggttgctttgtccgatgcgagtgtcaatcaaagcgcgcgggggggggggggggggaggtncataataaggagggagaggganttgattagcggcgccgtgagacacgggtgagacaggacnncataagggtcatcgaggagggagaagaacggg

SEQ ID NO: 58671 - DNA, 2523 bp, Oryza sativa
  unsure (1)..(2523): unsure at all n locations
ccatgcgtaaagacaggtttcctaaggtatatgccaacctgctcaagtgtttgtccttggctgttgttgatagtcattgcataacaaactcgaactgggaattgtctcctttgtaatgcaaaaggccatttcattttcgatgtgcttagtgtaattcttagtatataaactgtttcaccgatgtttgatccagttagtatagtacattgtaaaattgtttcgcctaaagcaataagtaatagtcttgttccattacaaaggcctattgattggttcaaatttcgtagaagcataacaacactaccttcctttaaaacaagtttgtgtgtaggaaagttagttgctacacctcctagagtctgtgtaggatcaaatgcacaagccacagtatgcatgcatgtttggctacttttgctataagacgtttagaaacactaaaaaccaaattttgggacgcagtaacctcttttcatcatattgcctcatgttaaaatactactgctattatcaaacagagaagaactgtaatatattagtagtttaactctcaaatatatttgtaaaaaaatattacattacacaatgcaaagcaaagtctttgaaaactaaggtcccaactcccaacaatttgctgggtcttcacttttgaggaagacctgtaacatacaaaatactctaagcagggacatacattaagcctaatgcatcagaaaatgttcctttacagtgcactgaacctccctttggtctgacgattaaatcattgtacaaccaatcgtactgtttatacactataagatgtaacaaagctgaacagaaccctatgtatatacaaagcatgagcatcatgaataaataggcatatatgatgaaattgtgggagcatgttctggaaaaacctcacatcatacagctagtataaataaaatatcagcagccaagctccaatattctagaatcattgaatactaatagcacaatacaaaaatcatatcatgcagtaggcatgtttaatgtgaagtaatcaatatcgcactaaagcaaaaaaaaaatgtagtcacagatacccctgaatatagatataagaggtggcttaaaataattgcgtgcaataataatcatggatttgacttaacatcttgcagaatatcataaaaaaagaactaaacttgcaaaaaaggcaaaaaaagacttaatagtttaaaggcacactacccaatttgcagaactatcaagccgcttcaacagtttaacaactgcagcactaatatatcacttacataacagcaaaactgccctgctgaaagctcagaatgagatatgtcactccgaagcaacaacagaaaaagaatgttaaaaggagtttatatataaaaacaaatgcctaattaaagtgcaaaattagtccatttggaagccttcacagcaaactgaatttctgtcaactcgctgaataaatatcttgcactatataaaatagatatattttgtttcaaaagggaaaatatgtcttgcaaggaaccctggcactctcccactctcctagccatcatataaactccatcatacatgagtatattttccatgttccaaatcactgggtgtttatttagatctcaatttaatttgtgaaaagcgagaacaggcaagaagcaaaacttttgctttgaggtcgcagtgcgcggattgattacttgtattttttttaccagagataaacaatatttaataatagaggttatatctttaaaacttcatatggcaagcttgtcttaaagataattactaacttttcccaaaaaaaaaatcagaggtaatgtgcaaaagttgtgcagccatgtaggattaaaacgccaaatgcatattttacaaactatcgaatgatagttttaattttactctagataaagggaggtagagttagaatctagaagcatgcagagctagaagcaggacaaaacgaggcatcaatagcaaacatatttagatggaaagaggaagttttacaataatagctccaaagcaagaaaagatgacatctggaagaacaaagcaaaaacctagctgactttgatagaaaacatgaggcagaggaaagcaacattcttatgggcagcaagggacaaaatattaggaaagagagtatgcaagaagtgtatgcactgtgcaacggctacaaaaggtactgcagtgaccattatgactgcaatggcttacgaaaccgagaacacgcatgtaccaagcgctaagtgtcacaggtaagctatcaatatagtaacaaacaaagcaccataaatgcacaatatcaaaaagaagcagaaaatagtgcaaaatagtaatcaataaaccgaaaaggaaatattgaaacatagtacaagacagatgggaatnnnnnntggtaggtacgagaggacacaatgtgggggggggttaaggttaacacaaagaggtgtaagataagagacccaattagcctttaaggcgctagtcacacaattcacatgaacaacagagacgcattga

SEQ ID NO: 58672 - DNA, 34476 bp, Oryza sativa
  unsure (1)..(34476): unsure at all n locations
gtttgcccgcaggaaggagacgagcgcgtcttcctatttgccgtccagaagaccaccgatccgtgtggtcttggacgggccgtcgcccagggcaacctccttgaccgggacctcgtcgcctgtgatcatccgctgcctcggggtggcgggggcggaggcgccaagcctctcgtcgccaccctcgggcttggacgcagcgacgaggtggtccgcgcgctgctccagacaagcgagcgcgactttgaggtcgccatggacagagatggggccaccggggcccggcatcttcatctgtaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccggtaggtcgatgtgacctaacggccacgtgtgccccggcgtcacaccgataattggctgggacggccggagcaccatccccggggccttgatggcgtcaaaggccgcaggggaaaggatgttgagggccgctcccccatcaatgaggatacgccccaacttcacgttgcaaacggtgggagaaaccaccatcgcaatctgccctccccgggcaacgcacggtgggtggtcggtctggtcgaaggtgagggcaacctccgaccaccgcgcccgacacgtcgcctcatgagtaggggccgcggccagaagctctcgcttcatggccttgaagctccggcgagaaacgtgagcacacgctcccccatcgacggtggcaatggtggccccaggctcttggaaacctaggtcatcatcgccgtcatcgatgtcctcggcgggggccttctgcttggcctcacttcgccgattaccggaaggaaacgccggggatttgccctctcggcgctcctgcctcctctcctcctcccacttcctcgtccgctcagccaaacttttgactgcacggcagtccgcgaggtcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtaaatcaccgcgtgtgcagggatgcatggtatggtgttgcggacttgacagaaccgctgaatgtacgagcgaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgaggtgacactccggacgaggaggcgccctccgttgcgtggggagcacgtcggccattacgccggcgctcgatactgatgcgggcatccggttccccacgcagatcttcccgggtcggaggcgttgacgaaggagtggcggccgaatggcgaacagcggctgccgctcgccgcgccctccgtcttgacgacgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtgggcgtcgaagtcgcggatccttcggccctctcgagcgccttctcccgcctaggactttggcgtggagggggcggtggagtacgagctcgacggcgtgggtttggctccccgtcgtcaccgctcatactcggggagaggtcgtgcgcctttgccggctcggccattgggctgaacaggaaaagcttggcgcacacgaaagagtgcgagagctcagaaaatccctcgcagagccccctacctggcgcgccagatgacggagcgtggggctcctcaccgggagaccgcgtaggcccccctttgccggttcggccggggactcagggtgagattctaagctctctatatgtggaaggttcgcgagacaggaaacacacaagacacgggcgatgtatacaggttcgggccgctgagaagcgtaataccctactcctgtgttttgggagatctgtgtatgaaggagctacaaagtatgagccagccgctcccttgttctgggttccctatctggaaaaatcagtcccctctctcagtgggctaggtcctccttttatatcttaaggggataccacatgcaccatttctctcttttttgtggggacttaccctaccttttcataaatggacggagatttgtatagttgccgtccgagtcatcttctgatgagacgacccacaactacctccactttcgccgggagcaggtgcgacgtggaatcgtggctgtctgctgacgacatgaccggtgtcagacccgtcacgtcggtcattcttgtgcaccacgtgtcagcttagcaatctacatgttcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcatagaccggataaacgagtgcactgcactgtgttacatgcggcgtgacacgctcaacccatccctattccagaaggcaggtaagcncanctgtgctcacctaacccatacacgcggagcaaaaacccacgaggggtcggggtgcctcggccctcggggccgaggcgggtgcggcccgaccccctcggggggactaagaggagggcgaacacatcaccctcgggcccgatgtccctcgggggtgccaggccacgtgtgcgattgtgtctgcctcaaacctctagtcatgatactcctgatctcatgttaccgacacttatgcacaagtgaatcaatgccgattcataccctccccgcctcgatcgcagccccacgatgacgggcctcgtagtacgcctccaaggctgggtaagtcggcggttgtccctcctcagccatcctatatgaaaaagtaataaattcaccgttagttaccaatgtgacatatattaaaagaaaatgaatgcaagaacatgagtaggacaactatgttccttacctacccgtgatatcctccacgtaccactagacctcttagttgcatggaccttccatttgcaccgtgggttttcacatttaacagtgtacctcctatttgcggcagaattgacaacacggtatggacgatggtgcacgatggcgtactcctggagccatagcttcaatgcgaccatggatgggaactctaaaccctttctgagaccatccacctggaatggttctggcaactgatctaggttgatgccgccatctagtagtgcaccatgggcatgtgttaggtccctaaactcaggaatgtccggctttctcctaaacaccttctcaaacgcacgacattcctctaatgctaacttgtcattattagtaagtggagggaatggacggtcatcatcagagtcttcagcaaattcaacatcatattgctcaacacttgcctcctcgtcaacatcatctctattgacttctactgagacagaatcgtgaccaccactcaattcgacatcaaagtaatcatctgtattcatatattggcctgctacttctgtcgggtattcagggttgactccgtacgacgaccaatgaacactcgccgacaaatgttcacttagatcaagcccctcttgtactaactcccttttcatcaccctcgctgcatccacatcatcagtaccgcaatgtctctttgatggtcctgcctcccataaatcatttccaagcaaaggtctcttcttctctccttccccctccaagtcttctcgtaccaactcagtcttacttgcaccccctccacgacgagaataatgtcacaaaattcttctcaacgtaatgataagaaggagatttgtttagatccaaattttctacggtacgaactaactttgatgcaaacacctctagagatctaaactgagactcttttaccaaatcaaagtaaacttcccattccaactgacctatcacatttaatatatacttatgcccttgaccaacatcgtatctcccataaaaacgaatctccacattatcctcggtccatccaagaacttctttcactcgtgactttagttcatctagagttgggtgggtgggaaacaaaatggtcttcaatgacatatcctcaaactcacatgtgcaccaacataaggttccaccactctaccaccgtagtaaacacgaacaagtctatccatctacaccaaaaaatcaaatgtaactttgcaacaaaattaaatcttcattcctaaacgtagtccaaaccgacatattataaccaatgcacaacttaaattgtcccaaagctactactccaaaaaaatatttaatccacctacaactatcaataagtttactagtgcattacacatcgaaatattacaaatactccgtcatacaacccaaacctccgtcatgcctcaaccataatttttcatccatccatccaaccaaaccatccaaaaattaacattaccacatatatggttaaaaaaatcatgacaccaatgagtacattgcaaacatgtagcactacaacaagccaatcctaagaacaaatgctaaaaatcataaatttgggtaaaaaaggggttctagggttacccaccgatctacaaattcaaccaataaaaacgaaaaaaaaagaggggggaatgaaggagtctacctttctcttcgatttccacaaaaaatcccgcgaaaaacggctttaaattgagtggatttgaggtggagaggtgagggggagagagaggggaagaactcctgcgctgctgctcgggctgggacttggcgaaaatgggagtggggaggagaaaggtggtggggcccacggggtttaagggtcggcccacagaggaggggcgcgccagccgtgctggcgccgtggtatgaggggcggcgccagtgtggctggcgcccccattctgcccagtcagcacctccacgacagccctagtgccacggtggcacgggcacggcgccagtgtggctggcgccgccatgttggggtacggcgccagccactctggcaccccaaaaaggaccatttccggtttaagttttcccaggagtctatttgtaaaataagttttcaaaaaggaccaaattgtaaaaattttagattccaacacagcaatgtaaaagtccaagcattggcttttattctagatgagaaaacgaatggcgtgttaagagatgttttgtcttgataacaactcctgttaatgttgtcgacatatttagtcaatcgatggcttagtttcctattcgtagaggtcgcagttgtaattggcgctttcatgactagaaacaggccggcgccgcgacgaaggttctaatttgatttctgacccttttttttctgatcgaaacgccgttgatcgatcactttgctttatctgaccacgcgcacgacctgcacggcaaagctcctgcctatagctgtttattattccctgtgtgtcgagttccagtccaaacacgcgagcgagaaaattcccttgctctgactcgtggcaaggaattcacgagtgtcgatgatcatttcgttgtcacggcgtacgttaatctggaagagaataccgtaactctgtaagagacgagagtacatgctacgggagtgtttgagagcagaggaaaaggtgagatcgagaaagatatgtaaaacgagctaatctattagcatatgaataatagagtattagtgtataattaatagagtagtttgaaaagcgtgcacgtgaaaaacgacttactaccgaacgcagccccggcaggtactccaaagtatcagtagcatgtatacatcgcctgaccgaccaccgccgtgtaatgactactgtaatgaattgaggcacagttagcaaaagagctcaatatatacatcgggtatggacggagacgtggtacgtactgtatacaagttataagactgcttgtgcgcaaaacgccatggctggcagttaaggccgtgcagctcccgcggagatggccagcaaaaacgcgcgttgacacgcagcagcagcagaagcaggaggaggtacgtacgctgatggggggtggtgaatgatggtcccgatcgatcgaggcgaggcggacatgcgtaaatccgccccgattccccgtgatcgtatcgcgcggcggatacgtagtacggtgcagtgcaggtggcggcgaaagcgacccgaattcagcgtggcggatgccggatgggacatcgcgcgcagtgcatatacggctgaattgtttcgcgttgacatgcagatgcaggtgatcgatgcggtgcgacttcgtcgtcgagatcgatcggtgtgggcttgggcttgtcggttcgatcgctttgcatcatgctgtaccccaaccagggttcccttttaccattttcggtgcgacaccgtggtaacccgaaaactgcatgataaccacgagacataactgattttaaaaactaaaaagatcacaatacatgataaccacgataatcatatgataaccacgtggttttgtaaacctgacaccaactggaagcttaagtaactaatttggatcgcaccccgattccggccgagtccgattgatatggtccagagagagacgccgccgtgcgagcgtgaccaccaccactgcatgcgtcgcatgattggtgcgtggttccgtcgaaaatgtcagcagaggaatgctcgccgagatccaacttctcacaagcagagcaaccctcctccatgctgtgttgaccgtcgagtcgatatatagtacacacaagaaaatgttcggatcccttgtggtttcgatcgttttcaccacttgctttctgtgagactgtgacggcggcaatcctgttcttttgagatcttttacattgctccaactaaattgcctccatgaggtaagagcccataataaatcctaactgttcaatactagttatatgttaattgacgttttggacaagattaagattaaacttttacaactttgaccatcaataactttaaaaatatttagtttaaagaaactagaaaaaacatatatagatttgtctttcaaaacactataataaaagtaaacatgtatttatttattgtatatattataatagaaaattaattaaggttaaagttatatcttgtagagcgtgtcattgtccaaagcgtcaattaaaatgaaaccgaagggagtaaacatcttttttatctaataaaatatactgtctccttattaataaatcggagctactccaacaatcattgtccttcctaattaatcacccatgacccattcatccgtaacctagctaccaaaaatcaaggaagaaccaaacattctgagtttccatattccaaatatctaagtgaaaacagagaaaaactatattgttagaactaaatataaatgtaaaaataagttttctaaattggcagtgtattctaaagcctcaaactgaggctatgtgaagcataacctgtatctattttaaagtttttgaacctgttttttaaaaaaacaactgaaactttgtttttcaaattataatttggatactcaaatttcaatttgaaatcggaacatgtcttttatatttaatattatttcgaattttatattcagttaaataaatattaagatattccttattaggctgtaataattatctttaataaaatttgcatggcaataaattatgtctcctatgaggtataagaccaatattagccatgggatcatggaacaatggacgatgcatagtaaattggtgtaggataaaaaagtccgtttgttttttgttgcactcatgcggttgcttataagcttattaacatcatataatcccaggtgctttcgagaagaaaaaaacatcatataaatcccaggtgaggtaaggttacgtgtgtggtggtttgtaatgtagcgttttcaccttgcgagaggttgcagtgtgatgcaacacaaatatatatttttaaaacattttctggcaagtgtgctgctcaggaaatcttctcttttctccatcccgtgctgccgtgcaacgtatgtcaacggacggtgtcaagacaaagattaattagattatgacatgcccatacccgataccaagaggcactcgcttgacctctttaatcgacttgtcttttctcacttgtcctatactgcaatttacgcaagatggaaggtcgttgtaacgtccattgtacttgattttcagtgctgtttgcagaaagccgggtcgataaaatggctgatttctctcttaaggataaaaagaagctagtaaatactatataatggaaaggaatcgatgttaattttgttacagtataagaggacggtaagcaaatgttctgaagagtcgaacgcgagactgccatttgcaccgtgcgcggtctcttgatctctctttttcatgtcgttaatttcgtcaatagattatgacacccgtgccatttcagcgttgacagctgccgacatgtgccatttggttgtaccagtttaatttcgcagctggttggcagctgtaaattttgctgtcaccataaagtccaaccgaataactgatcgaaactacaatatggagacatctcacatcctcttgtagaggggtagaaatgcacggccaactcagaacatccgtgcagcctcaacgagaggcgccgctgctgcaccggagagaattcagtagtgtgtggttttgttgcatttaactactccaaagactaatcctctcttgcatgcaattagtacaattaagtcaatagtgattcaggcaacagctagctagcagatataaagacggttctctgttcttggctgttttcttccaaccgtctcatcccgctgttatgctaatccaggaatagaccgaaattaattaaggcagtaatcacccagatgtgaaaaagaaaccaactgttccaacttccaagtggtctgttttggatcgaacagtgattggatcatgagctatgaccctttgaaaacttaatcattaaaaataattaaaaaagaaaaaaaacacaagtgtcaaggaattcagatttggcgcctcttttcatcgccatctttgaccgcgcaaacgccgtcgttcgcgaactcccccctcttaaagcccccaaccccctcgtctcgccactcgccacgacgcgacgcgacgcgacacgggagcaagcagcgcgcgcgcgctactccgaaccgaaggcccacgcggcgccatgctgctgggtgccatgagcggcggcggcgtcgtcgtcgccgtcgccgtcgcctacgccgccctggccgtggtggcgctgcggatggcgctgtcgtacaagtcggcgctgtacgcggtgcggcggctgtggcggtgggccgacgagtgggcgcaggcgtaccagtaccacgaggtgccacgcttcgcgtgcgacggcggcggcgccgagaacccgctgttccgcaaggcggcgcagtacgtggcggtgctgccgtcgctcgaggacgccgacgccgcctccgtgctgtcgtccgcgtcgaggaccaacggcggcttctccctgcagcttgggccaggccacaccgcgcgcgacgccttcctcggcgcgcgcctcgcgtggacaaaccggggcgacgtgctggttctgcgcgtgcgccgccatgaccggacgcgcgtgctgcggccctacctgcagcacgtcgagtccgttgccgatgagatggagctccggcgacgcgagctgcggctgttcgccaacaccggcgtggacgggagcaccgggacgccgaggtgggcgtcggcgccgttcacccacccggcgacgcttgacacggtggccatggaccccgacctcaaggctcgcgtccgcgccgacctcgagaacttcctcaagggccgcgcctactaccaccgcctcgggcgggtgtggcgccggagctacctcctctacggcccgctgggcaccggcaagtcgaccttcgcggcggccatggctcggttcttgggctacgacatctacgacgtcgatctctcccgcgccggcagcgacgacctccgcgcgctgctcctgcacaccaccccgcggtccctcatcctcgtggaggacctcgaccggttcctccagggcggcggggccggggacgcggaggcgagggcggcgagggtgctgagcttcatggacggcgtcgcgtcgtgctgtggcgaggagcgggtgatggtgttcacgatgcgcggcggcaaggagggcgtggacgcggcggtggtgcggccggggaggctggacgtgcacatccacttcacgctctgcgacttcgaggcgttcaaggcgctggccagcaactacctcggcctcaaggaccacaagctgtacccgcaggtggaggagagcttccatggcggcgcgcgcctcagccccgccgagctcggcgagatcatgctcgccaaccgctcgtcgccgagccgcgcgctgcgcaacgtcatcacgaagctccagcacgtgtccggggcggcggcggcgccgcggccgccgcacaggcggaacacgagctggtccggcgcgggcgggccatgggaggagcaggccgcgcgcgccagcgcggacgcggcggacggcggcgaggaggcgatcacggcgacggcggcgtgcggggtgttcgcgaaggacgcgccgatgagggagttcaagaagctgtacgggctgatcaagatcaggagccggaaggagggctccagcgggttcatgcccttgcacggcggcgaagcgccgtcgccggcaaacgggcggggcagcgagcacgacaaggagcggtgattaattaggcgatggtagtagaccccgtcaaacaagaaaaatatttttgattttttgtccgtgcttttttacttcgtgttaggctagtaggagtactacgtagttgtagttagttcactttttaattgtggatggaagaaatcaaacacgaaatggaggatgataatgggattgggtgatgtacaattgtacatgaggattgtttggttttaacagggtataaaacaaaagagatgggcaagttgaaattcttgaaaattgcatgtgaaatatgtctagttggaatgcaaactcccaactcccaaagtgctcgcaatcgcggcacccgcgcggctccggcgtagtcagctctgtcctggcgcgcgggagacagcgactcgtcgtcggcgtccagccagggcgagcggcagcagctatcatggagtgcgtgccatttgaaattaggccctctttatttcccaaaacaaaaattttcatgctgtcatatcgaatatttggacacatatatgtagtattaaatatagacgaaaaaaaataattacacagattatatgtaaattgtgagatgaatcttttaaacctaattacgtcatgatttgataatgtgggactatagtaaacatttgctaatgacagattaattaggtttaataaattcattttcctggcggaatctgtaatttgctttgttttaatgcttcaaatgtatatccatatatccgatgtgataattaaaaccaaaaattttcctcaaccaaaaaatagtgcgtctccagccaagccaaccaagccagcgccctgctgctatagcttacaaggtgatagctgcggctgcgggcaacgctatgtcgctcgccaaccaggtccaggtcgggggatgatgggtgggcgtcccactactgcacctgctaaacactattgtgccaatcttggccagcttgttgcttgttaggcacaggcgccgccgtttatatgatgagaccttttatagtgtttgcatttctaaaatggcatagatctaatggctcataataaaagataccttatgaaaggtatcagagatagaaaggtactaaggattaaaaggtaattgataatagggcaattatgtttaacaacgtatggacgtaccgaaaggtacggtgtaagtggatttgaaggtaccacaaggtaccgcgcaagtagtttttaaaggcaacgtaaaatatgatttatgtggtggggacaaaaattacattctcttctattcggtttccaatcttcggcgttctgtttgcgtcggtttccaaactttggtccgatttacgtggtacatatcatattcgcatgatcttgataattatttccaattagtcattaatttacatagcaatttggtgatccatcgtttgatgaatgtaatcaaagatcaaaaggacaacaaaatgagaagatttacgcacctaacaagaacaaaacaagttcaatgagaaagatttgcgaaaaaaactaaaccaatcgtctgacagatcgagaccgtgcggccgcttctagctccggcgaacataggcagtcctggaccacttcctccgggtcctcttcttccgccgcccctccctccaaccaccgcctccggccacacgtccaccgccggccctcaattctccacctttcaacttatcaaagaacacgtaaaccttacatacgaacagaacgtatctaagaacgatgcaacgcaacaggctacgagctaattccttcgataccttctcataccttttcatatgtgtaaaagacacatttgtcattctaatatcatcatatttacattaatgccacctattacaatattttctttccataccttgcccctcgcagatcaacggctcacgtcgccccacctccttgtacctcgcaaacatcgtaaaatccctcttatatgatagggaaagaaattcacttcctattggcggcgattgaattgtttcttaggagtactaaattcttgagaaatttctacttacattcaaaacggcattactctctctctctctctctctctctgaataggagtattaggagtaggacagtaggagtactgatgaatgcgaatcatgcctggctcgatgctggactgatgatgatgagtttaggtgtcgggttgaaagacaatgatagccgctaattgccgctggcctgtacaattccctgttttgattacgagatctctttgtattattgtgcggctgacaggaagatcgatgcacgagtgtatggtccttctgcctttgggttcttggctaccatttgtttcgcttcattcttcctacggagatcacgcgtgtcagcacagctgttccagctcgcgctcgggaggttttcgtctggtgatctggaaagctcactgcctaattgatgtactcgcagttttcctttttctttttctaatgcattttaagggacatatcgcgtatggtccttcgtaatggatcaaatgctaatgctagaagtagcaggagtactggagtagtaaatcacagcaacatgaggtatgctactacagtaaaaaaacattaagagagtgctccaatataatgatttcttaaaataaatttatttttgaataaatgtgagttaaaactgaacttcaacaagcgaactccaatgttgggctttggggaaccttaccatgatgtggaaacactgaaacagaggtcctgtcagtgcaaactggacaatcgcaagaggctttttccccggttataccggaggagccacccggtggccatatggatttcctggcagtagttaccatgcagtcctagtagctacggagtactgcatttgatctcaatccggatttccttcggacaaacctgaaaagccgtgagtgcaagattgcttgtcaggcacatactgacctgtccttctccgttttttatcctgaattacacagcataggccctagggtcagaccactccaggcctacctagttttatcccaccgttacattctaaagtgcagatatgattttccatgcacaattttaaccgtctgttttatttaaaatattttttaaaaaataaaatataggttacgtataaaacactatttatattttatcatctcataataataaaaatactaattataaaaaaatttaaataagacgaataattaaagttggacacgtaaacttatggttgtacttaaaatgggataaagggagtactccactcctaagactacgaatctggacaaacttctgtccaaatttatagtcttatgtcacatctcttaaaatcccttatattatgggacagagagagtattacgagtaggttttcacttgtttgcatgtactcctgggcacttggccaggaaggcaggaactcaggatgcaatgcagtcacggacatgatgagctgatgaatctaatgccttgctgctgggctggacagtgttaggtgttgacggtgaggcttgaccgcttcccccatttatagttggttcacacggccatccagctttcataaggcatcgcattcatacaggtcagctgggggcgtatttagttccaaaataattttttaaacttctaacttttctatcacatcaaaattttcctacacatataaacttctaacttttccatcacatcgttctaatttcaatcaaacttccagttttaatgtgaactaaacacagcctgggtgcaaatggcactccagcaaaccacaatggtgaacgctcggcaggtatatgccatgacaataccagatgataaaacggcaaaatcttttgaagaaagggcaaatttagctataatactgacactgtactaattaacaacatataaacaatatattctggtggtctataaatacaataatccagtctcgcagctcattggttctatactatattggccaagattggcatccatggccatctcaattcttaatgataagtgcggcccgaaatactatatggataccgcagtctctcataaccaccttacactagtcccccgaataaataaatataatcccaagtaattaagtagatcgaacaaatatacacaaacatacataaacccaagctggccatcatcgagcagcctttgttgctatgcatctcaaagagctctcatctcctcaacagttcgatgcagattcccaagtcgaatccatggcacctctcagttttcctcccttcctaaaagcgcacctcaaacaccttgttggaatccgattagccaagcctccaggcatgagccagtgcaggcaaaacttttagtcgcctgaatactgcttgtactaataaaaagaatctggctcaaccttaacatgtcaagcattgtccacctccctagtgtcgattatttcttcgtgacagtacagtatttttagctcttcttgtagctgaaagtgatgatagagatccatcatatataatgattatcaaatgtacatggtgtccatgttaggattaaaattgactaacttcatgggtgccatgtttaatgttcactattgtcctatatatttataaaataggttttgccccctcccccacaatttggcatttttagtaaagtaccatatggtctaaatagaatgatccttattgtaggtgacctcaggtgtcaatacagtgaagaaaactaaacagacatgacttactgacctggacatgttgcagttttgttgtgatcagttcatcggttaatgaaatcattctgcaaggtagaaaggtatgttactgcattgatcatcaggcaaccattggcatgaaaaatagatgttttaataacacgcgccattttttctttcgccaggccagcggaataaatgccgatcaatttttattaagatggaaggagagccatgttacgaacaacaacagagttgttgaggcaacttgccctggtcggtcatcctacagactaaggacctgcacattttacagctcgccgcgatttacaccggcggcgctaaagcgagcatcactatctagactactcccactgccttaaacgtgtcatgttcaagtcttgatttgagcataaaacagagcataaacataatactatggcagctatatccaatagtttgaggtttgccagtttggttgagttatgaatacaaggcaatgttttggtagctggtaacattgaataccaggttggaaattcatccaaaagattaaactgatggagaacaatgaactcttcacaaatgcttcaatccatgcacccctctctaacgtggaggctccctttggattcacacatgttgagttgcatatgacttatgagttgcatgcaccagccagcttaatataaagcttaagttgatgaggaaaactaagaaattcacttgtacttcaatggtacaaggtggtgacctgagtccgtgacgactgggaaagcatggttacggtagaggaatgggcataagcaccacggatgtaaggatgcaattaccacccctaaatatcagttgcaagtaacaaacctacctagattgcaattcaaatattttgacaagtaatgaccgttctccctcggaaatagacgtttcaacctgccaaatgattgtgagcaaactttgagttaatgaacatttggtagcagtattgagaattctttgtacagactatgtacagactaatagaaaagaatgatatgtgggaaaaattttgacaccaagctaataagcttcttacctctgtatcaccatccatattaccaagtctatactgtgttgctggagaaaacaaacgatttaatcgtaaataaaggcgaaaaaaactttcagcaaatacagaggaaagtatttaccgtcagctttctcattctgttgcaagctacttaggaggtttgtgatgagatcctaagtgaaggaaatggagaatgtttagtttgccaaaaactcaaaatactgcaattaattatactgcccatacttagaggtcactagattaagctactcccatacttgctgaaatgtggtctgctgtacaagattccgtagatggggaatcagaacggacgcagatactgaaccattgcagagttccttccgctgatgactattcgactgcagcatcgatgggggaaaaatgttatctattgtgaacaatcttaaagcatggagaaggcacaagggcagtggaaactgtataagaacaagaaggccattgcaattgcatgagctgcactagccagagatatatagttctgtagcaagtgtcactgaaaagaaaatactaaaatgatatgttaaaagggttgaaccttggttgcctttctaaatcatctagtggctcaaaaatcggagataagtgtcttaaatgatatgaagaatatactactagtattttcagaaaacattaagatccagacaatgacatgacaatagaaacagaagtacagaacaatgcccttaatcaaaccctagtattcaaaacttgtaaggttttattcagatgcaggaaacatttcactaagaaattcccaaccagcattctctccaagaaaaaaaaaacagtttttgtctgaatatcaaatcacagtaagtaattagtttctacaagttggtacattattgacattgaaaagcttaccattggcttagcatccaccggccaatgaccaacgctggctgattttctcagtgaagatccctgagcaactcaagtcatgacacttgatggctggatgtgggttttgaagtagtgtagactgtagagtacaacagagctttcaataaaatggatagggcacaaattcttacctcctgtaatttgcgtgaaatgccgcttgttggaacttcctgaacctgtcaagtaagattttaattagtatcccttgtagtgatcttgctcagtctggagcacaacctattgaagtgtatgctcagaacgaaacctacctttgcaagatccacattctcagatgtcactgaaaaacgtccttttatctccaccacactacgcttagacttatctcccaaggagcccacatagcctgcaaataacaggcagataatcatatactttccttcagttcataaccacagtgaattcaaatgatctaatttatgttacaaaagtctgtaaaccttaaatgtggtcatttgctatgttaataatattaacacgtgactgctgtttatcatgtgcatccaaaaaagtactggctgcttcctacctccagaagaccgaataggagcagacagactatttgcagaagcacgagtagggagtgcaagaggaccactgagatttgtggttctttttgtacaactcttttgtttatcagatgccaacttaactgccgcttccctgcagcaaggaataacaataaccaaaagtgcttttaaaatgcaaatgcctttttgagcaatttgtttcagcaaaaaaattatgaaacctcctaacttcataacagtactcacaggaaactcaggtatgcaaatgcctttttgagcaatttgtttcagcaaaaaaattatgaaacctcctaacttcataacagtactcacaggaaactcaggtatacaaattcaagaagaataactactaatttgtttctataaaatcaattattgcatgacctaagtcaaacatttaagaactaacgacacttgaaagctcaaatattagccgattttaagggggaaaaaagcatcttaaactgtaccgtttcatttctgaggcatattcatatgtaatatttcaaacaggaaagtccaaaaaaaacatgcattaaattattggtatgcacaacattgtagcagccaagtaatattaaaattggaataggaaaaaaaaacagtgaaaggcttacctatcaaaaatgcgactgctttcagttattgatttattatgtacaccagaacacagaattgggccagagcaagtcctttctttttgtttaacttcactactactgttttgtccttcagaatcatgttttgatgtagagggtaacgattcgttttctgacccttgttttctatatccatcaactttcctttcactatcagcatcaccaggttcagaaaccaatcctctgcttgtctcatgcatattcccccctggacttactgcagtgacacaagtttgttcactgaaatgtaacaaaagagtggaacattatgaacacactaccagtaacacagaaaagcatgcatcaaggctcactgaatctttcgcttgttttaatttataagaccaaaatttcaccctacaccacataaaataaaacttgaatcctatatacttcgattggtgatgttgagaatcacaagctagggaacaatatagaacatctatatcttttaaagaaaacattgccacaaaaaaatattgcatactgattcaacctgaagtgctttccactcaaaatttttggttgtccaaaatgattgccagaaaacggctcctgcaaacagagcaatcataaatgacttgaaacagaatcatatttggtacataattttgtcttacttacaagaaatcaataagctatgacaacatggtgtgcaaatgtttctgcagcactcagaattagcgagaaacaataacaggatcagaacataagcatcttccagatttaaacagaagcatttgtggcattacaaatgaccctgacttttcaaatttgataaacggcaagctcttttctgtgctttgaagttaaacatgtgtgatacttcttctatttgacacactagataaagttttctcatgatcccatctagctacagttattaccctgtcttaccagaacgcaagcctacgtctgaaacaaaatcaagtcgagagcagctaaccttatcagcttcatttattctatcattgtcaacatcttcctttatttcaggtggatcatcatcatgaatctgcaaaaaggttggaaatctcacttataagactaaattacagtcattttacatcttagcaatgtaacagaatgaatcagagagcaatgtagcatttcgatatagaactaaagaaactggttgttttaccaatgatgcttgagcctttaaatcctcaatatcgaagttccatgcgcttacgcctctttggtactcactctattagataattcagatgataaggaaactatcatgtaagtgaaataaaagtgcaaacatatctataataaaccaaactatgtttatcatgaatattagtttgtatgtggaacagaagtgcaaaaatcattagggtattacgtccatggagctaacaagtgaaagaaaaatagaagttagctactgcctgtaaggtggactagctaaagtgatctctcgtacaaatcattgcgttggctgaaatgtgtcttagacatcatattcttagcataaatatagtgacaccatagcatacaagtgataaaaaaatttaacgtcattttaatttttaaattaaaaaagcatcaaacatagtctaatatgctgggatcttaaatcattctgtgctagtccttgttcaaccaataacatatccatgcatgaaagtaataccacagttctaacttcattttgcaagggctgggatttgtgttactgcaaattgaccctggccctctacaaatttgtttttaagctgcatctactgaccaaaatcattaagactggtatggtcagtgataataaattaaaaacaaagcagaagatttgcctgtaaaatgaatatatataataccaccataaagcctatttcagaagtttgtgggtaaaataaactagctagcatattttcatgaactcaaatgaaagaacagcacaaaacaaagtggaacttaaaagaaacatcaaaatcacaaaccatagaaagtgcctcctgttcagaagaaggcattttcttcaaagctaattgtgctgcatcttttagctgcaaatgcacaggataacaggaattaattaaggcataatgtttccatcattaagtaaaaacaaaaggaaagtaaactagcaaaacctggagcgcttttacacgatcccacagagggggcaaatcagttaaaatactcttaacagtcagctctggaggttttgcgttcttgaaaaatgagtgctttagtaacttttcagccgttggcctctttgtttgatctttgaccaggcacattgcaaccatttccttgaaagactgataacaactgaaaagccttcattaggaggtaaacattgaggctaaaacaagcagatactgccataaaacatagactcgctagccaagaattagctgaaaggactagtactacctttgagaatcttttatcacggtcatagtcaaggcctggtggtgcattttgaagggtcatgagaagaacctacagaccacataaacatcctcagattctggcaaaacataaacatcctcagttcagcagaaagtttgtatttgtaggatcctaaacccaagattgttttctatgaacaagaatgttctacaggcatattgctaactgcatggataacgctgttcatcggcagtaactttaaagtccaaacaagtaatttcacgagaagaatgtatgtgcatgtagtatatggaattgtatacaaatgacagaacatgtattgcaagtgcaaagtacatatgttttctagcccaacatgacatacaaaaatcacaaaaacatcatccctggcagcaaacactaaccatgtgaaaatttgaatataagacacatagatatttggctgaccatgcacttgttaattagactgtcactctttttcttttaataaaaaggtttcaatttgcaaaagataaaataattcattgccttcatgggaggatacttcgagaagggagcatggccatgtgctagctccagtgcagttattccaaaagaccatatgtcagctctgtacaaggacaaatagttgtgagcgcactgtgcacctcaacagtacaatagcaaccaagtaaaatataaagacatatatagtagaaaatacagaatgtttgaacacaagcagcactgcagttacatgttgagtgcaacgacagaagaaaaaaagaatgttttagttatctgccaatggttcactgaagcatttgataccaaaatataccttattcccagtatttttatggtagttagagttcttacccttaaggaaattttaaataaccaaattaagttggtaaacaaatggtttgaaacatatttcctggtaaaatattttaagaaacacaattttatctaaatattgaaattaatatctaaatattgaaattaactttttcaaaataaccaggatactggtagctaacggaacaaggttatgctattaccaacgtacttgaaattatatcctgctccaggctggagaacttctggagccatcctaaagaccaaatgacagcagaaaacacgtttaaaggtttgcagaacacttattgtacatacaacagagaaaacgtaagaaaactccagttaccagcatggtgttcccacgaatgtattcctggatctttgtctatcacctctatcaaacatacaagcagagacaccaaagtccccaagtttcactataccaggactgtccataaggatattacccgcctgtataatattacgctgagcaaagcaactgacaaagttagctaaaatgaatactactgtagaagctaaccttgacatccctatggatatgtccttgccgatggaggtactctagagccttaagtgtttcctttaggatagaggcgataacaggctcctcaaaaccatcaggatatgcaaccttcatcaggtgtaaacatgaaccctctgacatgaatggcattatcacccagaggttatgatccacaacaaatgagcagtaagccctgatgacattagggtgatctatcaagctcatcgtttgtgcctcttttcttatatcatcctgggtacaatatgtatatataccactatgagatgctaaatacattattgaacttggggagaggatcattaagagacctcaaacatcagcctataacagtaaatgtatataattaatttactgcaggtaatattcatgaatcctactacttagcattaagatagaaagaaaaatagacgcattcatgatccaatgcaacaaaggtgaaaagtactacaagcaaacaagctataccacaacgtcctatacatctaatttactggatcagtaacccaagacaactgcatgtcatcctataagccgcaaatgcactgcccggaagaattaaatgtaggcctttgtgaagttaaccatccactatctatgaagttaggccgaggatgaattaaagtgcccatggataaggaaccccacgttgtctcgatatagccacaaaacctaataaaaagtaaccgacaaaatgaacaatacgaacgatcgaactaaaaatttgctaaaatgaatagcataagtgagtggagctaaatcccgactccgcaaagcacagttaccacaacctaattcttaagttggtaccacgtcaatactgatcaatagaataaacaactttaattggatcaaattgtcccaacttgacacaacacacacagctcaactgcatcgaatcctcccctgcacgaccgcatatcccccgatcaaaacagcgatcaccaccggaatccctaggacacgaacgagtgagggagtttcgatcgagagagagagagggggagagaaagctcacgaggttactgttgacacgatcgagatccaggcacttgacggcgacggtccggttggatggcaggaacaccgcccggtacacgacggcgttcgcgccgtagccgacctcctccagaaggcggtagtcgccgggcgaggcggtgaaggccgtcggcaccgccgccgcggcgggcgacgacgacgcggccgtccgccgcacactcccgctcctcaccatggtggccccaccccccacgctgagcagagaccccccgccgtgccgccccccacctccggcgatcgccgtcggtcgttgactcgtgtcgcgcgtacgagaccgcgggtggactggtgactgaaacgaggaagagaagagagagagacgatggggagaaaagggtgggtggattttgggaaagggaggaagtaattattttggcgtgacgtggcgggcatggggcccgagaggcgggggccgtatgagtgggcgtgattggtggataggctatgacatgtggacccgaaggcgtgggtcccgtttggcagtgggagtgaagagatggtggctgtggggtagcggagtgacatggggcggcagatgccgccgactgtctgagagatctccgcctcccgatgttggtctgtgactaggatcgtctgcaggggcttccctgtggctgataacgtttgttgagacaaacatggcatatccggatgcacatcctctgcagtgggttcacacatcagtgtctgctactgtatcagcagtactgcaggcaatccccgctagacatatctatatcattgcgtcaattaggtttttaaggagtatacttattttgtaatagaggtagtagtacaagctacatccctatcaaaccagacttgctaactatgtggtgaaagtttctccttatgcattcgtagtaatatattttaaggatatctgtatcgtataatttatatcattacgttgtatcttagtatactattttatctctgtggtatgttgggaataaggttcaaataaaagtttatgtgtcttttcaagtgttaaccaccccgtagcatgtcttcgtcatttctttgtgtggttgtactgcatacatatgtatccccactgttcatgacaaaaggcatcttggttttttttcacaattttgcagcccaatgattgtcttagtacctgtgctaaggacgaattatcaagtaaatatagtagttatcatatgacattcaaataagaaagataatatatgcaattgataattgtattacatcttgactctgagactaagataaagaaaatccccttgtaacccatttgtaacccatttacttatgcctctctatatactcgtgttgcacaccatcttcacatgaaggtccttattggttggcaatatctcattaattattagctcctaacaaataatttgaaagtaaaacttttatctatatgtgagtatgtccttaacgaccttaaaactaatgttgaaaacgaactacgctgaaagtattctaaaaacaacctcaaaatcaagtactaaattttaaattttggcaatgctttattttttataagggaaacaataagatcatagaactattaaaaacacatacaactcgacggccacataaataacagacgcatcgtcttctccgaatgcaaatgttctgcattcaaggcattcaagccaaccagactttctctgcatgcaaccaaacttcctctgcatgcaatgttttgcactaattatttatgaaatttcttcaaatcaattatgcgcttatcaattataaattagaggaaatacatatttttaaaaaagtaattcgataggtggccaatattcttggatcaactagtaaattacttatacacagaaatatcctttttaaggtacacggaaaatatttgacactgaaaagagaaaaggggtagtaaggcaacgaacccacaaagccgatgggcacagaggatccgcggtcgtcgggagcagagcaggctagcgtgtgccgctgcggctaccaagccggtaccacggccgaggacggctcgtacaaaaacggacggactcgccgcttcgcgggcccaccttcagccaccgtacgatccaaaccagcctcatttactaccaccctcgctggggttggtttgctgccgacatacgtgggcctacgatcctagatgggccggccccactttgacagctactcctactctcatgggcctagtacccaaccaggccaccagcccaacttatatcagaagacaagtccaccccatagcatcatcgtctccgcggaaccacgcctcgtcgccgccgccgccgccgccgccgccgcgcgacgtcctagcttcccggaccgcctccgcgtggttggatccggcgagaggggagaactgttgtgttccttggaagcgggagctggatgaaagctgggaggaagaacctacggcgggcgtgcagcgagggcgccgtcacgctgggggagggcgagagcatcatgcaggtcctcgcgctgcgcggctccaacgtcatcgaggtaggacaagctctctctctctctctctctctctcccacctccaggtctcccctgatcgtgaattcccttgcactccattcgtatgtgttccttatcgccgtggcttgctgggtgttaggtgatggacgccaagggagtgaagtctctggccttgttcccggccaagttccagaagagcttttggatcaagaatggtgagtggtcgccggactttagcatagctggtcactgctcccgtagtgaaccgagctgtcttttgccgccggtttatgacggtttggttgtgggttatgtgaatttgcagggaattttgtggttgtggatgctagtggccgggatcaggcgctcgaatcagggagcaagatagcctgtgttgtgtcccaagtcctcttccatgaccaagtccgggctatggagaaatctgaggaatggtgagttgcttggttctttgatcgctgagagttccctagtagtactaacaatcagggttcagggcttccgagtgtatacaagttgtaggaaaggctggtactggatatcaatctgtgaccaggggtaacttttgaaattgtttgccagtagctgcagattctgcatttaatatgcaaaatggcaacaagaaattcttgtgcaactttggttgaggtattttgcctcatgagtcaagaaattgtcaccgatgtatttgttggtgtaaccagcatgaataacctcggttatggtattttgactcatgagtcaagaaatgtcaccaatgtatttgttgttaacggcatgaatagttttcttcaagctatgctctgtgttgtgaccttaggtcacgaacaagatcgggtataggccggaaagaagtgttttcccgcctatccttagaaatgagctcaaacagcaaacacaacctttgaggattacttttgtattaaaaatgtcttgttgtgctacagggatttgaccggcttttatagcctacggtcttacatgtgatgttacgtttctaccctcatgggctttagtgaacttcctataatgcccttgccatgtcagcaaccctaggggtactacagtacattctcggggtcattatagtcttttggctccagctggcaagggtggttgagaagtggcccccacagaatcttccattcgactggatcttaactcgaataggtttttccttcgagttctcttagccgaatgtcttctatgcttgagggttcgcacatccttcatcaacttcccgatcgccagattcacctgccatgtacttagaattcatccccaatcaagatgagttacatataagtgataagaagccactcgagggtgctttcccactcgagagtattttccaactcgaaagtgttttcccactcgagagtgttttcccactcgagagtgttttcctactcgagagcgttttcccactggagagtgttttccttgttttacacttaggaactttccataaaccatcttaggtgtttcgaccggataagagggagggcgttgtccccctgttacaacactctgatgctcatacaaaacaatcagatttaagtgcaatatttgctccttggtttcaaaagcatttgtgttgagctgcgaaatacaaagtaacgtatactgtttttatccctagtttcatctagggtccagtgttagtgacattggtttatagattgtcatggaactaaaatatccttgctgtagtaaatgcttgtgaagagttctgcagaccattgttttaaatatttgaattctctggcaactttggattaaagtcagttgcctgatgtcacctttgcatttcaacagcctgaatagtttgctcaggttttttcttgatcaaatatccatgaaaatgatgtgaggaatctataacaataccacagcaaaactaagacttcaacttattgaattcatcagtccccgtttatcatgtaaaccgtcaggttctctaagaactggaactataggtttaattatatgttagtcaaagggtggctttactgacatcttcaaactggctctctgatgaattcattattttcgtacatactaggccagctatcttcaagtcaacttctaaggaaggttcagaagctggaacacaagaaggaacaaggccacagattgaggaggaaccggattctgatgaagatgatgatctgccaccgcttgaggcgaacacgaatagacaaagaccatttgaactgtatgccgactcagagagtgattctgactcttagactagtttacatttgaacacgccattgatgatgttgtggtttgtgatggaaaaatacacccggtgtacttatggtcaagtcttacattctgccaaaaactgctgagtgtcaaaatattctgaagaagttcgatgtcattcagtagcaggcacaaggcctttcacttgaaactatgatcaactccatatgttgctttttattgttctcaatgatggtgcattaattgtctggacacagcctgatcaacatactgcattttctatcaccggttcggaattattcaagcttgttgtgtgtcagctgtttggctccaaagcttggcctgtttctcaattctgcagatactgctagctgtcggaactcctaagctagagctgactggccaaatcgaatgaggagttgaagtatcaaagtcattagtcataagcgtggaaaataatccttcttgtgacgaccttctggatgaagcgacggcgtggtaagatccagcttcgaattaaattgttgatttgcttatgctgcaatttatgttcacgatcatgtctgctactagcaggataaggccccaaagagaatttgattttattatgggtttatatattccatcaagtctaattattagtcagggagtgcgtctgtatcggatgagttgtgtcaatgttgagttcttaataaagaataaaggagttctttttattaataaagaacaattgacactggcaacttggcaagcacagatgagttctttttattaaaaaaaaaaattaggactggagcattattactggtaagcatgtactcctgggtggtaccgtggtagtagtcaattacgagaaagtttcaaagaagtgaaatttgcaaccagcagtgtggaccggctccttttctattacgcggatttggttgagatttcggggctttttggacttttgtattgcactgcagatttccctacttgcttcacagtggtttcccagattttgcaaccaaaccatcccgatatttttggatcacccgtataatattcagtcaatctttcggcgaaatttgctttggcaacttggtctctgctgttgttcacgattctattatctatgcaaagatcagtgtcacaaaattcgttggagaaggcaatttcgttgatcgatcatatgtacacactctttgagaagatgatgtgaaatcttgaactaaaaatctacaaaatttggacattttacacttgaaaggtgaaagaaaaaaaacgaaagggcgtcctcttggtggccgtcgcggcgagcgggtcaccagaacgcccgtttccgccggaatcgcctcgccgtggcgagaagtccgactccgacgcagacagcccatgctcccatctccagcgcccacgtcaacgtctccgcctccatctccggcgtgtcgagctcgccgtcgtctccgaccacctcccactcgtcatccccgcacgtcccgcactcgcagtcgcacccccacccttcctccggtatcccctccagcctcgtgccgccgcacccgagccccctcgccgacgccttcgccgtggccctcatcagcgcgccgccctcctcgagcaccacaacctcggccaccgccgccgccgcagccgcacggcggcactcgacgcgccaccctcctcccccgccgcggcggcgcgagaagacgccgtccgccaccagatccttcccggcggcgtacacctcgaagcgcgccccctcggcgacgcagacgcggtcggcgctcgcgtacgccgccgcgtcggtgccgccggcgcccaccctccggagcggcacctcggcgggcgcggccggcgggagcgcccgcccgccgagctccagcgcggcgccgccgatggccgggaggtagacgagcgtgagctcggccggcgccggggacgagaggcggaggtagaaggcgcggacaccgaggcgcgcgcgcgcgcggatggaggccgccatggcgtggcggccgtcgtccaccgtggctaagcacattgctgctgccgtgtgctggatgcgattgattcgcggaattccgtgggtgtgtctgtgtgttgtgtcgcgtgggcgcgaggtggagagataataaagcgaggcgggcgggaggaggaggcgggagatggagatggggatgcggcggatgcggagggtggatcggtgggcagagcggctcgcggttttgggcggtgcgcacggggttttgtgggggaatcagtggtgtgcgcgtgcaggagcacacgggtttgggacttggggtgctcaggtgggcgcgcgtggggagatgtccctgggttggcttggatttgtcattttccggttgctactagttgtgctagactacagtgtttaggaagcgacccgccgacttggctgtcaaccacgccgaagaattggtggctgttagctgacgcaaatggggggtcggaaacgtgtcgcgatctgcaatgggttcgtgcgtacatacgcgagggcgaggcaccacgcatcagtccatgggatcgcgctcctacgtgggttctacgtgtacccacgtccctctggctttacgttaagtcagaggagactcatctcagtacatgcgcatgacattttttcttgcagtaactcggtaactttctaccagtttcatgtgaaccgagttaaccgtggtagtaccatcttttttaactagtcgtgctgattgtaatacacccccttttgaaacgcactgtaggaaacagtaagaggagctctccaattactccatcacatcaaaaatctatttatattattaaaggaatagaaaaaaaagcctccacgttcgctctcatggtctagaaattctcacattaatcagagaaaaagaaaaagcagagttcatatagaaatacaatttagaaatagctgaaattcggaattaaaaaaaaggaatattagaagaggagactagagtacacatagaaataatttagaaatagttgaaattcggaattaaaaaataatgaatattagaagagtagactagagtccatatagaaatacaattaggaaataatagaaattcggaattaaaaataaagaatattagaagtagagtatagagtctatatagaaatacaattaagaaaaaaaaataaaaattcggaattaaaaaataaggaatattagaagtagagtatagagtccatatagaaatacaattaagaaaaaaaaatagaaattaggaattaaaagataaggaatattagaagtagagtatagagtccatgtaggaatttaaaattaactaaaattcgaaataaatataataaaattaaaagtatagtttagagtccgtataaaaatacaatttacaaataactaaaattcgagattaagaaaaatatgggaagaagagtttagagaatattgaaagatgagtttagaatcacatagaaatacaatttaaaataataaaaattcagaaataaaaataaatattattaaaagaagagcataaagtctatatagaaatacaagttacagaaaattcggaattaaaaatatatattaaaagtcgagtctagagtttatataggaatatatataatttacaaataattaaaatttgatattaaaaataattaataactaacacgtatataaaatacattatgaatattacccattagtagttcgtaaagttattgcaaaatttaaaattatgttgtcattttaatatatttgaataatatattgagaaaacatatatgctattatatgagagaaaatataatgattcgccaccatgctagttgaactaaagaaaagttctccaaaaggtctaacatcttaattaccttttgaattaatctagaaatgcaatactaggaaaattttcatatcctcttattactacgtatagaacggttctacaggtaagaagtccttagcaaatcgaatcctccatttgaatagtactcgtatcaataatttcgtggtcaagaacacgaaatgatactcctataaatcattttaggtcagaaaagagcctatgcagtcaacagtgcgattcctgttgaatctgcaagatagtatagtagtcaataatagattacacaggagcgcagcactccacgttacaatgcgtgctctactatccactgcgaaggacgcagcgcgactcagctaaaagtttgagcctctaccatactacaagccatattgggtgcaatggcaatgtcaggttcagaagcagctgcctacctgacccaacctctcgtcttgttcacggctggttgctgccttgtggctctggtaacaggacccgtcttgtgtgtggcagcggccgtctttgaagttgccgtcacccgtcctgggttcttcagcggctcggtcgattttctcttcagccttggctcaccttgcaggctcctcttccttgaagcattctggcttccaacaggctggttctccaattccccaccaatcgatgaattccttgcatctcctttcctcttcttctcattgacaacttctggagccccaacaatggaagaattgttggtgactttcttgttcatagaatctgagcttctcagaatgtgctgctccttctcgctcattgcttcctctcttgtcaagaggtgcgcctttgcctctccaggagtactagcaactctcatacagttggtcgagtcaagtatcatgtttgtgtcctgaagtgttgtcctttcttgcaagttattctcaagatctcttggctgaaatgtggagaggttaaagtccacattattttcacccctttactgtaagaatgggcacaatgtagcagttctgagaaaagagcttaccttgatctgaagcatagcctctgttctctgtgtttccaggagctcctgtcctatttccattgcctacaaaaaaaattcaggatgatacaagtgtcaggtaggttaggaaatatgtatattagggtcagagacactagccacatgttacaaatcaccttagattctgcaactgatcgatggtgttcttgttccttcaacttgagctccagctcctttatctgaaaataataatataacaataaagctatgtatattagggtcagagacactagccacatgttacaaatcaccttagattctgcaactgatcgatggtgttcttgttccttcaacttgagctccagctcctttatctgaaaataataatataacaataaagccaatccaaacctggaccttttcaattaatagccactaacagtttaatgttaaatttgaactgcaacctcagattctgattgctgctggagtctaagtttatgctctgattcctccgctatctggaaaataaaaaaagaatgggtatatgtctagagtttagtaccctgtgcactacagtagctacta

SEQ ID NO: 58673 - DNA, 26621 bp, Oryza sativa
ccggcaaaggggcaagccccctttcttcccctcctttttcccttttcctccccgccggcgtcatcctccctgtcgccaatttggccgctagccggagcgccagctcgcgccttgaccgcgcaagtcggttctcaaaccgacattgccgccccctataaaccccagcccccccctttttcctttcctctcccattcacctccgcgccattaccgcccctctgttcgccgtcgccgttcgtcgttgcgcgtgtcggaagagccggcacgagcaaggacgcggaaggggacttcggccgcgccctctccttcctcttccccggcccgaggccggagagattactcccgcgccgtcggcctctcgtcacagcgcccctcctcttctcggtgatgtctctctccgttctccctcctcgctccgtctcctcccccctagctttcggtagtagctcgagtagaccccccgtagctagccggcgccgccccaaccgttgccttcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcgacccctcgtagcttcatcgccgttttccccttctcccgccgccggttgccgccgccgcaatccgccgccgtcgagcaacccccggcaaatccgagccgttggctcgtctcccctcgtcccgtgcaaccgcccggtgtgctcgctcttgcccgtatcaccgtggttcgctccgacgctcgccgccgccgcccgccgtccattcgcggccgggtcgtcgtctacctcccgccagcccacgtggccgccacgtaggcgccacgtcggcgccagctcagcctagaccgggtcgagccgaccccggtcggtccctccccgtgcgcgcgttccacctcgagccgtgaggctgcgcgtgggcccgtcgcatccgcgtccaccgcaaaccgcgcgcgtgcaccgcgttcctccccgcccgcgcgcgtgcgccgcgtgctccctccgcacggtgagccgagccgctgacaagcgggtcccacccgggaccgcgcgtggtgagcccggtccaccggactctctctcctccctcccgcgcgcgcgcgcttgggccgtcttgggccggccggcccgttaagctcggccgagccaccccaaatctcttgggccgcaccctagccgcccgagaaaagtctatattccctccctcccttctttctttttctttttccaaaaaggatttaattaaatcctttttcctttagaccaaaaatccgataatcttagaaattcaatatcttcccaaccgtaactccgtttgactccgttcaacttccaaaattcttcaaatctcgagatctatctagtggcacgcttagaggtcattaatagggctttattttcgctgtatgttgagttgtcccgtttcgcgtgtagtttcggagcccgaagacccgcagtgcgaggatttcgaggatcaagctcccgatctcgagcaaggcaagccacctttgaacatcttgagcctatatttgaaatttaattatgttgcttgcaaaatattatgcattgataggatcacacttaatctgttgtcccgtctgcaaggcagattggcggactcacctaatttgtcgcatttgatccttccattgttaattgctataccatgtccccttgtaaccacccagttgcgcctcgatactcgtgcactctgtgcgagtatcgacggtcgccttcaaacttaaaatctgagtaacaacttgggtaaaactggagttttaaaaagagacttggaaaacccgacacttgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtaggggaggacccctgggcttcctggcacagtatggtctgggacctaacctgttgttggtctgggacccctctcgtcggcatatggtaaacctgcatcggctttcgaaatgccttgtcatgaaagcttggaggtctcccgacgtggctgatccccacgggctgggtgacccgggttagtaatgtcgtgtgggtaaagtgtaccccctctgcagaggtcattaaactgttcgaacagccgtgcccacggtcatgggcggatgtgaggtgattcctagcgtagttttgtttgactactgcttgtgaaattgctgtagtgaaactgggttcgatgtttggaaaacctgcagctgatgggatcagctaggcccgggtggccgtttaaaaagttgctggcccgggtggccgtttgaaaagtgttggcccgggtggccgtttaaaaagcttttggccgggtgccaatcttgttcaaatctaaagactgatacattgcacatactctgaccggacgagacgcactgtctcatctgtgtcgtttgagaagcactcacttagttgcttttagaaaagagttcaaacaaaatcaattgcaaaaacatcagccattccttgaagcctgcattaaacacttatttcccctggcttgctgagtactcccgtactcacccttgctctatataaatatccccccagttgctgaagaagatgaagcgaatcctgctaatgaggagttcttccaggagcaaaccggctacgatgagttttagggtttcggcctagttcccaagtcgcgcctacttctactgtgatattctgtctccctgtgataccagcactgtttcctgggactggtatcgattaacaggttaatttggagcggttcttccaggagcaaggagcaaaccggctacgatgagttttagggtttcggcctagttcccaagtcgcgcctacttctactgtgatattctgtctcccaggagcaaggagcacctgtgataccagcactgtttcctgggactggtatcgattaacaggttaatttggagcgtcacgggttagttccggtcgagactagttcggggcgtgacatcgcttttcacacaaaagaatcggtgttacacgtgtttaggcaaacatccttatatctcggtgctcctcaagctagctaggcgaggtggtactattcggtgaacagtgactcgcgtgctacagtacacgcgatactacagtgtctaagctgctgctcactcgttgcttgggctgttgctgcgcttgcatggttgggccaagccaagaccaagctgctgggatgtcacacataaacatcgcttggcatgcaatcaataggctttatttgcatcgtcttttgaaaaagacttcctatgagctaattgttgggaggatgcctaatgttgcctattttcgagtttttggttgcaactgctatatttatcgaaaaggtgttagactaaccaaatttgaaagttggtgtgatgaagggtttcttctaggttatgcctcaaatagtaaggcataccgggtctacaacaagaacaaaggtattgtggaagaaaccgccgatgttcaatttgatgaaactaatggctctgaagaggggcacgagaatttggatgatgtaggtgatgagggcttgatgagcgccatgaagaacatgtctattggagacatcaagcccgttgaagtggaagacaagccttccacctctactcaagttgagcaaactacttccgctacgccaagccaagctcaagttgacgtggaggatgaaaaggcacaagatccacctatgccaccaagaattcacaacgctctctctaaggaacacccaattgatcaagtcttgggtgatattagtaagggtgttcaaactcgatctcgtgtctcttcgatttgtgagcattactcttttgtttcttgtcttgagccaaaacatataaatgaagcccttggtgatccggattggataaatactatgcatgaagagctcaacaactttgcaagaaacaaggtgtgtactttggttgaaagacgtagaaaccacaatgtcataaggataaagtgggtttttaggaacaagcaagatgagaacgggttggtggtaaggaaaaaggcaagattggtggctcaaagtttcacacaagttgaaggtttggattttggtgaaacctttgcccccgtggcaaggcttgaagccattcgcatcctacttgcatttgcatcatgctttgatataaagctttttcatatggatgtgaaaagtgcttttctaaatggtgaaattgccgaacttgtctttgttgaacaaccacccggttttgaagatcctaaaaatcctaaccatgtttacaaactctcaaaagctctctatggcttgaaacaagctcctagagcttgagagattttcttttatcatagggtttcaaaattggcaaagttgacacaactcttttcactaaaatcattggtgatgatttctttatgtgtcaaatttatgttgatgatatcatattcggttctactaatgaggtgttttgcaaggaatttggtgatatgatgtctagggaatttaagatgtccatgattggagagttgagcttcttccttggacttcaaatcaatcaactcaaggatgggacctttgtgagccaaaccaatcaaggacctactcaagaggtttgtcttggaggatgcaaagcccatcaagactccatggcaaccaatagccacctcgaccatgacgagggagataaaccggtagatttaaagctttatcgttctgtgattgatagcttgctttatcttaccgcatctaggccggatatcatgtttagtatttgcatgtgtgcacggtttcaagccacccccaaggagtgtcacttaatggccgtgaaaaggattctaagatatttaaagaattcctcaactattggcttgtggtacccaaaaggttctaagttcaagctagtcggctattccgattcggattatgtcggttgtaaagtggataacaagagcactttcggtagttgccaattgcttagtagatctcttctcgatcctaatcatcttctgctgcttctccattctttcttctctgtggcgtcaagcactgtcccttctgacgatgtcaaccccttcgcggcaggctctgtggccatctcggcggcgacggcgcaactcatcaacatcaagtcccacgttcccgtgatccttgatctcggcgactccaacgtcggcacctggcgcaccttcttcaccattgctttccgcaagttcggcctcctcgatcacatcgacgacacgaccgacgcccgcctgtaagccagcgccgacacctgtggacacgaaggccaaggtctccagtacgacagggcagccctacagtgatccgacgttctatcgtagcatcgtcggggcactccaggacctcacgctcagacggccggatttgtcttacgctgtgcaacaggtctgccttcacatgcactcgctgcgggacgtgcactggtgttgatgcgaaaacacgaggcctgggagatctgcttaactccagtgcaggtccaaaaatcttgcctttgaggttcgtgagcgtgccaattgatttgatcctgcaatcaacaagaaataaagacaaggaaaccgcagttaaatccataaacgatagccgatcggccagctaccgatgacatatcatttatctgagagccgatgtcatatgtgaatcgatcggcagttggctgtagatgttaacagtatataatctttatgtcgatatatacttaaattaagtaattgggatagatcggtcgccatgccgagacagtataaatcacttagatcgaaatatatattaccaaggagactatagacgtttacagcatagccgatcagatagatctagcgtgtatcggctaatactccgataccactctatatcaagatattaaagcaagtaaaatatatcaaacataaagcttaatacacctaaatgcaataggatcttaacataaagggcggatctagcatatcaattaagcatataaaacataaagctaaatcaggtaagattggctgaaactccgatgctaccctaatcggaaaccaagaagcaggctagagattatagttctaagcacgacttatgaggtcaaacctaactgatgcagccataagtatgaaaagaaagacaatatctagacaatcaagccattgggagcttcatagagtggtagatattctatataatctaagtcaacgttggtatttaacctaatcggctgccttctagtgatagatgttagccgactgaaggttagataacaatattgccgaagattatatagaatatatgataactcgacaacttacagagacaagattagagtatcataatgatggaagcactaatcccgagaacgcaagccgccataacaagtcgtacctctagttgaagatcgaaaccgatgcagctcaacccgaaagcaagaactagtcgaaagcaaaacaaaagtaaagggtggcaatgcgccgagattgttgttgaacatgtgttaattgaatacatggggttcggggtctatttatacccgagattacaaaatatgtccatatcggacacgactgttatctctaaccaactctaagataccataagtctttgcagcagacttttgcccaaacttatctctaaggaaattatataaaatatcctaattaatagatacaattgcctattcaggactcaatccgagtgtggcaatccgtgtgaagcacattaactcaacccgatgacacacaccgagtcgtattgtcggaatcggcttaatcggctaccttgtccgactcgaactcagctgtctttgatcgtagccgatttggatttcagccgaatcttgctctgtttccgaaacgatctttgtcttcgattccgcatcgatctaatcttcttcttcgatactcagattaccaaatttggttgttaacaattggacacttgtcaagcggatcctccgttatgttcgtggcacgacgcacaaaggtctgcaactccggcgttcttctacaccgtcgctcaccgcgtactccgacgcggactgggccggctgccccgacacaggccgctcgacgtccggcttttgcgtcttcttcggcgactctttggtgtcgtggtcctccaaacgacagtccgtcgtgtctcgctccagtgccgaggttgagtaccggggtgtggcgaacgcgactactgaatgttgttggctccgtcaccttctcgacgaacttcacatcaagctcgacaaagccacgcttgtgtactgcgacaatatctccgccgtttacctgtccaagaatccagttcatcatggtcatgctaaacatgtggagctggatgtacacttcgtccgggaaaaggtggctgttggggacatccgcgtcgtgcacattccgactcgacaacagctcgccaatatcatgacgaagggattgcccacagcgctgtttgaagatttccgatacagtttgtgcatcgtcgacgacgcaccaaccgccggggggggggggggtgtcaagatggctgatcatgtagataaggataggctagattacagtttctttttgacctattcttccgccgtgctcagtctacgatccattttatcaggattccgttggcactcttgagctgcaccggcatgtatatatgtatactggatgtgatcaatacacctgtgcgttgcaactcaaactctttcaagattgatgtacctcatgggcgtcatcggtgcactcggcgtcaaaatcgtccttggcagggcacctagtgctagtggtgactggtgaggctggcaggcgaagatcagccgtggagagagagacgcaagtggccgaaggcggagaccgcacagaccggggtgggaaggcctccatgctgccggatccggcgatctcaagcatcctcgacagcggatcgcctccgccaccctgtagcgagcactccctccatggccaccgcgctcctagatcggccgcctggacccgctctcgatcacgttgctgccaccaacagctctgcaccaccaccgcctgggcctccaccagcggcccgccgatccgccgccggtgcatgctatttcgctcaagatgcggatgtggtgcggtggttgttcgctctttggtcaatccggcaaaatatataggatcatggtggatgggtttcctctttgatttgttacgttacatatctatataaatatttagtttataatagggacgcctaatttattggcaagagcggaaatttttgaattggcatattttggtagtgatcaatttatgtttagttaaacttgaagttgacactttatgcatagttgtagtacgtgtacacgtatttgtaagtatgtctagattttttttttatttgttagctggtgtgtgtggtaactgagagtgcactcaaaacttgtgggtacaatacatgtttttttttttttagaaaaagactagcggcccggcttatattgaaagcgcgcgcgcgggggggggggggtgggggaggtgttgttttggggacatcccaaacacaaagtttacaacgcaggaggcatagcctcactaaaacaaaagatgtgtacaatacatgttatcgggttaaatgtggcaacaaatcaaaaagcctttagtttccactttgtcattgtttaagcacaatttcaatacaattatttcttcaatttgtaataaattagttaattacagtagcatttggaaatcaaattacaccccgcgaaatgaacttagctgatcaccccttgatgccggtgctattcctggagcacttaccggagttcttgtacgtctccgggcaagggccgccgatgtagcggtcgtgggtcaggccggcgaccgccgcctcggtggtgtcctggctgcacgacgccttgccgccggacacctcgtagtagctggagatggacaccggccagcagtggatcaaggtgaagttgtggccgcgcttgccggcgctcacgccgcgcgcgccgccgatggtgaagctgagcgacgccacggcctgcaccaccacctggtcggtctcgccgtcgtagagcctcgcggcgagcgaggccggcagcgcggaggcgttcaggaacgcggacttggtgacgaagtgcgactcctgctgcggcacgacgaacgccgggagcgtgaacgcggcgagctatccgtctgcgccgcggcgccgtagatgaggcggacgaggttgtcgccgccgaagtggaccacgacgcggccgctcgggttgaaggcgcggagcgtcaccttgtacttgaccagcgacgcggccgacggcgactccggccgctccacggacaccgcgcagctggccaccgacaggtccagctccaccggccggagcaccatcctgatggctgttaagatattaggggtagtttagtattttcgtatcacttatatacatttatatttgccctttagggctagatcaatcttactgttgaatccccaaattcttctcctaaagtcacatggtatcagagcaaggatccaaactctagttgtcgatctgatgttctcgccggcgcgccggcggcgggctcgccgtcggcgagccatcgtcttgtcctcttgtcaagtcgccatccgtcatcttcgtcaagttgcaggcacagcatcgtcgttcgtcgtctcatcaagtcgtcatccgccaagttgcaggcagcagccaggagcattgtccttgcctcgtccacatgcatccacgcgcatcggcgacggcaaccccgtccatgtcatcagcccagtcgtcccccagctgcggctcgtcgtcaatcgcaactccgtcctcgccggctgttgtggatctggctgtcgtcatcctcaccggtgcgcttcgcagggccaaccgtcgtcgttgtatgccctcattcgccgcatcaagttgacaagtcgtcgtcccacgcctgttgctcgtcgagcgtgtcatccgtcttcctcgtcgcaggtcgtcacctgcctgccactcgtcgcggtctccacatgccactgcctgttgccgccgctcgtcgttgcggccactgccgacagtagatcctttagtcttgagtgttgttgcctctaaaccaccaagtccaagttgcatacaaggtgttcgacaaaatgcttcaaagggttgctcacagtttcctgatcatacttttgctatctaaactcgtattatactgaaagtactcgtggtctttcattatcagctgctgctctctgctaccaaattggatagaatcggttaatctgcagttccttggcaaccaccattatatcttttgctagcatatcaatgtcatctacaaatcgattttctttgttttctatctagtgtatccattcaagttctgctgcagccacgagcctcttctcggcagttatcatccacctctgctctgctcattctctatccattgctttgcatgttgcgttgctttgaatttattttgggatatgcatcaatgtttgattattcatcaccttcatcttgtgccaccactattctccatcatcttcagactgttgtcctgagtcttgctttgtccaatgcacatgtggcttgttggtgattgattggttgtgccaccaggcacatcaattgttgctactgctgtggtatatcaatatccatgtgtcttttgctactaaattagtatcatttacaaatcaatttcctatgttatccattgaatccagcaaattccattgcatatccttcattttgtcaaagttgtgccagtccatctcttcattgtcatttcatcatgactagctccacagagttggccttcatcatatcaccagctccccatcggagttgatatcaacatcaatcaatgaaggaccgaagaacaatttgtgaaggtccttcatcatcaccatcgtcatcgtcatcaaatatgtggagatccgaagaacagtttgtgaagggccctccatcatcatccacgtctctgaatcaatgaagagccgaagaacggtttgtaaaggctttaaggtactgagaactgaagaacagtttttgaaggctccgaggtccacttcattgaggaagagatacatcttttcttcttcatcatccaagaattgacacacttcgacgacatcatcaagactttggagatagaccaatatttagcttgtgttctcatatttattttacactccaaatgcaatgtgtatacacattgcatttgagtgggggtgttaagatattaggggtagtttagtattttcgcatcacttgtatacatttatatttgccctttagggttagatcaatgttactgttgaatccccaaattcttctcctaaagtcacaatggccagcaccaccgttgccgccaccgtcgtcgcgagcaccgcggtcaccgcgtacctcgccacgcccagccacggcaacttggtgcgcttgccgtcgccacccatggtctgcactgtacactgtcaagcacacgcatcgcctatacttgtcgctagctttatatatgtgcaacacgttgatgcaatcgccaaatcgccattgtcaccgctatgtcatctctccaatgttcgatctctgcaggaggaagaacttgttctgctcacatgtcgtttctgtgactgtgatcgaattgacagtccacccactaatgcaatctgctaatcacgagctgtttctgcatgcaagaacttattctgctcacatacattgatttctcagcttaggatcagagtattggtcattactccacctcatggtcctaatcgaaattatacgcactgctaatatacagtaatggctttattcgttgtcgctttcatcgggagaggtccaaattttaaaagaaactccactactctttgagtcccactccgatatgctctctactggtagtagaaaataatctgaaccattaatttcatttgatcgaatggttcatatttatttctactaccacctcacttaatggtagttgaatcatagaagggtattattgtccagggaaaattatttacagaggggtataatcatcttttagactcactaacccaagctgccctctctcctcgcactcgccaccttagccgccctcgatgactcgtccgccctcgccgccttcgtctcactcgcctcttccgacgcctgcactgccgcctccaccaccgtccccgtcgagcattttgtttgcatcgtttctgacatacgaagctgcttgcatgccattgaaattgaacaggctaagggagagcttgctgaagaaaattgacagcagcaaaacctgacaacccattcattgcttagccctaactttctatctaaaatatagtatggtttgtactgtatcactgtcagtgcatttagcaaccatcgagcaagtctacagtaaaacgatctattatattattaaagaaatagaaaaaggagcctccacgttcgctctcatggcctagaaattctcacattaatcagagaaaaagaaaaagcagagtccatatagaaatacaatttacaaatagctgaaattcggaattaaaaaataaggaatattagaagaggggactagagtccatatagaaatacaatttacaaatagctgaaattcggaattaaaaaataaggaatattagaagaggagactagagtccatatagaaatacaattagaaaatacctgaaattcggaattaaaaataagaaatattagaagtagagtatagactccatatagaaatacaattaggaaataactgaaattcggaattaaaaataaggaatattagaagtagactatatagtccatatagaaatacaattaggaaaaaatagaaattcagaattaaatatataatttaaggaatagaaaaaggagcctccacgttcgctctcatggcctagaaattctcacattaatcggagaaaaagaaaatacagagtccatatagaaatacaatttaaaaatagctgaaattcggaattaaaaataagaaatattagaagaggagactagagtccatatagaaatacaatttagaaagaaatttggaattaaatatataattaaaggaatagaaaaaagaacctccaagttcgctctcatggtctagaaattctcacattaatcggagaaaaagaaaagacagagtccatatagaaatacaatttaaaaatagctgaaattcggaattaaaaaataaggaatattagaagaggagactagagtccatatagaaatacaatttagaaatagttgaaattcagaattaaaaaaaggaatattagaagaggagactagagtctgtctatatagaaatacaattaggaaataactgaaattcggaatgaaaaaaaggaatattagaagaggagactagagtccatatagaaatacaattaggaaataactgaaattcagaattaaaaaaaagaaatattagaagtagagtatagagttcatatagaaatacaattaggaaataactgaaattcggaattaaaaataaggaatattagaagtagagtatagagtacatatagaaatacaattaggaaataatataaattcggaattaaaaataaggaatattagaagtaaagtatagagtatatatagaaatacaatttagaaaaaaaatagaaattcggaattaaaaaaataaggaatattagaagtagagtatagagtccatataggaatttaaaactaactaaaatttggaataaacataataaaattaaaagtagagtttagagtctgtataaaaatacaatttacaaataactaaaattcaaaattaagaaaaacattggaagaagaatttaaggtcaatataggaatacaaatattggaatataatttagaagcaactgaaattcgaaattaaaaattaaagaatattgaaagatgagtttagagtccacatagaaatacaattagaaataataaaaattcataaataaaaataaataatattggaagaagagcatagactctatataaaaatacaatttacagaaaattcggaattaaaaaaagaaatattaaaagacgagtctagagtccatataggaatatatataatttacaaataactaaaatttgatattaaaaataattaataactaacacgtatataaaatataatataaatattacacattagtagttttgtaaagttattgcaaaatttaaaattatgttgtcattttaatatatttgaataatataatgagaaaacatatatactattatatgagagaaaatataatgatgctagccgcgcaatctgcgcgggccactatgcttgttttgctatataagagtatacaagggtgggatttcacttaaatatataagagtggcagcttagcagattgggatttcacttaaatatataagagtggcagcttagcagattgggatttcacttaaatatataagagtggcagcttgagggcaaaatatttacttcatgcaagcgatccaccagttactagcactgcaagttactagcatagtggtttgtaaaacgctctcgcatcgccctcccctaggggcagcacgggaggcatcgaaccccggccgccccctccccccatcttcctcctccgcctcgccgccgcctgagcggccgccggcaaagccgcgcggccacaaggacggcggcggcggggctcctcgttcctcgtcgagctcgcctcgtttcgggcggcaaggggagcagcccaggacggcggcgacggtgaccgctaaatccgcgccgcctcggccggatctggcggtgtggcagctggcggctggcggcggagacggagacggagacggcggcggggatggcgacggcgacggtagaggagcggctgggtcgacggcggcggggatggcagaggctgggtcgacgccggcggggatggcgacggtggcgacgtcggcagaggcgccggatccaggcgcactggaggcgggtccggccccccagcggcggatctggccacccggctgccggatcgggcgagctcgtggcgggggcagcagagctcgcgacgacgtggtggcggtagcaaggcgagctcggggcaggagcgcccgtcgcggcggcggcggcggcgtcagccgccggcaggagctcctggaggtggtgctgtcggcggcggtggccgccgacggcggacgcagtatcggcaacgtccacggcagctctcggccggatttgggtgtggccgagtggtggtcggctggcgacgtctgttggcgacagcggcggcggtgtggtcgtggcagttggcggcggcggttgctcgctgcttggtggtggagggcgacggcgcagcggcggtttgcggtggcggtggctcgtgtcggtggcagcggcgacggcggccgtgactgtggaggcggtggtgacgtcggcagcggggaagtagtcgggtgcgaggtgaggatggcgacggcgaggtggctgagcgttcggcagcagcggctgcggtggtggtgaccgtgtctgcggtcatcagaggcatggtggcctcagacggcttgccgagggcgtgggagatggctgcatctggctagcgcgacatcatttggtggagaggtcaaagaccggcttggcgcagagaagcgcagtcgatggcagcggaggtcggctcggcgcgagaggcacgggcagcggagatggaggccggcttggcgcgagaggcgcgtccggtggaggaggccggcttggcgcagagaagcacggccggcggtggaggaggcgacctaggtgtgaggaggagctgctggtgtgtatggagtggtcttcggcgcacgaaggctggccggcggggggtgccggtgcaggggtcctatatgtcggcagagctagtatggtggtggagcatcggtgcgctagccgtgggtccctttgttagtctagtggcggtcgatcccgcttagcggcggccggtccggtgctagccttctgctgggcttgtgtgttggcgatgtcggtgtgtgggtggtggtataattttttctttttcctggctacaaccctccagtgtcataatcttgtaatttttttctgttttatcaatagaactcgttaaaaaaaaagttacaagcatgattcttcagataagcccattcatctctgaaacggaatgccacacatgcagaagaatgcaacacataaattgtgacatactagctagggtattaatccatatccatatctgtaacgaagtgcttcatatctagaagaattcagatacatgcattggaccaaaatatcatatcggtcgccctgcacccctgtgaatgacaacccatgcgtgtatggctggttgacagcagcaaattagaagaggttttttaaagatgagatgacgaattcgaaaagggttgtacagtacagttaataggcaaacaaattaagttttatttcttcgtgcatatatatatatatatatatatatatatatatatatatatatatatacccacatggatggaagagtacatatcaaagcaaccgctaatctggctcatacatgacgccagccagctgatcttgtagcacgtgtacgcatacgcaaaaataaataggaggaatcaaattaaagacgcgagcgctcgagctttatgaaaattaaaaggtatcaccggagcaagagcagctccggcctgtagtagtagagtcccgatcgagacgtcgggggcggcggccggactcagcaggcggcatggcggaatccgacgagggcggcggggatgttgtagagcacctcgagcgtctgaagctggatgttgccgatgatcccggggacctggtcgttggggccggcggtgaaggcgaggcagccctggaagaggacgcccgacggatcgagctcgacggcggcgttcttgtcgaacacaagcgtgatcctcggcagcgcgaagctgcggacgccggccatgtcgtagcaggtgtcgagcgggcccttgggcggcgccggctggtacatcgccatccggtccctgaacgcctgcctcagcgcctggtacgccgtcggcggcagcctggtgatggcggtgcgggagtcgagcgcggcgccggcggcgaacacggtgggcggcacggcgatccgctgcccggcgacggcgatggcctcgaggcgcaccatgtagaacgtgggcgggatggccgggttcttgagcatcggcgtcagcacgtacctccaggcggccaccctcggcacgccgagggtgaagaatccccggcgcgtcggcggcgggaagcagtgggagaagacgcggccgtaggtcgccgccgtctgcgacaccagtgactccggcccgccgccgagtgccatgatcccggcggcgctgctgccgaagctgaagctgccctgcacgccgtggctgcagccgaactggaagctcctgactgcggtggcgggggtgatggtcagcaggtcggagatgtaggtgcccgccgtcgacgtgccgtcggggtaccggacgcggtactggcactggttattgttggtgcagccattggcgtaggggccgagctgggtgcacgtcggcgagttgcaggagaagacgccggacgacgacgacttggtggggtcgtagaggacgtccttttgcgggtagcacggcggcgtggggcacggcgagcactgcacccatgtcacgtcgctcgccgtgtccagcaccatcgtctgggtcactcccggcccgccgccgccgccgccggtggcggccggattcatcgcctgagatcggacagctagcatgtgagtacgttttaatatatttcgatccctcgaggagatgtccggtcacgttgttaatttgcatatcacttaaatggttatgaaaaagtaatttgacaagatgtattaacatgtaatatatcactgcacaaataatatgtaagatcaaattgaacttctacatcttaaaaaagaagtttttttaagaaccacagcagggaaagccaccaccgttaagattttattaatatataaaagaaaaaataaattataacatcagaatccagttctttactacatcttgatctctcatttaatctaaacaacaacaacaggaaatctcttcctcccttaagaagatacttccaggaagaaaaaggaaaattgtaaaaaaaaaaggttaaatttatttttttcgttactatacgtagaagttgaatttgaatttgataagcagcatgtacgtcaataatgtaataagttctagatctattattcttttcatcagatcaatcaataatgcataagaagttctagccaattttattaatattatatattgtgggtaattattaaccttttttaattatataaacttagctttctaattaattactagtaataggttaattattattattgttatataattattttacttctttttgcatatgtgtgggttaaataattttacctttgatgacattggtgcaggtgcagggtagtacgtgccatagttaagatctccttctatggactgctgttcgtagttagttgacaccggcacgtcgtcggccggctgcagcacgccggcgaccgagccggagagcctccactgtatgtagtcggcgcggtgctggtccgaccagagcatgccgtcgacggtggacggcgccgccctacccttcgccggcgaggagctgcacggcccgtacggtcggctcaacgggacccagttggtcacgttggggtgtgggctcactaacatccacgtacaacaattatatttattaatatgatatattaataataattattattaaatgccaaaataattcgtttcatttgttagagaggttatttaccaaggtaaacaaggaagaatatatagttaaaagttgcccaacgacggcaaagtctagtaaagagtcgagaagataaatgatttatatttataataggaggaaatagtataattgctctgacttaactacttattaaaaacgttcaagttttaatcttaggtactactacctctgtttcatatataaagtcgtttttattttttttctagtcaaagtttttttgtttgattaaatttgtaaaaggacgtagcaacatctacggtcccaaattagttttcaattaaatgtaacattgaatatattttgataatatatttgttttgtgttagaagtattgctaattttctataaatttggataaacttatatatgaaaaaattacggagagagtaggaagaagagagagaaaaattaagacggtactcaggctggagcagacggaatttggcttgagccagctgctggttagcaccacgatgtagttgacctcatctacacctgcactgtggtcagcgagagatgtagagccagagagcacaacaagaagcaacagtagcaacggcactagtgctgcacaagccattgccatagccgggccgctcctgtatttgtgctgtgctactgatgatgatgtgctgtgccaagtctagctagctccctgttcgactatatatagggggggggggggcattaaaggcattatatatatggcgtgcatgtggtacgtagggaataactttacaaaataatggagagttgttgttgatcatatctccaaggcagatgcttattattactctacttactaattactctctccatttcagaatataagtatctaactagatgggatactacaaatctagacaagctacctattcagattcataatattagaaaatattttatccgattttaaattcttatattttgggatgaagatagtaaagagttaacaatttttatctcttttttcatctcgtaagtcattttagctagtcttattctaagtcaaactcatttaacgatgaccgagatggttgatgaatacaacatctaaattaataaattaaataaatacactattaaaacatatatcatgcatggtgtgtttgtggaaatattttggcgttttatattggtgtattttttttataaactcgatcaaacctatattagttttattagaataaaactaatgacttaaattatgaaaatgagagagccatataatatgggtgctaatcttgaagcattaattgatatacgctcgaggaagcacccatatttatgtgtaatataaaaacttgcctttattaattgagccttttgatttaagaacatggagaagataattcttaaatagcactctagatgcttgattgcatggataattggacatattaagaagtaagatggagttataatcgtgatcgagttctcttatgaaggcgtcggcaaacggcaagcaaccaagattcctgaggtgctagctgccttccgaggtcataagagtaagaccctgtttggatctatagactaaattttagtcattgtcgtatcggttgttttgataataattagaagtattaaacgtagactaatgataaaacccattccataaccctaaactaattcgcaagatgaatctattgagtctaattaatctatgattagcctatgtgatgttacagtaaacatgtgctaattatggattaattaggcttaaaaaatttgtctcgcgaattagctctcatttatgcaattaattatattattagtctacatttaatacttctaattagtatccaaacatccgatgtgatagggactaaaatttagtccctggatccaaacaccacctaagttgtttttctaaacacgatacaacactacaagaaatatgaccttctgtgatgaatttctcgtgacatcggagctattagagacgcatgataggtgacggatgaattttcgtcacgcgagcgtcacatattacaaaacgtgacgaaattttatgttttttgatgtaaatgaagcgtcatctatcataagatttcttgtagtgaacacaagcggtcacaaatgtacgcacacccacgcttttgaatagtggcagcagtagaaatttttcaatgggggtacaaagattaaaaatataccgagccataactaaatatgatatactagtgggctacatacccaaatccggggcaggaaggagagcgccatgcacgcagagatgtcaacgccttcacaaacctacttcaaagattcggagatgctactggtctacgcacaaactttcaaaaatccttggtggcaccgattaggtgtgatgatcttgacatcgataacatcctggaggagtcgtaggttacacgtgcaactttcccactaaaatacctgggcctgccgttgatgctagggcggctgcacaaggttcacccacagcccctcttcgataagtcagcagggcgcatggcgggctggagagggaaaaacctgggtctggcaggaagaacaaccttggtcaaatcagtgctcacctcgcaaccggtttacctgctaacggctctcaaggtgaacaaggatccctcaaagtcctggataaacaacgcaagcgtttcctgtgggctggttctggtgatattattggaggcaaatgcaaagtcaactgggagaagatctgctcaccgacggtgaatggaggtttgggaatcctgaatcttgacaagttcacaagggctctaagactccgttggttttggcatgagtgaaagtcaccagaaaaagcgtgggcggggatggagacaccgtgtgaccagaacgataaactcctattcgcgtctgctttgaaaattaagattggtaatggagacacaataaaattctgggacaacgcatggcttgatgggcgctggccgaaggatgtggcaccactcgtgttctcgatatctaggcggaagaaccgctcactcgcgcaggcaatcgaaagcggccagtggctagatgaccaagccttacccatcaatgatggaatgacaattgagctcctgaaccagcttgtcactctctggacgacaatccaacaggtcacactttccccggatgaagacaacaaaatcacttggaagctcacgtgtcatggagaatacacaacgtcctcaacctacaaggcacaattcttcggatcgctcaaaacaaactttgaaaccttaatctggaaagtatgggcaccgtgcaaatgcaaaatctttgcatggctaatcattcaaaatagaatctagacgtccgacagattggcgacccggggatggcagaacaacgatgtttgcccgctatgccgacacactaatgagaccgctattcacctgctggcagactgcagatacaccaagaaaatatgggatgccattgtcaaccggttagcctgtgcgcccatggcgccgacaaattgggcacaggcgagcgtggttcacgaatggtgggaatctctcgccacatgccaagggttaccaaagctggggaccagatccctaattctcctaatctcttgggaaatttggaacgagcaaaatcgccgaatcttccgaaacaaggagctaagcacggcgcccctcaccgcaaagattaaagaagagtaaaaaacctgggctacggcgggaaccaaacgcctagcagagatgttaccttagtgcctattcggtctttgtaaatattacttttactccttacatgtaaatattgctccctgctttattcaataaatggcaagctttgccgttgttaaaaaaatgatatactagtacagaacaaagcatcctgaacaacccatctatgacggcagtcagcagcccgttatagaggcactcatttatgacgggccaaaaaaatccctcttgaatattggtcctcatggccaaacccgtcaccgatgacccctcatctttgacgagttgaatttgcagcccgacacaggacatctgtgacgggcctcaaccaaaccccatcaccgatgaggggtcaacggtgacgggtgcaagctattcgtccgttaccacctaagttgaattagctctaagttgaggggtcatcgatgatgggcttcatttaaggaacgggttttagatatatatcgttagagatgaaaaatcacatctaactggtttgatttttaacctgtcactgatacgacggtcagccgatcaagatcaagatggagacagtgcgccttatctattcgagagtctttttttttacggttaaaacagcaggagaggctcgtactgcacattttattaaaagagccaatatacgaggggaaactgtacaggggtacaacaagagggaaaaaagaaagaagaaaaagactgcctgaaaggcaagctaattaagatatgctattaatccatgattgccacaaaggtttttctgtttcctttacactatgcatatgcagagtaaactcatccttgaaatcagccttccatttgccaaagtttgcttgaataccattgaagatcaagtcatttcgtctactccagagatgccagcaacagattgccaaaacttccataaagaagggatgagggaagttcctattcgctgcaatgatcatgttcatgaaattcaggtttagatcccaatttataccgaggatatgccaacattgctgggcaaaggggcagacgaagaagagatgaagagagtcttctgtgattgagttgttgcatgtaacacatgtagctccaccttgggtattgaaatgttttcattacagcaactctttagtgtttaatctgtccaataagaataaccaaagaaacactttgaacttgagtgtgcatttgcttttctagatgagagttaagggaatttcaggttgaatatgagtaaaaaacatgtcataaactcttttcgattgatattgaggtgagttccagatgtatgtccattgatcttccatatgatttaaatttaaggtttgcacagtgctggaaagaaggtgccattcctgaattgcttggatggggagtggagtataaaatacctcttctaagtgactcagagattgaaaacctttgacacagatgtccttatttttagcaaatgagaatagggtgctcgatcatcatgtaaaaaactccctgaccaattatccttccagaaaagcgttgtcaccaagcccaacatgtaccaaagaaatggctctacaaattggaatcaatctgaaaacatccttccaccaaaaggatcccttttccacatgagcatgcggaggcagagcagagtttcacttaacacgagtgctcatatttacggctagtttcttttagttgtcccaatatacccgtcgacagcgagacacctgtgtgcacgttgtgagcgcgtacgtttgtactctgtttctaaaataaaacctttcgaagatgatgctaaagtaaaacaaatgttccccattcattttatattataagtcactttaggtttgtcctaaatcaaacctctgtttctaaaataaaaccttttgaagacgatgctaaaataaaacaaatattcccctttcattttatattataagtcactttaggtttgtcctaaatcaaacctctttgagtttaaccaaattaaaaaaaatatagcaatattttaacccaaaataaatataccataaaaacatattgaatgatggatttgattaaattaattcgatgttgtagatttatgtgtgtgtatccgtctcacgaaaagctcaaagtaaagtattgcgaaggacaaggacagatcatttgcctctccacgtgcatgctaaagcaaagtatagtgctccctccctttcagattacgacgttttaactttgattaaagttaaactgttttaagtttaactaagtttatagacaaatatagtaatatttataatactaaattagtttcatcaaatcaataattaattgaatatattttcataataaatttggtcaaacttaaaacagtttgactttaaccaaaattaaaacatcttgtaacctgaaactgagagagagagtacatgtaaatactaataccattaatacccgacttagctctttctctaacaaaatttgttcgagctcgtgttgtagctagctggctctatatctatagcacatttaatttctctctcctccaattaaacacaaatataatttggtggcttttgcttaactccagtactcctcctagctaggtgcttggcatcaatcgagatcttgctttattagatatgccgccaatcatgcatgcttaagcttctttttgtacagaaatatatagatgcttgagctttggaagctactacatcgtccttaattattaatttggaccacaaaaagcacgtgtgaatattaacacgttgtctgtcttaatttagggatgcttgatgctttttatacatatatatagtttctcaggagaggccagctattcatgcaacaactcgatctcagtacaactggcttacaccttgtttgctttttcaacactgatcaaaggaaaaggtttaaacttggtgaaagaaaaagagcatcgatcacgtgtgttgtattatactgtagtgatctgtaagtatgtatttatatattgtcaaaagctgaatttctttttcttacgaatacttagttatgaaattcattgatcgtttcaagattagagagatacgtacacagctacgcaatatacaatattaatacgaaagtactgattaattaagtccatgtctgatcttcggctcgattagatcagtggcggagccaggatttcaaagttgggtattcccgtctaagcgttgagccgttgcccgtccctgccccttgcggccgccggccatccaaccgacctgaccgccttagcttggcggagtgtcgggcgccgcccgccgcggcaatggcctccccctccgcggtagcacagtccagctcccgccgccgattgccgtctcgccgcgccgccacctagggtttgcaaatggggagtggcgcgagggagccgagccaaggagggatgggtcacggagggagagcgagagggggctgtctgaaagagtgctagctaagtgggtcaactgatgtttgatgggtcatgacggagtaggtcgggttggttggaggcatcgcaagagaccagttgtgctatgtttggatcaaagagttgaggatttaggtgtacaaatatgtgtacatgtgtatatactagaagtatacttgttttctgataaaaaatgttgggtattcccgggaatacccgggaatcacggtggctccgccactggattagatcagtccccttttgcctcacgtcgcgtaatattgcacatctggtttcacgtacacgatactgtggataacttgtgttgcactcttggcatgccttgagtcaccggccggccttgatccacaccaggggcggatccagaaacaaaaagttggggggactcaacataccgagtacattgatataaacacataatctcagtattaaactatgctaaaatgctattataagacctttagcacctcctatcttatcaactatgatgaaaaaattgaagggagggcttaggggggtatccatgggttttgtgggtg

SEQ ID NO: 58674 - DNA, 13372 bp, Oryza sativa
gtcttcttagctgctccaccgttcacaatagcaatgtctccatcttttgctccatcaaaatccactgcacatttgtaacctgatgatgtctcatctttacttaatgggcggcaacgacagaaaaccctgatatttcctggaatggcatgtacagccagtcagtagaaagaaaataattatatatggcagactagaaaaaaaatgtgaaagcaccataatacagaggagaagatcagaagaggcaggcacctttggtctcctcaacaatattatgaagtttctttctcttggccatctcttcatagtacttcagtttaagatcttcacactgtgcaactgcagcagaaaaaaaatgcttacaaactttttcattttaaatgctctgaaacctttacaacaatgcaactgatggatattacctaatgtttgaacagctcctatcatcttactcagatcaggaacagcgtttgcacagtcatgtgcttcaagagataacagtgtttgctcttgtttcatagcctgaaaattaataagtgatataatcagtaaaacttggcacgtattgtatttatcaattcttgttgtagcattgcagacagtaaatctgcttttaccttgattttattttccaagttagatatggcagctgcccataatttcttggcattttcatacttctgggaaacacttctcagttgatcagcttgtctatcaacgacttgttctgtcaggaatgtagaacagcggtgagcatatataaacatttaggaaacaaagttgattatcctgatagcttagttcataccaatattatcactttgcatgaccttctgatgaagctctatcttaagtctctcaagctcctgattggtagattccactgaagaccacgccatataacattcatcagacttcatgttgcactggttggttagctcctcaatctgtttctcatactttgagattaatttacttgtcctggtctgcattgtagattgatatgtatcagtattacaccaaatatgattctgtaactgtttgtgaaaatactgacctgtaaaggtgaattccctgtatgagctgaacatcttttgcataagacattcccttctgtaaccatgtctgtcactgcaagttcatgattaaggttatcatgctgaaaattagaccttgaaggagcaagttgcatctaatatcaatgtcttacctgccattgctaccctttttcgaatacagatgccacaaaccatgggacttccccttactcctttgaagtttatgacaatggcactgtcactctcaactgtcactctaatatcacgcacctgaaggggtctgttacctccaaccaccgcgtacacatcaagttcagacaaaatctgcacatcaatcaaaagtcaaattgtttagctagacatgaaaataaatcgtgatacaaaactaagagtcacatgagtcagtgtgtttgccttttcttcttggacaaggacatcaaatgctctaattccttttggcccataagtgttcactatctcagcaaaatgcagatctaagaaatagtctccaggagcaagaccatcgattttgtagctgaaatttccatatcgagctgagtggtaaagtgaaggatagtcaccaccttcaactatatcctcagatgtctctattgcatcccctccttcaaagaaagaatcctcagaaagctttgaagagggttcacaaccttcagttgcactgccaccggcattaatgaacagaacagagtcatctgtttcatcacaggcacaagaaggataataagaagcactgtggaactacgatgacatgaccaattaacatttcgacaaggtacttccaattttcaatttagaattcaagattatgaaatatccattttgaaagcacatgactgatgatggctatcgaagccccttctacttgatattactacagcaccacagtcgatgcaaccttgtactctgacatagaaacaatcttattttcttcaaccaatccaatgcccatgactttagtactacatgatgtattattcattcactctgagagtatcaaatgtggccagcacactgatccacttgaaaataggctaacatggcagagaatcaagtcaatgaagaacccacaattttaagcagagaaacagtactctatcaaatattcaaatatactccaaagagcctaaatcgacgcacaaaaactagagcattatgtgaatgattccacacatagctgattcctgttacatggagaaccttattaagctcctagcacagcacaacacctgaaggcctcaaaattgggattgcaactttgataccaacacaggtaacacaccagaaaatcccaaatctgggcacatccagcctcctaaatttcctcctccacacgcacacgtgcacacacacaagaaaaaataagagcaaatttggaagcatactttctagggttttctgcccgagccaaatcgagtactctaattcgaccatcctatacgctcatatcccaagaacccccacgcggagttgagagaaacctaagcacaagatctgcaccctggaaatctaatcacaaaccaaagggggaaaaaaccacctgcacggcagtcgccccgcatcagcccggacagaaccacgcgtggcccgggcaccaggatcatggactccgccgcctcctgcggcgaaggggccggcggtgcgggcgcgggcgccgactccgcctcatcgtcgtcggcggccgccttctcccagcccgtggtccacgagaagtccatgggggtgggctcccccgggcaccgctcctcctcgccttccatcggatccgcgagttgctgctgctgctgcttcggctgcggcggcggcggcgagcgagcgagctaggctagggtggcgatttggttgggggagagatggatggaaatggggatcgatttggtgtgcttcttcttcttgttgcctctttgtgccccgcggtccgaattcgaactgcggatagcaacggcgaccgttgtgtgcttttgtttgtgtgtgggcatcctaccgttgcatacggtgcgctgcgcgggccggcctacccgcacatatgaggcccaattaatctgcttttcaccggatgtaataagtctattttgtgctcctcgttttcttgctcgtgattgaatcgtttccctcacaaccgcaataccaggtataacatcttcattttcgaaaactggtgtaaatcgcctcctttgatgatttgagaagtggttttttttctgatgtagcaagttgactacacttgactcgtttagatgtgaggagaaagatgagatgaggtgaaggtcactaacatgtgggtcccacccaacttgtcacgtcaacataaaccatttcctaatccattgaaggaggtgatttatgccggtttatgaagatggaggagggtgttataccgcgtttggttgaggaagatgaatcagtcaggagcaaggcatgacggactcgaatagacttatacctcgccatattggatggcccaagaggccaagattgcccacggggctcatctttttggcccaacaaaatgtgcacatttgctcatctctccttaataaggccacgttcttcggcttggtttggaagaaaatttttcataattaaatattaacaaatataaacttgaaaaagggttaagttgctttttaaaacaacttatatataaatttttttttgcaaaaaacatcatttaacaatttaaaaaaacgtgctaacaggaccttagtagctgcatgtctttttctacttgtaacatacaaattgatgaataaccactctacctaaaattccaaaaggtacatttttaaataaaattttctatatacgtttttttattaaaaactattttaaatatatttttcttaattaattcatttgtaccaaaggttgtgggtcttatatatagacaaggccaggatgtaaaatattttcattatttaaaaaaacaatttttattattcaatgattcattcagctatttaatcatttatttacatacgtagacatggatttctgcacacgacgcacgaacggaaccacacctctgttgccatgttgattgctcacggctattgcagtgtgtgttctcacgctgcctacttttatattggcagatgagtttagagtttactccagactttagagtgatgctgtacagccagtactttatgcagaatccaatcatcagagaatggaccaaatttgatcagaggcagctatccttcgaaagcataaagggaaggctagctacaaatcacacttgtcatttgccaagttggtagctgtcacatacttataatgtaggagtacgtactcctaggcctaggtaagtgatcgatgccggcagatggagtgaatgtgattttttttttctctgaaagaataattagggattcttttgaaacgtagcattgaaaaaacgaagaaataaaacatacgagatatcaattaaaatgcaagtgcaaattacagaattgcataacgcacgaaaaaaatatacaggagcaatagtttgagtagaccgcagaaaaaatacaagaatcacttgaaagagatagactcaatggatttttcccaagagtttggaactttgactaacttccttcaaaatatgcattattccatgaatttttggaggaaatgataggatttactcctttgttttaaattccttcctagatttttttgctataggattagaattcaccaaaattcctatgattttcatacaaatcaaaagaggtccttaatctgcaaaccattatactaccttttatgtgaaaattatctacctttctgtgaacaattccaatgatttttggattgtgtgcctcaccacataggagtagaaagtagctgacgatgacatcatgttatctatcaggaaatgcaagttccgtaaagaaagctaagcacatcgtttttgttttgttctcgtatgtggaggtgacctcttctctccttcgacgtaattaccattgtctatgcgagtgacgaacaattactttgtaatgtcctagataagtagagtcactgtcatggcgcatgcagttgcagtgtagattgccattgacgccgtataaaaatacaatcaaccacgcttccatcactcgtggcatcgactcatcagcccccagaatcaaacccagtaaaaaaaaactggattaagctcgatggattagatgattaacatggccatcagtaaaaaagttaaaaaaaataaagatgaacacgaccgataggataggcattaggcagaatgtatccatctatccatcgtccactcgtgacaatgacagcccaaactaaaaaaaggcacaaaactgaagaagaagaagaagaagaagaagaagaggaggaggaggaggagatcagagacatgaggcatcatcttttcgcttatgtttatacttattagcaaaatttgaattttttaactttaagtttgaagttaattttaaattttttttcatcataatttattttttgggttttgcttttagaacgttaaacatgtatataaaagtttttttttcagcaaatacgccgtcgatgggctgcagagttgcaaaaaaggactagacacggaagcacacagaaaaatacactgcaaacttgagaggaggctgaaatcgagatgcagacaagcacagcattgggatctgaatttctgaacttctgacgagagcacacgagccgtcaattgacacgcaacttgtcgacaaaaaaaaatactcctcctccctccactgatgcaatacgtacgtgcaccaccaacccaccaatgcgtttgcaacggagaggaaaagaaagctagtagaactagtagaatgattggaatatactcctacctgagctgagctgagctgaatggcctattgggttccatgttactgccatgtttaattaagatttaagagtagagaaatggagagagatcagggaactgaatcctgattgaatgaataagtacaaaagttagctgcatcatgcatgcaatggcaaatgcaatgctggtgctaaacaaccacctagctacagatgctgccagattatagctaaacaaccacctagccccatgtcaagatcatagcttgtttagtggcaatgaaccaagttttatcatagagtatgaacacactatgttagtatatttatgacgtaacgactttacactaaactagtagagaatatacggcgcattttattttattttattttatcggtattgttcgtgcggttgctcttgatcccaatcattcggttgtcgataaagaattcggagatgtttgatctctaattcccagagaccaatcaaattgaatgaactaatgaattcaattcaggtgttgagacattcataaatgaaatgacaaagtttttttttttagtcacaccggaaaactgatgatgagaaatggctaatcaagatatgatgatggcgatgggatgctttggattcttcagaggtcgaggaatccggtctgccggagcacggcgttgcggacgcggcggaggtcgcgccccttgagcgtcctcccggcgccctccagcaccgacgacgaccgcgcgtgccgccgcgccgccaccacgtgcggcggcaccatctcgtcgtcctcgttgtcgtcggactcctcgccgccgacgacgttgttggcggcggcgcccttgcccggccacatcgggaccctcaccggtgccgaccgcctcggtgccgcggcgcctccacccggcgccgccgcggccctcacgggcacggccactccatcctgacgcccgtcgtcgctgccgccgccgcgccccccgttggcgagcagcgacgacagcccgaagctctgcggcaccgtgtgggcgcggcggggcgcgcgcggtgggccctccgggtgtggcggcgccgggcagcagtaaccgtcgtccccgacaccgccggccggccacaccacgtcgctctcgtcgagctcgaacggcggcgccgcgccgtcgggccccgactccggctgcttcaggaggccaagaaaccggagcgagcccgcgcccggcgaccgcggcatcgccatcgccccccacggagcagccacggatcaatcctttggctctgatctccccttcgccgtcgacggctgcggcggcggcggcgaccagcgattgcaacgaggtgtttgtgttggtttcggatgccgcgaggtgcgcgttatatacaggggagagaggaaggggaggaggagggggcgatgatgagtcactggaggtggggcccacactgtgggggaatctccagatagatgcagtgggattcctgtgtggttttggaatgctacagcaaacacaagaactgatccttcccgtggttaattcgggggcgctttgcgctttgctttactgtactattcctagttcatacgccctccgtttcattaaaaaaatactctaattctagacaatataatacaatgaatctagacaacacaatctaacgcaatgaatctggacaatctatctaattttgttgtagattatgtcaaatccaattgtagattgtttttattttttaaaacgaagagagttgggagtagtgtgacgagctagctgtttcccatgacgaaatggcgtaaaatgctttataggataggtgttcgtttgcggattgatgtatctgattccgcatcaccgtgatcccgtgatactattcttttcaatcaggatcactcataatggttactaagtactacctttgcgagtttggatctgttttaaggcatttgttggggagtgtcttataaagcgaaaatagttttagaacaaaacttgtttgtccagttttattatactaaaatgtgccacatccactcattatctcttgtattatgggacagagagagtatataacaagtaaagatgaagaattaaggagtctatctagaccatccaattaccaaccaatgtctaggattcattgaaccttccctgctagcctcatcaagaaccaaactcgatcagctgcgagctgttagtatatatgaacaattgagaggacctgcgagactgtgaggtcgccgtcgatggcggtcactgggagtgactcaggtggtgctctaagagattgtcatttaattgatctcttttggatgatttagatgggtctactgttaaaattgttgagctatagcgactacaccatttattgtatcgtcctctctacatttttctctagtaacgaagatatttactagccagtggaagtttcagtgtgaatagctaggcgaattgtttaaaatgaaatccacatgatgtttactttaagactgtgattaatgctcaaagagccaacgtacagtgaagtatactgttttactgagaaaaaaaaatattgggtgcaacgtactagcagtagcttgacgatgatggatgcatggtgacaccggccgggtcaattcagaggttttcttgcctgcggttaagacgagagtaattgggggagtagaagacaagatgtggtggctaacaagtaaccaggggctactgtttcagttcgatggtgatagtggcctatatggaacgttccaaaccatctttcgaccgtgcagtgtacctggcatatatgtttattctttgtaatcaagagatagtcatatagcgcgtatcttgtacaattgcgagccggaaattaattacttatttggtcgaagagataaatacgagcttacgaggtgacactcaaacgtactacaccttttatgcgtggttgatgtgcagcacacgagaaaactgcgttctcgtggtgaattagacgcggaaagctagctagggcagttaattggttgtatacaccatccgtttcaaaaaaaaattaatataatactctctccgtgataaaatataaaatatagtactccctccgtttctaaatatttggtaacgttgactttttaagtacatgtttaaccgtttgtcttattcaaaaatttttgtgaaatatgtaaaactatatgtatacatatatatttaacaataaatcaaatgataggaaaagaattaataattacttaattttttttaataagagaaatgatcaaacatattttaaaaaaattaacggcgttaaatatttagaaacggagggagtaagagattttagggaaatgtaacttatcatagtctatccagattcatatatcatatccatctaaaatcccttatattaaacatgacacgttctaatcgtggttattatgctaaatattgctttatgttacccgcgcgtgtgtgcgcgaggcgtgaatgaatgattggtggcgcgcgggtggtggccggcgccgatcattgggcgctgggcgacacgtacgacagattgatgattttacaacgtgaccccggccgcctgcctgcgggatgtgcggcccacccccgcacgtacgtacggttaatttgcgcgatcgagcggcgggggcacacacgaccagacacgcacgccgtgtgctcggcgatcccaagcgcgcaccgatcgatccgcgcacgtcgcgcggccgcggagattcactgtgccgatcgatccaccgcgggtggcggggtccggggccatggccagcgcctcacacgaacccagcacagtaccaatccttgcatgattgcgcgtgcatgaacgccacagttgtaacagatgaaaggacagcagatgagagaaccttttttttcctgggaactaatacattcgttccaaaatatagcaacgtataatataataagactcatcataatattatgatattacgaatctagatatatatccatctatcgattctagaactataaatttaaatataagacatgtttctatgagtaaattgttacattttgagaggggagttagcatacggtcctcgctcactctcctctccgccgtgtttgtagcagtagcactacactgcggccactccgtgcaaagcttgtccgacgtgaaaagatgggagaaactaccctacaaaggctgacgcgagagggcctttcgggcggcagctagcattgccggttttgtgcacgcacggccacggtcatacacattgctgccaacctggatggattttctctcactgtgcacagcacagcaaacaccacactggctctcagtctcagcagccttgtagtactactgtcacagatctcacaagcacagcttctttgtcgttgtcgaccagaagcatccacacgaagaaattttcaaattagtagtaactgagccatgtccggcggcattttacgttatagtaagacctagtattactaccggtgataggactaattaaagattgttcttagattaccctgagaatgagagaggcttggagatggaacctgcctagccaatggcccatgctagtgctacctacaccaagtcaccaacaaagatggaagagatccgtgactagaaacgaccccacgttaacctacgcatcactgtgccatcccctgaatcgggaaagatgcactgcactgccactaactacggcaccactatacgcgagtcatcagcgagtgagagtgacagtgtactactggtagggcagggacctcctccaattaggcgactaatagaaacaaaagtgctaatgctactactagtacgagttttgttgtgtgatgagtagtactgatgtggccaacacgtcggtcccgcctccccctgcactgcatgggaacatatactatcgtgtggtgtggtgtggctggagatggaggtgtcgcgtcatgtcagcttcgccttcacacacgcgccgcaagacgccagtcgggcgcgttgcatcacttgtcatcgccggctcacaggctttcctgcctggatgcagctttggctcggctgtgtatgcaaaggcgattttacatcgatcgatcttcacgggaaaagccatgttagtagcagtacagtacgtcacggcgtcagatgcatcaccgggggattgagatcttgagatcgatgtaaaactgcccagttgcggaggtcagatatcaggaatgaaactactcctattttgattcggcggctatctggaaaaaacatactccaacatcgcaggtgtcgttaggaaccattattcagcaccagtcctccgaaacgatgtaaataatgagtttatggaagaagggacaactgttttacttgggcttacgacctcgatgcccgcatggttcactcgataaacttgagatacagtgcaaggaattcaatcatttgaactagatgacaatcgatactcatctcatctagtataatgtagtcgtacttcaatgacattgacatgttttacacatacaaagatacaaaaaatgtgtcggacgtagcctatgattggtactttggtagggacctacagatcaacttgtactctacagatgcgagataaggaagaaaacactcggagcaatcaagctgattaaaagaatatgggtggttaaaatggacatatctgttgctcgacgcactcgtacatacaacaatagatcaaccagtaatgatacctgccaatacatcactttttcctcgtgcaaatatggtgtacactaagcgtatagcatctaaccaaccatcaagagactcccaggtatcagcaacctgaaaaacgagttaaaaatcacaggctgagaattgaggtgataatgacagagggagggcctagggaggagcaacaagaataaacagtgccctgaaatgtcaagaaggcggtacagtacatgtaaacttaactcctgaacaacaagcatcaaatgagtatgtacttaccaagaacaaaggcccgtgaattgtttctatacaaaggccagcaccaggtggcagtgttagatcggagcatgcagacactgaaacgatatcttcaacagctactttaatatattttttgcttctccccatatgtccaaggggtttgctagaagggctttcagaggcatcgacctaacatttgcaacaaaaataatgagactcaaatcctggtgaaatgcacatgggtagaaacatctccggctaaaagaaaccgtctgaaaactccaggtactctagaagtatgctcatgttaaagtagaagaacttacctgctggagtccctcatggtttaagacaaattctgacctttcccaatgtttatgtggtgcaatggtgttgtctgctggaggagcagttagatacccagcttttagatatggtaaaggtagctgcaaagcatagcataacaataagtatgccaaccacagaataatttaagacatgcagattacctggtgtatgaataattgaatagttgctgaaaattcaaaacgagataaaataaaaatgataaaaaaccaagctagtgataaaactaggacatatatacatatcacttaaacactgaggacacacaagttcacaatctttaccctaattttctcgatcatattaattgttccggtgcatttcaatatacgattttgtttccttgtgaatcatcatttgtactcaataaaaaaaccaattacatttaaaaaacgaagtccaatacaggagatgaattgcttaaagacaaacttcaaacaaagaaatactgaaagcatagagcatgctaacataccattgatcgaaccagacgtagagcactgcgataaacctgcattatccacaacaacatttcagtacatctacataacgcctaaagattcatgaaatgtcctatggaatttcaagcttataaccacatcatgatgcgaggcataaaatgctaactctgccaaaatagtcagttcactcatccaagtaacatggaaatgctactataagataatatcaaaacccacaaactgctgaaagctagcagaatatacatacaggaaagagaaaaatattgctgaattaacaaacgtttctacaatactgaatcgtatttgttgaattaaaatatcacttcagtgacttcagttaagcaggaagaatacaatgactgactgactatgaaactcttcttgctttgttttcacatctctaccttccagggcatcccaataaggaaatttaaaggcagagtagtcaaagagaggaaaaacacatactgaataatttggcttcaatgcatgagcagctgcgacataaatggcggactgactgtacaagtcatttggagagacatctggacctgcagacctcattgtatcctctgctaacccatactgtgacatcaaatatatgaaagttggtgaattgttgttagcaaaaaatgcagtcagctagcatgtacgaatattgacaaagtgctgtaaaaaaacataccaggacagttccaagattgtaaatagcccgg

SEQ ID NO: 58675 - DNA, 57738 bp, Oryza sativa
ctccttccgttttactgtctccgtcccatactacttctcactttgagtttttttttaaactacgcagtacaatacaaatactcacaacacacgcgctcacccttataaatacacacacgcaaactctaccctatttgagtttttggttgtactccctccatcccataatataagggattgtgagtttttgcttgtaacgtttgaccactcgtcttattcaaaaaattttgaaattattatttattttatttgtgacttactttattatctacagtacttcaagcacaacttttagttttttatatttgcaaaaaaattttgaataagacgagtgctcaaacgttgcaagaaaaaactcaaaatcccttatattgtgggacgaagggagtaattatttgatcattcgtcttatttacaaaattttagaattattatttattttatttgtgacttgttttattatcaaatatactctaagtatgacttatcattttttatatttgtattatttttataaataaaacgaatggtcaaacgttgtaagtaaaaagtcaaagcgacaattaatataggacggaggtagtatattccaagttgtttgattttttttcaaaatttttagtttaattaaatttataaaaataagtaatataatagtatttttcaatattaaacatattatcaaaatatattataaaactaatttaatattgtaaatattctattaaaaaatatgaaaacaaaaaaaacctaatactaatactagctcgagctccgttgcatcaggtgttcagaaccacccgtgggccatgggcccgaggcccatcctgctagccggaataagtccactttaactcccttaactaatgatcaaatctgattcggatctttcaactgcaatactggatatttctaccactcaactgttccacgcacaaaataggagagcccatcacagtcacgcaaaattggtgggcaagaaagaaaagaaacaacttctgcttcactctcgtgaaacaaaaataggagtagtgtagaatgtgtgcatgggaatagagtgaaaactatatgatccgctagcgcacatattggcaattagcatgactggttcggttactgcctcctatgaatacgtaataggttaacatttcagatgtataatatggtttatagttactagtttacacgttctttcaatatctcaactccttttctattttatgtgacttgtttatatgagatagtggagtaaaccagagagccattattagaaggagcgatacagcaacactgaatttaatgctcacatctaaacggcacgagcaagattataaatagtaataagaaaagaattggttttaaaaaatactcggcacgatcaggtggtttatgaactggagcagcagcagctcctcttccctaccagcggcagcttgttagcagcagctcatcttccctaccagcggcagcttgttctgcatcacgggcgcttccttcagaaggaggagctgcctcaacctcaacaacgtgatttcaggcgccatcatgctcccgaagatgtggctcaagaacctcatcatgctcgcctacgtctcggcgatcaggctcgtctcttcggtcgcactgacggcgccgctagtctgggccggcatggccgatatgtgcttccacatggcgggcagcagcctgttgaacatgaaccgggttgcccatcgccctcatcctctacttcctctgcttcgccggccatggcttcttcctgacagtgtactcctcgatgaagtccaagaaggattttcccaaaatacacttattaaaatttatttatgtgttgttgatggtaagtttactaaaatttgtgataacaattaacaatgtaaatttagaattatggttaatgaaaaatgaaaagtcaatggtgaaattaaattagcaaccggtttggtaagaatacaaacagattgtttttttattatatgcgtgcatggaagacgcacacactcataattattttttacaactcgtatatcactaatcatgcacaacatactcgcacacctcctaatcatcatcgctactacgttctcattatactcaccactgcatggccctcatatgttttgttggcgctcccatcatataccaggtctatatacatcgtgcagataaaatttaagctaataaggttattttgatcgtccaattaaaagtaaaaattaggatcagacgaaatcaacattaaaataacttattttattaaaataagttgtaccatcccttaaaaaaagttgtactacttataaattttgtaaagttattttacactgatagagaatggcgagtgcaatacgaaattaatgccaagtgcaacatacacaatttagcattaatatttttttgcattatgacgaaatgcgcatccgcaaaattcgcccccaaattgcacaccacccccgaaaccctagaatccatcgggaggtaaaagggaaagatgggtacgagaatggggaaactcaccatcaacgccacaagtctccacccaacggcgcaagggactccgcggggggagccctcgccggggccggagtagtcacaactgacgatccaggggggtgagtatagacctcgcacccggctcgggagagggccgctcctggggaagttgaaggatatggcttgcgctggggtcgggagaggagggaaggaggggaaggggaggatcaccggaatcttcgccagcggggggaggaggggaaagtgggtgtgggagggggggattgctggcggcgtcgccctcgcacgaatcgcggggaaagggaggagaggagggggtggggaatgatgggacggatccgtgaaatgttcgacgtggtgtggtgcggtagcgtaactgtgggcgatgggaaggcggggtaatttcgggcaaaagggtcgcgcccgcgcagggccgtacgtacacgagtgcgtgtaggtgtagggccgttagaggttgaccaccacgacatgcataaatatgctccggctgtgttcgggaggtgaggttggcaactcacacaaccttacctctcacgcacgcaaaacggtgcgacgtgttttcttatgcttaattaaggatttacttattttttttaaaaaaaatattaatatggttttttaaagcaacttttcaatataacttttttgaaaaaaaacacaccgtttagcagtttaaaaaatatgcacgcgaaaaacgaggaaggtgagttgggaaagtttgcggaaattaaccgtgtgctacccgccactcgctccgttttatattacaaatcgtttgatttttatccaatgagtaatatgtaatactgtagtatttttaatataaaataaacatattatcaaaatatattaataaaactaatttgatatggtaaatatcttattaaaaatatgaaaaaaaatcctagtactgataatagctcgagctcctttgcataaggagtcaggaccccgcgggctgtggacccgaggcccatcctgatagccaaagcacgaaataggagagtccatcacagacacgcaaagttggtgggcagcttcactctcgtgaaagaaaattaggttattgacagtgtggaatgtgtgcgtaggaaaatggtgaaaactatatgatccgctagcgcactattggccattggtatggctggttaggttactgcctcctataagagcaggtataataggaggttataagtcagttataaacatattttaaagagataaaataggagagagaagagcagcgggctacagatctgtagacagctccagcacggacttcaagacataatgtgtgtatataatgtgtgtatgacaggtgggatcaggtattaatagtatagtaagcactattgtatgaatcgactattaaggacctgtttggcatagctccaactcctaaatattgctccaggagttgagtctggagtggagttgtgaacctgcctaacccagctccacaactctagtacattttgtgagagagctctacccaactccactcctagttttggtggagctaaaactgtttggctgagctccagctctaggaggggtggagctggagctggagctatgccaaacaggccctaaattggctatagataaattggagcttgttgttggctatactattaaacttgctctaaatacgttacatgttaacatgtaagatgtataatatggtttatagttattagtagtagtttacaatttctttcaatatctctcaacttcttttccattttatgtgatttatttttatgagatagtggagtaaaccaaataaccatgattaaaaggagcgatacaatatcactaaatttgaagctcacatctaaaaggtgcaagcaaggttataaataataataagaaaatgattggtattaaattatactagtaagaagatatatggcacgatgaggtggtttacgatatggagcagcagccactcctctttactagcgacggctcgttctgcatcattggcacttccttcaggaggagctgcctcaacctcaacaacgtcatctcaggcatctgctctccgtgtcatatgcggtaagtggctcagccttgcactcttcaccatggtcggcgctatctgcttctacaccggcaaactcatcgatcgctgcatgtgcgctgaccactgcgtcagaagctatccggacatcagccacccagtgcgaattgtaaattgagatggggctgtgtaaaagctgtatgactgaaacaaactagaaatatatcgacaaaagtattttttaatgaaatccaaatacgcatatgaacgggagagaacacaattatttctccatttcaacttttgttgctataaaaaatatccttaacgatctataaataaataggtatggtctgcagagaatgatctacgaataaaatttatcttgcttaagaccattggtatggtctactttagctagtgaggtagcttgccttgccgccaactagtttttcactaatcaatggttaattatatgtgttaatcgctaattaggtgcatgaattagaggttaattatatgtgttaatcgctaattaggtggggttggtgtcccaaccagccccaagagtggatccgacactgtgtccatcttgcctacgatggccgtacctagccttcgccggctacggctagatggccatcggcctcgtcttataagtcgagctctaccttgtcgccatcagcttcctcatcctcgagggtgacaacatcgagaagctccttcctggcacggtggtgaagatcctgggggtaccaggtgtatgggaagcagctattcatgctcgcggtggggcgccatcatcctcctgacgacgtggctcaagaacctcagcatgcccgcctatgactcggcggtcgggctcatctcgttggtggtgctgattttgatttgtacccgattattgtattcgtgatttacaaaagaaaatgcaaaatttgaaataagggaatagaaccgtgagagactaccaccgggagttttaaatttgtatgttgtacggtggcataggcgagtctagagaagatacaattaaaaggtttttacatgggcttgatttaaagtttcagcttaggcttaaaaataaaacacatagccatctttttagttacttttgatacatgagaatattcttgcgccttctattgtatataacatcatgtaggaaggtaaaagaaattttgaagaaaagaataataaagcacctaaattaactcaagagagcatttcaggtaacttaattgatgttcaactagaccaaggtaggaataattgtgttatgctacaattgtccactagttatgctatgttagagcaacctctagtggaacgaatttctaatgtgcctttatcacaagctaaaaattcagattgtgttgatattgataatgcttgtaatgaggaagagttgtgcaatgcttaacttatatacatggcacaattagtgaaagaacatgctacttctatttctgaatatttgggttccactcaaaataaacgtgtctttgctattgctaatgactgagaagagctgcaattattgtcttctttatgtactttaggttatatcgaatttgacgttccttgtgatctaaataccttagagatgaaattttatgattttctatgtttttcttggaatagttatcatgtcattggtaaatataataatagaggagattatatggtgcatcgtgtttatatatgttcatatttgaatactcctttaaatatggaaaaaatgtgagaaactaaatggatcgtacagcgttgatgctattgggataaatttacttaaccttgttttgaagatcgatgacaatattcaagaaggggagtgctatgcaccattagattctatggtcaagtctcactatctttttaagacatgtccattaaggtgagttcgtttttcgtgatgtaaattggatttatatagaacaaatgatgctacacaatgattgcttgtttgctatttttttcatgtgatctctcctatgacgacaattgcaacaagaaatcgagaacggtttccagacaagaaggaggatgatgtgatcatcaagtatattcatacaaccaagcatgagaaatataaaacattgcaaaagaatacatcggatgaatggaggatctaaagatattaaagtccaatgagttttggaatccagttcagcctccggagacagcactgacttcaaacggacctagcgccttcatatggtcatgccaactccgatttggatgatgttggacttgatggaaagcttatctaatcaactttcaaatgcatccagtctcatatccaaattcattttgagttaacgggaatcgtcaaaacaagacagtgttgttgctaaaaccgaacttgggccttgggctttctaatagactaggcccatctcgaaagtgtctccctctacctccacgaatcagcactaaaccctatatctattttcctctataaatatttatgtacaccctctagaacaattgggttttgtttagttgaattttgctaagtgtcattcaccttgtttctagtccttgctcgattagttggcgactatagattcagagcccccaatgattaatacataaggtagtcatggttatctcgcttggttgctttctatctcgttcttgtttgtgttcttcgattggcaaatagggattagccttctcggcgaggtcatccgcgtttcgacacgggtgataaccagaggagacgtgatactgcgattgcagggctcaagagcgtgcgcgttcaagaagccagatcgatttgtgtcgcgactccgcccaaatcgtcgtttatcagaaccttttggaagatcgggaaccctagtgtacatcaagaaatgttccgcacaggatgctgtgatagacaaagataaatacaatatgctccatgacaaggtgaaaccgaggacggtttccaatcaagaaggggaggatgatgaggacataactagctcggatataaccatgactaccttatgtattaatcaaataaaggtgcatatattctacattagatttacttgttatatatttgaacaaacgttactacacaatgaattttgtgtgttttcgattgcagaggtacttgcttgggcgaaggaaaagagaccgagcttaactaatacatggatgattaaagaagttgattggggaccaaaccaagaccttctccaagtctacttctacctcaccacatcacttttggcacatagaagacaagagatcaagttgtacacgttttggattcggattcgggcctcctgacagcatcaacttcaaacagacctagccactgatctagaaggtatttcggggcccatgagtacttattagaaagcttattgagtctactttcagatggttttagttccacgtcaaaattcctaccgagctgccgggaatctgcaaaacaattcacgtatctcatctagatccgaatctgatttgggttttgagccttgtaattgtgtcgtgggcttagcccaagggattgtgcaccctagggcaaccctaggacgtccctaatcacatttattcagtagccgtcatcgttttgagtcgggttttgcttagattattctgtcgagaacagtttcgtcgctagatcggtttgtaagaccccaactcgtgagcttaatcattcatctacaattttggttgttttctatctcgttcttgtttgtgttcttcgattggcaaacagggattagccttctcggcgatgtcatccgcatttcgacacggtgataaccagaggagatgtggtgctgcgattgcggggctcaagagcgtgcgtgttcaagaagctggattgatttgtgtctcgactccgcccaaatcgttgtttatcagaacctttcagaagatcgggaaccctagtgcacatcacccaatagttggtgtgttgatttgccgggtcgattggatctaccacttcaatcacaactattcctttgtgcttaatcccctattcgcaatattttgattgcatcttatcttattcttgcagtgttctctcgtttgcattgcagggatcatcaaccgtgcgtcacggttggtacgacatcgtttgcggtgtagcgattgcacggcgtcctagacttgttttggttgatagccacgtcgcaaacatcgcactcgatcaaagcgagagttatcccctcaccaggagatcgggccacgagagagagcatcatcagtagtccaatacaattttagttaaattaaaaggtagtgtatctaaatttggaaggtgttgcatcataaacttttttatgtcgagttaaaatagagatctctcgcaccggtcggttgtagcaatctctcacaccccgacttctaactgtcgagagatgcatactcctggttgtacactagtcgtttatagcgatctctcgcacctcaacttctaacggtcgcaagggactccgcggggggagccctcgccggggccggaatagtcacaaccggagtagttggggggagggggtatagacctcgcacccagctcggaagaggggcagctctgggtgagggggggggggtcggaggagatagctcgcactggggtcgggagaggcgaggatgagggggaggaggagggtcgccggaatcttcaccgctaggggaaggaggggaaagtggggggctcgccggcggcgtcgccctcgctaggggaggagggaaaagtggggggagggaggacggggggtggggaatgaggggacggatctgtgaaaggttcgacgtggtgtggtgcgtgcgttagcgtactatgggcgatggcaaggcggggtaatttcgggcaaaagggtcatgctcgcgcggcgctgtacttacgcgagtgagtgtaggtgtagcgccattagaggttgaccaccacaaaaacaaaaactgtgcgacgcattttcttataattaattaagtatttactattttttataaaaaatatattaatatgattttttaaagcatcttttgtaaagaatttctttggattagtagtttgaaaagcgtgcacgtggaaaatggggaggtgagttaggaaagcgtgctactctttctgttttatattacaagtcatttgatttttatccaagtcaaaaaattaaagtttaattaaatttataaaaaagggtgatatagtagtattttaatataaaataaacatattatcaaaatatattgatgaaattaatttggtattgtaaatatcttctctactacttacaaaataaaagatgtttccgccgtccgtataaaactaaaaaaacggcgagaaaaaaattctgttaaaaaaaaggaaaagaatgtctggctccccttaaaaaaacgtttgattccttagaaaaaggacttcttgtccgtataaaaaaaggaaggacttctcgtccgtaaaaaaaaagtcctaattcaaagtccataaaaaaaaaaaggtcaaaacgctctacccatacattttctcatctaattaattccaaaaatcgattctctattccgtcctcatcctttcccaatttcccctttcaatttggttttaattcaccgaatttaatctccatttaacggttgtcaatgatggccgaccgatgatttttcccaatcccaagtattgcagtttcgttccgattttgcaaaaaatagaatgaggagatcaagtggatcaaaatcactcaataaattttcagtgatcaagaatatttgatgggatgatccggaagcaggccgagcgaagggaggtaggacacaaggctttttcaatttattcctcaactcctaatagttgatgtactactggaaaaaaagcctttacctattgtaacacatgggcaagtttccatcatcttaaaaaaggaaaaaaaaatcagaccctaaagcgagaaaaacgccattataagaaaatctgttcgtaaaaatcacctgactcaacacgaggagaaaaactgtcgtttataaaaataccagttatagaaaacgtccgacttaatgtgagataaaaatcgttgtatataaaaaaagattaaagaagtccgaatccacacgagaaaaagtggatcgaaaaaaccgttcgaccccacgcgagaaaaaaaaagtcatttataaaaataccgctctgaagaaaactatctgacccaatgtgaaaaaaaacccgcgcttataaaataatccggttcggcactgtgcaatgaaaaaaaaaaagtacctgatttcaagaaaaaaaaatccgattccatgaaaagtagtcatatcgtttgtaagttccatcgtctcctgtgtcagtttggttttttcaaaacgttcgtggaatattttggtgtgaattcttgtttgggttttttttttctcggaacgagaacaaattgatcgaggcttggttggataggatcatcaatttttttctatctcctacacgtcttgtgttccatgatctactctcctactccttccatcccataatataagcgatttgggagggatgcgacacatcgtagtactacgaattggatatagagcatgtctagattcgttgtactaggatgtgtcgcatacctcccaaattccttattttatgggacgaagggagtacgttggaggccttgtacgtctctgtatgcaattatcagactactttgttaagtatagctaatattaatatttttgatacgtatcatataaaaataattatatattaagagaatagttcacggtgactctgttttgtctagacttgaccatgcgagatgttgacggtccttacatcataatatctgactgtcaatatttgcatataataaaataaaatatggtatctaacttagtggtaagaattattactgatcatttccattagtcttattaaaaatatgaaaacaaaaataatcatgtactaatactagctcgagctcctttgcatcaggaccacccatgggccgtgggcccgaggccaatcctgctaaccgaagcacgaaataggagagcctatctcagagtcacgcaaggttggtggcaagaacagaaacaacttcggcttcactctcgtgaaagaaaaataggttactggcagagtggaatatgtgggtggaaagtgtatgatttgctaacgcagctattggccattggcatgactggttagattatggcctcctataaataaacctaataggttaacatttaagatgtataatatagtttattgttattagttaacaattctttcaatatctcaacttcttttttatttgatgtgatttgttttgttagatagtggagcaaactagatagccatgattagtaggagtgatacaataacactgaatttaatgctcacatataagagcatctccaatagaggactacaaaatagtccctataaaatagtcccaaaaaatattagattaggaccaacccataaatgattgggcacaaaaatcttcatctccaggagattctcaaaacttgaatcctaaaaataaaaatatggttgttggcctgtaggccgtgtgggtagctagggtcgtcgctctctaccgcttaccattgcagttctctgccacgtgcaatcgccgtacgcttctttttctagccgctctacttttgcgcccccgccaccactactgttgttcggattgaccgatcgtgtggagaaacggaagactaagtcatatggaaatcatgcattgagactaatccatgcaacctcccttttctgtagagatttttacgaaagcgtatcggtaaacatttgtttatgggagctactctagtctgcagtaccaaatgtattgcacatatccattattgtcacttctcatatagccataaaaaaaagctgccacattatcaacaagtttgatataatcagtaagtaacaagaaagaaaaacctgaatacaatgcacacacattgttctactgattcgacagtcacctagttcagtcagtttactctatatgacaacataacaaaatttccaaactgcagattggtgaataatacagcaaatgaagaaaaggggaaacagttcgataaaatggttctaaaagcgcgttttgaatgtagtactccctccgttttgaaatgtttgacaccgttgactttttagcacatgtttgaccgttcaccttattcaaaaacttttgtgagatatgtaaaattatatgcctacataaaaatatatttaacaatgaatcaaatgatagaaaaagaattaataattacttaaattttttaaataagacgaacggtcaaacatgtgataaaaagtcaacggcgtcaaacatttcgaaacggagggagtaattagctaggtccatcatcctatagtccaaattcaaaacacatgtacagagctgccaagttttccaggatttccatggcagaacagagcatagggttactaatatagttagtgttttgatatacgaagctagaccttaaaaacctaaccaaattaaattaggcttcatggtgaagcacttttaagatttgcagagaacaatagcaacaccaaaaacaaacgaatcatgaagtagacagtttacatttcagagcatagtgtgatgtggaataggctgttgcataatttctgaataaggtatagtacagtaggaaaccacacacaactcgtcttctgaaagatatatagatgcaccatttatcaactagctggaattcagtggacttgtaagcacattcattatttttaactgccaattcaatagaatgcccaccaaactttaggctgcagattcaagacaaatgattactcattacttttttatcacctacttggacgcctggagcatgacagcaagtagcaacaacaacctgaagtcgatcatattgcaatttcagtttgtcctactcagtttgcacaaagattttctggtaggagtccattccccctcaatcagcaaaagtagatttttcccacatgttaaaacggcatcaagcagtgcattcacttgacagctacactgagagtgcatcagtctatccattgaaaacatgcaatgcatcattcaacaagaaaatgctaacgagagagaccaagcgacgttcaggggatcgtcgtttacctgcaacacgggatccggtgaccgccaacgaaggggatgcagcaccataagatggagcgggcgaggcagcctggaaggaggtaaggccgtgcggtggcgcccttgagggtcctggatggaggtcaagctgtgtggtggtgccctcgatggccctgatcggaggggggcgtcggtgacataggttgtgacttccctttaaactttcaaaaaatgtcacattaaatgtttggaaacatacatggagcattaaatatggacagaaacaaaaccaattacacagtttgcatataaattgcgagacaaatcttttaagtttaattgcgccatgatttaacaatatagtgctatagtaaacatttgctaataacggattaattagacttaatagatttgtctcgcagtttacaagcgaaatctataatttgttttgttattaacctatgtttaatactttaaatgtgtgttcatatacgtcaaaaaaatttttataaggaactaaacacagccatggaaggaatggaggcgagcatggagttcaacaaaaaatgttgtgattcctcggattgggggcctctgcaccttggatgaaggactggcgctgccataggtgaggagacaattaatcagacaagtcaacgaaggcaagaacgcggcttcatccggagctatgaaggatatgacccaggaagcctacggcacgagaggaagagaaaaatggtgcgtacggaaaaaattggcgctggcggcccaaatctactgtggttgggaatgcgcagagcatcccaaaatctggttaggattggcaccgattttggatgtgggtgaatataagggccatataggtacgtaaaatctaaaccgagaggcttctcgctttagtcgtatcacgcgacacggctcacagccgttcgatcgtgcctgtcatcccgacgtacatctgcgtggctgcgctctaatggctcaataagaaggatcaacgtagtgcctgtttgcctttttttaatagatacgtatgtcttttttctcctcaaataaagttttctctcaaattacttatccaatctataatccgattacaccattatgttcattacaattaaatcttcacaacaagatcttacatgattatattacgatgaaaaaatatttatatttataaattacttttattatatacgtaagttacttttatcatatatataagttacttttagatttgactaaattacttcttagacatataaaagtaaattcaataaagtctaaaagtaatttacatatattataaaagtaacttaaaaccaaacggaagtaactttatcacgatattagaagtaaattcattgtagggataaaaatatgattttatctcgaaattaaatttaatcagtacagattaacacaagtaagtttaacattttttaaaagtaacttcaatgttaattagaagtaacttttgcatggttgagaagtaactctctgtaaatccgtttaataaaaagaagataaaacctttcatggattgtaaataacattgatggaataacttttaggctttattgaattacttttttagtccaagaagtaatttagtgaaatttaaaagtaatttagatatattataaaagtaatttataatttttcatcaaaatataatcatgtgagaacttgtcataaagatttaattgttacgaacacaacggtgtaatcggatcgtatatcagatgagtagtttaagagaaaagtttatttgaagtataggtagatagtatctttaatagatggagtggtagctggtttctgtgtatccatgtcctaataaatagtagcgtatagcgggttgttagtggattagcgtctgtgtagagtgttgcggatagcgggcgctaagttccgatagcaaatataagaaaatagccataaatatatcaatattaacataaatttcacgtaaaaattagaattaataatacatttttaattactcctatatttcataacataaaaaaaaatatgaaatcacatatagatttataagataaataagataaacaatgtaaagttctacaatccatatatgaagaacaacatttaagcgttacaatggtccaacaaagtcaatagcgggctgttatagcggacacgaagcgctataacaggctgttatagcagtagcgaaatgctatagcgggcgctaagttacaacatgctatcttcagtctgctacctcgtagcggtagcggtagaggtccgcgctatagtgggtgctacgaacgctatttattagcttgttgtatatgttggatgtatggtttttcgctaaattccgaatctgattggaactttttttatctcttttgggaatctgattggaccttttttttatatgctctaaacagtgcgagcaagggagtaaatagtaacaggaaaatgattgatattaatactagcaagaatggcacgatgaggtggtttacaacgatgttggagcaggagcagctctcgtcctccctaccgccagcaggtcgttctgcatgtataagctgccttaacctcagcaacctgacatgtgcctcagcctcagcaacgtgatctcagttattgcatgctctccgtgccgtatgcgctgtcgtagggcaggtgctactacataagaaattttttgaggaccctggttaggctgcagacggatcataattgtccacgtctataaaaatcagccttcaaattcatatacggtttagtaagatgcccgcattcgaaaatcgattttcacaaacgaacctagacgcaagtgaaaataaacctatttttacgagatatttaactgtttactacttttagatgtggcaaataactatttgccactggacccaaatgtcattaagatagaggtggcaaatagttaaatgccaaatctaaaagtggcaaatagttaaaagctcctattttggcatgcggtcccttaaccacatgcaaaaatacattttcgtatacgatgccttaagtgatccgcatacaaaaatatctccttttttttctcccatcctctctctttccctcctcaccacttcaatttttttcacccatctcctctcaacatattttcaatcctctcctccactcctctcttcctctcctctcaaaatcctctcctcaatctctctatctctctccctccgagtgggcggcgatgggcggtcagcagtgccaccgtcatccccttcctcaccgccaccgacgacgacgaggaggaggcgatcggctccatcccccccgacgccgccgccaccgacgaggcggcagcagcggttgatgccatgcggcgggcctcctcctgcccatatctggtgatggcggcgggagcggtcggtggctcggcgatgggagcagtggcggtgggagcgaacgacggctcacctcctcccgcccacatctggcgacggcggcaggagtggtcgacggctcggcgacgggagcagcggtggtgggagaggacggcggctcacctcctcccttgcatatctggcgacggcggtgggagtggacggcagctcacctcctcctgcctagatccagtggcggcgggcctcctcccacccagctccgatagcaggaccggacggcggcggaagcagcggtggtgggagggccttttcccacgatggcggcttgcctcctcccgcctagatccagcgacgcagtgggaaaaacttttgttgctatataaaatatcctaaaagatccatgaataaataggtatgatcgtgagtgatctacgaataaaatctatattgccttgtcttgcacagtactactggtatggtctgctttagacagtgaggtagcttgccttgccccaaaccagtttttcactaattaatggctaattaggtgcatgaatcggaggtggggctggcgccctaaccagcccaacagatctcccactgtggccacctcgccttcgacggctacagccagatagccatcggcctcgtatatgttaatggctaattaggtgcatgaattggaggtggggctggtgccccaaccagccccaaccgtggatctcccactgtgaccacctcgcctttggcggctacagccagataaccatcggccttgtcatgtacatcaagctctacctccttgccatcagcttcctcatcctcgagggcgacatcctcgacaagctactccctagcacgtggtggagatcctacggtaccagatgtgtacgggaagcagttgttcatgctcgctgcgggtgccgtcatcctcccgacgacgtggctcaattacctcagcatgctcgcctatgtcttggcggtcaggctcatctcgtcggtggcgttacgacatcgctggtttgggtcggcatgtccgataagggcttcgacatagagggcaactgcctcttaacctgagagggtccctcagcctctacttcgtctgcttcgccggccatggcgtcttcccgaccatgtactcctcgatgatgtctaataagaattttgccaaggtacaccttttaaaatgtatttatgtgttgttgatagtaagtttgctaaaatttgtgataacaattaacaatgtaaatttagaattatggttaatgaaaattgaaaagtcaatggtggaattaagttagcaacaggtttagtaaggatacaaacatattttttttattatatggatgcatggaagacgcgcacactcataattactttttagatttcgtacatcactaatcatgcacactatactcgcacacctcttaatcatcatcgctgctatgttcccattatactcaccattgcatggcctcatatcatatgttttgttggcgctcccatctatatagattgtgcagataaagtttaagctaataagtttattttgatcgtctaattaaaagtaagaattaggatcatacgaaatcaacattaaaatcatttattaaaataagttgtaccatcccttaaaaaaatgttgtactacttataaattttataaattttgtaatgttaatttacaatgatacggaatggcgagtgcaatatggaattaatggcaagtgcaatattcagattttagcattaatatttttttttgcattatgacgtaaattaatggcaagggtaatgcctggttggcctttcgactagtttaacatgtgtagtgacatggaggcgtaatgtgccacagtatagcctatcaccccagcaggatgaacaggtgactgaaggcgatgaaggtcacctctcaactatatggttacctctaatccacccatttaaaagcattgtagcttaaagataaagctaatcatgagccgcctattatggattaatttatatgttaaacctgaacttagaagatgcgtctaacacttaaatgaaagaattatattagccatttgaaaacaaagtttatgaaatttgttttttaagtaattttatacatagtccaatacaattttagtgaaattaaaaggttgtgtatctaaatttgaaagatgtgttgcatcataaacttttctatgccgagttaaaatagagaactattgtgttgtatatattattgtactaagttagtcttaaccaatctactttcatgaaaggtaaatcccaccaagctaccagcatgctccacgcaatcaaaataataaagaccgtcggattagaaaatgagcattagccgtccgatgtttacttcaaacattacaggccatcggataatctcaatctctcgtcatttggaatcttctcgaatgttgttcgcagaacttcttaatgctgtattcggttctttaactttgggaactaatcctccggcgtgaaaaacgaagcaactcattaacgcataattaattacttattaactaaaaaatttgaaaaaatatattaatatgatttttttaaagtaactttcatacaaaaaaaatttttagcaaaaaaaacataccatctagcactttgaaaaacgtatgcgtgaaaaacaagtgaggggaggttggaaaagagagggaacgaacacagtcttaaagcaaggataatagtgagatataagagcatccccagcagctcctctatccggtcctccatcccgtttttggcgcatggaggggaaaaacaacgctccagcagaggctccatccgatgcgccaaaattggcggatcgccaaacacgaagagagaagtgtcaaatttggcgtttctctctcctcacgccatccccaaacgcccgctcccatccggttctcccgcccccatccggatcgagcataaagggtgaaggaagaggaaaagagaggacgcactggtggctaccttcgccgaccgaccgccgtcggccaacggagcagaggggaggagacttactggatctggccgcccgcgccgccgtccccgctgctcgcccgacaccgccgcccgctcgccgccacctgcctcctccgcggctcctccacccgcctccagtcgtccgccgccgcccctcgcccacctgcctccggtcgtccgccgccacggagtagagtgcgtagaggcagcggatctggctgcgacgccgctcctccgcatggcgatctcccgcgacgctgctcctccgcgccgctcctccgcatgcgaccgccgcgccgctccccgcccgcgacgccgccgtccctccccctcccccaggcgggcgcggatctggcgtccttcctgcctccgctgccttcccctccccctccccgcctccccacctccaccgccttcccctccccctcccgggaagaaggcggcctcgtgctccccgcgctccccggcctggaggatcttgtagacgcgcgggacgagcgggcccaacttatcggtggacgcgtagttccccgccacttggtgctctggcgggcgtaggtcggaggccatggcggcggtggtgggtggtggaggtgaaggggattcggcgagagaggagaagagttgagaaaagagtagatgagaggagaagagttgagaaagaatggaatgaatagaagagaaaaattaatataaaatagatggcagttgaaagataatagtaaaatataggatagataatgtaatatgaatgatttgttggagtaaaaagaaatatggagtgagaatccttttggaggactatccaaataggcatatggaggattgaatatgaatgagctgctgggaatgctctaagcactactacaaaacatggtacaccaccactcctccgttccgcccgagttctccctcttctttctctctgttgccgcctacgtggtggaggcgttctgctcgccgccggccacttgccctcatatacaaatccactggcaactgcaacagaatatggaaatggtgacaagcagaagccatggggcttggcgatgtggaaccggatccacatccacgtgacggctgtggtgctgtacgtcccgtggtgcaggggcggaggtagcatatgggcaggggtgtccagcaacccgatcaaaatttttttttaagttataactcatcgatatggtgattttcactatgtgtgtaaccttctcaatacaaacttagacacacgcattaaattgaacttgatctaaaatagaataaattaagcaagaagcaccatcctctatttcgttctgttctagttccgccctgccgtggtatgtggcaatcgttcgccgatccataacagcaaccatgaggctcggagcctcggagaggttggcgtcgaagaaatcatagtagctgcacatcctgcgccctctcacccaggcatcttccaggctaatacattggtacgtattgttgcaattgcaaacctactgataaagccagcaagcaaatttcccgtgaattttaattaatggagaaggtatcatcctgtttttcttcttttaatttgcagataatcctgggctttcagtactctggattttgatgtatctttgattctgtgatgaactaatcactgatacagctagaggccagatttctgttcactaggtaaaagtcactgatactactaaaaagaatatcagggatctcgatgctctgatgcttctctctctttcccaggctaacctggtagaaaaccctggagttgtacttttaacaaaaacagggcactcagccttgaaagtaggacacaaaattctttcttagatcactcggaagtggcatttgttttgtcatgacctttcccctttccaattacaagttgaaggagtatcgacacatatttatggactaaatgacaacctgtaactgtttgatcaaataatttataaataaattcgacaaaatctaatacaactggcgcaaaaatgacaggtcgcgccgaaatatttaaaatagataataggccaattttgatggcccaatcccaacgctacagactataaattttgactgtgtatacttggctcatctaataaattttcatacacatcacatataccgtgattgttagagtcgtgcaaatgcacgacttaataggccagtaggtatgagaattgttagggataatataccaaagtgtaggatattgactattggtcaaacagcttatgaaagtttattgaacaatcttggacctttcactatcttttactgatacttatctatgatctaatatcagatattttatcaactgtcgcatccaatggtccatattttcaaatgatgtggcttaatgatgttgcgttttaagttttaccttttacttagagggataatttagacatgttataaatagatagcataggtcaccaaacttatagatcatgttgtatgcttgcatgagattaaatatgtaattattgttagtgggtgataatgtgacatgattgcatgttgagctttagacttagtggactttaactttataggaagcatagataacacttccttgtcaagcattcaattcaactttttacaaattaataattatattttaatttagtttgttataagaacatgaagagttttggttggataggacatatcttagtaccacaaatttggacatgcagtctgtccatatttctagtactgggatatatccattctaaccaattatatttttcaactaaaactctttatattttgggacggaggaagtatgagttttaaatgcacccactccatgagttttaaaacttgacgtggtgcggtgcgtgtgctagcgtacttgggcgatggcaaaggcgaggtaatttcgggcaaaagggtcacgctcgcgcgacgatgttctgtacgcgagtgagtgtaggtgtagtgctgttagaggttgaccaccacgccgtgcatatgtgtatgctccgtgtgctaccagctagtactacaactttttattatttttttaaaatgttttttaaatttgttttcatcttctatagatttaggcggtgttttttctaactttcccaactcaccttcctcgttttctgcacataaacatctcttactgctaaacggtgtgtttttcaaaagttatatgtaaaaaaattgctttaaaaaatcatataagcaatttttttaaaaaaatagcgaaagcttaattaatcatacgctaatgtgtcgtaacattttgcgtgcgtgagaaatgagaaataagctctcaacaccgtgtaacaaatgcggccttataccccctaacacacattgggaaaaatcctctttcagacagcgttttacacgaagtagtatacaatctttgacgcatggtgatgatcgcccatcagggttggccattttggacatataatgattatattatgatgaaaaaatatttatatttataaattacttttattatatacgtaagttacttttatcatatatatatataagttacttttagatttaactaaattacttcttagacatataaaagtaaattcaataaaatctaaaagtaatttacatatattataaaagtaacttaaaacaacttggaagtaactttgtcacgacgttaaaagtaaattcgttataggaataaaaatatgactacatgtccaatgaaaaaaggcattcattaaagttattttctttttgtcataagttacttctataatatatgtaaattacttttaggctttattgaatttacttttatatgtctaagaagtaatttagtgaaatctaaaagtaatttagatatatgataaaagtaatttataatttttcattaaaatataatcatgtaagatcttgttataaacatttaattgttacgaatataacggtgcaatcggatcgtagatcggattagtagtttaagagaaaattgtatttaaagtataagtggatagtatctctcttatatggagtggtagctggtttagacaaaccagctaccactagctgtgtagtcacgtctaattttaaagccattatattttgtaaacattttattaaagaaatatgaaaacaaaagaaaatcctagtactaataccatctcagcgcctttgcgtcaggaccgacggtgggccgtggccccgaggcccatcctgctagccgagaaacagttacaggagagcccatcagagaacctcacgcaaagttggtgggcaagaactcaaacaacttctctcttgaaagaaaaatatgttactggcagtgtggaatgtgtgcatagaaagagggtgaaaactgtatgatccgctagcgccgttatatgactgggtaggttactgcctcctataaatacgtaatgggttaacatttaagaggtataatatggtttatatagttattagtttacaagttctttcgatatctcaacttctgttccattttacgtgatttgtttgtatgagatagtggagtaaaccaggtagccataattagaaggagcaaataataacactgaatttaatactaacatctaaacggtgcgagcaagattataaatagtaataagaaaaaaaatggtactaaataatattagcaaatatatctacgacacgatgaggtggtttacgacgtggagcagccgccgcccctccaccctactggtggatcactggcgcttcctttaggaagagctgcttcaatctgagcaacgtgatggcagccggcatggggatgctctccgtgcagtacgtgctgtcgtagagcatgtggcttagcctggcggtcgatctcccctatatttggcgccatctgcttctacaccggcaacctaaacaaccgctgcatgcgcgctgaccactgcgtcagaagctacccggacatcggccacctagtgatgaatctagaatgtaaatttaggtgggaatgtgtaaaagctttagtatgatggaaacaaactagaaatatattcttattttagttaaattttatctagaatctagaaataattttatccgtagtctaatacaactttagttaaattcaaaggtagtgtatctaaatttggaagatgtcttgcatcataaacttttatatgccgagttaaaatagagatatattgtgttgtatatattcttgtactaagtttagacttaaccaataggtatgagaattgtttcggataagatgccaaagtggtaggacattgactattgctcaaacagctcatggaagtttcttgaacaatcttggacttttcaccacttttactgatacttatttatgatctaatgtcagatattgtatcaactgttgcatccaatggtccatattttcaaatgatgtggtttaatgatgttgcattttaagttttaccttttacttagagagataggttatacaagttataaatagatagcacagttcacaattcttttcttaaagtaatactaatatagtgtgcttagtatcattatatactaggtaattccccacgttttgctgctggaattactaagcaattctcaatttttttttgacaatcaagcactaccacataaatgctaatagaagtcggcactataggtggcggaagatgtaaaaccgccacctatagtccctttctgcccacgcgcctgcccaaaccacaagaacaccagttcttaaacaaaaccgacacattttaccccagtcagagatagatgccggttttaatttaaaaccggcatcttttggttggcacagggcccaccttacaacccacatctttgtggtaaaaggaataggtgccggttttttaaaaaaaatcaccgcctataaaatattataggtgtccgacaccccataagacctagccaccacacgctctctctcgcatggtttttttaagccgttcttatccatgcatcaaccgatgctctctctctctctcacacacacacaccgacgctctcttatctcctcttctcctcctcatctctcgtacgcatcggcggtggcctggcggtgcagtcggcggcggcgcctcccctccgccagatccgctcggtatgagaggcggtggcgccctccgccacatctggccggtagcagaggtaggcggtggcgggagggaaggtcagatgagagatatgtgaattctgtgaataattttactatcactttgtcggatgaagaaatgaccaaaacaaaagttatagatcttgatgagttatacaaatttgttgttgatgacttttccaattgaaatcatttagtatttgaaaatgttgtttgaagttttcatattttcaaatttaaattcaaactgttcaaaaaataatatatagaaaaatgaacaaaataaagttgtaaatcttgataagttatacaactttgttgttgatgacttttcaatttggaatcatttagtatttgaaaatgttgtttgaagctgtcatatttttaaattcaaattcaaactgttcaaaaaatgttatatagaaaaatgaacaaaataaaagttatggattttgataagttatacaactctgttgttgacaacttttccatttgaatcattttctacctgaaaaatttatttgaatttcttatcttttaaaattcaaactttatatagttcaatcaaatccggatgtagaaatgaccaaaataaaattggtagatctcaatgagttctacaactttgtttttgacagctttttcatatgagttcatttagtatcataaaatttaatttgaaactcatttttgccttaaagtctgattcctcctcatcatgttaatacttgctaaatatatatttgatccaattaactcagtttggctggtgaaatatgtgaatggatgtgaaatatatgatcaaaatggatgttctttgagcgtggttgtgttaaatatattgatggttgtgtatgtgaataaatgtacaacttcttttccggaagccgatctccaaagaactatgaggttaagcgtgctgatattttggtgcacacgagtaaggcaatttcgggatgggtaaccgaccgttgttataaatgattatattttgaagatcataaccatatccgattgagaaattttttctggatgcacacgagcaattttaggataggtaaccgaccgttgttataaatgatgatattttagagatcataaccatatccgtgtctatccaattgttcaccatatccatgtcttttgaggggtagttaatgactgagctcgtttatataatagcaaacttttcaatcaacgtaatggtggaatacagattactatctacatgtttcatcgcttgttcatttattattcagaaaatatttttattttacaagaggatgtgtaccaaattatacctaaacactattctatttcatatacaaatcaatataataaaaaactatttttattttacaagaggatgtataccaaattatacctaaacactattctatttcatatacaaatcaacttttataatagtagagatatgaaagaaatgaagtgtgcgaaagtattaatttcgggaatagcgatataataatgaaatcggtgattaattatcactaatggcacaacctggcgtatacgtatgaatattgtgagacacgtgccgtcggctgctctagtgccttgtagaggcacttatatactcatgacattttgatatagctagggtgatcgatacaatttcgtggttggctagatgaaaggaaaatgtgtgaatgttttcatttgaatggaaacatgccactgtagcattgtcattagaggatgttaatcacggtgatttgccggcagttgatttgcatggaaacgtaggaaattaaaaggcaagatagctatctggatgaatattcctcgccatgagcatcacgaacgcgtatacgaatacaaagaaacaatttatccatatcacgcctaatcggaaaggagtcaccgacgcggtaggttcgaaaggaaaatacagtgagcaggatgtggatatcgataagaagaaatgttacatatggaggaatgatggtgcaaatcatagaatcatgttaattattggctagccactgcaagctggtaaatagcatgcgtataacagaatggaaatatatatcccattgatagtagaatttaaacgtatcgttgtttaatggaaacacaccatcacagtatcattgtgagatggaaaagtatcacacctttttctatattaatcaacaggaaacttcgtgatggatatgtatagaagtgaagcaaataaacatggcagctgttcctatcattccttgcattgctctgtgccgactgtgcatgcaccggctcctctctagtataaaatgctaagccatatcatttgcaaaggggacagcggagagagtacagaggcacgagccgagggcctgcagttcacgccgccgccgccggcaggcgctgcgccgtgcccagccttggcagtagtccatagagagacatacatagagacacaggagagaaacacagagaagcacaaggacaaggagagcggacacaggttgctcatcgtcatcgggaaccatcacgcacgtcgttttcgccggagtatctcggcgtccggcgggaacgtgcgtgctctgcggccggcgacatcggctgccgtatctcggcgtccggcgggaacttgtgcgctcggcggccggtgacgttggccgcagtgcctcggcgtctggcaaggaggcgcgcggaggaggagacgatcgccggagcacgtactcagccatcgccacgagtttaacttcttagttttcttttgttttccttctctttctgttcagatcagcatgcatgcacaagatggcgacatggagagtttccggtgctgcctggcccgctggatatagcgtcctctccgcttgtcggaggcaccgccagccggagatcgcgtcgctccctctcgtcggagacgccggtcgccggtgacacatctacctgctgccgcgacgtccttgcctcgccggccgcaacctctatcccacgacgtctttacctggcgatgtgatgtcgtcgagatgctggatcggacgtcgtcgccttgccggtcgcggcctcttctccgcaacatcgtcgacttccgctcgccctcatcaaagctgctatcctctacacacattgtcttgctgcttgaagagaacgccggccggagcgccactactcggtgcccgcaaggcgtcatcagctctggctgcgtcccgaaccatctcgctggagttgccgtggacaccgctgagccgcccaaatccatagacggcgaggcgttgccagctaacgctagcttgtccccgtcatcatccgctgcccgccggagaaggccattgccaggtcgccaaggtgctagttgccgatatccggaggtcgttaacatatcatccacaagtcgcgatgggtatcgtcggacccctgttgccagcacctgtcatgatgcgcccttggtgggcagggatgtcccactgagactctactaatcggccggtgacgccctccgtcccccacgctcgttgtagcctctgcgggtcgccgccaacgtctattgaatatcatcctcaccggcgctgcctatttccgcacgtgctcttcatcggcttcgctgccggcgtcactatgctgccgtggagctgccgaccaagccatcccaaggtcatcattccccggaggccatcacgtcgtttgcagccgccgcgctgaaattactcagatgcttgtattgtgcatgcgcactgtacgaatgcatgtatatgcatgctactgtacatgatgacaagcaagcaaacaagatgtgcatgcatgctaccgtacatggtgagaagttaaattgagttagcaaattcatactcatttgatgctgctctgtactaaaccttcgagccatgactaattcggctatcattcgtgttgatcattcctacctttataatctaattccgatgcaattgctatggggtcgagtcatcttagctacacaattccatgtatgtcttcaacaacaatatacaccaacacgttgttcaagaccgatgaggctgaacggcagggcaggcggagtctatatgaagactacgtcaccaacaccggcgcacggaccgacgaagccgtggaccactgtcggcgcccacacacatctactccaccatcactatcatgcatgggagaacatgaagcgaagactgacggcgcagtactcccaagtcaagccactacgatcagaggtgacccaacataatttgggttttggctccgattgtcggcgcatatacaagagagccacctagttcctggaacgcgtctcatcgttctcaggctaggctacgcccctaacgtcccctaaaaaccgctcaatactatgtgctgcagcgatcagaaggctaactcttgtaccatgaggatggtcggccagtgccgtggagactagaagggcgatgctaccctatcgccagtgacgacaagcttggcatctctaccgacgaccaatgccatgctagtctccattacaagcaccatctttacctccaccgacgaggctgaacggcagggcgggcggagtctatgtgaaggcgacgtcaccaacaccgacgcacggaccgatgaggccgtggactactgccggcgcctacacaaatctacatcatcactaccatcacaatcatgcatgggagaacgtgaagcgaagaccgacgacgacgaccagcgcagcttaatcggaggtgtctcgcgggtttaacccgcgagagtaattaaccgggtgttttccgagaccccgggaactaggagaacacaatcgccaagtcagatccacctcaccgatgggctgtggagcgcatttgactaaggattttgtattttcgtaattccttgagaattataataaaatacattttcctttgtccattttatttttgtgtacgtggttaactggcatgcccgcacatcttactttattctacttccctgggcggagagacaaaaagttattttttctctccaaacaactgagatataaaaacaaaaccctagccttatcctctttctccccatctccacaccacataggcggaggcggcgcccacaccacacaggcggaggtggcgcagggcgccagggcgcaccgcgcaccggcaccgtgcattcctcaggatctcgtcgtcgccagttgccctctcccctcacttcctctcccctctggcctccgccctctctccttgcctcctaacccctcccctccggcctcccgactcccatcctctctagtatccctctcactccggtctgccgacaacgcacgggcggcgcgcggggaggcacacgggcactgcacagcgagggcgaggcggccggcgagccacaagggagttgtggtcatgcatgcttcatggatggaatgatggatcaatatgtgtttttgctgatttttttgtgatgctattcaagcattcatgctatttttgatggtatgtacaatatttgctcttaccgaattgatgattgccttgtatttttggtgctaattggatggagatgctacccaatgcgggccccggaagtgttggagacggtgcctgatttggccccgcatctccagtcggggccaggggcggtgggtgaagtcgagggtcgggggagggccgttctagtccaacccggccccgcaccgccccattgccatccctaagcgcctttgcatcaagaccacccgtgggtccgaggcccatcctactagctgaagcacgaaatgggagagcccatcacagtcacgcaaagttggtgggcaagaaagaacagaaacaacttctgcttcactctcatgaaagaaaaataggttactggcagtgtggaatgtgtgcataggaagagggtgaaaactgtatgatccgctagcgcagctatgggccattggcatgactggttaggttactgcctcctataaatacgtaataggttaacattttaagatgtataatatggtttatagttatgggtagtagttacaagttgtttcaatgtttcaacttcttttcctttgtaagtgatttgtttttatgagatagtggaggaaacatatttagattcaataatcccttatctatcaaacaaatgtgtaagattgagcatatatagtcgtacccatagttccattcgccacaaatatatggcccggtgcgaagaatagcgtacatgctagcattctgtatcaccttgatgtcgtagttccccttaaagttgtactacatatcaaaaatttcatgaaggtcaggaacaagaacaatgctggaatagattaaaattatccaaaatgcacattttgtatgaggtggcgtatattcgtagtttgaactgtaattattattaactataactgaggctctcctataagatccctccataattttaagagcactaaaaatagctggaattttcacgtctgacatattaaaaaaaaagctaaaccgtccaaactacatgaaatttcgattaaactactttgtttcttacattggttagaaatcaagaatctggtttgcaaaataacctacatgcagggatactacgatctatacgcaaggaatataaggatgtataaactaagcttaatttatctaaataatatataattatactcgtcaattgagcaaatcccgtgattctatttcattatctaaaaatatactcatcaattagctaggcatataatcatttggataaattagcaacaagttcacaacaaatttcttataattaggttggttttcatggtatactttattaatcgttttgttgaatccctagtggcccaaaactcttcagtaggctaaaattgttttattcatgtcgataattaatgctaaaatataattttttcactcaatcatattgtgtgtcaaagtgccatgtctgctatccgactcagccaattaacattattgccagcccacccctgacacaatttttatcaattcttgtagcgattatatatataatataaaagattactgaaattgattgaaatggaaccgcatacccaacggtaggttacattctctctctcggtttgaaccatcaggcgggttgatgctactacctagttgtaaattaggaatacgctcgctgcattgcctggtggagaaaaccggaccggtgagtgacccagacaacccctcggttcaccggttcgacggactgactagggaactgtcggttgaaccgcggttcaataactataatatatatatatatatatatatatatatatatatatatatatatatatatatatatatatatatatatatatatatatatatataatgtatatttcctctacttcacaagtgaaaaagcggtaggatggctagagccaagtgctctcagcctctcagtgcgcagaccagggttcgagtcctcacgccacaagcatttctctgatttcaggtacagtgtgtgttgcggctttagcttttggaaacatctctcacttacgaccgtttggttgatcgcagcagcttttggaaaagcagctacgagaaagtcaaaaaacccgtttggttgatcacctgtggtttttgggaaacatctctcacttacgaccgtttggttgatcgcagcacgggatgagagaacaggtggcggagtcgtcgccatcctctcctcgcgcgtcccaacccaaggcaagctggcgccgagcggggacgagcagggcggcgccgaacaaggacaggcggcgatcggccggggacgagcagcgtcagcgccgagcggggacgagtagggcggcgtcgggtgttgccagcgtcgagcaagcagcgaggtcgtaggacgacgagatggacgttgtcctctcctctacctccgccgcgctgggaggaggccggcgacgggagtcagggggcgcggtgggggagaagctcgccgtctcgccgggaggtcgccgccttgccgtttcgccgcgttgccgggaggtcgcctcgccgggaggagaaggggcgagaaggggtggggttggcgtcggacggggaggagaaagggcggcgtcgggcggggaggagcaggggcggcgccgccgtcgggcggggaatgaggtggccggccggccggagggcaggggcggcgccggccggagatgcgcctctcctcccacctgctgcgcgtggtgcggatgcgggatgacatgagacgagattatcgaaccgttttcttcgtaatggttgaggtggataattttttttcccaaaagcaggtgaaagtagggggtagaggtgcttttgatttatactataccaaaagttagctttgggcaaaagcagctgcagcttttaggccctttggttggcttttggcttttgcaaaagtaaaagcaggttgaaaagcctaaccaaacacacccttagtcggttcaatccgctcaaccgaactgtggagtcctctagttccagttttttccggtgaattgtcgtcccacctcatgatgtagtcatcggagacacacagcgggccaaaccatcgaccacacgtacacgatgtccagataggagcaaaacgctgcaggtttcccatcggagttgcgctaggtgatctggacttccgattctctcaacagttcggaaaattttgtgtcgtgattgtttagctacttaattgggttgttcacttctgtttagattaggcaagtggtcagctattaatgggctggttcagcccaactagctattaggtagatggttgtatggtgcgtaaacgtaatggcataattatgaggtgaggggaatgttgcccgttagctagagatgaaaacggtcaaaaatgatatcattttcttattaattttatagaaacattcaaaaaaatcttcatatattatgagtttagctatttagtggtaatttcaatacgatgctagcagaaattagaaaagctaattttttagaaatggtcatcatcggtaaagatttttttaagataatagaatagaatgccagcatttgctcaaagagttacagccaatcatcagtaaatatattattgttgtattagttttgtggaaaacgatatattaaaatggtcgggaaattttcgtactatgcccgtaattcgtatctgtattaatatagaaatgaggcgttcaccccttccaatcctatatctcaattcaacatgttaaatctctaccgttcattcgcagatcaagtgtaatcaccgattccgctcctccgcccaggtgattacacctgatggcgatgcccacgcgtccgctttaccactccctttgacaccgcccctcgatcctcgctgcgtgcagctccgccaagctccaggtagccctggagcgtggagacgacaaagctttgttacgacggccgacaggtggtcctgaattccaccgccaaaatcaggttagttcatccctaaatcatgtttccaatcccatatcatctgatccccattgtcccaacatcgatcaattgacttcttagtgcgtaccaagctttttcactcggctcacctcaggtcagtgtttttctggtttcttggttcagttggttgtctctaagttgatgcatcatatctagccatcaggaatataatgtagtgttattttccaaagaagctgtgatttgacactcaataagaataatttggatgtgaagaattgattcaagttaacagtgtgagtttggatggaatctctgaacccattttgggaaaacaagcacgggggactgtcgctagctacatagctgcatccaagatttgatatcacagtatgcatgagcatttatcagtctgtctgtgacaaacatcgtctcctcaagtctgcctgtagttgtatgttcgtccaaacatgcacaaattttgaatcttttgtcactgtggaaatcatattatttcacttttctgatgacctgatgtagatggccataaactcttgcaggaacaagaacaaccatgaactacttccttgatgggcgaataaagagggcataaattatttttctatgtgtagcacgcttcctcatcaccgtcttcctgggctctgttgtgcactcttctaacgccaaggacgtggaggagaagctaagtatgtcaagattaaatttgagcacaaccaatctgtattttctttgagaataaactccttctgatgtcaagaagtacaatctgtttgcgggggacagtagaggcacaaagctcagcactgatgttgctgacaaagatagtagtttcaccacctgaaagaggaccagattacacaatgcagaaggtaacaagtaatgaaattgctatcaatttttttcagaaaattgttgcctgatcaagaagaattcaaggacggcggagatgaagattttgacactggcaccgaagagttcatcatttagattaagaagagacgatcaatcaaggccaaaccacccaccctgtctgaagatttgtgcagcttaaaaagaactcatctaccaccagaaattcagaataaattacagagcacatctgctcttattttgttcatttccattttcggtagagcattgcacatgcatctcatgacaggaagatgattaaagtacttctctaggtttttccagcaaatgtgatacgtgatttaatgcaaattatttgtttagtttgaaggctttccgagaatcatttggaaatctgggaattaatcgttggtagctcgaaggaattagatgttgattgcgatgcataatctaatctatcttttgcctttctcagcagatattgcaacaatcaggatctccatacatgatgtagcctggtcatttgaaaagaggccataaagaaagctcggtgtagtgcattgtgtctcaatgaggatgtacaagcagcaaagcagtgatccaaatgtacttatatagtagaacttgtcccattttacaaataatgtgcaacgaattattgtctattgcaaaaataaaagtctgtggatggaaaatctacttccgatcttcaattatcgacaaaatgagaaaaaaaattgtgaaaaaatgtgatttagtttccttttattttgggcaaaattattacagtggtgatgaatcagcaagatgcctccctttaacaattaaataaaatatggttagatgtaactacatatatagttttattactgtttgcttcccaatatttagagttctatattagatgagattatcgttcttgtgataatctttattgattgattggtgcgtaaaaaccatgtaacgaagtgtactaatgtattatgataccagataatgtagtttttgttttacttccacaataggatgaatacatttatctaatttgagaactgtttgttgccattacggtactagctaatatcctcagagtagatgaagattaatgttgacgaagtacaatgggactagcaggttgatcaattgttttggtccctttttatgcgtttctaaagttaaaataactatgtagtgataacatgattacttttgctttttataggtttcgcaaggatgtcttataaatttaaatttagtcaaacagattacatatgtttcaataaaggtagtttgtaaattttgattgtgattgtccttataaagtatattataaaaatgtgcattccatgtgcacaattactagtgaggagaaaagcatgagaacgagaacttctattccaccacagcttagtcgttgaaaatggttatataggaatgatattccaccacagcttagtcgttgaaaatagttatataggaatgatagcaaaaggatagtatatgataccatgataattgcatgccctaccgcacttctctatataatatcaataccatacatgttatatttgttatctgcgtgataaatttagagcttttgaacctttgccttctaaatcatagttattatggagtgattaaagccttctaaatcatagttattatggagtgattaaaggtcagcatgagatattagagaaaaacaattaaccaagatatttttatgacacgaaatacatggctctagcaattagagcatcaccaacagtatattctcaaatccttcccaaaactgattatgagatattttagtcaaacaatcagatctaacatatcccatatagccctgtacatgatgttgagttagcattttaattttttcatttccttaatttgaggggaggctccaactctatttctggcatgtccctccttttcttcgccgcttctatcctctacttcattgctagcacattcctcctttatttctcctctttcatcatatacttcccgggccactggcatcgggacagggagtgcgtcgtgtaaggaaagaaacgaaaattttagtttagttggaagtttaacaaggctcattttagttgttggaattgaatttaggcttcatcttataacttcaaaaaattttacggatagattattgctaatctattggtaatgctattactcactccgttccatagtacaaagatgtgtccatttctacttgacccaaagtataagtgaatttggtatagtatttgtcacatatccatcaactccaattcaaatttctacttattttaaccccaactaccaactcacctacaaccaaaatcacatcgagtaaggatgttctagtcttttcttgctatccttaatattgcccaaaagagaataatcgtaatcacatctcataaccatattctagtcttttattgttatccttaatcttgcctaaaagagaataatcatataatagaggagtatcaaatagacaaacatataattgattaatgctccgatcccaattttgttttacattatatgccgtcgatatatactaaggacatatgtgattgaccatattatctagatcaacttataattcgcggatattcacatactactgcggcgaacacacaaatgggtgtaaatgtcgatctttagtacttgcatatatgaaataaagaataaagccatggtgttgaatgatactaaattgctatgtttgattaagacaactatctgagtgggaaaatggtgtcgttatttaaatatgcttgctttttttctctttgtatctgatttgcattggttttattgttaggttgactcggggtaagtatttggaaacaaatatttgacatcatggctataggtctgctacttactttgtggctacttagatagcagtactatactttgctggctatttccgaacaatctaatttttcatctagattttaagaagttgaagttgtggaatccagaaaaaatgaatcaaaagctagaagctaagaaccaatatttagattctcacaagctgactaacaaccaactgcttattaaaatattaagcgtccataacataccataggacttaaactcgagtgagcatatcagttaaattacgatcacttttttttccgacttgatggtctgtttgctttatcctttttctgacgtgtttagtttgatgcttttacaattgtgattgtttgggcaggtgccgatgatccgtgataccagctgatttaatttggcttgaccatactaatgaacataattaaggttgtttaaagaggcccagttacacagtaggtgggtagcataccaaacaccatcagaactttaccctacaaaatgtgctttatctttttcttcacacaaatatagcgtgaattcaattcacgttcacacaaattgaacgccaaacgaaaacaaaccactccttttcagatagcgaatttttttttgggtaataaggcatcaaaacaaaaccggtcctaattggcagtgttttttttttgttttgttttttacggacttaaaatgagccgaagtaaacgaaatcctgaagaacttcaccatgtcattctagattcctagtacatcctcacacagataaacagattccaagtacatccttacacagataaactgcagataaactgttcccatgtgaccttgacatctcccacccttttgtatagcttaaagcaattactcccttcttccctaaatgtttgacgccgttaatttttccgttaatttttttaaacatgtttgaccgttcgtcttattcaaaaacttttgtgaatattattcaaaagattgagtagtagtagtatatttaacaatgaatcaaataatagaaaaagaattaataattacttaatttttttaataagacgaacggtcaaatatgtttaaaaaattcaacggcgttaaatatttagggacggagggagtacatatttacaacaagcgcggttgtgcatgcaacaaagattgcacaaagttgcatctaaagttagtaaattaccaacaaatatgggacacggtatgccaatgatccaagatgaattcaattcaatcagtacaacgccacagatatggaagcagaggattaagcacgaactaccaacacacatcaaatagcacaagcacaaaacaatttactatgcatgtcaaacaaaggcacagaaaacagagcatcaagtgtcaaagccagagtagacgccactccccctcagaagtcgcttctcttcttcaacgtagttcttccccctgctagcctggccacgatctctcttccgcttttccttctgtgagaaggaagcatctttattctctttctccatctgcctcggctgcgggtttcgcacaccaataagcttttctccctcagttactgcagttcttgtgcgctcccgttcttcataggattcagtttgatcttctttgtcgttgcgatctttcccggtggaccaagaccagttaggctcaacctttggagggggcaccgtcaagacagatgggccgccacgatacccatgccggctcaaagcattgaaatccacaccaccaggtttcttcttcttcgacatagctgttgttcagagagctaaaaccaatgttaaaatgaacactaacaatgagaggtaatactcagaaacatgcatcatctggaatccataaggctttgttaggatttaccaaaaccaaactgtgcaagcttactgattacagcaattaaaaagacaacaaaacagacaacccaaaccaacgtcttctactacaatttaattttttttttctcaaaaacgctctactgcaactttatgggagggaacactggatctatgtaggcatgatacattggagctgatgcccaaagactggctaaatgttgactagaggtggtcaacctatggacttcttcagtgatccaaataagggcctcagctttcacaggatggatgatagcatccagaggccggtgctcatcatcactcccaactctctgctgatcccactgtttcaagaggacattggtaaggtaatgtaaaggctgcttatataactgcttcaccgacctgccgagtcccagccatgttgtgcatgggattacagatccacggtgagcaggaactggaatatgcttcatatactcttgatacatttcagccttcctgatcagtgcacctgcatgatctcattatagtaagcatggaaatttgtatctctacgtagaaaggaaaaaaaccttaaaactacatgagccaatccaaagcagaacgctattgtccatgtctgaagggtataaaatccagctcaaagcctctattagtgcttgagaactaaaattatactccatccacaagagttagacctatttcatatttgagttttttttccaaataagttgttcctatttgtagtgtctatgcatccaaaacttaaatggagaggtaaattaaatgtttgattaaaacccaaggagccatcgtaatactcattggttgcatgcgtgcatacacttcttgatctttgttatatgcaagatgagttaatttctctttggtcttggtgacaaaagtaataggtgtaactttttgtggaagaaggagggagtactaatttgctaacttattttgtagtgttggtctctggctcatcccatagggtatatagagaaagcataggactcgactgttgaagctccaaggtaacgggcaactcatgataattctttgaatgacagagtattaattacatacttagttataagagataaatgaaacttagatagacttattatagtggtgttcataattagcacaaaatcatattaaaaactccaagaattttttggccaaatcagcatgtaaaaccaggtacagatataacctgcaagattgtctggatgcaggcactatgagcctgttaatataagtggtatagccagcagtaaataccattgtttgggagacaacttttcttaaaatgtccatcttttaataatggcaacaagtggacaactttcaaactcaaacctcaactgtgaaaataacatgtgggcaatattaacatacagggaaaacagggaattcctccatgacaattgcgataactcaaatatcaacaatatcacaataaattcatgtacttcaaaatactgaacattcacttggtcacatgaaatctatactctatatagaatgctaaaataacatatagcgcgtaaccttgtaagaatagaacactagctaaggtaatgttgcttagtttcaaaagaaaacccatgcttagtttgttctttagcaaagtctaagaaaaatgaatactaccactagagaaaaacacgtgagttcccccagtgtactgctatataatttactgttatatcaatcccaatcaatatgaaaagaacaagccccaaatttccatagatggctggccaaaataatcttaagataacgttaacgaatctacagtaatgctgattctctgatgtgaaaggtaacgggtaaataaccactatggctttgcttgagtggaaggggactagatccaatccctttggatagatatagaaaactgcagttaaaatccctggccatccaaatggatagattctgatccctgcatatagaaacaagccctaatttcacaaatagactaaatttacagtccgaaacaacataagctagctaggaaacacagactaaaaatccatactccatgttgaactcatatctcacaggcaacacacaatacagacattcaaaacaatcttgtgagagcatagcgaggccatatagcatgctaacaaaccaaaaatatgaaaaatctcctcgtgagctaacaaaaagacagagacagatcactgggatagctctcaccgtctggtgcggcagctttggtggaattgggcagcccgaaggcgttgtcccctttccccttcccggcttcatcgtcggaatccgagctcagggagtcgtcggaggagacttccagcggctcctcccacggcgccgccctcttcatacctagccgcacccggccaccgccacatctaggggggttagcgtcacgccgttggcgaacggtggagtcgaggccgtggatgatgatgagcgagggggggcaatggacgggtcctcacctggatcacggagacgtcaccggcggcacggcgcgccgagggagaagcggcgcggcgcgcgagggagaaggtcgctggctcgctcgccgtcgcttgtcgccggcggcggggacgacgaggccgaaaccctcgattgctgtgttgggctttggatcgctggatgagggtggagacagaaggaaaaagtacacctaaggtacctcaacttgtccgcgaaaccatatatgggcaccatggtatcaaatgcacaaaatcactcaaatttttcaaaattttcaaattattagtatatacctagttataataatttgatttatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttacatatatatatatatatatatatatatatatatatgtatatatatatatatatatatatatatatgtatatatatatatatgttacttcgcatttatcctaatacatttttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgtaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttaacagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagaggaatgcggaggggaaccagcaggggcacgtggaaagggatgtggaggggaaccaggaggaggaggctagtggtagtcaaccctccgttggacagaagagggcacgcgggcaacgaggtgcagcgaagaagcttaagggtcggcacatcataacggaagtggaagaagatggacgtcctagtgccccagccgaagccaccaagaactatgtacgtcacagcggttgggttgtgcgggataacgtgcctgtcagtacggtgtactggcgaagaacaagggcacacggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacgatggaacgctcaacccagctgatggctcactggtcttcggctatcagatacgagaggctgcgcgacgactaacagatgcagtggaagcctcctctcagggcacgttctgaccagacagagatagggacgagctgacactcgccctgcagactccagagcatccaggacgaactcgagggaaaggggtgattccttggaagattggtttcaaggaggacatccacacatacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatatgagctgtatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctccaccgcctacccacacaagggcaacgaagaaggcgaaagttgacgccgccaagaacaaggacccggggtacgattgcacgcaagaggagctcgacgcttacgttgcatcagaagtcaagagaccattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggtggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaaataaacgtcgcaatgctcgaccaatatccacaagaaacagaggacaatctcgtccatcttctgaaggcgcatcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgccataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcaaggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctatcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatattatgcatgtatatacatataatataatataatatatatatatatatatacatatatatatatgtatgcatatatatgtattgaaacatatatatatgcatggtttatatatatatatatatatatatatatatatatatatatataaaccatgcagcaatagggggcatgcaaaaaaaaaggtcagctcgatctttactcccggttatttcacccgggactaaagatagcgatctttagtcccggattggtactcccggtttggaaaccgggactaaaggggggttacgaaccgggactgcaaagggtttctccaccagtgaacgcctccgaccttgtcgtcgtccccatggatcaactgccgccaagccctatggcccctcccttctctcgagacacacagtgtcgaccgatacattgacaccctcgcgccaaagagaccggatccacaccatctggtctttctcagcgccacgatcactggtagaaaaagcattttttttacgtggaggtcttattttcgctggcggacatgacgcttagagccaaataaccacctacaaaaatataaatcggcgcctgcgaaaattagtgtggtatatatatgtggcacatgcagctgaaatttttctaagtcttctcctcttccctcactctccccgccggcggaaggggcagacggtgtggggcggccagcgggctccccctccctcccctccagatctggccggagggggcaggggggaggccggcagccggcagcgaagcgcggaccggcagccaggcgcgggacggtgacggcgtgtgctcccggcggcggcggcgggcggtggcggcgaagggcggcagcggtgaggagggtcgaggcggcgcggctcccgacccctccctcccaaatctggtcggagggggcggggggagagcagtggccggaggctcccggcccctccctcccagatctggccggaggggggcggggaaagcacggcggcggccgggtggcggagaggagggtctaggcggcgcggccacggtggctcccggccacccctccctcctagatctggccggagggggggcgggccgcggccgtgcggcggcggcgggacgacggcacggcgcagacatgcagaagcggcgacggacgacggctgggcggcggcggacgacggctaggaggcggtcgtgattttttgaatgtttttatttgctttctttgctaaaattgattcggtgattttggatgaactggatgaattgatttggtgatttttggatgaactggatgaaatgaatggattggatggggaatggattgcgaatgggaagctgcccattttttttagcgctcgaagctattttcgtagctggatctattgcgcgcctgcgaaaatcaactattttacaggcgttgaggtgcaagcggatgacttgtccgcctgcgaaaatatgatttggcggcctggaaaaagcctttttctagtagtggacgtccgtgaggtagaggaggacaggctagcgccgctataggaggagaactgcaacggtggcagctcgaggcaagaggaggaggcgagcgcatggcgtagcaggtttgcatcggtccgactcaggcgaacacctcgcgagagccccttacaccggggaagccaacaccgctggaacgaggggtggagcaatggtgtggtgccgtggtgggtctttttttttgggggggggggggggtaaaattttcatatacttttaataattacagcaatatccctgaatctgttttttttttctcttcttcgcattatatttcacttaaggataatgttttcttttcgcaaaatttaaaataagatgtaggtagcgaaaggagtttcgctattttagaaaatatcaaaagctttcgtgcaaaacgtgtagagctaatccatacgtgtctagcatgcacatgcccctaattaagagcgtttacagtgcatccacacaaaaaccgaacctgggatgccatattggatggaactctacaaagcaactcaacccatagtgcaagctaattataatgggccccaccaacatacactttttcatcttccctgtctttcctcattacctttttaaaaatcctaacacatcccctccgtaaccgattcctctcctctcatatcccagcgaccacgtcagtgcctccctcccctacccacctcggtgatggcggatatggaacttgacgacagcgaacatggatagtggcggtgatgggattggcgctcgacggcggcagtggacttggcctcccctcttctcgctcgccgccgccgcctcttctgcgtcttcctcgcggaggtcaccgccgactggagctgcgcgactcaccggatctggcccggcgcggcactgacaaggctcgccagatctgatggcggtggcttgtcggggagcagcacagcgcggtggtggcgagtctcgacgacggcgtggccaagctcgacaaatccagtggtgatggctcatcggggcgcgacgtgaggatggtcatggccatggcttcgtcgtcgccgccgtggttgccaccgcgctgccctcctcgcctacgccggcgagcccctcccctctttaccatcgtattctcctctctctctctctcccttgcttcctgctgcgcgtaaagacccactccctcacttttcctaacgaagttgatgaggtccctggtaccaaaagagtgcacgagaaccccatgaaaacatggtccccatccctttctcttctccacgcaaccaattcatctacgtggctagtcggagctgaatgacacatcggagctttgtgaatggcctaataacccatgcccggacgtccatatcagacaccaagctaggcaacacacaacgccatataaacaagcacgtgcccagtcgcccataccaaacacggaaacgcccgataaatagtgcgatgacagtccaaacacaaactccttttcctctagtccaatcaggaagcaccgctgaaaaaaaaaacagcgtgacagtcaatcgaggataaaaaatttcaataaaggagaaagacggtggggacagggatattattaaccgatgatacatgatcgtgctggcaaatcttattcgagcggtacaaagattcattcttaggccctctcgttcgatggtaaactgataatgatacattttagggagttgatagttcgttgatgcacattttgttgggcatatttgttttcatcgtcagatacgcccccaactttgctccaaaaggcatgctcgctacaatcggcggaagatggcaagtgataatttgcattgctcggagagattttcaattgacagtatttctggagctatcgacaaagacatcatgtattttaacatcactcaacagctagataaatatcattcacacctgtaacagcgcacgaaattaccctgaagaattgcaagttaggccaatagcaaccaataactttctgctacctgcaaaactgccaaatttgccaaaataacatcgaaaaagaaacgcgaaaagagtaagctaaaaatggcgcgagaatctcctcttcctcttcgtccttggtctataagcacactcgataagcttagccacatcgagcaattcttgtagtaatcctgcagaaagagtatacaaggaatccaagaaacctgcaagcatctatctagccatggccgccgcgagagcgggcaacgccgtccggttaaccttcgccgaggaggcggcgccgccggtggcagctacttcgccgggccgccgctcgctgcctcgaccccattgccggggagaccgacggcgacgacgacgtcccttgcagccggtccaactgcgtctcctgcagctgggttatcgtctgaggacagttcagttttctcgggcgtttcttgatatgttcttttcaggtttaatcagcgagttttatgggagtttgatgagtagaaaaaagagggggcttaattagcgtgttctatggctggattaactaatcctcgatccaaattcttcatctaccaactcttctaaatcaatcataatttttctctattgaattccacatactttcttaaccatgtccaagagttttaggagatattagcaaataactagcttttatctcccctgttgctactcgaatttgaagtaagctttaattaacttatcggttttgagcgaatcagcgagtcgtactactctggtagatagataatcttctagtacctatgtaatgcgaactgttaagttataaatctttccctttttttgagaaagagaggatcacctctcccatttcaatacagaaatgagaataatactgtcagttattacaataccaaaaggaagaaccttctaccgtgatgcagcaaacaaccttctacatcatacatccaatctaacggtaagcaactatcagcggattccatacaacatcaagagacaaaaaaggcaagttaaatctacatgaatacatcaaatcaagtgggaattaattcttttgtttatgccatttcacattggattctaataagtacaattacttcagcacatgctacaagattgggtatacttaattacattaaggaacccagttaagacaacaaaaaaaaaaggacaaactggaagcatttcatctattaattataagttctacaatgatatacataaattcagctttccgtacagtggtttggctatatgaagactactaaaagaagctacgttcacaaagaaccaaatctgcacaaggtattcagctgccaacaatgtccatggcaagtcaacatctctgaaatctaactagtagctggccttattcagttctctgtggtatgtcttccaacctaatagaactgggacctatttttaggtgccaaaaatactccagaatgtccaaggtaccacagcaagcggtacattgaacaaaccaaataaataaaacaacaaaaatcgattacaattgcgacaaacatcatacctagcgacgtgggtacagatcccaacctaagtctggctcttttcgcttcaatactggcaccccagagctgccaccctgtgacatgttacccatgcgctcgtccacaaacatggtctgaccttggaaagacacaggccaatagcttgcaccttccctacgtgcaccttcatatgaccttccatagttgagatccatgctgggatgaaaatagctcaattcactagagggtgggattgctctgctgccgagagatggatgagatgtgcccactcctaagtttggcaccgttggtacaccgaaacctggcaatggaggtataactggcgtgccctttgcatcaaccatataaggaacagtccctggtgcatagaaaggtgacgggaaagacaaagcagaatgagacgaatagctgacaacactataatcagggggtgtatgcccgtaagattgcatagaccttgcaggatctcttgattccacacttggcccaagaaagttatgctcattttgatggctatgttccttctgtccaagaactattctcttgcccagaattgtcactgcagaatggtctgacacatccctcccagaagtcttgacagaggactcatctgcacctcgtaaaaagccatccacgattggtgtgttgtcattcaagtcaaagttccttactgcaggttgccttgaagatgaagaggaagaagggtgactccaatcgccattacattgttgtcgattccaaaatgatggtacattacttgtggtgattgcagcttcctcatcgtcacatggacaattaaggtcaagttcaaggctattcaggccaacagttgcagaggcatcctttcgcactatgtcagaagaaagcggaaggatggctgctgaaagtggttcaccagcagtagcattgtcactttcagaaacattcaagtcaaacagagcattgcctgttctctgtgaagaggcagatactgatttctctccatcgggagtacaccgaggagaagccggtcgaaaagcactggtggctgcagaacctttccatcccagttcaccttcaaagtgcaatcgagctgggaatacagatgaggttcttgaggcagccacagctataggtgttgataaattaattgaattactaagcgtggacttcgtatgacaatcaacttcctcagtgcactggttttcattaagatcaatgcctcccagcttcatgcttcgcgtatgttttctactgaaagtaccactgtcatccgtgatgcctgaaccatcctccttcatagatgaggaacttcctgaatcctcccctgtagtggaggatttattatcattatccggttcatccatgggcggttcaggctgccggcgtgcttctaagtcgggactatcagaccgtctggaattaatatcaggggaaccacaaaatggtcccctgtagtcaatgacttcccgctctacctcaatagcaaccagacgagctacttccagtgcatcagtatcatcatactcagctaatggtgttgatgtatctcccttttctgctttcgatttcttgtctgctgcctttgaggaatccccaaagctcgtcatgcatctcttcaacctcaattcattgacagcgccctttacatctgtatcagatgatgatgtaggcccctcctctttccttgtactttcatcatctgatgaatcttgcatgtcaaggggggctaggtcccagcctcccactgtattcttctcagagtgtggcatatcttccaaaaaggattcacctttcttgatatccacgctaatagaaacattttggtcctgcacatccattttgttactaacaaatggattttctggattattagtcccagaagacttggcctctgcagttccatctggcagtgagacttgtgcagcaccactttttgcatcattgttagcagaagactcctccgtcacaggtacattttctaaaccattacgacatgcaagtgatggtactgaggggttcccatcaccaataatggcatttccatcggagtttgggggtatcatcaccagcgactgcttcactatatcacagttatcattggtctgggagtgattaggcaaaggaacactcgagcagaccatcacctcagacttcgacttatctcctgcaattgcagcttcatttgccccaccagactcaggtttaggttctgggagtttgagttgatctgggttccgctcttttgctaccatgtcatggacatcagaagtgcatttcggtacacttctccatttatgacaaagcactcctgcctttttgttgatatcagtattgctatgagaaagtagatgctcaacagtatgcagaacaccacaagaagtaatttgtgcattttcaactggaagacactccagtgcagacaatactgcaactattaggtcttctgctgcattgctgatatcctcaccacagttctgagcatcctgaagccattgatggaggaaaccgacaccatttagctgaacaaaatgctgaagacactcttcatttttggtggacgctagagtgtttgcagccgttgcacactgccttatcaagtcagcggtgttaagttcagcagcacttttgagcttcttgatctcagataccagttctccaattcgtgctacagttgaaatgccatccttcatctcagtaagagtaaagaaatcctcaagcatcgtgcttcttgcactaagtcactatacggctgcttgagtgctaaactgagtgttatctggtttgatggttatataacatcctgaaatatggaaagcagcttggccattaaaaagtattttggatcaacttaccacaattcaaataacagtatgaatcatggtgaagaaaacagctaaaaaagataatatcgaaagtgtatctaggcaaaagaagaaaaaagaatatatgagcagaagtgcaagcagcagcaccctttatctctaggaataattgcatgtgcataacccaataaggcattagttttagttaattgcataggatataatgaatggcttagatccttatttggtcaagacaatacaagtattgactttgagtgtgtccgtatatgccactgacaaaaagatgcctaacatttcttaatttacagaactacgtccactgctcagagctcagtaattctttatcagcaaattctaaagagtcatctaatcggtgcgttctacaggcggagtaagaagtgcaaattatgccacaattacacatgaatcacacataaatctaagtgtagtgtactagtgcagtaagccactaataaggaagaaacacgcatccaccagaatcaaccgcaatttccccgcttataacgaatagcgcatccaatcagtaaatcatacacacaggagtaaatcgtacacatcggcaagtgaactgcaaaaggaataagcacagatcaacacaaatcccataggcacacgcgcgcgcaccgtctcgaaaccagcacgaaatgcgcatccgcaaaattcgcccccaaatcacacaccacccccgaaggcctaaaccctataatccatcgtggaggggaaaggtgcgtacgaaaaaggggaaactcaccgtctacgccacaagtctccaccacccgacggggcatgggactccgcggggatgagccc

SEQ ID NO: 58676 - DNA, 1689 bp, Oryza sativa
agggtagtaaagaaggaaattaggtatatggggtagtagggagaggaaaagtaagttaggattggggaaatgaattggaagggagaagagtgatgtgattttataaataagagggatggaaaaaagggtgataaaaagtcaatggtgtcaaacattttgaaacggaggaagtatcatgctattgtactcgctctgagaatgccgtgctagcccaatcgcttcgcctgcactcgattataagctataacacttattaaaagaaataaaactataattaaaaaaccatcaaatcagttttaaaatttaaattttaactacatcttatagatttagcttaagagtaaatgaacaatatctctttagaaattaaccatgtgttgttgataaatccaaacgccggggtcatgaagccgccatgctcgccaatcgccagctgctggtgttgatccgatcgatcgatcgatcgatccatgtcacaccataacagcgaccacgcatttcttcgacacaagacatacaattactactagctatactagagtagccaatcactataaaatgcttcagttgctttctaccaataatattataatctacgagcatatcctctctttgtcccctaaaatataattctagagatgaaactggacaagcatcgaggagtacatctctagctagtacagtagctgattagccatgttacgactcaagtcgaataatcaaggagcaatctttgtcatgtgtcttcaaaaaaaaaaagaatccttgtcatgtctgcaatcatgcataaatggccgtggatttaagaagaggatgattatccattgaagagaagtcatgggtgtccattatctacgatgtcctgaactgataacaatcataagttccaataacatactccaacattggagtatttggtgattcaggttctgtatctttctggctgagctgagttcaacacttcaacttgaagcaatcatgtactccaacattggtagtacataaataatggcaacgaaggcagatcaatgtgggacaaaagaaggtgaaaggataaattctgaatctatcaacgccgtgtttagttccaaaataatttttcaaacttccaacttttctatcacatcaaaactttcctacacacaaacttccaactttttcgtcacatcgttccaatttcaaccaaacttctaattttgatgtaaactaaacacagcccaagtgtagtacctggatttttcacattttggtccttttgaaaaacttatttcgcaaatagacccctgaaaaaacttatcccagaaatgatccttttttggacgccagagtggctggcgccgtcatccaacaggacggcgccagagaggatggcgccgtcctcctgccaccgtggcgcacgcgaaccgacgtggcaggaggagggcgccagccatgctggcgccgccgcctccattcctgtttctctatatagagttgcaacggtgtcatttttattttattttttcggatgttttttcacacttaggatcacgatacaaccaaccacaaaaaaaatttaaactcgaactaccacttaactaagtctgaaaatagctagcataccacttagtctactttgcaccttcactaaaattagaccataattcctttagtaaaactctttgatcagcatgttaaacataatgcact

SEQ ID NO: 58677 - DNA, 6928 bp, Oryza sativa
cagatatgtattagagtatctacctacaccgacacagatgtacaatgattccaaacacagggtcttgagctcgtacaaaaggttagctggtacagttcgtcttcatcaatcaccagtgagttttatccccaggaccagcaagtatgatctgcattcggacaagcaaagttaattactccgtgatcattgcgcacaacacagtccaaaaaaaacgttggggaagaaacaaaattcctcgagctggagcaacagagtgcgacaacttcttgttgtttttttcttcctccaagacaggttgcttacattgcaatcgatggcaaatctgcgagcgagcatgattgcagagttgcgttctctggccgtctcgaagcccagcaccaggctcaggtctctcctcggttgccagtacatcgcttggggtgcagcatctccaccgcctctcataccacatagctgaaatgaacaacaatgcaacgcaaattttagactatatcatagtccaatgatgtggaatgaaagctatcatcagtgagatggaagcaagtttctacaccatcttatgagtgctaaaagtgttgcctagaatacctgcatcgttgaggagtagaattcttttgcaattactgtcttcccttttgcgagtctcatccgcagtttcccgatggaaagaacatgaattgaatcggtaggctgtttgattccattcacttgaagaacaacaacctgccataaggggcaaaaataggtgtccttaaagaatgactagtaacagtgggtaaagctgacttcatgagcagtaaatacacagttcttttattatttttagtgacactgaatatttgatacaagcatccaaatagaatgatttcttgacataaaagcagcagatggcatgccaactgggaaattatgaaaaccaaaatatctgacaagactcagtaaatagcaagatttataacaaattatgtaggtataatgcagaaacaaaaatggataaggaaggaaaaccattacattatattcagtttcaggattccttagaagagtctctacgtaatcgaccaatcctgcagctgctcgacaaaataacgttagccatgtcataataataaaagcgcattaatgttaccagtcaggaaaactaaccaggatccacagggccagcagtcttcacgacagagatttcaccgcaatggttgatctcagcttgcaaataccgcccaacatcatgtggttctggagcatatgcttgctttatggcacctatagaagatcggtagcaagtagcaacagtcatcagtgttacatcgtatgtagaaacaagatcgttttgcttgatggaaatagtttcacctgaaattatctctttcttgtttccttcaggctgcacacggaaccactgtattgtacttcttgataaatcaacatatccatcactctgggaaactatgcgcaacattgagcctaagctttcaaggccctccagctcatacgaggacacatcgttttcctcatagctttgatgcaggtgtaactgataaaaaggacagccaatcatgcatggaaataaataccagatcttgatctctacataccgaaattattcatgttgggaacttcacagatttgagaagcaacatagaataaaagaaacgattcgatctaaagacactattatttgtcttttacggctgatcatccaagtagcaagataactcctatagaaaaacaatgacagtaaaagtaggcatgaagcagcaataacaaaccactacacgctctttggcatcgttctgcttatttgcacaagtttaaaagaaagaaagcaagctacagagttgatatatgattctatcttcgcaaactttgacatagaattggtgagctcttgcggtgttttgttttcaacatgctccacagtgcacggtgtgattcaccgcaaattcatattgcaatagctggtttcaatctggcctactgtagaaatgacaactgaaattgccaaaatcagcatgtgttaaccatacctctttcaaaagatgaacacaatttgaggacttctcagctaattgttcacgtaggacttcaatctcattttcaatgtccattgcctaaaagataattaaaaacttgaaattggtcatttagaaaccataataccatacgatcaagtatgcaacataggcttgcaatttcacatgtagagtgacataataagtgcattctaccttgctgggacaatgcagcattttcactctccgtgcttcttgagccttttccttaagttcatcctcatcctaacaaggtttcaaaaagaaatggtaaacagatatgtacaattcagcttgaaactagaggaactctaaatatggaatctctcttagcataaatgaatcacaagacacaggcagctggaaattaggggtttagggttgaaagtgcctaagacatgtaggaaatgacaacaaatgtaacaagaagaagatatctaccaacaaaaatgatttattatgacttcatacatcaatgtttaatgttgcatatatctcatagttatttcaataaaataaaagaacatagtgttcctaccacctacctgtttcccatttatttgaggatcaatttcttgctctttaactaattgttcaactttttgtacagcagctctagcattatctatctctatgcgagcgttagatctttcttcttcaacaattctcctggcatcttcagaagcctgtatgaaaatacagaaaaacaagcaatgattgaaaagggatgaacacatgaaggtataccaatggatagatctacccaaggcgatattaaacacgattctacaagaagccggtaaaaaaacagtaattattgtcagcatgcttatatctgaaccatattgaggaaatcaggtggaagtcctaaaacgtgttattcaataagctgtgattacatgtgactgaaatttcactctgtattttggaagggaaaccactagtacttcaatagttcagttccatagtataatacagtcccaacataagaagcattctattgttcattagtactgcatattgttcataggaagaactcaactttccttactagcaatttagcgaaacagagaacacttaaaaacaatggaacctgacattttgctataacaataaaaaaccaaaagtgaatgtcacaagatgctaaaagtatgttgaccgatgttcatagcatgcatacactactgaactacaagaaattttggacgcaccagtttcaatgaggttgcaattttggcaacctctgccttttgctgcagcaactcgtcttctcttttagacagctgaactgttaaaacatccacctatagaaagtaccaaactattaaaacagcccacagaaaaggcaccatttttgcatatggagcttggagggaaaaaaaaggacagaatagtagcctcttttgaaaacacatgcaacacaattaaagataaatagcaacaccattagaaaagttacaaattgagtagcaacaatccttggtgaaaaatcaaaatatggttcataacaagaaacaaaccatagaaagggactcctcaatttcatccttatgtttccctgcaactcgacttctcagcgattctaatacactctttagatttttcagaaggatgtctcgctccaataaagcagcttgtctccatttaacctgagagttcaagatttcaaggtgaggccagatagacaactttgatttatataactccattcattcaagtattgggccaatcgtcaaagagcattcaggaggacagggcctaaaacaggtaaaagttccatacctcattagacaacaatgtggcagtgttaagacccttctcaaatttcatagcaagctcacggactgaaaggcgctgactccgatgaagtaggtctgctgtttccttggcaacagcctctttcagagatggcatttcttgatcatctgtcaatttgataactatcccattcaaactcttcttgtatgtagggaatttatttctgatgaagtttgcaggacgcaatggccctgaccagaggacatcattatgtgtcttccgcccgaaatcaattgtggacgcccgcgtcatttatacagcaccctcaaccttgactaaatagcaggctttacccctcaatagtttacagctggccacagtaaattatcattagttgaaatgctcgataattatagtttgtttaaaatgtgcatccataatcattaggggaagtcaacaccatcaaaaaaataaaaaggaaagagtacaaataaaatgcagtgtccatagataataaaaatataagacaaaagcaagtgctggtcggtttcaaacaaaataagtgctggatatcatagtatcatctagctgcacacaagtgctaccaccaaaccaattaaccaaacctcatgcgtcgcaagtattgaagtataaacaatactggtcactaaactcaaagttacaaatctgtattggaggctacagaccaagtaattgttacacttaaattccactatgaaggacagttagtagtaccagatggtaaagctataaactactagtgcaaatttgtcagtggaatagggaaaaaggacgttcatgtatgattaaagtgatcggtggggaacaaaaggttaaccaatcaccaggtagcatcaagtacagttggaaattttcaaacattgtagctggcatcagccaaaaaatagtagttactctaatcttgcgaacaacaaaaataatttggagctgaaagacctttgcaattttattacaaatgaaactaaacaacacagttcagaattcatgggtaaacttaagcttagacatagcagagctattcaattcatgcacagttcttctgggcttctggctacacggcactcgtacgaaaattaaaactgaagtaaaggcgcatgaattcaattcactatcgggacatgttttctagtaggttcgttggcaaatcattgctagtatatactcctgcgctaaccacctcgccactccacgcaaatgcgagtgcaattccgtactaatttccttatacaattcttgtttcaaaaatatatataatttgcttaaattttcatcaaataatgcactatagcagactcatactagcaaaataaacagagagagagaaaaaaaatataaccttctgccaatctgcctcccaatcgtccagccattcaaaagcagtaagtagaaagatgaacaaacaaaaaacacacacaaaagaaaaagagagagagaaactaaaaaagaaaaaacgcacagagaaaacaggagagggagctagaggtcttaccaaggagcttccagaacgcaaacccgccggcagccggctcaaatggcgctcgctcgccgggatcccgcggcagctgcacccacggcggcgaggctgattcggcgaggaaaatgtggcgcaaatctgggggagagagagagattttggtgcgggtttgcctctctctctcctctcttttctctcttcttctctcgcgagcgggtgcgagctttgaatggcagtggcgactggcgacgcgggggtgggccctaccaaggaaaaagtggggcccacatgtcagtgggcccaccggaggatcgcgggtcaggtgagagtcatcacaggggcaagtgcgatccggggacacgacacgactcgactccgctccccccgagattccctccgggcggcgctgcgggccgtaggatctcgatcggacggcggaggatagtgggaaggggtttcgcgaccgttccgttgatggcgcggggcgcgtcgtggaccccacaccttccaccggtagtactccgtagtagtaggaagttgggataattcttgtctgtttctgtctgcacttcgaatttttcttcttcgtattttttttcattttgattgaattttcaggggagctgaacttcatctgcaaattggaatattcaatttgatttcagggcgtttgggacgcatgatttttcacagggttctcatgtagtgctaacttgctagtaggaagttgtttgttcagttgtgttgtcagtcttcacaagccacatgtgtggttatttataaagctgaagagttcaccaaaaataaaaaggacattgcgtcgcctctgagcatcgtcaagttagaagttaataagagcatcgtcaatcacatggttttaatttttttctcctctttttttttcaaacaagagtaatagatgtggttagcagctgcatctcgttggtgctacgcatgtgctcggctttgacttcgcaggattgattgaatcgatcccgggaacagcgggctatacatgtagctagcgcggttggtatctgcaaatctgctaacataagtaagagcaagtttaatagtatagtcaactactgactttaaattatctatatctaatttaatagtttgtttatattatctataaaccattaatatatggtcacgcctcgaaccttttagctctgctcatttctagtaacggaataggggcgcagcccttgatcaaaaaaaaatatggtcacgtctctcatacacacaacgtattggagtttgttgtgcagttggctataaatctgtagatcgctttccttctttcttctcttctctactccacatgtgcttacaactgactttactccctccgtttcaaaatgtttgacaccgttgactttttagcacatgtttgaccgttcgtcttattaaaaaaattatgaaatatataaaactatatgtgtacatgaaagcatatttaacaatgaatcaaatgatatgaaaaaaataaataattacttaaattttttgaataagacgaatggtcaaacacgtactaaaaagtcaatggtgtcaaactttttgggtggcgagccgatgtcaatcaaggccagcg

SEQ ID NO: 58678 - DNA, 6579 bp, Oryza sativa
ctgcttctcccactcttgcacgggtgcggcgttttcgtgggctgcgcgaaacgtggcgacggcgaggatgcgaagggcgggtgaaggcggtggatcgtgcggcgggaattgaatcacgggcgcgggagcatcggcgtggcgcggtcaaggtgggggcacaggcgcggcaggacgttgtcggcgtcctctgcctccgcgcgcaagaagacaagggcgagaggagagaggccgggtttagaagggaaaaagtgagggaggacggtggaaagggaagcctctcccttccgttttgggcggcgggcaggcgaggcgcgtgggagcggcgtccttgccggtcggccatgcgcgcgagaaacggcagcgtggctgggattttgggcggcgtcggcgggagtcaatgagagagagagagagaaagggtgagagagagcgaggaagaaggagagagcgagcgcacacgcgcaacgcacgtgcgagggggaggaggaggaggaggaggaggaggagcggctgagaggagatgggccgaggagaaaatggcccacaaaaatccgagggaggcataatagactttttcggaggagattgattcgaagagaatttgaacttggaatttgacttagattttggaattgggatctggatgagaggaaggagtagacggaggattcaagatggggttttggatattttggatctggggaagtatttggcgatgattcaaagagagggatagaatttcagagtttgatttggagacttgagttggaagaggaatttcgaggaggcaatttttgatggtgacgagagggatcaaggacggatttgaattgagatcttggcacaacttagactcgcccacaaagaacggaaattttcgcatataagattttgccaaattagtttttaacgtctcacgaaaagcggagcgttacaactgtcctctcaagcctacaacatgcaaccttcataagctaaaaaaaaactatccagagtttgacacgtagaggctgttcagattatagccaatataaatcttaccaaataccaaaattttagtaagttgataatatcatcaaaattttagcatgatttcttatgtatttgccaaagtttggcaaaaaaaaaacctaaatatataggcatatctttaacaactttgccaaaaaaaattgtatggtttaaaatggcatcaatttgaacagccttgtacacatatccggattctggagttaaataagcaatacttccttttaaaatataaatagtttcattttagaacggggaagtagtaaagtagtgtcctatagaaaataaatctaggactggatatgatatattctagtgttacgaatctggacatatgtatgtctataagtattaggatgtgtcacatatgatattatgttggttttttacgggacggagggagtatatctcaatataatcagtttacttattgcatattgattgattgcctcgtcatgtcgatcatgttcaagtgattcgatccccaaaccgtgatctatagaacgttgcttgtgatctgactagcagcagcgtgcaaaggataactatatgaggacgacgtagtagcagcagcaacagcactgacgcgtgatccgtcaaattgcgtgggaaatcgatgtgaaccacaaggaatgcgagagatcttttttcagccaaagctgtccacttgcacggcgaaagccgtaaaccaaggcgctgccacgccaggtcggcgcactaagttcactgctgtagcctcgcgcgagatcccatttaggtctaccaaaccgtttggcgtaaagttatcatcaccctacactacagtttaacggttaaggtatataccgtgattttgaaaactgaaaaggttacagcgcatgataatcgcgtggtaaccgtacggtgttttatcaaccttggatctcatccatctcatgatcacctacgcctcagcctcgcccaactccgctttgtggctacctggaactaaagctgattgttcaaggagacggatttggtggcgacgatgcgagcgagacccgcgtacgggcggcggcccagcaaatcgcgtggatgtggcgtgtgattcgcggtcatgttggcccattggcaaattgtgcggtggtagaaaggccgcggtctttcgtgcccaaagcccactggtggtggtggtagggagggcagagaaagcagcccacaacgccaaacgcgtgtaatattatgatatgtccctgcactatacctcaatcttaaacgcatcactaaacaattaaatcacaaattagatgtgaaggcttcttaaactatcaaatattgcttttttttccttctatcatttcttagaacagaaccaccattgaaatctctagagacaacaaatcgagggagcgcccatacttacttcataggctaaagattttatttcctaccctctccgtttcacaatgtaagtcgttctaacatttctcatattcatattaatgtgaatgaatctagacatatgaatgtgagaaatgctataataacttacattgtgaaacggaggaagtatttatctaacaaagtatgtatactcacatagccacacgcccacaccactctatattttaaacattttaaaatgtgaaaaattgtagatgggtggtcgaccattttgcatccatcccttcacaaggggcatgcagcactatgccttggatgttcatgctcccaagtcccaaatcgcaaaccttttcaccctagctccattcacatacttctcaacattgcatcggaattcggaggaatacacatatacatacataaactttcttttagttttagcccgctaatatggtatacaaaaataagcaaaaggaaaaggacaggatgccggatgcaatgcaccactgtacatacatgccgtgcatgttaaccacagttaaccacaaaaatacatgcacgcatgaatgtctcctactgcctcctgaagccagcactttgtttactgacactgaggcactattacgaaatgataaacgctactactacctattgtcagcaagaggcacctattgcatttcatttcattcccatcatcatctggagctcttcaacacggatctccttgtgctccttgcctcctttcttcctaccaaatgcgccgctaatcagcttcttcttcctctcctgcagctccagcatcctctcctcgatgctatccttcacgatcagcctcaccactttcacctccttggtctgcccgatccggtgcaccctgtccatggcctgctcctccaccccagggttccaccaagggtcgaagaggtacaccgttgatgccgcggtcaggttcacgccggctcccgcagccttcaggctggccagcagcacggtcggagaatcagggccaacgcatccgaattggcggataacctctgacctcttcttcgccgtcatagagccgtcgagtcgtagtatgttaaagcctgctgctttaagtggcccttcaagcaagatcagcatcttcctgaactgagagaaaataacagactttgacaaagggtcttcgctctgtgaacgcctcagtagtttcagcaaggcttgcaccttggaagaaagaggtctatcaagattgactgaggaatcctcatcgggatgtttaatctctggcgcaataaagaggtcttctttgcatagcgagcgccggcatattggacagcgggaactagagctcttgaggattttcatgatgcaagtctggcagtatatgtgcgtgcagctcgttatgacggttttggctggtggagcgagacaaatcggacattcgaagtcatctccatcgtcaaccaatgaggccagcttcttcaacagctctgggtttttagacacatctacagcaagcaacatgtttactataagtaacagttactctgtaaatgatattttcaacatgcaagctgttatagcgcgtggttgataaatgtaagcaatgcaaccctataagaattgaaagaggatagaaaacaaacgatctcatcaatacttgtttttaggagtccaataccctaacaaaacaaagtctgaaaatggaaaaaatttacgcgtgcttgtcttcacttaaaaaacaaatccagaaaagtgataaatcatatcatacaaatggtgattattaattcaagcgactcaccaaataacctggacttccaataaatcctaatatatcaatcaaaacagtataaaagaaaaggttaaaaaaacagaatttactattttctggatataagataaagtaatccctgaaaataccaaaaaaaaatgtaaggagtgaggaccttactgctaatattgttatataaacaaggaaaacatttcagaaagcggaacttttatctgtagaagtataaacagaaatggactagagaaaataattcaaaggaatatgggaatatgatttcactggctatgcagcgatttctgcggtttactaagttatattgatataatcaacagagcagttgacccattggagaaaatgacggataggtagcaagtttgtaaagttaagctggcaagcagcaatgtactgatgcaatttgtcgattcaaatagataaaccaattacactcaacttgctagtttgacactctacagtaagatggaacagttctaagaaaaatcaaaagaaatactactatcatacaatgcttagtgtgcgaaatctctttggcaacaagatggttcaatctaaacagcacagtttaattttgatgagtgtattatggccatattatatcatcacaaaataaatccagaattacaaacaggaaaaaatgccataccttcaagggagctgccactgccaggaagccatgatttcaggtctaatgggcatagtgctatgtcattgcagagctggcggagcctcagaatgaaataaagcacagttgagtaattacgcaaaatcgaatccctgtcaccaaactcccgcagtttgtttttcccttccaattccatctggtcatagtactcacgttcctctgcagaaagctcaatataacaagctaaaacagttttgggcggaatgctgaccaagcttttgctaccactctctgtctctttggttctgcgcagggaaatagcacctaggaggctctgtaataagcagataagaagaatttaattatcagaaattgcaggtatgcacgtgactctttcagatcctttccaacaccattattaaagtactacctaagtatagttactagttcatgtgaattgtgaattacaaaaaaatgacatgtaatgacaaggcaaacaattttccaaacttacctgcaatcgtgccaacccaattccgttattctttctctctaaggggagctggatcaagctctgccagtagctcttgattgagaatggttggaatctcaaaaatgccatgagcgggtaaagatcaaatgagctgttctgaatgggcgtccctgtgaccacccaccgcctctccgcgttcaaagcaatcaccgccttggtttggcgtgctgcagagttcttgatcacatgggcctcatccagaatcacacggaaccattcaatttcctttaccggtgagccctcctgctcaagttcttgccccaaggtgctataagtggtaatcacaatgtcatatttcaacagctctttcttctcttttgtccgctctccatggtacaaatacaccttcaagctaccggttttcgtgtgctcctccagttgtgtcacccaagatgagaacaccgatggcgggcacaccacaagcgttgttcttgactcctcctccaccgcctcctcaaccttcctccttttcgcccctctagccttcttcccacctacattgcgagctttactccttccgatcagcgacaacagcgtgagagtcttccctagccccatatcatcagcgaaaatcccacccttcaacggcggcggtctctcattcgtcttctgatttgtaagaacattcttaaatcccccatcattatcttcctcccagaatggtggaaggtcgcatgactcctcacggtgcaccagccaccccagcgccgccttctggtgctcgaacagttcggacaccaccacatcccgcggcgcctccatgggcgcaatccgagctctccctcccttccccacatgagagaacagcctatcgacatccccgcgagacctcttggtctgctgctcctgcacgatggcggactcggagagggcgaactcggggtggtcgacgtggatgaggtcgatcccggaggcggcgagggcggcggcgacgagggcggcgtggggcgggcgggcgaagaggtggacctggcaggggaggctgtagagcctcttggaggcgggcttggggacgatgccgtgggcggcggcgacgtggccggcgtcgaggagcggggcgagggcggcggcggcgcggcggccgatgtggccgatcttctcgccccgggcgttgtcgacgcggatggcgttggcgtcgtgggggttgtggggctcccggacgaggccgacgctctcgcggcgggtgatggctcggccgcccttgtagtactggaggcc

SEQ ID NO: 58679 - DNA, 62441 bp, Oryza sativa
gtgtccaggactgtcacacctggagttttcccttcccttaggttccaaatcactaataaatggcttcaagaatttgctttggttaaccaagagaaaaccccagttaacaatacattaaataatcggaattgtcctggagaattttttttaattctctttgctatgaaaatcactaacatgacttaaagagtcaagctaataatttcttcctttgcctttggtcatgaattgttcccaattcactcccctctcagtccgcggtttcgttttgcatgacgaaccgtatccgtttcagttcacggaaccgtttccgttcttttcctaaaacggcaccgcattgtttttcctttttgggaaagtcctagtctcccccttgtttcctttttccctccccctccccagccggccgtgcgcccctcctccccctctctcgtgcgcgccccctctccccctcttgttcgactccctcccctcctcccaatcctactccctctaggactccacctttccaagtctagtcctctcctatataagtgatccctcccctgtttcttttccttttcctcctcaatagcgccaccaccgccctagctgctgccgccgccatcgtcgccctcacgtcgcctcgccggtaatccgttttccctcttaattgaattggttgaacccaatgtcaattatctccccatctaacctagcccgctgtgtcctctctagcgtcgcggtcgtcgatgatctcgtgcttgccgccggaccgccgctgccatcgtcgtgttccctcgccagttttgctctccggtgagaacctccctcttgttttagggttagttttctcctcgttttagttggtttgagtcgtgctgctaaaccctagtcgttgcaccgcgcagccccgcctagccgccgctgtgccgcaccgtttagccgagccaccgccgtgccgcgccgtctagccgagccgccaccgtgccgagccgccgcagcgctgctgtgccgagccgagccgccgcctagcagagccgcgccgctgccatgccaagccgccgcctagccgagctgcttgccgccgttgtgccacgatcgcgctttgctagaacctagccgccgtttgtcccgttgcatggtagttgagttgtttagccgcaggtgcaaccctaggttcataccgacctatcgtttgccgtaccggggctttaccgtgaattgtgtctagcccgctggtttagccgcagtcattgttgagtcgttccctcgttcgttcgaacgaggtgtcctccgtggatcgttcgttcgtccgtgttgagtcgttctttagtttagagccgttcagagccgccggttccgttcaccggtttcggttgatcatttgggtgatctcgtgtcatgtgaaattgactcgttgagtcggtatctcgtgagtctcgcttgctagtcaatctatcatttgttcttattttcctttcgggcattaatctcagtcaattgattaaggtttttatgttattagtaataacgcagagcatcttgtaaaattcataactaaataatctgagctctgttttaacccattcaaattgcagtaaattcgttaaaatgtcaagaatccatgaaaattggtttcttttgctgttttagtagctttttagcttgtattcattgtgtgccttgtttgtcgtttagactccggcagtttcgacgctccagtttattttgacgtggtcgctgaggttccgtcagctcaagagcaaggcaagtcatacagatatcatttatcatattgagcctatttgcaaaacccctgcttttctcttaaaattgcattatttttataatgtcatgcgggatggaatttaccgtactcagtctttatttaccctgattcattgatagcctgggataataatttgactagatgattggtttaggaatgcttagacatgcttagatcaactagctcacaatgggatttactataatatagtccttaattttatgatgatgttatgccatcttggcatatggttaattaattaaatatgctttattggtgggtcgtgggtacatgcatgatttatttggtggtcgtgcccataacaattaaggaccggttctcgggaatccctggaagatatactcgtactaaccacaagtcagatgggctccaggctgaatcttaagtataatcttttttagctagcacaccaatggcaagggtaggcatgatggagtatggatggaccgggaggtgatctatgctgcttccggatttacctaggcacaagtagggactgcccatcgccttatagggatggggtgaaaccggaggtgggtgtgctggttaggtgtggttatatggagggttttgtcacgatttctgcatgatttatttggtggtcgtgcccatgacaattaaggatcggttctcgggaatccctggaagatatacttgtactaactacaagtcagatgggctccaggctgaatcttaagtacaatcttttctagctagcacaccaatggcaagggtaggcatgatggagtatggatggaccgggaggcgatctatgatgctttcggatttacctaggcacgagcggggactgcccatcgccttatagggatggggtgaaaacggaggtgggtgtgctggttaggtgtggttatatggagggttttgtcacgatttctccctttggggcatggttttatgtgtggaatcgtgtcttgtgggtaaagttgtacacctctgatcagagtaaaactattcaaatagttgtgcccgcggttattgggtggtcaaccagctcaccgtgattagtctcaccttaataatttgacttaatgaactggtgtagttcaagtggtttggtttggcttgtcgtaacgtggtttagcgttggacagtgatgatattaatactgcttaattatctactgttttactgatttcaacatatgatttataaatgctgcttttactgtaaaatatcttatgagccaatcctttgattacccttgcatcataccttccacttggtatgacttgttgtacggtggttgtactcagtcttgctttatttttcccaatcccccagaagctaagaaaattttccaatccccagaagctgagaatctgtcagattgtgagttagaagctgagaatctgtcagattgtgagttctatgaagattaggcttgtgccagacgtcaagattttgcctatggagtatggaggaagtttcgctttgctgagaagattaagtttagttggtctttagttttttcgctgcttttctgagtttattttatatttttgtaagacgtggaactgtatcaaattgtcgatttaagggttgaggcagcatttattatgacttttgcagccttggagtatctagtgaaaatgttcaattcaatattttacatgacatggacatgttagctatacttggcaaccaatctcatgtcgctcataaccagttactgaacaaggcccttgtgtcacttatcattgctatgacattgtttgatcttgtaactaggaggttaaggctgatgttgtaccgctcaatttaactaggaggctaagtcaccctatcctgctaggtgtaaaattgacggggaccaaggccccctagtcccacccgttgtaaaattgatgtttagtgactcatactagaagaacatcttggatttaatctaaaagattataatgatcttcatagagagagaaaagatattgcaagatgctaaaaaaatattaacagtgtttcaagaaacaagtcatattagggttgagataatttttctacataaacatggccagctgtaatcctttactattagcattctatgaaacaacaaatgaatacattatttcccttactccactacttgttgaaaactatttcatttatgacgaagaagtatttgtgtattgttattgtttctagccatctgagaaaacaaatcttatattgtatttgtatactaatttttttatgactttggcaatgcacccgaaccactacaaacaagtatggaataaacatgtcatttttgtgcccctacttagttataagcatcatttttacattctctaacaatccttaactgtaaaatttagaaataagatggaaaaatttcatgataagacaaataagcatcattttttacatttataacaatcctcaactataaaatttagaaatgagatggaaatatttcatgataagacaaaatagtgaatttattctcacaaaaacttagaaagagtttatcacatttttaagtgtttttaaatgattttaatcctcttaatgccatctatagatttcatggttttaattataagtaacactatccaaattcttattccaaattcatataacaaccactgatagtaatgacaactgcaatctaaatttttaggtttctgttgttagtcggatttgccacatgattatatagatttgtggggtttgactagtgtaggcaaaaactacgtatcaaacaacatgtacagagaaaacatggacttcttattgaggacatcaccactgaaagtctcatctagtgacactttgtttattggatcagctagtgacactttgtttgccaaggtcatgactaactcaaccaaagagcagatgtatgcagttgagtagtgttttggtaggtgtatgcagttgggcagtgttttggtgttacttatattagtaattgtaagaggtgtgtcaccaaggcattacaggacatgcaacaagtaagtgtttcaaagatggatgctatgacattttatagcttatgtaacctcagaatttctggtaaagatcttaagtgcaatattagacatgacaatgcttatttagtaagatggttatgttatttgttgttgctctggcaagatatgcaacatacttatcatgctacaggacgagaacaggtaatacgaaatggatatataatatcatatatggactcacaaaattcttaattgagttaaaccgtttaggatgccagatttttgtggggatctagtctctactccacattttcaaatttgtttggtgatctagtctctactacacattttcacatgtcaacatcagtagcgacttgaatattctttgatcttgtactcgctctcgatgtaattaggagtctaaggccgatcttctacccgctaaatgtaactaggaggctaaggcccctatcccgataggtgtaaattgacggggggccaaggccccctagtcccaatcaaaattaatgttcagtgactcacggtaattgtatttaaattgattatacactgtagcataaatattaagtctattcagaattactggtgagttgtatcttgttacatatataaaagggaaaattgtaaaaaccaccctaaatgtcactatgagtttgagatgcctccccaaaagaagatttgttgcaaatccccacctcctaattcatcttgttggtttgatttaggcaccttctctccacacgtgtgtgattcctgaagaatctcatggcgaaatcaatcaagccccactcgacgggagcaagagattgtgttgtttgttctgtataagacgatcatttcgttgggttctcatggccatttcatagtgtttttcatggtatactagctatatatttcaaactgattcatgtgtactgaacaatatattcgttttttttttcagggacgtaatgagtatatagaaacatttgaacatgaagcagtaatcatatagccagattataactgtataacttcatctgttgcaattggtcagatggcccaaaatagcagatttcagtacagtttaatcaaaaattaaggccacacaatctaatgcaaaaggaacttgttgacaaatcatcacgatgagcgggacttagctaatttcaccacgagatgctctaggaatcacgcagtgcagagggaaggtgcctaaatcaaaccaaagtgaattaggaggtggggatttgcaacaaatcttcttataggggggcatcccaaacttgaagtgatatttggggtggtttttataattttccctatataaaaaggcgcaacatatttggcctatacaatgcttggaacatgacaactaaacaatatgaaagtgcattaaggacttgttgatttcactgagttgagataataaaattgatataaaattaaattcaagaaaaattattttcccaagatacgatttccttccaacaaaacggtgtttaggttaaatgcacaggtagccagtggacaattataaaaatttaaaaatatattttaagagttcgagaatttaggtgatatatataacaagtaaatttagaaactgtccattcacttaactaaaaagagtaccttcccacaatcgacagaaagaataaaccattgcgaaatattttaccttacgatagcttgtcggtcgaacaatttcagtttttctcgttaattatttgctctactcgtaccgataattgccagacacgttttcctattttctgtgattggtttcggtctcgacgtatcactacagtgtaattaggtatatgcattagatgtgtcctcctccatcgtgtacgtccatgatccactatggtgtggtcttgacaatttgattagttattaagcgtgtgcacatgtgcatgctgaaactgaagagctttgcactgttcacttcgatcgtacatttctttttcgtgccaagacaagcatgctagttaagctggacaatccacaacacgcattatatgtgcatatatgtctgtacaaaaacggaattaattaagagcaatcttgattcttgaaacacaaatcatatgagatctacctaagctctcaatgattaaccacacctcccccttgcgatggacagatatgatggttttggtctctcacactcacaggtcatagcacgtgcctgcatgaccctttccgtcgaggccacgagctaaattacactgacatgttacttccattaatcaaccagctgttagttaatcagtgactagcttaggtaggtgctttgctactttctcttttttctctttctttcgcttttccagccatgagatgtaaaattaatccagctagatagttaattaatctaagctgcgtggatcgatgcatggatggatggatcgattcatcatccatgggaataatcgcagctgcagctagctagctagtttagcagttgccatcacatatcgggatctgatgcccagctgcctgagctgatgaatctttttgcagcggtgtagcagctgaacatgattgatgggtaggttgctcgatgcccaccgacactgacgaccatctcgttttatattaaccgacagcttgattaactcagctgatggggaggctgcatggagcctgtgtaaagcatagatccccaaattgttgtggcctgcctgcttcactagatagtgcctgcataaatatctaattaaatatcccattttcttttgtttcctgcataaaagagtctcttggcatgagttttctggagattataattgattagaaggtacaaataaattgtttctaaaacaaagaaggtacaacaaataaattctacagggaaaatttgatctcccatgcatgtgagtgtgtagcaccggcacaattttggtctgcttaatcaatttgatctgcatcaagttgtagttgactcggaggatatataaacctgcttactaggaggttgctctaaatgtgcacacgctttgttggttctgaatctctctgttacaggatgccttggaccattgggttaatgtctcactatgcaaacctattgaagcattagtcaacagggttcggctatgaattattaattagttagaattaaataatatctgaatgacaataataaagaagaaaaaaaatagaaatgacaacacaacaaaatcagtgatcacagctaaaaagctttagaaaaaatactttaattttacactagttagatattaagtattctatgaaaaggtgaagcaagttgaaatatggttcccaattgtactgttttagaaaatgtcctggcgaaaatttcatagaaaataaatcgttttcttttaatgtacttatttgttgcattcaattgtatttttatcattagtttttgccattgaaaatacttttatggtattataattgtatttgtcagggttatggataccacatacctaatagtagttgactaaatctcggcaggacccactacataccatgtcctatacggaagcaaccttcggatataagaggagttccggataaggaaagacaaccagagttctacgtggaaacgacaaagactactcggattgtattcatattggtttccctagttctacttggacaagaggacacctatgggtataaatacaagcccccctaggaggagagggaaggggatcaacacccaacacaatcgatatagaagccacaacatagaatcctacatacgccaagacacgccgccggatatcgacttcagggataagcacggctagtaccctacggtgtctccggatactgtcaggagagacgaaagcgctatctctgatctcgccgggcacggattcgaggaggaaggctaccctgttgtcgactacgagtcagatcgtcagaccgccatgtcgacaacagttagataggctaccccaaatattgtactggtgtgattatcatgaataagagctataccggcttcggccaacaggatgtaggattattacctgacaatttaggggcccgaacctgtataaaaatccatgtctccgtctcttttacctcaatttcgcgtatactctagtaccaacgatccccatactatgcaaataccggaatcgcgacatcaaacatcgacagtattattataaaaaaaatagaaatgcaatgatgatcaaagctgagtatcaataaccataaatcgcgtttttagggtaaatcttcaagtagtaaaaataaaaacagagtcactactagtttataccttaacggttcattaaatatctttgtgtgaattattgttctgaacgaagaagcacctaccagtagtgctgctagtagttgaatccaatgtcccttttttttttttgaaaaaattaatgttccatgatgcgagcgtgcaggaagatgggatctatgttggccgagcatcaaacgactactggtcctccaatctgatgaggtccagactactactcttgtttttgagatgtcatgataacaagtgtactaccgatcaatacatatttttcacttaaatggtaataagatggtatgcggccctttatgcaactggtactgtggtagaaatgaatctacacttgcccagttttttcttttcttttcttttttctgaatgggtgtatgggtaatctaattttatgataatctttgaaggtacagacggatgaattaactagtatttgatttagcgacaggtataaggcgacggtggaagtttcggtgacttgtaaagttgcaagagaaactatcaaatacatgtacagagaataagacgacatgcaaatcacctgtgaatgtgacagtacagctaaacacaaatcaatttttcatagccccaaaatccatgttactagtggtacacaggcagtatgaacagaaagctccaacttaacaactagcttagcaagtccgcagagaatagcatgttagttgcaccgacggatttagaatagcatgcatttgacaaatggacatgcctgcagtactacctgttctaacattaatacacaaggatttaagagctctgtttcaaggcctgagcttctgctgcagccatggggtctgcattggtatcagtctcctcttctttctccccttctttttctgcagccaatttctccctgtgcagcttctctgctgcctgcatcgctgcacgctgctctgcctgaaggcgttgcatttcttcttcctgctgctgcctctcgaaccaagtatctgcatcagcccaaactgaaaagagacaaacaaacttgtcagcattttaccattaatcaatgtttagaagcagtactaacaaaagcacaagcaacaaagggatgctcgacatacagtacgaatcaatcacattatcaaattcgtaatttgttcagatgtatctagtgtcctgatggctcatatatagtagagtttatatagatgatattgcgacaaaatgctatctttgatttcagctaaggcgaatcgtgctgcaggcatagagggtttactagtatataagcaaacagttatacttaaaacatgtataaaataccttgacatcatttttaccctctgatccagatcagaaagtatacctggtagaatcatctatgaaaacatagtaatatggtagaagttcttagcagttagcagtgttccacaatacataatttatcagctgctttctgctacaatcattttaagccttagaaaaaacaaatggtataggcataatgctttcagggacttaagggtttcagtggcaaaaccaggcacaccattatatggtaagaaaataattttcccaacttttggcaaagtaagtgttttcacccctctattagtgaggactaacgtggtaaaaactaaaaagcttgtatgctaccatgaatataggtggtaggagctgaataattccacacaaccattggtatttcaatttccaaaaataatgtcttgatttgaaaaaaatacaaaaagcttgaacaagaaattatggaaggcacaagcattggaagtacaccagaagatctatcagagtctgtgcagtagttccctaaatatgagctgagcacttgtaatgtgcatggtagggataaggggctactaagcctaattaaggtgttgcttgaccaggcaacccaggtgcaccgtctgggcagccccactacaagggcaaggaagaggagggagataccaaagacttttatttacttcttggttaatgaaaagagatacaaacctcatccttacatcaaggaatttgacctataagaaaattctctctaaaattaaggaaatacctgacagctcaacattatcttatctctaaacaactatgatgcacaaacacttcagaaaagttgagcattggtgtctaatgacatgtgcagctctgatacgcttaggatgcttatcgaccaaatgtcggatgattatacagaaaaaataacttcttttattctccgagacaaggtcgactcatccccgaatcatatgtgacaacccaacccacttggccaggacactaaaccctaaccccatctcaatccttcagctcccctcatctctggttaatagaattctagaacatatagacatctactgaaattgaattctaggagttaaggatcctatttgaggtacattttccttgcttaaagctcgcaatacattatttcagtggcaaacgattgaggatgtgaaaataatgcatatatactacttttttattagaacgtgtagtggtgtcaccatatcagtgtcatgcacgtggaacagaaaaagggccctagagtgtagtgattccttctactatatgagtctattgggtgatacatgacagcaattatgcaataacgaaaatcaagatgaaatgaatatattgcaaaaaaaaatgaaataaacaaaaaagatttcagtgcaggtaagtggtatgtacagctaggactcaaggaaaacatcattgagaaagatatagaagacctacaagattgcaacacaacattagacttgatggttgctcagattatttagctaaatatttaaaatgatgtaagtgtttgtggaacaaagaatttctcttgaacattcaaatacacaaaggacagttccgcacaagtgatgctttgatcattaagtaactatggctggattaaatcattagatgcatggcaatactactctgtggcaagataatactactttttttgtgaacgccgatgcagtgattcaggaacaccgctaatacaaattgtagtatgtacaataaattatatagtgtggtcattcttgttcttttcattctcataaaaaaatttctaagttcatttctattcttgaaatatagcagtcttgtaataaactgatggttaaggaagtcttcactctcatcggatgttggcgcttcctaaaacattatccttcattttaaaaggggcctaaaattgaatgatattttcagacgatgagaaatggagaatcaccaaaatgattaccatgacctaaaaaggacttcattaacattgcattatttgtttgttcatattatcaatacaagtctctaagaatagcagtctccagtgcattgtgaagggttgcaagtcctggaggaagaacatcaagttctatattatgggaatagttcattactaatagtatcgacgtgctttcactacacagggatcacaaagtttagccttctacattcctgtataatctgctaatcatgtattcactttcctcaaagtatacatcaacttatgaaataatttaaatgcccagtaaaacaaatcgagcacattaccaggctaattaatgaaattataatactgacatagttagcagactgcattggacagagaacagttaataacctaatataggttatcgaatagagtgatgaaacagtagccagggctaagtagccattcttgactggcatttcaaacttccagattttaggaacagcaagtgcatgcaaatgcagtacgcacctttggtgctactagtgttacacgtttttctcagaagaatcccaagctagcatgtcaatagagtccgtcaaagattgttagaaaacacttacggcatccaatattaataggaataatttcgcatcattggctccatctattagcacaaggctcatgatctactacgatatacagttttgtaatttgtacagactgaagacacaagggtcatgatcttatataagttaagcttgctctttcctacagcagttgcttattgccaccattacaactgaatcaaattgaaacatttggagtgctacagattataattgggacttttagcactgtgatttcgacctaacctagcaaacgctgatgtttaaatatccaaatgccctattagaaaaatataaggctccagaatttcaagaagcacctaaaacacactcattcatcaactactaccaattgtaaagtaatcattgcaagcctcaatagaggtctaaattctgcaaattcaaataatgttaagaactaaaattttctgtggactacaagagctgaattttatcacatgagatagttctacttccataacagaaaatcaaattttgtagggcatgctactcattgagttcaatgatacgccactctcatgtctcactgactaatggccccaggacccaaatgctaaagataatgttgaagaaacaaggatcttcaacattttaaacttttcattgttcacattgataaccccaatttgttacaagcaaataaaaatgaatggaagaaaattcatggcagtgaaaacctaaagacaaatcatgataaaatacaagtcatgacaaaagacaaatcatgataaacttttgccattgtttactcttactagatcaggcaaaacacaagtcctacaatcaaaattctttgcgactcctcaccctctacgatctggggtctggaccacgcatttggcatttgcaccacattgcaaataaaaatttaagccaaaacgaggtagtcaaaaccagcagttctagagttctagccctaagtcaggaaactaagcaggtataagcgatgagcaatggagacgattggacaagcaataagaaggaaggaaggaagctggacatacttggctgtgctgcccacccctgctctcctcccttgatgcgctcagggaaggcgtagttgacggtgaggacgcggccgaagagctcggcgccgtccatgttgtccatggcggcggcggcgtcctcccgctcgaggaaggtgacgaagccgaaggagcggtgcttctgcgtggcctggtcgagcggcgtcttgacgtccttgatctccccgaagggcacgaacgccgcgtgcaggatcttctcgtccacctcctccgccagcccacctgcggcaccacaaaaaccaagaaacgaggcacgggttcagctcagctcactaccacactgctactccgccggcggccaggaaaaaagataaccccgtgaaggaggaatttcgtcgagcaggtggcaggcgtggaaaagaaaaacagaagagaaagaagaagacgggtgaggagagctctagcttggagctcgtggcacgactggcacgtacctacatagagcgtgttcttctgcaccggctggttcatatctccgtcagcggcggcggcggcggcggcggcgacggcgggatggagatcagcgcaggcggctggcggactctcgtggagacgggagccgaagcccggggggagggggggacaaggagtcagagaggagagtgtgcggcggaagcagcagaggaggccggcagcggtgctcgccgggatggagatcggcgcaggcggcgcggcgcgggcgaaggagacaggacaggagaaggggaaggagaaggcgagcccgttccgccgcgatgttgttcgcgatatgggcttttccgtacccccagtctcgtttcggcttacgctttgggcttctctggaccaaaaacagcattactccccggagtagtactccgtatcagaacttccttttttaaagactgacagaatgttactttgaacttttgttttttttttactttgttacagaattaaaagaaacatcaaatgctgaaaaaattgtatttcttatcattgtaatttttaggttttatttaaatatatattatataagtatcctatcttactataaagttataacccactaactccttaaacttaacatgcaaaaataccacatcatcatccattaacaagatgtcacatcatcatccactaacaataatcacatttaaacattatgcaaacatgctatattatctactccctccgtttctaaataattaacgccgttgacttttttaaatatgtttcaccgttcgtcttattaaaaaagaattaaatatgtgaattaattctttttctatcatttgattcattgttaaatatacttatatgcatacatatagttttacatatttcacaaaagtttttgaataagacgaacggtcaaacatgtgctaaaaagtcaacggcgtcaaatatttagaaacatagtgagtataattttatagtttttataatttaagagcttttaaaatataagcattttaaattatcatcctagataattcacataatatttcaatgtatatttttattatgttttatgatatcctatatacttatatagtttatcctcacttagttagtgcttaaatgattaatctatggtccaaattatctttctctttttttctctaattaagtcatatcacctcaattgtttttagcctttagatgattaatctacggtccaaactatctcccaacttttcttcttccataaagtcataccaccttactttttacgtttgaatcaccattctacatactatttaaatttaaattatcataaaccacattaacttacttaatctgatgttatctagttatcttacacgttatttttttattgttatcatactaaattcccgcagcaatgcgctgggtttcacctagttaattagatgtgcatgctgtaaaagataatcactgtgacttcatcgtgggttgcgaccactttttatttcagagtaaattttataaaaccacaactattatggttaaatttgcacaaaacaacagaaattttggcaagcgacatataacccagatattatggttatgaagtttcacaaaaccacattgttagccattttgacatactcctatatcaaaattttgaaaagtaacatctatattatggataaaatcctcgtaaaatctgagatatgattgtaaaactcaaagtatgatagatcaaagttaaaatgatcaatagtgtggtttagtgaaactttagaaccataatacctgtggttatatgttacatgcaaaaatcttcatggtctcgtgaatttgtacataataggtagtgttttacggaatttactcttttattttatcatactcatccactccaaaggcccaagtccatctttgctaccattgaataaaaaaaagatcagtctatcaactatagttgaaaagtaactctctaacaagggggatttataattatgacactgcaaacataaacctttgctataatgaccctggacccacatttcatagacatagatgggcccatttgtcatccactcgaagtgtcaaaacaatgaagccccaatgtttgcagtcccaatattgcaaaattagcttaagggtgtgttcagatgcccctcttcccaacccctctccctcgttttccacgcgcacgcttttcaaactactaaatgatgtgtttttttaaaagtttatatacaaaagttgcttaaaaaattcaaattaatcctttttgaaaaaaaattagcaaatatttaattaatcacgtgctaatggaccgctccgtttgccgtgcgcaactgtgcacgttcccatcccatctactctctatttctcagctaccgtgaggcaagaaataaagtttgatgactttgctatgtttaatttagattataaagcagaccattgttatagattatctattggattatagatataaattaaacatttcaaaaattcgatgaataacttgaaaaaatcagagcctttttaatgcattactacaatatatcatattagccacttcctgatcaaaccattatacttcctccgttttatattaaaagactttttagtattgtacatattcatatatatgttaataaatctagacacggcaatgctataaagtcttttaacctataacggaggaagtattatttacttcaatccaagatcagtctaacctgatctcgctccgtcaacagtgccacccttgcacccacactcaatggccaggtgcccatagtttcttcattatgtgtttgattgatctgatcctaccgcttccgctgtgcggtttcgatctcacgagttgctggtagaagaacttgttctgggaggaggttgggggggaaaggggggggggggggggggatcgatagatgcaaagtcgggaggagtggggggctcaagtcgtgcggccgaaggcgcgtccttgtgaagatggatgaatttttagaacagaagcgatgtcatgcaaggcaagcgcgtgcagggaaacaaagtcgaacgaaaagctagctcagagtagaagttttcttccagagcaacagatgtaataacagacgatgagtacaaagttatctttaatttttataatataggtaatgataataaaattatttttggtggccttttgtttcgaaagaattacaatcaatcttccggatattgcaggtcgaattactgcgaattgaataaaaacgacttagattactagtctaaaagcaaagatacaacctccatttatatataattggcaaaaaaaaactgctaaatatttcatctgcttgaatgttggatgtagtccttgccttgcttaaatgaggatacaaaatatccaaaaacaatatccgattattatgccgattaaattttgctcagatcaccactaatgagagtacatatgcgctggattgtttcacttgccaccgcccctaacaactaaaccggccaagttagtaagtttcaaactaaggcccacgatcattagagcgtagaaggccggacggttagcccaacccatacttggttggggttggaggccggagtccgaagtgccggagaaattaatggagtaaaccggtgacttgtccgggttgaagagcccgaagtgcttctcgatggggaataagttcactttgagaccctcaaaagtgatcgaaatctaatccgtaaccctaaaccacaaaaccggatatcttgaccccttaactcttaaaagcggtgcaatttaactccttcggtggttttggaggacggtttcgctgatgtggcgcatacgtggctttctactcatcaaataagttaaaaaaaataaagtgaggcccacctgtcagtgagtcctctcctacgttctctctttcttcattgccagcagcggcgggaggacggggtgagcagcggcggctggtggcatcggggcgcagcgcagtcggcggctaggacggcggcggctcggccgcggaggctcgcgatagtgggaggacgagggaaacggcggcggcggcggcccaatatgctgctcgtcatcctcgcccttgcggttaccggcgcggtctccgacggctcgcgagtcgctggaccacatctccatcaactgcatcggtgtcgggggacatgtccggctgccgctccatccactcgcgcccgttcagcaccgacgaggagggcgaggctcctcgtccccgctcagccgcggctcttcttggatagtcccgactggaggcagtcggcggcggggagggagtgggaacgggagcgggacgatggcgacgacagaagaggaagctggctcgcgtcgggatcttggtggttcgtcggcgatgatgccgtgtgcgctgatggatattttgcaatcttgagctttttaatttctgttttgcatgcatatagtggctggctgaagtctggcttgttctttccagttatgcatgtaacgaactgctgatggagatgaataaatagagaagaaaacagagaagctgcggtgactggtgagacttaagcagcacaaaaaccactctgatcttcggtttttcagtttactgttcacagtcttacaatcttcagagtttcaaagattcagtgaggttgagcgtgtgagttgtgagcgaattgcaagtttcctgacgatggtggtggtctccccctctcccccgccgtaggcgacgacgcgatggtggagagcgcgtccagcgcgccgttcccgagcgacaggagcgtcacgctggtgatcgtcgggagaggcggagcagccacgagaggcccttgaggctagagcagaagtacaccgccgccgtgtcaccgagcaggtagaacagcacggcgagccaagccgccatcacgccgtagccaagaacccgccgctccacaccgaacacgcagtcgaacaggtacaggtagtcgacgtagtcacgcgggaatcgccggcgatcatggccatcctcctcggcgacgtgctcgcacctctccccatagctctcaacctggaatacaccgccgccatcgcgacgcccccggatcccgccctccttggacgacgataccacctccggcggtgtgccgccgcgcggcaagatgatgaagaagaagacgagcaggagcaagaaggccacggtgacgctggcaccgatcagcacccttgtcgccggctagtgcgaagaacagacgccgaccccatctcgccgagagctggcctcgccatcgtcgactcctccactgtggggaccgcttcagctcccgccgggcggcgccacaccgcagcccatgccctgccgccggccaaaggggaagaaggggagagaaaaagagagagaagggagagagggaggaggactgacatgtgggtcccacagttagtgggccccacatttttctgtgtgtgaatgacaaacgggtcccacgtaaattttttaattttaatgccacgtaagtgccacgtcaaacgccacgtggatcaaaggctcggtcaatattgccacgtaggtgccacgtggcgtcacgtcagcaaaaccgctctctaaaaccaccaagggagtcaaattgcactggttttaagagtttggggggtcgagatatctggttttgtggtttatggtcacggattagatttcgatcactcttaacggtcatgaagtgaacttattcctctcgatggcatctcccttcttctggttctcgtcaaacatggcgaatatgtaagtctccaatgccacgggcctcttgggcgtgccctttccgacatggttgatcaagttctggttgtacaccctggcgttgtccttgctcgcgccacgaccgtcagccgatggccacccggtctcggaaatgacgacgggcacatctgaccctccctccttctccattgccgagtatatgctgtcaaccatggcatcgaagaggttggtgtaggtgtgtccgttgtcatctatcgtcgtcgagcttggccggaagagcgcgaagttgaggtcgacgccgttgtcgttcttgtaggcgtagtaggggtatacgttggccagcagcggcgatccgtttgctcgccaagaacttgacgatgggacccatgatggagggggggtcggcgaacgcgcttccggaaggcagcggcgagccggcgaccaagctcatttcaacggcagtggacaccttgatgtggccgccgaggccggccgcggagagcgcgtctctgatgttgttcatggccgggaggatcttgggcttgtcggcgccgtctttcacctcgttgccgacggcgatgtacttgatgttgacgtccgggtagtacggccggacgttggcctggacccaggcttgcgcggcggaggacgacgcgttggtggcgtcgttggaggcgagagagcggacgtcgggggcgtcgaggacgacggcgattctggtgccgcggagggcgtgcaggatggtgtcgttggggaggtagatgcgcatggcgtcgatgtggttggactggtaaagctgcaccacgtcgcccggccggcgccggcaggttgtctccgttggtgccgtagcacacgccgatggccaaatctccttcgaccatgtacgacctccgacgtagtttgagagagccaaatgcaaatgtgtgtcggcgtggagcgtcacataggaggtcgtgcacggttaaaagaggtttagacctgtgatacattaagccactactaaaaactgattttcctgtgcaatgagctctttagattgcagacgaaccataattggtcgcgtctgcaaaaatcgtcccatcatttttgcgtgcggatgcttaagaggaccgacacgtgaaaatcaaatttcgcaggcggacctctccgtacgcgaaaatcgatttccgcgtgcggtcctcttaaaggcccgcctacaagtttattctccctcactctcttccctctcatcaatttcaaaaatctaaagtcccatctccccacagctttatctcctttctctctctccccacagccttatctcctcctctctcacctcctcccgacggcgacggtgacagggacggctcaggagatggagagacgcggtgggggggcgtgggacaccacagagacgggagcggcagcgagcggctcggcagctggcagagaccggcgggtgcgtggcggctcgcaacgatgacgaccgcgcgtggaaggcggtaagaggcaacagtgaccggcccccgcctggatcttggcggcggtggcttcgggcttgcaggcgcggcgggctggctccacggcgacgaggaggtggccggatccgcacacacgcccctaccgacgaggaggaggaggagcggtggtggcttcaggcaggtgggctcggcggcgaggaagaggtggccggatccgcccgcacgcccccaccgacgacgaggaggaggaagaggcggccggtgtggcggtggcttcgggcggacgggtttggcggcgaggaggaggtggctggatcagcgtgcacgcccccaccgaggacgaagaggcagctggcgccggtggcttcgcatgggcgggcccaacggacggcatggatttggcctcccctcgctcgatctcctccgtgcacggtggccccctccagcgacagatccggcagtgaggaggcatgggggtggcggatcaggcgacggcgctggcgacgacgaggacaacggcgaccacgagggcggcgtatagggttagggtttcggattttattttatttttcggtttttaatttttgtgtgcggacaacataagcacccgcacgcgaaaatcatattttggcgagcgccactcgcacgcaaaaattccatttttgcagaccctttcgcccgtgcggttagctctaccacatgtgaaaacccctctagaaccgcacggaaaaacctgttttgtagtagtgagccaaaattataaatttaaatatgtatcttacaagattttgaacataaatgacaccaccttacaactttaaacacatggcatgtatttgactgatgaggaaactacttcgttcggtgtttctgatagccaccaaagctttgagatttgtgtgaggggatagagatacaggtccattggttcaatcgctgttttttaaattttaagaattcatttataaacaacaaacatgttccagcagcatcattaatcgagcttcagtgttatactccctttgtttctttttagtgatgtcggttatttgttttgaactaatcaacatcatacattttaacatgaggggatcatcgtttatgttgtcatatggacttgccattatgtatactttcttcgttttcaaatatggttcattttaggatcttgtatctgatacgaccatggatactgttgatacaaccgtcgctcacatcaatattaagttgaccaagttttagaatccaattcggccacctgctatagtactgacttcaaacggccgccaaatatacgtacgggctccattttgggtccatgagtacttcatggaaagccctcgaagtactctttccaacgaaaccagcctcatctccaaattccttcttagttggttgcaatcgcaaaaacacctatattggaccgatgggcttgtaactttgtttgggaccatgacccaagtgaggccaatgtagggtgcaccccaaccaggcggagcatgagcctagggaccccttggtcgtcctctcaccttcataaatagctagatacccgttcagggttttgtttagattaaggcaaattttgctataagacatcgtggcttcgtggttttagctataggacaccacgcgaagtgacttttggggaaagacactcgcaaaagttggatatttgctggtggacaccacaccattaaaataatcatgtgaaagagaagagagaaatcacgtgaaagttctaaaatgcccttgggcccacatgtcagatctgcaactctctatatatatctctttctcaagcacatggggcccgcatgcaaacctctagcatcgttttccctttcttcttcttcttcttcttcttcttcttcttcttcttcttcttcctcctcctcctcctcctcctcttcctcctcctctgctcacaggaggaacaggtaacgtgaggcgtggcaagcttgatggcggctttccatgggcggtggcgacagaggaaggagatgcataggccggcagtgggcgagcagcgtagtcgcaggaaagacagccggcggtgaagccggtgtcgacgaggtccgcggggaaggaggtggatccaagaggagacagccggaagaggcgagtgacgccgcacagaggtggtggccggcgccgatgcgggccatgcggctggaggagtccagacggggttgaggacgatagggctagtggcgcagtgacagaggggagggcacccggtgttccaggcaaagaagctggcggggagcttggggacacggaggacgacgacggtagcgaaggagattcggtggtcagcggtggaggtccctaggcggtcgagggcaggaggtgaggtgaccatcctctaggtgtgatgaggacacaactagctcagatataaccatgactaccttatgtattaatcaactaaaggtgcagatgttttacattagatttacatgttatatatttgaacaaacgttgctacacaatgagtttcctatgtttttgtttgcataggtacttgcttgggcgaaggaaaagagaccaagcgtaacaaattcatggatgatcaaagaagttgattggggaccatatcaagaccttctccaagtacacttccatctcatcacgtcacttttggtccatagaagataagagataaagttctacacgttttggattcgaattcggccctcctgacagcatcaacttcaaacggacctaggcactgatctagaaggaatttcggggcccatgagtacttgttggaaagcttatggagtctgctttcagatggttttggtcccatatcaaaactcctaccgagctgccgagaatctgcaaaacaagccacgcaccttatccagtccgaatctgattttgagttttggccttgtaattgtgtcgtgggcttagcccaagggggtgtgcgccctagggcaaccctaggacgtccctaatcatattaattcagtagccgtcatcgtttagagttaggttttgcttagattactctgtcaagaatagttttgccgctagatcggtttgtggaaccccaaattcgtgtgcttaatcattcatatgcaatttggttgcaatctatcttgttcttgcttgtgttcttcgattcgcatgcagggattagccttctcggcgaggtcaaccgggtttcagcacggttgataaccagagaagacgtggtgctgcgattgcggggctcggtagcgtgtttgttcagaagccggatcgagttgtgtcgcgactccgctcaaatcgattgtttatcaatacctatcggaagatcgggacctaacaccccttatcagttggtatcagagcgcggttgcccgttaggtaatttatcttcccataaccagaaaattgcaacacaaaaatatttactctttacctagacaatttgagccgttgcattgttctattagattttgctttgttaaattctagattgtatcatcgtgtcgagtgctggtttagttttagatttaacttttagttttgagtattgcatctgttcatcacctagatctagggttcatcactcaagtgtgagagttgtacgtcagttttgggttcagtttttcatctcgtcgattgttgcagggaccttgaaaaattgaatcgtctcgtcgtcgggtttccgtttttgtgatttggagaaatttttatcgagtggttagagagttgcttgatttctagggttcctgtgttgccgtgtgttcccgagcttatgtgtgccatgagaaataaattaaaaaaaacgcacgaggttggttgatatgggttggatctgttagatataaaaaaaatattagtggggccacccttatcctgtggaggccggggccgaaacccccacccccacgtccgcaactaccacctcccctcacggccgaccacctccacctcacggcaatttctcccgtgccgcttcctcgattatcacattgtttggtattttggtggttgtagatttgagatatttttataaaaacggaacctacatgatgtgagcattccatttttgaggtgatctaattttagttttacactttgtatttgagtccctgtaatattcatatttacatttgagtctttctttgaggtcagtggttcagttcttgttgaaaaaaaaagtaaaaaaataaaaaagaaagaaaaggcagaaaggtgcaaagaaaaagaaagaaaaaaaaagccgcacctaaaaaaaggaaaaaaaaggcagaaatgtgcttaaaaaagccgcattaagaaagaaaaaaaaaccattcatccttggagtatgttttcagagtgcagagttgtgcattgattcatatctagtccttagtgttgtcgggtgcttgcttgagctagagttgagtctagactaggccagcacattgactagtaatttgaactattattcaactttgcattttctgattagtacaattgtgttcctttgctactatatattgtgcctcccaagttccacatatattcttctggtcagcactgctttgatccttgcaatcgccacatcacgtccttcaaggtgtcacgaaccagccactggttgtaccgtccttagcattgctggtaagacacttgtaagagcttagtaggacgcttccatttgcttgtctccactacaatccatgttctatagttaatagttctctcttttctattgacaatggcatgtgcacgtgatgaaagtactctggtgcaacaagtgctaagttctcaaatggagaaagcggagcaatggcagtaccacgaattatttgaaacaaagtttgtggttaaggatagagcatgtcatgctataattgatagtgaaagttgcaacaactctgtgagttcagatttggttgacaaacttgagttgcctacacaaccgcatcctcatccatattacatcgaatggttcaactcttgtggtaagttcaaggtaaatagaattgtgagaataaacttttcgattggaaattaccatgacactgccaattttgatcttgtccctatgcaagcatgttctttgttgtttggtcaaccataggtatgtgataataatggatcgcatgattttgttgctaatacatacacatttagacataatggtcgggaaatgaaattggtacccatgagttttactgaaattttcgaagataatcttgaaaggatgaagaatggaatcgaggaaattttcaaagatagtattgaaaggacgaaaaatagaatcgatgagattttcagacataccaggaaagatactaatattgcgatgccttcaactaagtctgagttattacaaaacgaacgtattgttgtgcctattgctttggatattaatatgttgcaggcatctgagaacaaccaaggtaatgaggaggaagagaagaaagacgaagagcaaaaagatctatccatagctccatgcatgcttgaggaatgtttaattgatcaagcgcctacaatttcagaagatgagaaaaaaggtaaagataatggtgctacaactgctcaaggtatgcatagttatgatgtgccaattatgtccactacttatactacgttagagaaacccatagtggaaacaattgttgaaatacctttgtcacaagacaaattgcttgatgtctcttgtgataaagaagagttgtgcgatgcttcacttatatccatgccacaactagtgaatgaacatgttagttctgtagtagagccacccagcattgagtttaaacatgttattcacattgatagcgagaatgaagagcttaaattgctatattctttaaatacttggggttatattcaatttaatgatttttgtccactcaactgtttagagaaaaaaattatttgctagatttgaattgccatgccgttctgatgtgatttttcatattattggcaattatgatagtaaaggagaatataatgtgcatcgagtatatatttgttctaatttgactatcataaaatgtattgtctagagtaccgcatgcatataagtaattctctatctatggccatcaagaaatgttcctcaccggatgttgtgatacataaagataagttcaatacgctctatgacaaggtgaaaccgaggacggtttctaatcaagaaggggaggatgatgaggacacaactagctcggatataaccatgactaccttatgtattaatcaaccaaaggtgcagatgttttacattagatttacatgttataaatttgaacaaacgttgctacacaatgagtttcttgtgtttttgtttgcataggtacttgcttgggcgaaagaaaagagaccgagcgtaatgaattcatgaatgatcaaagaagttgattgggaccatatcaagaccttctccaagtacacttccatctcatcacgtcacttttggtctatagaagacaagagataaagttctacacgttttggattcggattcgggcctcctgacagcatcaacttcaaacagacctagccactgatctagaaggaatttcggggcccatgagtacttgttggaaagcttatgtagtctactttcagatggttttggtcccacatcaaaactcctaccgagctgccgagaatctgcaaaacaagccacgcacctcatccagtccgaatctgattttgagttttggcattgtaattgtgtcatgggcttagcccaagggggtgtgcgccctagggcaaccctaggatgtcactaatcatattaattcggtagccgtcatcgtttagagttgtgttttgcttagattattctgtcaagaacagtttcgccgctagatcggtttgtggaaccccaaattcgtgtgcttaatcattcatatgcaatttgattgcaatctatcttgttcttgcctgtattcttcgattcgcatgcagggattagccttctcggcgaggtcaactgggtttcagcacggttgataaccagaggagacgtggtgctgcgattgcggggctcagtagcgtgtttgttcagaagccgaatcgagttgtgtcgcgactccgcccaaatcgattgtttatcaatacctatcggaagatcgggacctaacaccctcatcaaggtgggtcaaccgaggcggcggcgatgagccgaagggcgttgaccatggcaatgtggaagggagattgtagatctgacatgtgatctgacatgtgggcccaagggcattttagaactgtcacgcgatttctctctcatctttaaccagaaattattattttaatagatgcaatgtttactagcaaatatccaacttttgagagtttcttcccgaaaagttacttcacgcggtgtcctacaactaaaattttgaagtcacgatgtccttttgccgtgtaatcccgtgatcggttagatcaccggtttgctcgttatggaaccccaacatatcaattgtattcaattcctatttgcaattcagattgattttatcttattcttgcttctttcttcgatttgcttgtaggaataaggttgatctgcaccgacaagattaactacccacagagaggtgtatcgatcgctaagacacaacacaacaacgtctcgtacgattgtagtcgggtcggcaacgtttctcccaaatcgtagttatcttcaactcaccgaaaaagcaggccaataatagtcgtgggtgcattgagtggagctcagggttcatcatagtcggtcaaacctttttaactaacttagcatatgaagtattaactaatatataaatgctatgtagctacattgatgactttatgtgcagttattagattatcatggagaatactttcatcatataactttatctacttatataatactttcttttaagaaactgcaagtaaaaattatcatattggagaccgatgtcaatgcttggaatcatagtgaatatgtgatggcatgaaaatgtatgcatgctatgtactacttcccttttatattataaaacaatttgatttttttcctaattaaacctttttaagtgtgacgaagtttataaaaaatgttagcaatatctaaaacgtaaatttagtttatcaaatctaatattgaatatattttcataatatgttaatattatgttagaaatattgctatgttttttataaagttactaaagcttaaaagtttgattaaaaaaatcaaagcgttttatagtatgaaaaagagtgtaaccgactctatagttcatggctcatgaaatcatctccagccttacaggtctagattttgatcgtcgcaacaatgtggcttaggaaatgatttctggcatcctacaatcgatactggcttagaactatgaatttggtgatttggcacgattttgaactatgaactgtgaatcgataccggcatttctggcagtttctctccccaaggtcgatagcagatcatgaatttggtgattgtttcccattgcgacacgttttgtgccgtccttataagttaacaccagtaagccaaactatgaaaatccccaatgccacactcccaaatgccatattcccaaaaaaacttgaataaattgccattggtacacctacattagttgatttcctgccattttggtccattcttaacgccacatcaacagccacctcatgacaccatcaagaaaatgacattgatacccctgccctttcagtccaatttttttttcggggactttcagtccaaatttaacacagcccacatcaaataaaacacaaccgacagatgcacaataatttcacaagcaaacacagcttggaacatacaaatagaatttgcaaacgctagacagatcaatctaccaaaaaaagaatatcagggaaaaatccgatgccaaaccaaaaggagggaaaaacgaatgatctattgctcttttacctgggccaccgccggcagagtcgctggagaacggagcgacgcgaagtcggacgaggagtagggacgcaaagcctagagcagggggcaatgcaaatatcagagtttttctcctactcccagtgtgcaagggcaaaacagggatttcaccccatccaaagctgatgtggcataaaagaaaagaaataaaatggctgggaatcaactaatatatggatctagtgacaatttatctaaacattttgggatgatggcatttgggagtgtggcattggggaagatagcaaatagtaaaaaaaaatcctgtcttaccttaggttcatacgagcatagaactgattgtgatacccacctttcaaaagtatccttcatacctaccgttaaaaatgtctatgaacaagcttctaaactgatggacacttttttgcacaccattacaaattctgagtgatccagacctcagacgggaataacccgtagatctgttctttaacatcacaaaagggaacagtacgctcaaattttcctgttttcacgtcgtacgtccttacacctccccaaacacgcagtccaagaagccaatcgaatgcatgtatgatcacgggggcagagaaatatatacagtgaggccgtatcccgggcaaattctgggtgggtaagcatgcggagtgattcaatctgaggaatagcgcatgatccatcaaaacattcccctgcaccacccccttgcatccatccggatcaaccttgcagatttggaacgcgatgccatccgggtagtgacgcgcgagaatcacacgaacctgcaggagatcaccccatggcgtcgacactagatgccgagtgaggatacatcctaatcctccgtagggccttgcggcataaatcacctcccttgttggtccgttgctcgctccatcaagatcccacttctccaccatcctgtgcaatgtcacggcgtggaacctccccttgtggtacgcacagtcgagatatctgtctcccccgcttagagttgaagccacctgccacctgctctggcctgccttggcaaaagaaagccgctcgccgttgttgtggatgatcatcacgacgtagtcgccgcctctggatggactgcaagacagcactgccttttggtagaaccatatccctaaccgatacgcttcgaacctgctgtttgtttccaaaaggtagttctccaagttccctccttcgctgccatagaccgcctccacgcaggcgaaatcggtaatcggtgggagggggatcatggccagtgtgacagggttgtggagcacgagattggagaggtcatttgccaaaaccagccagccgtgagaggccccgtagcacgcaacaaaggagccctttggaaaactgactctgtagatcttgtcaactgcatcaccagggtggtagaggttgcaggtcaccgccgagcggcgcctttcgtccagccttttgtcaacgtggttgccccatgacatgatccatggagtgcgagaacgcgggacaccggcagccgtggcggcggaactccatgtggtgcagactgcggcgaaggcaagtgcatgaggaagctccagtcgttccaggatgattaggaggagatcaatagggaggtcggacaagctggggcttgcacaaggtcctgctgcagcaaacattggtatattgcgaattaatattcagcacaaataaaacactctgcatgcaaacatatttgttactagtaagagcgaacaaataaattccatctatagttcggacaacagcccctcctggtaagcagggcttatcgaattggaaaggaacattgaatccaattcggacacgaagaaaccaatacaaaagaatcgaacacaacgattttgcaattggggctatcagaattagaaccggactcccactcttctggaaaacgatctacgtacgcaactcatgataggaacgaattggacgcctaatatatagcaaaaaagaatttaaaaggaaagctacccgtgagattgtaaaattaataacaatttaataagaagcagatataaaattaatagtttttccatgtataacaagataacaagtgtttgtcatctcgctaacgttctctttcaagatttacatgacccgaatactaaaaggatatctgtactgaaatttgttgatggcaaaagtacatgtttagaaagacgacaaaagtacatgtttagaaagacgtgttaacatatagccatgttatcaacctggtgtaaactgaagcatgtatcacggtatggtatggagaacataattacacgaatggtgacgtcgtgttgtacaaagtaagtggacattggtgagtaacattcggatcatcaatttactatcttctagattatgttttcgaattaattttgatcatgagaacctacctttgctcaccagtcgggaacgtctttatacacgatattttattgccaggtcccataaccaacactacaatctttaagcaaaactaattccgacacactgggagagatgagaaattgaggaattttatggactgatgcatttgttgctattaattattatacttgcccatgatttttttcattaaagtatgcgtctgtttttcattagtatcataaggtcattacatcacaactgttatattacgtgtcgactgtaccatgtaataaatagtgttcccatagaccctttgtctcataagatctacactcccctaaatatgttagctatagcatgtgacaatccaattattgtggactgtgtaagtttattttggtcatagattcagaaaataaaatgagtttgaatgaatattatttacttaaattgctcctaagttggttcaacagtctccaaaaagatgtgaggcaatgactgcagttagttagttctgtatacagagtgtatttgccagttgccacccttgcaattatttgaggggcaatacttttatgaagcttaaaaaatgaatttcaatacatctgccctggcttgaaagtaaacatgattttatttttaagattgcattttagtttacaggagatgtacagtgtagctaggtctgtcatttttatttgtaaaactcaataggtgtaaccgctgctattttaatgcatatttcaaaaccatgtataccacaactggtactgttaagcagttctgcatcaacactggttattatttggtttttatacaataccactatgttaattagtgtggaatcacttacccatgtcctcttaataatttatcctctgattgcactaataaaattagggtgctatatggcataagttatgcacgcaatacactacactaaaattctgaatgtcttgtaataaaattgttatgcacgcaatacttcttatcaagatattctaaagtaaaacgtctcaaatgcatttacaaacaagttgacaagcgggcatattacatccacacaacattgtattgtttcaggtccctagaaatatacctaatgctacgagagctattcattcccaatttagatggtgaaactttcttgaaaacaagaattaatcattccatatgtgcttaccttttactttggagcaattaggcacgggcaaggtgattctttctgttccctcaaggcattctgtttataccccttggaattggttgggcttgaatccaaaaatccagagcataaaacaatatataaataaactcccaatgaaatgtttcaaaactcccgatcacaatagattcattggtctactttacaatatcttcctccttgccctctactacatgcaaatgtagtaggaccagcccagttgaaacaaaaacgaaattaggaactacatgaaccatctatttaaatccatggttgtggaagtaccgtaggttaggctcgtataaaagggttaactcaaatacatcactcttcagttattcgccatatgggtggcatgctaacgctacatacaccacaatttagtaaagcagtatccttttaaaaattgacagcatctttttagagtaaatgtgacacacatgcagaaatagatcatgtgtgaaacatagatgtatacaattgagtaaccggagtatctctagagtaactttgatagcttgaataactggagtgtggagtgaagtagtcaacagcagagcagatttttcctgattcatgcaaaactgtaaacgtcggatacaaggaagtggacataaactattttcataagataagatgcatagattattttcagttttattggcttgatctcttgcagttaagtgccatatatatattagtatttgacatgtggaactatagccacgaatccgtttactgacagatcaaatcctccaagcataattgactataataaagaacacattggatttgaatccaaggaaacatatcacacatgcacgccatcaatcacgggtgcatgtactccaaatatacaagggtctaaatatacatttcactgatatagtacacaataaattatatttgtaaatatacatgtgtcaatcaattggacaatatcaaatatgtttattttttgggagcatgtatattgtacctgattggagccggcctatgtaacctgacgaatgagtttgaaccggcaacggcgcttccaatggaaggggaggttggccacgacgaggctgtgtccctgaccggacggcgataaggctttgcttgataccgtgacaggaatcagggaatgcggcggcggctgaaaggccggatgagagtgatggcacctatagaaccatcttctcaatagagtaacataacaatgcatagtagtcaataaaatcagtttaggccatacatcagtgcttgcacataaccaatgcagcacattttacatattcaggtgtcattatttgaaaagcaatattatggcgtaactcatcgaatccactgccacacggataatagacccaccctggatatttctttaaacaaatagacaaaagcattatggaattttcagaaagtacatagtttagctcatgtaaattttatatgtggctggaattagctcaaggaaagaacgaatcccatcatcatgacatcataccatctcattgtcatgttacattttcaagggaaaaaattatcactgcagaaagcagaacttggatataacctaaaagtaccagaagccactttgaaacttggattaattccattgttgcagcagttgaacgatataatacttgaaggttgtatatgcacgctactaattaaagcacttcatctgaatttacagacataaacatcctgatcataagagaaattaaatcatttgcattatataaaaagttgcagatgctaatcaaattgtttaaaacaggacgtcgtcattgataatttagtgtgatatgtgcacacacatcagaaacatagcactgtcaatccgcaagtaaatgaattgccattgcttattaaattttggaccaatcgaggaaaaatcaagaagaggaaagagcaaatgaaataagagaaaaggatctccatgtaccaggcagagagggccattgacactgatcaggtagaccactggtgaatcgggtagatgatggacacgacctggcggcagtgaatcggcgacggggctacggccgagtcggcgctttgtgtggtggcggcggtgacagcgtgagtcaatctggaggcaggaatcgaatgagaaacacatgcagataataactttttgtgtcacacatgcacataataatttgatttcaattatctcactggtgtattctatagtgggagggaggaaaattaaacagcaagtacaaattcatttgtattcactattttatctctatttcagtaactttgaacagatgcataatagccattgataatttaatattaggatgattcatagtagaacggagccgctccctaatgatgaagctcaccacgttgatccaatgcaaaaaaaaaaaagaactaaacaatcaggcctgaaatgttcagactgttcatgcttatgctctaccaattgctatacaattaaagaagaagatccaagaatacatatgcgtaaaatatgagtttccacctcacagcaagtttcttctctgacaaataaaatgatctaaactcacatcacagtaataaaaataccacaaccaatatcaaaacttaaatactacaggacctaaacctaacttatatctggattggatcgtaactgctgaaggcaatactactcaacacaacggtagaaaatgtgcattatcgttaaaatacctgctcatgatagtgtaacctataaagagatggggatttcagtgcattcgcgtttgggaggggaggaaccggaatatagatttggattttgcagtgaataaagatgtactaattatctgacggggaattaccatcgatccatccaatctgcaaggtgctctctactattgtgaccttctcgctcccgctgtcctgcacacacacgcaaataacaaagaaaaaaaatcagagaagggggattggagtcaaggaatggagataaaaaaaaaggaaggaccaggaagtctgggcctctccgttaaaattcaaagagttagggataggaatttaggagatcggggatggagaccttcaagtgtacgatgcaggcaaggaggcggtcttcgtggtgggacgggcgtagaggaggcggccgacagcgacagggttggcgcgacggagtcttggcggcatggacctcggtgactcatgtgtagggtatggcgacggggacggagatcctgaccagcgaaggagaacgtgcggagcggatgagggttgcagcgacggcggcgtcggcgtggatcgtgggtggctgggtgcggcggcggttgagggggagcggctgagaaagaggcgttggacgatcggcggaggcggcggtggcagaacggctgaggcgcgatgggagagaggggagcgatcccgcaaagagatgggagtgaggggaaattgcgaaatcacggatgaggagatcacgcgaggggagaggggggaggtgggagccacgggatggtgaggggatcgcgattggcgtgaggcagcgtagtggttggcgtggtggcagggcggcgtccgttttttgcgcggcggtgtggcggcggcggcgtcgtgcagtgtgcgagagagaagggagagggttgcgcgcaggttgggggcggcgaatcagagaggggctgcgcaatcacgcgattgatggagggtgattgatggaggtgggaggcggggatagatctataccgttcaattttacacagagatgatccggaccgttctatgaggaatgaaaaaaatgagtgatgaatgaatgagtgaaaccatttgttgaactatagggtagactatagggtagatacacagaacccataaatttatgcaccgaaaatgcagattgttttttttcgcaaaatctaaaccgagtgcgctctcgattttgtgttaaagagcgatgcactcattcgtgagagaaggtccagtgcttctagcacgtgagagaaggtcctgtgctgctagtacagctacgtgagaaaaggtacagttgttattagtgcacacaatgcatgcctattttttctttttatagaattttctctcaaattacttatccgatctacaatctgattacaccattacgttcgttgcaattaaatctttacaacaagatcttacatgattatattacgatgaaaaaatatttctatttataaattacttttattatatacgtaagttacttttatcatatatataagttacttttagatttgactaaattacttctatacattcataatgctctaagttgattatttttattattgtttttagttaattctttattttgtggactttataaatcttatctacactttacttgtgaatttactttacatagttttttatttcagctcactcacaatataattatttctactacagagagttactccccccgtttcataatgtaagtcattttagcattgcccatattaatatagatgttaatgaatctagatataattttaaattaaagttactttcttttcttttcgttataagttacttctataatatatgtaaattacttttaagctttactgaatttacttttatatgtctaaaaaaataacttagtgaaatctagaagtaatttagacatatcataaaagtaatttatggtttttcatcaaaatataatcatgtgagatcttgttgtaaagatttaattgttacaaacacaacagtgtaatcggattataaatcagatgagtaatttaagagaaacttctctaagaagaaaaaaatacatagatattgagtgtactagtagctttttttttttggaaagaagggtgtctctctttagtactatccagctagcactctcggtatagttgtgttcttcttcttcttcttctttttttcgtccaaggccacttgtgagttgtggctacctgcaagcacaaaccatctgtgggcaagtggagccgagaggacctgagagcaagtttaatagtatagctaactgctagctccaatttatttatagccaatgtaatagccaattcatataataactgcttactatactattaatacttgttcctacctatcatacacatattacgtcttagagtccgtgctacagctggctacagatctgtagcccgctgctcttctctctctttttttatctctttaaaatatgtttatagctgacttatcctgcaactgtacctgctctgacacgaccattccaaacatatcgaaatagcaaaacccttgtgtcgccttccctccccggcaaacccctcccgccgaccccctcgtctcgcaagtctcgcaatccacctaacctaacctagggtttggatttcctctcgcctccgccgctcccgaattccccaccgcgccaccgcctcggccccatcacctcgtcgccggccggcttcaacgccacgatccacctcccctgctcccggatcccccgccgtcacgcccggggtctctcctcctgattcggcaccacgatccacctccgggattgccgccgcgccacctcctccggctccatcagctcgtcacgaccggcgtctctccctcctgcttgcttcgacgacgccacgatccgcatccccatccgcgatcgccgcctcctggacccgggtcttcaccgcctctcgacttcgtctcccagtacgcatatgcagctgccatgccgactgctacaggtggggaagcgccggcttcggcgcaggagtgcacttccgtgggtttgggggctagattggtccgccttgatggcaacgccattaccacagtggccgaccttcagttgtccggtccaattccttctccacctccccaagacattgatacagccaccatcatctatggagaggatatcaggccgggtacctacctggttattcatgcaggagttgatatccttgacattgccagactcactttccttgaggaactaccggtggctgccaggaaagggtatcccacggaagcggaagaggagaaggacgccaaagctgtggcactggcaggcaggaaggggactcccactgaaatgggagaggaggagaaaggggtggtggcaacgccccatcaagagaaaaacatggagaaactggaagaaaagaataaagaagctgagaggttgggaatggaggaaagagaggaagaagaggggaacgaaagattgcgggaggaaaaaccatggcacaaccaactgtggggcgaaacagtgcgggaagaaaagaattggcacaatcaattgtggggtgaatcagttgaggaggaagaccattggcacaatcaattgtggggcaaaacagtgcgggaaggaaagcattggcacaatcaattgtggggcaaatcactgcaggaggaagagcattggcacagtcaattgcggggcaaatcactgcgggaggaagagcattggcacagtcaattgcggggctgatcactgcaggaggaagagcattggcacagtcaattgcggggcagatcactgcgggaggaagagcattggcacagtcaattgcggggcaaatcactgcgggaggaagagcattggcacagtcaattgcggggctgatcactgcaggaggaagagcattggcacagtcaattgcggggcagatcactgcgggaggaagagcattggcacagtcaattgcggggcaaatcactgcgggaggaagagcattggcacaatcaattgtggggtgaaagattgccaaagaaaaaacattgccaccaccaattgtctttgagactgtggcctggattttctcgtgcggttcttgttttacactgttaagtttaccccctataagtttttcttaaggaaagctgtagaagtttctgccgttaatatattaggaagaagatagcaaagggaccaggcagttagaaaaacaattaagttcttgtttcttgtctgagaagatactgcaatacatgtaggtgtgtgtaggagttggatgtaggtctttcttctttgggtgcttttgctttgaggtgaaaggacttaagagttttcatctgtatgcttaatccaggttatcctagaacgttgcccaattgttatcttattgaggacggttagtgtccaaacacttttgattttttttaaagaactgctgaatcttcttcttcagttgttaagaacttacgactatcttcctgggctgcatcaagttggaaaatgatctcatcatgactgttgccaactgtaaacgaatgttgcccacattgtctgttccatcttatcagatcttttgccagctgacctaactttagatgcagctttaggtagggattgcatgttacgactggtttttcccaagatctcttcacatcatataaaacatgtgcccacctcttacattacttcccaccaagagaagtggggaatggtctgaacaatttgtcgagaaggtgtgccatggacgctgttgagaacattaaatcccattcagttgaacagactgctctatcattttttttttgtctgagttgtgttgttagtttcgtttgtccaagttaagcgacgcccattaagtggaaattcctttatgtgtaatcatgcccttaaaatggttatcattcccaaattcaagcgattgttatttttgtctgtggccctcctgtaagttttactcctgtgcaatttatctcataatagtaacttgcttttccttcgtaggccaaggttcatggaaagcaacaaaatcatatagcttacagtggctgagatatgacaacaaagaagcacttttcggattcataaataaggaacaaaacagaaatatcaaagatgctgagattttgttaagcaccatggtaacagtcatcttttatacttgtcattgtagggaaaaattccatttgattctcgcaaactattttgtgtcgcttaaaatgaacatttcttcattattctttattgtcttataacatttaattctgttgcagaccttcaatcactggaaaacaggtttgatgtgcaagctagaatttgaaggacacctggtacataaataacaactttctgatataagatgtttgataccttttctgttatttatcgcatttcatcttactctatagcccaatctctgtgacagtatgggtatgggattaaatcccagcatggataacttcaaaatcaataaactgttaggtaagaaacctatatatatttgcatgcattaaagtgttgcaatgacaatcaatcttgtcaatgaaatctttaacaggtaaaggtcgatatggggaagtgtatgaatgcacttattctaatggtcaatatgcagtaaaaacgattgatgtaaccaattattttgaccacactgaaccaaggtttgtgagtgttatccttctctaaggtttatattcttaaatatgccattttctaagttgtaaatttctttatttcagagaagtcagcattatgtcttgccttcaagacgcaaacattgttaccttttaccaggtactcttaagtccctaacaaaaaggtctttacacttctaactgcaactgttaattatgtttctgaatttgaatttattaggcgtggtgtgaaaacaagaaagaggaaaacaaatttcatggttttggtgtacatgagccgaaatatatttatattcatatggaggcctgtgccaggtacaaacacattttctgtatgcttgttatcaattacacttcccttcaggccacatgagaaactacaggcagctaaaaaaaatccttttaaaacaagccgattctcttgttgtggttgacatgattatatctatagaataatgttaaggatgcttccagaaacatgcaaaactgtagaaacgaatttgagaagtagcgaattggttgaagcattataattcaataggagcttgtattgaataagagtcgatatattcttggaataagaggccactacgccattgcactgtcccaagcgattagaatgacggctgttaatcaacttttacagcttatagacttctcctgaaattttatatatcacatgcaggaccctttatgattttctgtgtggaaataatgaaggaacaattcaggacaggtggtctctttttgagagaatcgtaaaaggtgtaagatgcatccatgctactgggataatccaccgtgacctcaagccatggaatattttccttggaccttgtggcgctgttagaattggtgatttaggacatggttgctggtctaaatcttactgtgatggtcgacgtggttcacctgattgtggaaccatgttgtattcggcaccagagctcaggaatgggctgttggttactgataaggtattccttatcacagtttcacttttcaaacgttttcaactatcagttaatagtttcacatataatttattcttgctgttatcgtaggttgatgtgtacagtttaggagtgatatatcttgagatcttcatgcctgctgctgttagtgttaacaacagagttgatgcattgatcgatttgatggaaagacgatacaaaccagaatggacagcttggtccatcgatatggaattcttgaaggacctaactgctttaaacccatgtgaccgtccatctgtgggtacaattttggtacgtacttacgactagcaataaacattaaactgcttgcatatagcattaatttgatcattttttctgtttttatttttattacaggaatatatcgccgaacacgcaagtgactgttgagtgctaatgtcagatgtgcaaagatgatgataatatcgttagtacgttgttccaaagaataatcagaccaagcatttagtacttagtattttgcatcagcagacgtattattgattgtatgatcaatcattgtagctatgtagtacctagctttggtactcgatgtagatttccattgagatgaactctcataatctgaactagaaatttctgtcaatcctcaatgtgtattgtcctatgatgaactctcacatcagaaatactctctctgttgtcccaaattagatgttttaactttttacttgcaatgtttgatcattcgtcttatttaaaatatagtgtaaaaataaaagaatgataagtcgtagcagtgatacacccgcagcgctcgaaatagtaagtcaagcgccacacgccgatctcccttttttttcccttttttctcaacctccctcccttcgatttttcctcccactctgtttcctgattttccgtttctctcaacctctcccttctgaattttcctctcactccgtccgatcaaaataaatagagtaggtctggctcgtaacagcgagagtaacaaaattactgcttacgagaaaacaccgagagtaataaaaatagaatcatgctatacgtacgacccatccatccaaccagcttacgacccaaacggtgtagcaacacattgcgagacggtgtgaggattcgtgctgcatgctgctgacggcgcgtacatcgacgttgtagtcgtctgacagagtcggatgtgtgggtcgtgtgtgtagcattttccataaaaatactaatctcggtttctctgttccacacatccctcctattccttcctggttgtaatataagataagtgagaccatgtaaatgaataaatgattttggttttcgcacatccctctcgttccttgccggtcctaataccaatcctattttactataaagttataacccactaactcctaaagcttaacatataaagatgtcacatcatcatcatccactgacaatcaatacatttaatatcatgcaaacatgttatattatctataatttaaaatttattacattttagagcttttaaaataaaaagcatgttaaatcatcatcccgcataattcacataatattttaatattgttgatataaaaacacgaggcctgagagatctgcttaactccagtgcaggtcaaaaacttgcctttgggtgtgtgagcatgccagttgatttgatcctgcaattaacaagaaataaagacaaagaaaccatgattaaatccataaacgatagccaatcggctaggtgccgatgacatataatttatttttgagccgatgtcatatatgcatcgatcggcagtcattaataagtaagaaagaactaaatctactcgatcggctgtagatattagcaatatataatccttatgttgatatatacttaaatcaagtgattgagatagatcagtcgccatgccgagacagtataaatcacttagatcgaaataaatattaacatcgagaatatatatgttcatagcatagccgatcagatagatctagcatgaatcggctaatactccgataccactctatattaaaatattaaagcaaatagaatataccaaacagaagcctaatatacttaaatgcaacaagatcttaacataaagggcagatttaacatgtcaactaagcacataagataaatatcgtcaaagggcagatttaacatgtcaactaagcacataagataaatatcatcaaatcaggtaggatcggctgaaaccctgatgctaccctaatcggcaaccaaaggcaggctagagattgagattctaatcacgactcataagatcaaactcaactgatgcagctataagtatgaaaagaaggacaatatctagataatcaaaccgttggatgtgtcatagagtggtggatatcctatataatctaagtcaacatcggtatttaacctaatcggctgccttctactgacagatgttagccgattataggttagatagcgatattgccgaagattatataagatatatgataactcgacgaattaaataaataagattagagtgtcatgaagatggaagcactaatcccgagaacacaagccgccataacaagttttacctcttgttgaagatcagaacagatgcagctcaacccgaaagcaagaactcgtcgagacaaaacgaaagtaaaaaagggtggtgatgcgccgagattgtattgaacgtgtgttagtttgattatatggggctcggggtctatttatacccaagattacaaaatatgtccatatcggacacgactcttatctctaacaaactctaagataccataagtctttgcggcagacttttgtccaagcaaatctctaaggaaattacataaaatatcctaattaaaagatataattgccttctcaggactctatatccatgcgtggcaatcctcatgaagcacatcaacccaacccgaccacgtacgccttgtcatattgtcggattcggcttagtcgattaaccctgtccaactcaaactctatcgatcctggtcgcagccgattcggactccagctgatctttactctgtttccgggacgatctccatctcgaactccgtcccgattccttcttcatctccgatccttggattaccaaatttggtcgttaacaaatatatatatcttcattattgtttataatatcttatgtacctatgtaagttcatcatcacttggttaatgttatttctctcttatctaattaagccatatcgatatcgcatcaattgattttagtgcttatgtaaatttatgttgtttagctatcttacacattatttttacttattgttatcatactgaagtctcgcagcaacacgtggagtttgacctggttactaaaatgattattaccagcctctcccatgttgatactacctaggcgtaaccgcctaagtaaaaaaaataatatacaaggtaaaaaatataaacactttagacggtgcccacagtttaaaaacattaccagccccgttgataaaaaagggatttgctataccacagcttgctggtccatttatccattgaacccattcacaagtatactccaatggatccaaaattctaaaggggctaaatggttcgaaccctagaaaactgagaacatactaatcgatccagactcctctcgttgctagacaccaaaaatcaatggcctataacaatctcaagatatcgtctccattaagcattctcacggactgcgagatccatcatgtatttataaacattcattttgatgaaatcatgattaatagggtttcctatttccgtgtgtacattgttttgttttcatcaaatacatggttttgatcttcagtatatttaacatcatttatattgtatgatcacagcctccgttatgtccttacgttagacgccactgacttttcggtatatgtttgcgtattcttcttgtaaaaaaatatatataaccattatttaatttttatgatttattttatgtaagtatagcttaaattttaaataaaccaatgttcaaacatacgcagaaaaaatcaacggcattaaaaaaaaagaaaaaactgaaggtaggacaaatttttttctaccgttgcaaacgcattggcgctaactggtagaagggaaaatcgctccaacagttcatctacaagcaccagaagtttgcggccagtacattttgagttcccacaagagaatgcatttgcaaacctataaaaattccagccattagagtacatcctgccatcacaaaagcaatcaccagcaatctcccaccacaaaacaaatctgacatcactgccacaacaaatacaatcagaaacagatttgtacaccgccatcaacacatgaatatcgatctcaatgttccgaatcttgaagtagggtaccataaaaatgatcgatacaagcttaaaactgatagtgagtacctaactataatgtccatagacatgcttctaaacagataacaatcttgttttctaattattgcaaattctgagtgatccaaacctcagatggaaataacccgtagatctgttctttaacatcacaaaagggaactgcacgctcgaattttcctgtttccaggtcgtacgtccttacacctccccaaacacgtagtccaagaagccaatcgaatgcatgtattatcacgggagaagagaaatatatacagtgaggtcgtatcccgggcaaattctgggtgggtaagcatgcggagtgattcaatccaaggaatagtgcatgatccatcaaaacattctcctgcaccacccccttgcatccatccggatcaactttgcagatttggaatgctataccatctgggtagtgatgcgcgagaatcgcacgaacttgcaggagatcaccccatggcgtcgacactagatgccgagtgaggattaatcctaatcctccgtagggccttgcggcataaaaaacctcccttgttggtccattgctcgctccatcaagatcccacttctccaccatcccgtgcaatgtcacggcgtggaacctccctttgtggtacgcgcagtcgagatatctgtctcccccacttagagttgaagccacctgccacttgctctgtcctgccttgacgaaagaaagccactcgccgttgttgtggatgatcatcacgacgtagtcaccgcctctggatggactgcaagacagcactgccttttggtagaaccatatccctaaccgatatgcttcaaacctgctgtttgtttccaaaaggtagtgttccaagttcccttcttcgctgccatagaccgcctccacgcaagcgaaatcggtgatcggtgggagggggatcatggccagtgtgacagggttgtgaagcacgagattggagagatcattcgccaaaaccagccagccgtgagaggccccgtagcacgcaacaaaggagccctttggaaaactgacactatagatcttgtcgactgcatcatcagggtggtagaggttgcaggtcaccgccgagcggcgcctttcgtccagccttttatcaacgtggttaccccaagacatgatccatggagtgcgagaacgtgggacaccggcagccgtggcggcggaactccatgtagtgcagactgcggcgaaggcaagtgcatgaggaagctccagtcgttccaggatgattaggaggagatcaatagaggtcggaccagctggggcttgcacaaggtcctgctgcagcaaacatttgcatattgtgaattatattcaatacaaataagataatctacatgcgaactgtatttgttactagttcatatataagaacgaacaaatcaaattcatccatagttcggacaaggaatcccttctggtaagcagggtctcccaaattggaaagggacatcggatccaattcggacacgaagaacacaacgattttgcacaaagattggggcagtcagaattagaatcagactaccagtcttctggaaaacgatccgcatcacacaactcatgatttggacggattaaacgcctaaagatagcagtttttttttctacccgtgagattgtacaaaatttgttgcattcttgagaaggtacatgcgaaatttacgaaacaaaattgcttttttttagaagctatatgtgagattttagggggaaaaattgcatctttatcacagaaaggagacaacaaacactcattttggaaggattgagaaatccgatatagtcgctgtgtatcgtagtgtgatttgattgcaaggttaaataaaagcaggcttattattactcacccaagggcgacatggcagggagaaatcggatccgtttggagggattcctccaattattttactgaatgaatcggatccagtcaccgggaatccacgttggcccaagaggggagggcgacgagctcacccttggcctgaagatgcgccggatctggccggtggatccccgtccaagcagaggggatgaagggggaagcacggccaccgatgaagttgatgccgacctcgtctagactagacctcgccgcgaagcttgtggaggtcgatctgcccacggatgaagtcgccgccgacgatacacctctcggacgggtcgtggctcgttcaatttggagctaggacgagattaggggtctgtttggttactacctgaacctgaagcagtatttatttaggtctcaactaacgcataataagcctgaaacttttgctactttgtttggttcaagcctgagaaggcgctggacgcagggcaagtcgactcaggctcaggcgtagtctgtatcgaatatatatatatatatatatatatatatatatatatatatatatatatatatatatgtatagtcggttacaatttataatttagagttgtaataggtattagaactagagtatgagtcaaacttgtcacctagcaactatggcatccctgttggattcgagacacgtggccacgcacaaatcttggaacaacttcatcttctaccttcccttcctctaatcacccggcaaagaatcaggtttcgaacgcttctcctaattaccccgcatggaaccgctcatccatctcttcttcttatctaattaatgatctaatccaccggcacaaaatcgagggaacgcgttgctctcgtcctacaactacaacacaggcgatactagtagtccatcgccgcagatcatgaacctgttacctgtccagccggcctcattcatcaaaaacagattgtttctccattacttccaatgaactacgaaaatacatgtgaccaaaacgctaggtaattagtttaatcacccgaacttaatatactattcaaagctagtcatttaatctccgattaatcaagtaacggtgtaaatatgaactctattgttgatctgcaaaagaaagttctgataattcacttcgtatatgtgtaaggtgatttaatttggtgcaaatgaaagttctgataattcttcgtgcaagaagagacaaggtataactcacttcatcgttgtatggtagattaatagatttcacggtaggggatgaagatgaagatgagatggtttcgagattcgtatagccacgtgtcttaaatccaacaggggtgccatagttgctaggtggcacccggtgccatataactttttttcccagacgctatcctaggatctctcataaatagatagacgtgtctattgtaactgtatggcgacttagcatagcgagagggagtggctgccggcggcgactgaccatgagtcgttgtaactctgatatgctgtaatatgctggatcgaggaggagcgcccgtaatcagtgccccggagatgtaggctacaggtgaactccgttaccaaatatcgtgcctcggtgtcgtcatcgtgtttggatctcctatggcgttttcttccgcggtttggtttccgatgtgatttcggggctggttttataacacagatttggtggcctctcactcaagcagctatgttaaaaaaaattgattacgttgggttatgatattctgactattcccttcctccagagaaaacctaatctagctaggaatgaaacactattctcactacttaaaaaatacgtagtggtgatggtgaagccagcgcagacacgcgatccaacatagaaacgtacatcaacacgttcagagcgaaaaaatagtgcacactcctcctccgaaacgaaaaaaaaaataatccgacccacgccccgtgcagccctcaaccgccgacacgggagcaggaggtcgacgcgtgatagactccaaggggacgccacggcattctccctctcccgcgtggtccttctcatcaccgctgaggtgctgcctcctcgccgccatcgctgcgacccgcgccgccctcgaccgccgacgcgggagcaggaggtcacgccgcgccatcaccgccgaggcgccgcctccttgctgccatcgttgcgacccgcgccgccctcgaccgccgacatgggagcaggagtcacgctgtggccttctccctctcccacgtggtccttcccatcatcgccaaggcgctgtagtcgctgccacgggaccaaggaggtctccgcgcgacggactccggggacaccgcggccttctccctctcccgcgcagtccttcccgtcaccgccgaatcaccgcctccacgccgctcgtacactgatctcgatctccgccatccaggccgccaccacctccaccggtcacgattgccacggaggtcgatccgtcgcctccgcctccgcctccctcctcgacgccaccgtctccctctataggtacaggtcccctcctgcctcaccccaaccctcccccttcttactctaccctatctattggcttcaccatcaccctatctgttgatgcaattttcgattggatgatattgaatatgccccatgatttcttagctgctgggctgtactcctgctcactaactcagctgagtatttcttcgcagttataatggcattgctcactatatggtttgtcatgtcatgctactgcacaagtagctttaactataagtgggcatagggcctcatacatcaggaaaagagcaactttcatatacaaacaaatggaatcatttttttttgccccatcaggaaatggaaaacacaagttgctttgatttgtgattgttcaatgactatgattctgaacgtttaatcaaatggtacgttttatttttcctaaagggtttcagtaatccatattattatccatttactgtcagtgccactaatcatggttgctgctctttcaaatatgacgttgtgcagcatggaaataaaaatggtttctctttcatgttaaaataagctatgaaccatcctgatattaaattgtcaatggctattatgcatatgttcaatagtgactggatcagttatctgatctacatcagtgatataattaaaatcaaattatttatgtgcatgtgtgacaaaaagaagttattatctgcatttgtttctcaaatttagatagcaggcctaatcttttatcgagctaggagaaaccctgagttccctggttaggaacaacctggagctatggatgatgaatcatgaataaagagtttttcagtgttatgttgtagcggccagaatggaaaatgcctgaccatagctctgaagatgagtacatcttttgcaaatcttgatctgtgcacctcttcagctgactgtcagcatgaaaaaaatatgattatgatcaggctttttgcaagtcttggatttgtgcacctttttagggatggatagcaatatgccaatatgattgccgtagcttgaggctttgaggtagatgaagagttaactagtttcagtgcttcttcctaacttttttttttctaaatagtttgcgcaaaagtgactcatgcaccatctgtggtgaataggtcggtgccctagtatctccttcttgatggaattcaatatgccagtgtgcctattagatattatgcacacttctctattcagcccaatcagacgttgtctcactatgtcaatgaaccactcctagttggacgtgttctcactctctaccagggcaaacgccaaaagaacaaggtgtaaccatgtatcaatccctattactgtgagcaatgtgcctctgaatttaccggtcaagaaggtcccatcaattgctaacactggcctcaaatgcttgaatgcctccactgactgccaaaatatccatgaagcacgaccaaatacatgcctagggactccatccaccattcttgatttctccccttgaggttgatgagaacacaactagttcggatataaccatgacttccatttgtattaatcaaccaaaggtgcatatgttctatattagatttacttattatatatttaaacaaacgttgctacataatgagtttggtgtgttttcgtttgcagatgtacttgcttgggcgaaagaaaagagaccgagcgcaaggaatgcatggatgattaaagaagttgattggggaccaaaccaagaccttcttcaagtccacttctacctcaccacgtcatgtttggtccatagaagacaagaaataaagttctacatgttttggattcggattcgggcctcctgatagcatcaacttcaaaccgatctagtggcgaaactgttctgtcattcaacaaggaaatgcatacttgggttcttacttttgatagcattcggtagcataggcaagcgaaggtatgcctcgtcccaatctccccatatgaccttcatagcaactcgcttagcatgccaagctttgtcgtacgtaggccaatagtgccatatgtgctcaactgcctctacaatagctacaggagacaatgtaggttcagcactaacaaatgtctgtaatctattacctataaacctcgaagttagctgcaaatgtttgccagatgcttccgcattagagcatgtgtggtgtttgcctacactagttatcctccacctatcacccgccctctttcttgtacgaatctgccattcacaataacaatcaaggcatgccaccatgtacttaacagatgcattgaactcgttaccatggaatgggcggtgcacccagatagagtagctctgcaaccatatttttagctcatccatggatcgaaactccaatcccttcctcggttcctcccccattgcatcgaaggctctatcgtattgtggatcaccgtctgcaacagcaagcctgccattgctaaggccctcgaattgagttatttttggatttcaaccaatgattttctcaaacacggtcctctcctcctccgacatcctgctgtcacatcctgattttcatcttaggatttataaattatttaataaattattattagaatttatatgaaatgttcattaatttacaagtgaagctaaatgtgggaaataaaatttcctaaacataaagcatggctggatttaattttattaaattatccatggttaattatactctctgaaattttctcggatttttcggagctcaattcttaattttaataatacaaagagcagttcagcaattatttaaataataaattaatcattaaatggtctgattataaccttgttaagtactttgagtgtccaattattttcaggattgttcttgaaattatttgagaattggaagtatttttaacaattcaaagatcatttcagtgattaatttaattggaaaagtaaattgaatcctcttttccttttcgggccgaaacaggaaatgtcctctctccttctcggcccattctcccttcctttcagctggctttattcctcctctgaagtccatttcttgtccctccaatcgggctggagaaaaagaagcccagtcaagtctaattcgcttccctgctacagtgtcgtcttcaagcttggacagagcccgtttggagggttatgtccaagtttgaagatgaatttgtaggtgaaacttttataaatgtgttcttggtgacttaaaagccaatgttgaaaaagaaactatattgaaaatatctcaaaagcaatctcaaaattaagcttgaaaattcaaattttgactttttctttaactgattaggccatccgatgggagcctgaatttgtaaccacgcacagaattcgacgcgaatttggattcgttttcgagtttatctcttcaccaaaccctaggttttcccggcgcgattcctcgcgttctaagcccgatctctctctcccatggctataaatagagtcccctccctctcctctttcggccgccacctctccctctctctgccgtcgcttgtagcgccgtcgccacgttcgtcttctctgtccaccgccggcagccgctccagctgcccctagcagccgcctcggccatcgacgacctgcgccatcgcctctctcggccctgcaaggtcaagctccaccccgtccaccccttacccgaggccgaatcccgccggaagcttgccgtcaccatgaaccagtgggttgttgccacggtttggtctccagccgcgtcgttcgtcatcgtccgtcgtcgccttcggtcactgtcacttcctttggattcgcagctgtgaggagaagcccatccatccctctgttgccgccgaagatcaccggaacatcgctgtcgttgtcgatcagtaccttgccgccctttggaactcgtcaccggccatctcctttgctgtccgtcgtcgtgtaagtgttggtaaggatcgtcgcgttctcctcttcctccctgtgctcatggtttccgctgtcgtgctgccgtccaccggtgtaggtttttccctagggtcttaatccaatctaacctaatccgttgtttgtctagtgttgttgtcgtctctgtgtgttgccgctggatcgtcatcgttgtctctccctctccgatcgttttggttcggtgagacttctatccgtgttccctcggttaggttttaatctctagtttgtgttgtcgagtagccgccgtcgtgtcgcgcttagctgctgccctagcgtcaccgctgcgctagtcgcctagccgccgttgtgctgctctctgctatagccatgctgatgctgctgtgcgaggccgcttgccggatcaatccaagccatccggtcttggtcgacccggtcaaggttaatctcagccatccaaaatcaatataaatcttgttatcccttttcaatggcatattagttctttttactgtatatcgtctactaaattcgttccaataatttccggaggatgttttagtcttatatctcagtcataaattatttataaattgtttaattaaattggaatagtcttttctttaatagtctttaattggaattaatcttgtaaaacataactaattcatatgaagttggaattaagtggttcaagtctctaaattcatctaaaatcttgatctacatatttgtttatttttatgtactatttatttggtttttattagtctttttattcgttttgcgtgttagcttgtcgtttctgtcgttgcgaagatttgtgaatgcgtcggaagtgttcaaaaagattaattgaagaccgattattgcaaggcaagtcacacagatcccaaacacaatcctttgagcatgttgatcctatatttaaattctctatttatttcaactgtgcatttattttcgaatgtcaccgggtcgtgtgaacctattcctttgtttatggccaatttgcattgattaccctattccttgataccttgggtaataaattgattagcttgaaccttatatattggtttggttcagctaaatgccatatatatataattgcttagccatgcttagaaacattagttcattaatgggatgaatcatactacattattatttatgattatgtttaatggtagctcacgatggttaatcgtattatgataattaattgataattaaaaattgacaatggtgggttgtgagcacatggttttgaaggccgtgctcatgacaattaaggatcggttcacgagctactgttgtgagacattaaccgtgccaaccacaagccagcgtgggcaacggctttaccttttgtataacatggttcattacggggcaccagactgagaagcggtgagaagtccgtgggggtcgctggggagtccatgcctcttgttatatttatagagggggtgattatgatccaggattgatgcactgtggtgagttgtgttgtgtgaggggtactgtcacagttcctttccgaggtaccgtggtggtattgaggtgcatggtgacatgtcgtggagctgtatcttgtgggtatagtggtacacctctggccagagtaaaactattcgaatagctgtgcccgcggtcatgggcgggttgagcagtgtttttcgtgattagtctcacacctctcacaataattatggatgctataactggtaataatttgcttagctcctggtttggagttagatctgtacagccgggtatggttgttcagtatggttgggcctgagcagcatgggtgtgctgttcagtgttgattaaaattgatgattaaattactctattgttttactgttcttaaatgtttgctatatgctgcttttgcaaatgagcctatattatgccatcctttggtatccttgtgcacttgcatatttgctgtgtggcttgttgagtatgttatatactcaccttgcaataatcaatcaacctcaattgaagaaaaaggatccagaaggagaagaagttgcttataccccagttgagctgcctgtgggagtggagctgaagccatcgctagaccgttaattccgctgctgttttttttttcttttgtagtatgtaacgatgttattatgatggatttgtatattaaattgtcagtttgtgtacctcggctgattcctggacgaggattttatgcacaaattagttcggaaattattagtgaatttccgggcgtgacacctgcccattagatgatcgtcatcagaaagaatcagatgcagactcatccacttcattgtccaaatcagcatacaacaaattcgagtttaatccattaaatatcatgttttcctcacactcctcgcgagtgtaaatttcttcatcaagcaagtctctgatgaataaaatcaaccgcctctcgtcaagttcaactgtattctcattatctgattgattcacatccataccatcatctgacatttcctgctctacctccccatcctccacatcccggtgcctctcctcacctatatccacatcctcctcaacttgtttttcatcccctacctgcacatctccctcaattaattcttccttccaatccaccacgaacacatctttatgtatttcgtcccctacctccacatctttctcaattaattcttccttccgattcaccacaaacacatcattctttaattcatgacaatacatgggggattctatgtgcggactttcattgaggtctaaaaattctttcgtcgattccctacgctctttcttccaagcaaacacctcaagcgatttgaactgtaaacccaagactatatctacatatgtttcccattccacctcaccattcaaatttaacatgaacatatgcgacattgcaccagcacctatatcatatatccccttgcataccaacagactcatcactccaatccaatttatccttcgtacgtgaaattaactcatcaaatatgagtttggcacgaaacactgactgcctgactaacatcccctcaaattggctaccatcggtactttcatctaccacactgccaccaaaatggagtcataccaatctatctatctacatcaaataaccgataaataagagtgcattattctactatgatacgtcgctataaagatagaaacttgacatgggtaccccagacctaatgaaaagatttttgaatttcgaacgactaaccaccagtctcgatgttcctaggatctatgccaatcaacatcaacattaatcaatatgaatccccaaaatatttacaatacaacggctctacacatccatctcaacttcaccattagcaaaatagtgcataacttacaaaaaaaaactatatgaatcctctatactaacatcaatatacaactataacgtcgcatcgttagccacattcactaatccacaccacaacccgagcaacatttaacaacccatgatttcaaccaaaatactctataaaaatgagggaaacattgaggaaattaggcttttggaggggatttaccttgcaaaccaatatccaaagcaatgctcactaaataaccttcgatttgaggtggatttgagaggatttttggaggggaggaaagagggagttgcgcctgcggaagaaccctagccgagtgcggggaaaagaggaccagtgacgggccggggcggctcagccacgaggtaaaggctgctacctcagcgccaacatgcctggcgctgaggttagccgcatcagcgccaaggcggttggtgctgaggtccctgccacgtcgacgtgggggaaaggctgggccgccacgctggcagggctcaatgccgatgcggctggcactggtatggccaaccacagcaccaagcaccctggcgctgagccccggcctatttttggatgaagttttttcgcgggcgagtttcgaaataagtttttcaaaagggccaatttgtcaaaaaaaaaaagacgggctggtgttatagtatagtatgtatagtaccataaaaatcaaaacatatggagtaacacgatttgtactcatacccatctacccaacaggtatgaatttttatctattaacagatccgtgggtaaaaaaattagaccgtagagtaaaacaatttcggctcatgggttattggaccctgttgccttttctaaacacgaggaatggaagatgtgatcgaacagaaagcgcttgaagacagccagttttttgctacacttggatggtaaaggcacattaggcatctataaacagcagggtaagccagtggatttgaagttcaaacccatagtttaagggaggctttatgctaacttccacggaaggaaagaagcaaacaagggcatatggcccatgcacggcaaacccaaaactgaaaactcacacgacacactatatcagaactctcatgtgatgctatgtatatatatatagaattatagctagacatctccgagagaaaaaaaaaaactagcaaaccattgtgacagtctcaattttgcatttttgctatactgcttgcagatccatggggcgttgggttaggcctgaggtcagtatacagtctcctcttaatatattattctgcacgattattttgttgagatattgtactagtcaagagaggattcatcattttccccaaaattggttatccacttggcttttgtcccaacttggataattttggtagatctaatccacaatagatcgatgaactacttaacttagggtctgtttggtacagctcccactctgagactctaatctcttgaagctagagttgtatcaaatactttcgagaacttgaataataaagaatggagcttttatgccgtttctgaaaattaattatactatgagggtgaagcgacatttctaccgctcctcaattccgctccacccttggagtaacagctgtgccaaacgggcttagttttgctccactctatgtatttacaagaaaaaaacccaattttgcacgcgccaatctcctgccacacccgtctactcttaccaaggttgacaatttttacacaaactgatcgaaaccacgaacttttgaggtttcgacatgggatgaaagcatatcccgaatgaaatttcaaatggttttcaaggattcaattttggaacggcaaattcaaccaaaatttgatcgaaatgtggtgaaattggatcattagtggtcagtatctggcgctcaattggaaatgtgaacccggactattactcatgctcatgaatttgttctttgtattcccgcaactcagtcctgctacaccagctctgcccacctagctagttcccttgtaatggcatcctgccgcataagattgaaagtggcttactcgtgaaacccactaattttctgatgtaaaacttactaatagatgacaaaaagctacgaaactgtttattttgatcaaccagtgggttcgtgggttagccacttaaacccctaccctcgcatagtaagagagtgaatagtgatagcgcatgcatttggtggcttgtttactgttagacctgaaatagaccgctcagatcaaagcacattacagtaatcaatagagtaaattttcccgacaggtaaatcaggcagtggatcgcagctgcattaaactgccattaattgtttcatgcgttgaatcaccgtagagcaatttcagtttactgttgcgggatgactccgtattacagcagaatgaactggatccgcatcggccatgagctgagtagcgtcagagatggataaagttgacagaattaaaggctaggatgtaactgcagaatagtccgtcgtctattcattggaagaatgggaggaggggaatattggtaggaaggatggaggatgggaaaaataatgggatagagggctggtaggtttgggccggggacaagagctaccacgactgcacgagcagctggttggtttgggctgcggcccatttccagcaagcggtagcagtagtttgtcgacaaaaactccttgtatacctcaaaattttctctaatcctttttatatcttcaagttttaatcatctctcttagggcttgcagcacagtacctacatttagttccatgtctacattttactttccgtggatgtagatttttttcattattatacgaaagacgcatacacgcatacaaacatatatcaccactcacttaaatactattaagatcgtaaccgtgtatacataatatataccactccctccgtttcaggttataagacgttttgacttttgttaaagtcaaactgctttaagtttgactaagttattatgaaaatatattcaattattaattttatgaaactaatttagtattataaatattactatatttgtttataaacttagtcaaacttgaaacagtttaacttt

SEQ ID NO: 58680 - DNA, 109586 bp, Oryza sativa
  unsure (1)..(109586): unsure at all n locations
cttactctccattcaaacaatatttatgcgggacccaatgatgagtgagggtgatatgtgggcccgagtggcatttgggaatgaaattttgggagagtggcatttgggcactggcatttggcaaatagtaaattctcccacacataactaaccgctgacatgtggggcccacacagccggccgagacataaacgacccactgacatgtgggccccacggagccgtcccgtccccgcactttcccctacacacaccagatcccctcttctaatcccaacctccaaaactcataaaactactctaaaccctactccactcccgctccgctgtcactgacaaccatggcccaccacgtcgctcccctcctcctcctcctcacgctcgccgccgtcgccgccgccgcgtcggaggaggcggcggcggcggatacagaggcggctgcggccgtggaggccggcctgctggtgcggcgcgaggcgcagctcgcgcggctcgaggagctcaccgagtcgctcgccaagtccgtccaggcgctggagtccgcgctcgccagatccgtggagcccgatccgccgccgccggcagccgccgcggcggcgcccggcgaccggagggcgccgcagggggtggccgtgacgaagcggaggccctactggtccgagcggttccacttcgccgcggccgcgcggctcggggacggggcctacgccgccgcggcgaccgcgctgccctacgaggacgcggatgggctcaccaagtacttcgccgtcggcgactcccgcggccgcgtcttcgtgttctccgccgccggggacgcgctgctcgagctggagcccggggtgtccggcgagccgccggtcaccgccctgctcgcgtacctctcgccgngccgcaccgattgcttcctcttcgccggccacgccgacggctccatcgccgcccaccgcctcatcgagtcgtccccgcacggcgatgactggctcaccctcgccgccgcgtcgtcccgcctcctcgtccgcggcctcgacgccgcccccgtgctccacctcgaggcccaccacgccggccgcgcgcgctacgtgctgtcctgcgactccggcggccgcatccgcgtcttcaccgagaacggcacgctctacggcaccgccatcgcctcgtcgacgcctctcgcctttgtgaagcagcgactcctcttcctcaccgaggccggcgccgcgtcgctcgacctccgatcaatgtctgtccgcgagacaccatgcgagggcctcgctgaagctctcaatggctccctcccaaaggcctactccttcgatccttccgagcgcttcaaggcctatggtttcactgatgccggcgatctcgtgcacgtcctgctgctcggtgacattgccagcctgaaatgcagggtccgggcaatcaagaaggctgagatcgacaaccccgtggcgatacagacgatcaaaggctacctcttggtagccagccaagataagatccttgtgtacaacacatcaactcagtactatgggagggttggggctccccgcctgctattcgccacatcaatcaaggatatcaagtctgtgtttgcgggttctggtggcgtgatgcctgcttcaccagctgggaagccgcttgttgccgcggacagggagaagctcgtgatcttgggactcggagatggttacattgctatatacaggtccaacttcccggtgtacaaaccggagagcaatgctgtggtgtggagtggtccagcgctgctcttcctcctgttcttgattggcatttggcaagtctatgtaaagaagaaggattcgttgggctggactccggaggagacatttaacacctcagtcacagctcctacagggagcattttgaatcattcgaccagtgaccgtgccttcgctgatagctcaacaagaactggtgagcgaggctatgttgatggcacaacaagagccagtgatagaagctatgtggatgccaccacaagagcgacagaccgagcctatgctgaggctaccaggggtgtggacctacggggtggggcgttgagaggtgctccaagaaggtatgtgtcccctactagatatacaggggccgcaggaattccatatcgacctgtttcaacagagcctgtgcttcgaaccacaccggagctgaagtatcgaggcccaggtatggagccccctggttttcccaagaaaagagacacattgttctcaagcaaccagacagtagtagatgatcatgttgattgactgtttaattagcggtgtagacaacacgctaaattttgaaggggttttgaaaatcctgcaccaatgtgggcagcgatccacatgtgtgttgttgtaagatgtaactcaaaaatgttgtatttgcatgagtacattacagccattgatatgatgctgcagatggtgaaataactttgaaatttatgggttacattatagctatgaaagaagggattgttgagctgttttcgtatgacttccatcttcaacgatgtaggaaaattggacaagtttacaataatttttaacaatgataggctggtaggatgtactatggaattgctttaattatacagtggcgtgttgagcatcagaaaaattcagcaagttgcatttgcaataattttagccatagacactacaatatcagtgagatctttttttttttcagaattcactaaagttattaatgacacagtttgcaaactttaaagctcaacacatcacgtgtaacattttaacttgattttctatcactatctgatctctctattacctttttgcttccaagataaggaggatctgctgactgccattgcagatattttttagtggttgcaactgctacatcatcttaagttggtgacaatgacatggggcttagaatggtagcctgtgttgtctaatttttgtgttcttttagcatgacaagtgattccttcaatctgattcccatctatagatgataaccaatttagttatctgggagatatcataccagaatttattctgacagttttacatgaattagaatttaatctgacagacatgaactctgctcggtctgcagactgcaactacaggattcaccggttcagccattttctgcaggacagcaaaaggccttgcattcctttgttcactgaagtactgtttagcaaaagaccagcgctgtcagcagccggatcaacatctgtcacaaccggaatatgacaaccctagagtttcagaagttgaaagcgggtggagcattcaactctttttaggtaggtaggttcagactttcagtagcaaatcgtttcgtaggcgagcaggatcagctgcctgggccttgcatcctggaagtaacttcatgcttctaattgtagagcaatgctcctgtcgttatgctaaaacaagttcagattcgttttggttaacattaacttccacttcctcccttgtagtgggtattattccgttctatttcagtgggcagtaattcattgctaggcccttgcattatcaaacaagatttcaccaaaaaaatgtagacctgatatatcatcgaaaataaaccggatagcagcagaactgaaactctgggatgacaacataatttgagcacaaatgacccactatcattgcctctaaaatgcagaaaccggaggcagtgaaacagcacaaatttgaacttgagcaacaacttactgaaacaaaaagatatgaatataggaaaacaatgtaattctttactgcccagtggaaatttttcaccgaggaacagaattcatcaaatgtgagtataatgtaagctccaatgtttgctcacaggtgaagtgaaaaatgcaaaacgtatcctgactgttgcatcttattacaatctcaaggcctagaaaacaaacttcatattcatggtaaaatcacgacactgaaccagtttctctcgtctaagtggacttaacgatgaagttttggcggctgatggggttcatgatgactggtggtccagcggtgcgaggccaggcctggaacttggtgtcagtggcttgccaccactccttgtcagagacagtctttggaatggaacctgcgtccaatgaatgaagcagattaaggtccaatcttccgggaggttaagcacatgcctgtaagactaaactcacctccaaatgccttcttgtcagaaacaaatgtgtcacacaggtaagcaatggcgaaggatccaaccaaggacccagcaatgtatccggccgtcatttttgctgcacaatcatgaaatggcatacagattatcaagtctgatagaaaatgaatgttacagattattcatatgaagagaagcatgagtgaacatcacagtctagaaaaacaagtcccctgctaactgtagttgttctcaaactataaataagcagctttcttgttcattggtataaacacaacagacagacaaaaggaaataagctccagcgtacatatagtcaagcgcaattgtgtagaaatgcagatagtcaaatatgattccaagatatacaacttaatctccagctagtttaacaagttagattagtgcaagatcaaatggcggtcctcttgaaacaagtgatatgataaataatactggacttattgtggaagagtaaatgtgcagtacgactcaaaccacagcctacatataccttaacagaatcagttatagataatagagtagacacatcatttattctactgataatactccactatctcacagccaaaatgcaggagcaaactagacccaagggggcttattgctaactgtcgaagttgtcaaaactataaatcagctgctttcttgttctttggtacgatggaataagttccagtcttccagcacatacatagtcatccacagttagaaaatataactatcacgcctcaagcgcaaatgtgtagaactgtagataaggaatatgcgattccaaaatatacaactgaatctccagctagttcaacagattagattcgtgcaagatcaaacagttgtcctcaaacaagcaatatgtgattcactggacttattgtggtagaataaatgtaattaaaaccacaaccatcatatatactttaataaaaatcagctgaagatatagacaccttgtttatttattctcctgacaaatgccctactctctcacagtctcacatagcaacatctagacccaaggggattattggttgaagcaacgggttaaaatgaaagggttggcttgggtgggagtggatggttcatccaatcgaaaccagtggtagtatcgatggggccattcttcaactataatggtgtcaaagtatatgttcacaacagcaattttctattcgtaatgtgtattaatagtgggattagcaaaaagtcatttgcctccgcccctgctccaattaatcatagtatttggttaagaggatcacagagtagactccgcgatcgatcgatcgatcatccctgaggaatcggtagcttgtaatcgatcaaacacgaccacttcaaatctcgacgattcatgcacaaattcatcagagaagatgaaactgggacccccaaaacgcaggcgagctcgctgcgcaaacacggcaggacccacgaacgaacgagttaggaagcccagcttatacgtagagaagtccgacggagaggcgcagcaccatggaggagatgaacggagagagcagatccgcgagagatctgggagccctaggtctaggggggcgggggtcggcgagcacgtaccttggttcggatcggattccgccgccgccgccgccggagagagaagagaagagaggagaggagacgcgttcctggaaaggaggagacggtggcttcttggcttctctctcgtgcgggttaatgatcgattcctatatgggcctcgtgggctttttttgaaggcccatagcatgtttatgcaaaatggcccctggattaaaaaaattgcaaatatccaaaaggaggaaggggcagaagtcagaactcacaagcaaaattctgtgtataataaacctgcagctagctgcagactgttgattaattgaaccaaactgaacatatatatatgttcacagcaaattaagcagaatgatatatatatatataatatgagatgataaataatacggtgacactgccaatgttgcaagatcgatcgatcgatattacgtacattacatatggctggcacataaaacaaacttgctatacattcgatcagcgtaggactgaaacggcaacatcaacgaactacgtaccgatccatcgatcgatcaacattgcatagtactctctcgtccgtttctaaatatttgacgcctttgatttttttaaatatgtttaactgatcgtcttatttaaaaaaattaaataattattaattattttttatacatttgatttattgttaaatataattttatgtatatatatattattttataaaagtttttaaataagacaaacggttaaatatgtttaaaaaaatcgaacgcgtcgaatatttagaaccagaggaactataaattattcatggtgcagtgcatgtagatgtagctaacctatatatatattccctccgttccaaaatatttgacgccgttgactttttttaaacatatttgaccattcgtcttattaaaaaaaattaagtaattattaatttttttctattatttgatttattgttaaatatactttaatgtatacatatagttttacatatttcacaaatttttttaaataagacgaacggtcaaacatgtttaaaatggttaacggcgttaaatatttaggggatgagggagtatatagctagcctattctagatgatactgattaataagcgcgacaaagccggcgaggtagaagacgatgagcggtatgtcgagaacgacgtagtgggcgaccagcatgtgcttgtagccggacgcggcgcagaccccgccggcggcggcgaccacgacggggaccagctcggagaggacggcggcggtgtacgcgccggcgaagtgcgccaccagggcaaagaaccccgacaggaaccgcgccccgttcgcagccgcccgcgccgccgtcgccgccaccgcctgcgccgtcgccgacagcagcaccagcgccgccccggcgcgcatgaacgtggcgccgccgctgccgccgccgtaggcggcgcagggcccctgcgacgacgacgcgtcggcggtggtgatggcgaggacgaagagggcgaacgccaccgccgcccagcccatcaccgcgtgcgcccacgccatgccgctcaccgacatcgtcatcctcaacactagcgaagctgggcagctagctagctagtgagtatatagtggttagtgaagtggagatcgcgatgcagcatgcatgagaacaaattaagtgcaagggctacatatatagtgcaaagggctaaagcacaagtcaattcacttgttggtggcataggaaatatgatgtgaacgaaacattacaggggcgtagctagctaggtggcacctatttaattatagtatatgttctagttaatataataaaaattgtatagtggaccacctatttaattgacatattacatacaaatggaccacctttactcaaaattatagctacaccactaaaacagattctagctacaccactaaaatataagggtattccaaaatcaagaaaagaccatgtcgcaacttctcaccaaaatacatgacaaaatcaagctatgaagcatgtggggggcaaaaaaaaaaaaacattgccaaaatacatgacaaaatcaagctatagagcatgtgtggggcaaaaaacattgcgagaatatccgcttagattttaatttagtgtgtgtttctttttatgttttcttcctgtttcttttattttcctctctctttcacgtcccttgatagtatttagtcccttggtaatattgtaaatactttctattctcttaatataacttcagtttagcgtggctacgatttcaaaaaaacatatatataatgctgaggtgagcttgcattggcatgcatgctcgatgatcagaaagatgagatatggatcagcagcaactaataacttaccacagctgatcataatctctgcaaagttaattaaacacatgatcgatcgattcatcggtcttcgagattggtatagtaggaaagattacttgatgaggctggccggctggcttttgagatgagcagagctagcacacatgtgaagtcgatcgtacttttttccccatttgcattgcattgcctgctacgaatcctaatcccgtttctcttaattacgtacgcgtccaatctctcttattaatttggctctgctcgatcgatctgctcttcgtcttttgcttaatttgttaatttgctcttgaggccatcgcacacatcatgagtgactacttgcttctatctttgtatacatctttcttctttgtctatctaggaggagtaggatttcctcatcacctcccacaccattaattgattgccaagaacgtatggctactttcttcgccggtaagcttaatgtccttgtcataatcatgcatatttcggcttgtttgcacctaatttcctcttctccattgattactactcttacttaggcctcgtttagttcgcgaaaattttttttgagtgtcacatcggatgtttgatcggatatcggaagaggttttctgacacgaatgaaaaaactaatttcaaaattcacctggaaaccgtgagacgaatcttttgagtctaattaatccgccattagcacatgtgggttaccgtagtactttatggctaattatggactaattaggctcaaaagattcgtctcgcgatttcccctctaactgtgcaattaatttttatttttatctatatttaatgctccattcatatgtccaaagattcgacgtgacgtttttttaaaaaaaattgagtaactaaaccggacctttttttttagataatggaaatgtgttacatctccggcctctgcccgtaggcacacagccaaaaaattcagacgtgaacagaaaagttaaaaaagacaagatgggacaaacccccaacttctgccgatgatatgatctactaaaataatattttttttcaaaatcacgtagattctatcacaaaattctgtaggtactacgccatccaaaatggaataaaagttccttggctactaattccaagcgtgtagcaccattgcgcatagtatcctgttgttcctgtgaaatcatcatacaccaagagtggagccaattggaacacatgaagataacctgcatgatgttagatatttttttatggttaaaaactatatcattacggcaacgccaaattgaccaacataaagcactagctccaaacaaaccggaccttaattagtctatttccatcgtcacaatatatgcatgtacaggatatatcatgtactccctccatctaaaaaaaagttaaccaaagaggggtcatacctcctctaggttgcctttttctgggacggaaggagcatgtaacttgggctccatgtgattcaattcctcgggcttggttcttgtttgatttcgatcgattaattaatttagtttcttggttattgcctctgctctgctccgttgcaacacagcttgtggtgttactacagtacattctgatagctccatccatcgacttgaaatttccagaggaaactcgcttgctaggtatcaccaacaagcacaacgatgtgattggatcctatacagataaataatttagagtaaatcacgtggccaatatctagatttgttcgtgtgtgtcatttagatcctgaactcttaaaatttatttttagttttttaaacttattaaagtgtgtcattctggtttcaaataggcacaactcctccaagatcaattggcgtggcatgtcacacggatattttagtcgtaaaatttatttttccttctcctttcttttcctcttcttttcttttttgccatacttacatgaaggaataagaaaagagagaggagatgaaaaagaaaaataaaaagagtcaatatttacgtggcatgccacataagtgtcacgtagaatcttagaaggatcatggcaacctcggaccggaatgacacattttatcatgttcgtagatctgaaaatgtattttaagagttcggaaatcgaaataatatatacggatgagtttacgaaccaacgaaccaaacactttgcgcaataatttaagaaaaaccatttagattttaccaatggagtggttacatgcatggctgatgggaaagaagggagcaacagatgaacagtacgtagaagttgggagtgtaccgggcaggacgtccaatctttttatttcaactacccacacaagatggtgcggaatttcatattgatataacagaaaaaaaaatcacaacactacaatcctataactaggaagaagaagaaaaaaagatcaccccaccacaagctagaggctccaacacataccttgagaagcactagcaccgaattggctgccgatgtgcgcgactgatcgccgctacccctacacggggaaaccaatttttcggttcaaaacattttcaatatctggtaaacattttaatgtactcgtcactgtaaaaaaacacttagaatttaggcttatttagattatctcaattacatatgattattgtagaaaaaaacacaatgaacgttattacttattggaaccaagatcatgcgaatgggcactggaaaatgaaacatatataaaaccttgtggtcgttgtctgatggagtatttttcttgtacttttttgaggaagccgatgcttcaacaacgctgagcccaagaaagtgtaaagtgtagaacaaatgtatggactgcatttcggaattcaccagtagaatcaagaatggattaattttgcaggatgatattgaccgcaatcaatctcaggagcattttctggcctaaataaaccatatcaagttcgttccatatttggagctagtgtttataattagctagcatatcattatggtttcttgatcagaactccacttagagcaacttcaacagactctttatttagctctccaaggtaaaatttagttaacacagagaaaaaacgagctccaatagcctctctatccggatggcttccggatggccaaattgctcctccggctagctaaatgtagccaacctcctccactggctaaaggtgggtcccaccaccactcccatccccatccaacatctctccctgccggcgacgaactgagggcatatgccggccatgagcgccccccgccaatgtcgtcgtctaggccaccgtccgccgtggcagtcgtcgtcgtcgccgtcgcgcctcacgcacgagccgtcgcagccatcgccgctgctgcgcagggagccaccgccgcctccgcctcgcgcgctggagccgtcgccactgccgctggatcgatgggtcgatgctgccacgcgggagaaaagaaatgggaagagaaagagaaagagaaagaggaggaagaggaagggaatggagatgggaggatgacatgtgggtttctttgtgattttggagatgtaaatagagagactgttggagcatacatctagtttgactacccaaatcagttggagagttggctaaatagatatttgaagagtctaatttaaagatgctgttggagatgctcttaattcagaaggaaaaaacaggtgaactaccagaaaagctttgccagcaaagtcatgacgtatacaactataagccatcttcagcgtactctaacagaactccatttatgccaattgaagaaatcgttgcaagttaaccgcagtttgagctaactattatgttataatcttttgagttgcggttgataagctgtggaaaataaacgaagcaaccaaaagtaatataacagataaatagcaattgaaaatttatatccatgttattagtgattgaaaagctagtcgatcgctagaaaataaactgacaaaaaaaactcaacataaaataaagttttaaaatctaaaatttggtcgcgattgatcagctaacgagagcagaagatggaaaatttgttgtccgaagaaaaaagaacaaacacagacggaaattaggcctgtttagatcccacccaaaaactttaaaccttgtcacattaaatatagagtatcaaatatagacaaaataaactaattacatagattacgtgtaaattgtgagatgaattttttaaacctaattagtccataatttgacaatgttgtgctacagtaaacatttgctaaagtttggggtgtaaagttttggcgtgtcacatcgagtatgccagcacatatttgaagtattaaacgtagactaataacaaaacaaattatagattccacctctaaactgtgagacgaatttattaagtctaattaattcgtcattagcaaatatttacaatagtaccgcattccgcgataacaacgcgaaaccgagcggtctggcggaatgaaacagcggtctcgctcaagcaatagcaatactagtgtcatgccgatttaattagcaattaattatcttgattagtgattaattaattcctaatccagatacttaatcactaattattattatttaattgttaattaagtaattaattactaatcaaacggagcccattggacagtgtcgttgattgcttgggcgaggtcgctcttccatccattatgcgagactgcgtggtctcgcgctttcaccgcactcgataccgctcgcgatgtcattttcgcgtaacggttttgcgagaccgacaatatgttttttgcaaaaaattttacgtctcgaatattcccgagaaaaaattgaatgaaatgtatattttcaaatttaattatgctttggtatgtcgaggacgacgtagtgagcgatcgacgagcatggacgcggcgaagacgaccccgccggcggccggcggcgaccacggcggggaccagctcggagaggccggcgacggtgtacactccggcgcagtgcgccaccgccgacagcaccagcagcgccgccgaggcgcgcatgtacgtcaggagcattttctagcgcctaactgtcactgcacattgaagaaaaaaatggcatgaaaaagtttgttcgatacttggaactagtgttaattacagtaccattttaatatggctcgtagataattcagaacgaaaaagtaggtaatttaattatcagtaaagctttgccagcagagtcaccaagtatacaactttctttcagccatcttcagtgtgtactttctcacaagactccgctttataccagttgaagaaatcgttgaaagataacggcagcttgagctgacgattctattctaatcgtttgatctatggcctatggctgaaaagccgtagaaaattaaagaaaaaacatccaaaaataaatatacaagtaaaaatttcatatgttattagcaatcgaaaagtaaatactagtagaaaataaactcggaaggaaaacaaacccctcaaagtcaacataaaatcaagtttgaaataatttcaaattttggtcgtggctgataagaccaacgagcaaaacgacgaaaaaaattgttatctggaacgaaaaaaaaaacacggtagagattaatactgtactaaattttcaacggttgggtcaccttcaattaccaaccgaagcaagcaactggtaaagcaaatcaaagcaaaagatgctagtagtagatacccaccaacgaaagaagccgacgctcctccctccttcctacaccgcgtccaccgcacaccgcccgagggcccaacacccggtccacggtggaccgcgtccacagatcgatccctcgcctcgagcaagcaaaaaaaaaatccgtactactctacgtggcgtggcagtcgtcctcctccctcccacgtgagcctcaccgacaggtgggcccggggagaccgtggtccccacctgcagtggcgcgcgtggtcccatctcccaaagcgagatgagtttgctgctgcagaataaaaggcacccagaaaaaaataaaaaggcagaaaaattcggcggaattcgctgttggagtgagtattcatcgaggcaaagctcgaatttttggtactatccgattggtggcgaagcagcggcggagcgagagaaaatcgctgtaggaatcgggggagaaggaggagtagatagagggaggtggattgagctgtgggaggttaggttggtgattggtagaggaggaggaggaggagatggagaggaaggtggtggtggtgtgcgcggtggtcggcttcctcggcgtcctctcggcggcgctcggcttcgcggcggagggcacacgcgtcaaggtgcgcagctacgtctctcgccgccgccgccgaggttcccggcggcggtttcttgaactgccttgttactactactactttctggatgaactcgctcgcgttacttttatagatctcggtgtgtctgctaagttgagcttttgtttggatctcgctgtttcccatcggggatttctgacctggtgggagtagatgcgtgtagcttatccgtggttgttcgctaggaaaatgcgctgtggcagaagtgaatctttgagcctttttatgcttttggttgattttcgctagagctagtgctgcgatcatgttaggtgtagagtggatgtttagttcaatctgattcgactagtgcgtgtaaaattatatggttgaatcagaatctgtccaagttatttccttttctggcaatgttcatcttgtttgtcaggatatagcactattagtctactatatatggtgaagctttacttattagaaatctttaaactcgttattctactgttcttttactcttgacaatgcggctagaacagcttaatcattgtgaaactcattacaaaccctagtgcctgtaagcacattgcagatattttcctctttgaggcttgaggatagactaattttgcactgaaatgcatgtaaaatcatgccgcgatgtaggaatataaggtggtacatgtttatagctttacataatgcaaatgcaaacctcaaaagtgtcaaggatcttatgctacgcagaaagttcttctgactgcaagtgaaactttactatagaataacttaaaaaacaaacagactggacatattaactgtggggctgtttggcagcgcttgctgcagctgcgctgcacggacggttagaagaaatatgagttcggttcctttagtagctggctgtggtgcagccgcagccagggcttctgaacaggccctgtagtattaactgtttcactatgtatgatcttagattttacatatagattcttgcaataacagtcataccatcgctaaagcaatatataattatcatgtcccttactctttttagagtgctagattgtaataattggctgtagctcttctgagcaaaggccgggatgttctattccattatctaaaaaaaataattatcatgtcccagttataatgcacattgcttaactcatgcaggtttcagatgtgcaaacttcttctccaggtcaatgcatatacccaagaagcccagccttagccctagggttaatatctgcggttgctcttatggtcgcccagtctattataaatacagtggctggttgcatctgttgtaagaggcatccagttccctcagacactaactggagcgtagctctgatctcattcatcgtgtcttggtaaaactctacccttgatgtttattgtgttattttacctttttcctctatcttgacgggtttcaacttatcttaccgatctaagagaattctgaatattattatgttatgttgaacctaacttagccttgacagtttgttaaacagtttttatggaaacaagggatcttggttgccaaatgcgttggagttcttgactctgtcattttggcactacaaaggttccttgcagttgatgccttatttcagtagtctttattaaaacatgtgtgtttttctgtgagatagcgtactagcattaggctgctgtttgttttattctttgcaaggaattcatatgagtggttcacatgatggctaaatagaataacttttgcatagatttcaagtgcaattagtaatgtgaagtgcaattctacctttttcttggaacatctttggggggttagctgtgctttattctaaggtagggttcagatcagaatgttgtggcttattttgcggaagtcctgattcctgaatgctatattttagcaaaatactctgctatttgttatttgccataacgtcgtcctggatattgttacattctgcagggccactttcataatcgcgttccttctcctactgaccggagctgcacttaacgatcaacggggtgaggagaacatgtactttggcagcttctgctacgttgtcaagccaggggtcttttctggaggggcagtgctctcacttgccagcgtggcactggcaatagtttactacgttgccctatcatcggcgaaaagtccaccaaattggggtccccagcagaaccaaggcatcgccatgggccaacctgtgatccctccacagagcagcgaaccggtgtttgtccacgaggacacctacaatcggcagcaattcccataaatcatgatctgtgcaagctgtttcgagggccattctgatacattatgtttggtttgtataggcctccaggttagaacagtagcagtaacaattgttgttaggtagagtcatgttttttgctttcttcttccccctctttcttgagcgctactgtcgcacgttctgcttcatcacagcggatattcgattttacatgaaccgggcaatgttgaagaaagcttgagtttcttgctatttgcaaattctgaaggttttacatgataattggatcatggatgtggaattacaatctgtcttacacctgtgggaacttgatgagcagtcattcagcacacagtggatgctagctgctccctgaaccgagcaatggtgtcgtggacgatggcgttggggcgcaccgtggcatcgaccacggtgatcccctccgcctcatcgatctgcagcaggtcgagctggctctggagcaagctcgccggcatgaagtgctccccttccattgatctcctcctgatcctgtcagcaatcacctctgctgatgcctccaggcacacaaacttcaccctgcagctggagtagctccctgaacctgacctgaagctgcagtctccttccctgaggatctccctgtacttctgctgcaatgccgagcagctgacggcgacgtcctcgccatgatccagccgctccctgacagcgtcgcggagggcctccagccacgggatgcggtcgccgtcggtgagagggatgcccttgctcatcttggctgttgtcagggacagggaagagcagagaagttcagaaacgaaaaagggaaatgtaggttggttggttgtgagatgatgaattcttcagagaagtatattgatcttgatcatgccagacctttgtttgcctgagaatggtagtcgtctgcttcgatgaagctgcagcctaaggtttcagcaagcagtgctgctactgtcctgcgaattcacaatgaaatgctaaattcataagaaaatgtgataaattttgctgaggacaaaaaaaaaagaagtaaattcaagatttaaagctgaacagtactattacaaaatctgaatgtaggtttgaaagtcacatcctaaaaccaactcttcagcaaatgcagaggttttctccgaggaaaagacacagcaacatccatttgacatcacaatgttgaattgttgacaaaatgcatatcagtgtactgataatgtctctttctgcttgcttctacttaatgtgcctaaaattgaccaacttgaccataatattaagcatgaactgagctgaggacttgaggttggtctaaaacaacacaatcagtttgaatacttgacagggtaatcagaaagaaagaagtaataatcttacgatttaccgcagccactgactcccatgatcacgattgccaaacctgcaaccccagatgttgaacaaagatgaattagcagacacccaagctctgctgattacgattagtacttgtaatgataatcccattccaagcaattccttgaattaagctttaacacttcaaaaagaaaacatcaattcagaaatcaacacagcacctattctgtcagaccaaaatcacaggtatggtcgcaatacatgtttgggatccatcacttcagttcgcaagaacaagaacatggtgaacatgcacatgaataacaggaaatctgaaccaattcggtgcagcgaaattgcgagaagaaactaaacagatcaaaagagttaaaaacgaaacaagcacgcactgatcctggtcactgacctggtcggtgcgtgagatcggaggcagccatagatgagcttggtggttcgtctcgatctgttcctacgacaaggagtacgacaagagcgtactaaacctgcgaataaacgaggaagaagacgacagcggcggcggcaacaactctacttggcttgattgctcttcctttattttatatctcgagattgaagaacaaaatctatcattttttgggagaaatttatttagtctagtctagaaattttgacttgcatgaacactgcaatttggcatttttgacgtagtgagtactatggccatcctcataaaaataaggagaatttttcacgaatccaaacatagaaagacaagattgttttaggattggacggcgaagaaagagacttgaagcgaattgtcgtctgatgactaaaactaacaaagatgagacgtagacgaaagcgtcttcagttcaaagcaagaccacctgacgtttcaactttcagttcaccgtcactttagactgggacctggtgtttccaaagactcttttacagttcattcatgtccatgctgtcgcattgttgttgctgctgactcagagcttatcacacatccttatccaagaggaacatttgtagtatcaacagaaatcatctttcaaaggatattgttgttatacaggatcctcccaagaaaatgacaactttctatagagaaaaacaagttaggacgagagttggtgatgatggaaataccaacttctctcaagtcttggttgattggattcaagttgatgctttcatgttcctctagctcagcaaagaccttggtggtttctactgaacttgtttctggtctctgaatctttcagcattgcttctggtttctgaagcaaggaagaaaaaagctgttgctaccggtgagaacaaagatgttaagatgaactcaaaagatgggggcaaaaacagaatccgagatatacataatcacatacagtaccaaattcatctgatctagtaatgtagtcacgtaagaacatgcaaacagctaggtaactatggctactttctgaaaaaccctgaatcctgaagtgttttgcaatattctaagatgacaggagatttcttcaccatgtcccagatcttcgctgagctcctcaaccagtcacgctcggtgagattcttcgagaatgacctcgatggccttgataagatctgcacccacagtaatatccacaactaagtgaattgtgtccagagtaaacgtagtactctgaaaagaatcgtttattctgcctttacatcagaatcaggacaagagtcatcattgtgttcagggtcagttctgcaccatattatttttatttttccatataccatgatatgcatctatcgattaataaggatatgcagaactattccttttcgttacttgggaaaaaaagaatgcgaagtgctaattctgttaaaatatgaaagagctcaacctgctgagcgccaacaaccagttaggtaaagctgcaagcatacctgatcacgaagcatccctaacatggatggacatgtccgatactcaaaatttgttgagttatcaggtgttcttaatggaagaagatatatgtcctgctgattggagctcagatcctcaatcttcatgcttgaaggaactgaggagtcagaaacttgaggtgttgctccagagcttccaatgctaaaggaggaggacttgaagtgtttttcaagaaccctcttcagaaccatgagctttgaaggagaaaagtcttgttcccgcaatctgttcagttagaaaaccacaccattctaagattatcaaattaattggtataaaagattggattgtagaattaagtgcaaaagtgttgtgttcatatcacaacaactaacttcactgccaaaataccggaaacaacaaaaggatctctttgttcatcaaaaaagaaatgagcatatgataacataagaaaatgcaaacaagcatgaaactgagcagtgttcacctagcatgcacaaaacagagatcagctatgtaatcttcaatgcctgattggttatcatttttgttttccttgtcttgggtagttgaggaggtcaataatgatggatcaggtatgttgtgcttcagtaaatcaacctgcaaaaattgtattaaatcaccctttcaactttctgccattggcagaaactaaattcatcaacacagcataaccacaaattttcataagtacaatatactaatacggagtttcaggtctgagctctctaatacgctggaggatataaatgtgttcttaactattcactgtaagaaaatgtgatcaagtggtatggatgataaaaacaaaggcataaacaaatatagacagacaacttaccgtaagaatgaggtcccacatggacaggtcattaatcccctccgatacaaccaacaaaatattgcaaacagatgccaagaaaacaccaagctacagcaattccttgcagaacaacataaaacactgatcaactattcggtactgtcaagctcagttagcagtgggtacaacccagtgcgagaattgaagtatagcatttacctggattcccattaactcatgagccaggtctgctgataatggatcaccactgaggataggaattgcggatgaaccatctggcttcatcatatcaattagtacggagggactgaatactggctgcaagacaaaaggtgattgttttttagaacgttaccagcaatatgtttaacagctctggcatttggaacattgcatagcagaaactgagttaaataactcttatcacctgagtgtctagaagtataacccgttcattagagatcctgatatcaatgccagcagtacagtgcttagccattgctttgatttcctcagtttgtgtagcaaaaggaggaagcattcctacaggcaatactcaactaaatgagcttcggtttgatctaggtgtccacatggaacaaattgctagccaaattacaactcttcactacgctttttcagcaagccaaaagacacaaaagaggttaggggaaaattgatgtatggaagaaaaacagaagcttaaggacttaatagagtgcatattatcaacagcagagtgcatctacaaaataattctgacaagcgcatgttttgtttgacacatgaaagtaacaacaatgaattgaactgaaactattggaagactgaatgctgaaactattggaagaatggatgattgtaccaggtgagcttccatcatatccataaagctcgttcatgatggttgacttgcccacaccagttggaccaattactccaatcaccatgaaatcattgttctcagtcaaatactgaaaaatataggccccaaaagaaacatgaagatctcgatcaatcaccggtttgacatttcaagaactctagaagttatgttatacaaaaatactttcatcaaaatgtcacaaaatatctgaatgttttgagggatatatctacagatacttttaaataatcttgtcatcattcaaatccagtttcatgcacaaactgtaacttttgacgtgctagacaaaggtcgcattggcatatatcatattactgcaagatttaagctttatcatcagggatagtattagaatgcatctcaagagaacctaggaaaccatgaactaaactgtataagagctacgagcctacaactaacaactgcattgaacaatggattattgcattaaccagacacaaaaaaaaaaattgtcaactgaatctagttataggatctcacacaattttatcacaatgcttgcatcgaaccagtaagtaaaccctgaacagcaaaaggaaatgaaagaaacaagaagcatatcctcgtagcaaagccacttgaggacgcacgcaccgggaggatcttgtcggtgtggacctcccacgcgtcggagacgaggctgagcgagccaggctgcgtggcctgccgcgagcggcccgcgcctcctccgccgccgccgtcgtcgtcggcgccggaggacgaggggggcggaagcgggggcttggcgagaaggatcttgggagggggaggcggaggcgggtgcgaggaggaggaggacgagccccggtctccgacgccggcgagcggcggcgctccggcggccatcgcgcgcggcgtgctgctgctgctgtgggcgtctctagttgaggaggaagccgtcgcttaattaatcggaataagttcacttgaggtcccttaacttgtcagcgaaatccggttttgtgtgggcccaactgtcagacgcggtgctaggaggcccggcccaggtaagcgtactctttgggccatcctactgggccggatttttttttctatactcttctgtttataccgtggtagaccaagaaataaacagagaaatttttactacggtcatgaatatcccgtccgttcctccggagcattttatgttttgcaagtacttaaaattaatttttattcttttttaaagttattttattagttaaattttgaattttgattacgtggattctcctcctcagcagcccattggctgaaaacgcttgatttccatgtatgagaatcggtctcataggaatgtttattttgggtataaaatttgaatacttaaaaatgcttagtatttaacatttcgataaagattcactcggtctttcaaattttggtcataataatttctaaaatgctcttgtagcacagtaataacactgttaacagtagtagtgcaggttcagccatgttgctccacgtaggagtatgttggtgtagtagggtgctgggaccgagacagctcatcgttcccctacctctctgctgcattctggaaccctctctctctcttcctgtgacccacaacactccaaccagacaggcagaaagcaagcaaaaggataggaaggagccaagaacaccaagaacttgttggagctgagacagcagcaccaagcaagaaaccggatccaatccatccatccatccataggtaatgatcgtcccttattaccttccctacttctttgaaatcttactgtcttcaattgctcttttgcccgtgaagttgtagcagttcgcagtttgtctgtttcttggggagtgagtgtgtcgatccctaaaaagttcatctttttttgccccctttcccacgcaatttagatgaactggtcaaggagagcgcgatgatacagccactggttgtacaaatctgtcccgattcgttcttatgttcgtggtctgtgctgtactagcgctcgttttgttcaagcgattcagaaagtgacaaaactttggggcattctcttcggccaaatcttttgtttgcaccatgcggtagaatctatcctagcttgacgattctggagccctgaccacgaacttgtaagcgaacaacctagagggaaaaggaaataggtggttccgcattgttgaattttgagtgaaagagtgtacctgaggctccacaattcactgctgacagccgtgttcaatccccaacatgctaacaatttcttttttaaaaaaatgtttggagagacgtctctccctccaaatctcgttttttcttttaattcattgctgaaagataaactgaaatgctgctcacatggcccggcttctctgatgttcaaaatacaaaatgtgattctaagtgttctgaggtggatcccatattcagaaaagattaagatttgttaacgtgggttggtttgacatgcatattgcatttgcttcttactagggggttggattgtgtgagcttctcttgttttagccttttagcttaactcactacatgtggtgtcctcaagtaagcatcacagttggggttaacagtcagataactaaaccgttttgcagatgaattatttgctaaaccagtggttgtagagatgaacccgataaattcttttgtaactgaaaccggattgctactcatttgacaacagctttttgcaactgtaaagggcagccagaaacaataaacagagtgtgtgcagacttaaaaccatattccctccatttcacattataaaacgttttggtctctccatccctcgtctagattcactagcatccatatgaatttggacacatatatgaaacacatacatggattcatgcagaatctgtttaaaacccaaaaaacgtcttataatgtgaaacaaagcaagtggcttagatcaggtttgttgtcttgtgttcaattttttcaactgaataatagtacttggtagaaaatcttttaaaaaaacaatagtaccaggaaagatattatgaatgtaggcacggttttgctttgccttgtgcaaatgatagtctactaataattcttccacgtagaccatacctaacatggctattttttaccatgtaattccctttttgttgttacaagtaaagcattagagtgatgatatttcatcgttcgtgtccgtaatctatagaactcttcagtcttcccctgataactagtgtgtacttaattttgtagtttccaatggctggcaagtacatcgccgctggtcttgttggttcctttgccatctcatatgtttgtgatcattttatcgctgagaagaagatatttggaggtatggaatctgatcccaagtacccgtttgtaaattgacagcacgcttaacatacaccgttggcaaatctgtctgtataaagaatatgtgcaaaacaatcatcttacttcttgatcaggcaccacaccacataccgtgtccgacaaggaatggtggcaagcaactgacaagaagtttcaagcctggcctcgcactgctgggccaccggttgtcatgaaccccatcagtcgccagaacttcatcgtcaaggatctcgagtcctaaggtagcactaatcgcgcaatatgcgccgttgcacccctcaatcaaaacaagagcccatttgaagccacgtttcatctttcatttgaggtgctgatgctaaagctcctttgcttgttcagattgtagtgggagcatatatgctgaaggttgcgccgtgactaagatggcgatggctgtggctacaaactacctacctatgccgtactcccgaaccagtacgtgagtacttggtctcaataaaacagaactattttgcctagtgcagcctgaacagaacctgaagcatatctgctttagacattgtcatcttggtgattgttcttatgcagtaacaacctctactttgtgcttgtgctattgtgagtgaatggaactatctgtctgtcacactggaatatgtgccttgtctactgatgcaagagattttaggccacttgtgtcaactccagaatccaggtggcctctctaatctcagtgtaggtagcaacagacagcatctcgccgttttcgtgaggcttcttcagtgattctgaagcttatgtgttttcttgcacacaaaagtagatcagctagcagaaacgtgttgctagtttggtcaagatttatgtgcgaaacatttgacactgctgccagtatttgtcagatgaaaacgctgagatctcctctatcttgggagattttgcacgcctgatttaactctgggtcgttttcgttttcgcatcagcatttcatcaaatacccatctgggaattttcccgagctttgagctgctttagaacaaggttcagatgctgatcatcagcagttcaggatgtgatctgaagcacggacagaaattaagaaacgaagtcattggaaacgtgtcaaactgtgggcaatacacgtcactcaccctgcatcgtagtccgtacacgatgtttatgtacatactcccaggtagtcatacgtggtgcttgcaaaatcactgaaaaaaatcgtgactttccaggtggccgtctgaatcaacagatactagttgacgtacggaaaataataaaattgaaactggtacggaaacacgtccttgatataccactattatagccccatcatttggcctaaacagccaaataataagccaaaatttaaatttttaacttgattttgaacttgattttgaaatacttataacgtaatttttgttaaaattggcttttaagtcgctacggacaaatctacaaaaattttacttataaattaattttaattttttataagctaaataagccattttggctaaatggacaaccgatggaagctttatattctactagtacaaaattaagggtcactttcgtaggtggtacctttttcatttttgactgggagaaaagaggaacaaataaacaatactatgtgcctttcaaatataaacatttgagggcatgatagttacaaatgaacaaaaacacactaaataatactgctctatataagtatttatgtgatcaaaatttatagtacccatctcataatgtataatgttggttagttcaatgtcaacaagtagtagaggaagtactacacaataagaagttttaattttgagcaacggcgtcatacattaaaatatggaggtaatatattttatgaaaaactttatgtataaatgttggcttaaaatattagatgaatctattttttaagtttataataactaaaacttaattaatgacattatcattttacatgccatctccatcagattccatcgaccattgggaccaaaatattagaacgagtataatattctctctgtcctaaaaaaacttaacctatgatatgtcctctcctaggttaagtttttttggggcgaagggagtattatacttgttataatattttggtctcgatggtcgatggaatctggacaaatagtagttcagattccttatcttaggaggggtcataccccttcccaggttttttttttttgggggggtggggggacggaggagtatttgtcattagattctgtgattgtgataggatgatggcaagaagggggtggcaccatgcagcagcattccctagtcggtcggtccttctgccgcaccgaccattcgaccccccgtcgccactacaaatccaccacgctcccctcccgcgtgtcaccacgccattacttacttgatccttcttccccttcatcacagtctagtacttcttgcacctgcatcatctgcattggcagcagtaaactaagggtgcgttcgttctgagagattgggtgagaaatggatatcgtttttcacgctgcttcctaaactattaaacggtgtattttttataaaaatcttctatagaaaagttactttaaaaaatcatattaatttatttttaaagtttaaaatagttaatacttaattaatcatacgctaatgactcatcttattttacgtatcttcctaatcttttctatctccttctcctcgaacacaaccttggtagtaactagtactgatctgaggataagctccagccattctgaaactctctgctctgtctgtccgtgcatcttcttcctgcagctgacgacaccattgcaagctcggtaggagtagcagtagctctgttgttcggttgttctgctcaatggccgctcgagcactgtctgctgctgccgccgccgccggtcgccggatggccggacagactggcttccctcttcttgcctcctgcaggtaactggctataactgaaagaatgggagctctgtttcatgtatttctcctgttttttttttttttttgcttcttcattggattgtttctgctatggtttatcagtgtccagtacgtcagtttagtgtaggccgtgaatcgtgatgagctgatggcgacgccagtatcttgccttcgatcttctctttgtactatttttttttcctctttggtttgcaaccctcaatcgatgataaacatgccacctttttatgtggaactctgaatgaacgttcatttgggctgatgaactctgataaactctgatggagaaagaaatgagccaagcaagttcaagttcctttggagatgtttctctcttctgtttttttactgttcattttccagacagatcctgatccttctagctgttatttagttactgctccatctctaaatcatttgggctgtgtttatggtttagctgttgattgagctgtcatgttctttttagatggattgagagtgttgttgtcttgtagagtagatgccatattttgagagaaaaagaatgttcattttctgatgaaagtctgtgtgagcaggagaggagatcaagctcatcagaattactcgattagcgcacaggcccagccggaggaggagcagaaggccatccacgacggcggcggcgccgccggagcgcaggtggaggcggcgctgaaccgcaagaacgtggaggtgcacccggaggaggagacggtggaggacgcgtgggtgcccgaccacgagaccggcgtctttgtccccgccgacgaggccgccgtctccggcaccgaaaaccacgaccactgcggagcggcggcggcggcggccggcggctcgccgtcggtgcttgaccaggcggtgttcgtccgcgaggaggacatggaggacgtcgagaggccggccgtcgacatggccgctgccaatcacaagcccaaatgagcatcaactcagcagtagcagcaataaccaataaagccaaataatgccttctgaaatctcatgtacaactagtactagaaaatttccagtgaaaatcttgcgtcgttggttgtatgaatcttgttatctacagtgatcaatcggataatctgttctttgatgaatcttgttgtggttttatcggatggaatttgctgggattgctttgaattcgtgcacgacgccgtcgatctcgatgaggctgcagccggggaccttgtcgatctcgttcctcctcatctgccccctcaccttcaccgcctcaccgtgccggccattcgacgcgtacgtgttcgacatgagcacgtagtcgccggcgtccgcgtcggccacgcgccgtcgcatcacccgctcggcgcgctcgacgtcgccgtgcgcgcggcatgcggcgagcagcgagctccagatgagcgcgtcggagtgtactggcattgccgcgatgagctcctctgccttgtctagtctcccggcgcggccgagcatgtcgacgacgcagccgtagtgctcgatgcgaggttccggcatggcgttgagttgctggagcccctcctcgacaagtccggcgtgacagcacgccgtgaggacgccgaggagggtcacctcgttcggcgtcacgccggctcgttgcatgccggcgaatagagacagggcgtcctcgccgcggccgtgcattgcgagccccaggatcatggatgtgtaggtgtacacgtctcgccgcgccatgccgtcgaacacctccgtggcctggtcgaccgcgccgcacttggcgtacatgtcaagcagcgcgttgccgacgacgccgtcggcgctgtgccccatcctccccatgtatgcgtgcaaccacctgccggtgtccagcgcgccgagctgcgcgcacgcgccgagggcggcgacgaacgtcgcgtcgtccgggcgcaccgccgcggcctgcatctcctggaacagcgcgagcgcctcctcgagctcaccggcgcgcgcgaacgcggacatcatcgtgttccaggagacgacgttcttcttcacgggcatcctcctgaaccaccggtgcgccgccgccgcgtcgccgcacttggcgtacatgtcaaccagcgcgttccacgcgacgacatccatagcaaccttcctctccgcgacgcgccggtgcgcctcccgacccagcgcgaggtccccgatctgcgcgcacgccgagaacgccgcggcggcggcgacggcgtcgatggccacgcagcggtcatccgccatggcgaagaacagcaccacggcctcgtccaagaacccgtgcctcgcgtggccggtcaccatggccgtgcaagagacgacgtcccggccggcggggaacccgtcgacgagcgcccgcgcggaggcgagctcgccgcgagcgaggtagagctcgacgagcccgtcacggacggcgcggcggcggtcgaggccgagcttggccgcgtgggcgtgcacggccggcgcggcctcgccgtgctccgcggccaaggccttgatgagagcccggaggcctcgggcgtcgtgaggggcgccggaatccacggagacggtgccgttcttgtagccgccatgggagcgatgaggcggtggcctcctcggcttgctgctgctcgccggaggaagctgctgctgcggcggcgacggcggcggtaatggataaggcgccatggccggtgcccggtgatgaggtgagaatgagtttgggtgggtcaaaaagtcaaaacataagtactgacaggtggggacggatacaggttgggacttatgtgccgcataagaaactaaggcccataaaccaaccggcccaatacatatgggcctcacgtgagaagaaatccatgagctacgagccgactaacatgggtcggactcaggacttcatcaagattcagatgaacaacatcgcgtttgatttcatcttgattttcagataaacagcgtcatgctgaatttttaccttcatcatccatctgatcctggaaagcctcagggccatcgaaatcatcttcatgtatccaggaatacaaaagcatgtgcctctggacatgcatattttcagcaagctggaagagctgaaagcctgaaaatgctttttccctttggaagaaccaagctgtaaatgcatcgatcacatccaaaaaaacatcgttgcacacatctcatgcataataaacatgttggaaggaaaatcaaattgaacgcacaagtaatactgcatttaacacggaacaggatgcaataccatttttccccttcacaacaaggtaaatattatttcttgtagagagataaaacaaggttcagacattcagagtaacaggcacaacagtttgcctccagaaaactaacccaaataacaaaacaaccattactattatttctaacagacgataattaaaacgaacatggcagttcaccaaaaacataaacatcctgcaagccatcccttgcagcctgttcagaattcagatgccatcatagatatagtagcttgagttgcaaaagcccttctgctctgcagcacttgaggagagaatttcagcagaagataaacccaaacaaagcttccttgtagcagctaatgatcgcaagagagtagcatcctgggcttcacccagttgggcagcaaccctctgcgattgccttgatttggcgccaaggatgacacacagtatgaatcatagccgatccctccccatctctgtgggttcttgcaagacaatggtggccgtggcctgaaagcctccctcttctcatcgaagaagaaggcccattccttcaactcttcctcttccatcttcacccacattgcaggctgggatgacaggtcaaggcagaaggcctcgccgatggaggcggcgagcaggatgagcatgtcatcacacaccaccagcgatggctcgcagaggtcaggctccgacatctcgacgctccagacaacttgtacttcttccaggctgagctggggttccagcttgacggtgtaaagctgctgatactcgagggcatagagctggcctttgaagggcacaaactgctcaagagctttagaattgggcgggcaactgcactgcgaccaatggtcgcttccaactcgccatgcgaacagggagtgcttggcctcgacaaggaaatgcgagttgtgataatcaaggggagctgtgagggcacaagagttgacaaaagtaaagaatgggcagggtggaggtgaaacactagtgccggtgaacacgtcgacgatggcgaaggttgtgtccttcagcgagggggcattgccagagaagatggcatggccataagaacagcattcataatccatccccgccagaaaatctggcggagtcacgcggtgtatgcagatggttggcttggctggatcaaagagctcccatactactggatcatcgccagaggaagcgcagctgcggatggcaagaggacggaagagggtggtgcgtaaggtagattttgcagacctgaaggcagcatgccaattggggcaggtggcaatgaaggcagcaaggtcactgggtgaactcaacagagcaaggacacactgcagtaggtcatctgggaggtctgcccatccttggagcactggcatggagttgggggtgttggagatcctcttgcaggtgttttccatgatagcaggctctgcaagtcaataatgaagtcaatgggagcaatcagaacaaagaagttctggttaaaggacaagcaacatagtccactaattcactacgtcatgtgggcgcatgaaaaaatgagtattagaaatcctagccactaagtgacaaataagaagtggagtacagtggtgctacaatattttgcaatgttatgaatgcagtatgtagttacaagactcgacaattgaattcattcacatttcaaataacattgaagaaaacggatagttaatgctttatttcattctataatatgcatgaatttagtatcgacacattgcatgtgtgtcatgttggtagcaatacatccttgacttttttatatcgtttataacttaaaatattacacacaacatataagtaataaaaacctgtatcgttataaaataactcgtgttttagccatcaacatacatactaagaaagtatggggtacccccttctaccttgcttgatcctcaaccacaataactggtcctttctttgttccaatcataccaaatatcatggtaaaaaaaaaacatatttgataggatgttagtatttactatgagaacctaaaacattgacaatttgtgatacaaaatagcctaatccaaagatcacacttttggtggagacgtattaagtattaactgctgaaaaacataactctataagtatcttcagtatttctaaaaaaaatcttcaataccaagacatcagtggaagttctcttatttgggatttgattaatagaaaattaatgaacaaaaattgcgtacatattattttgttgataatcaaatattgtctcaccaccacccgagtcagtatagattttgaagacttatgatgtactcatagtccttaagaattcccctatcctccaagatttgaacgtacatcttagaggagttagcagactaataaatagaaacaacgagacaacacaaaatgggtggacaaagtacgtggaagaagaagtttaccgatgaatgaagataacaacgatagtgagggcaacaaagaagccccaaaatggttgccgtcgatgttaatgaggacgtatcgagggtctgcaatggttacgactagcgagtagggaagacgaagcggcggcggaactagctaatgattagggtttggggggaacgaggcaaggggattcaatgggttttatatggtatgacatgttaagagataagatgcatatgtccctcctcggaaccagttcacatacacacacacctcctggtaccagtacacacatagacccttttcattattaatttggtagtaaaccctaggctttgctattccggaaatttctttggtaccagttcacacatagacccttttcattattagtttagtagtataccctaggatttgctattccggaaatttccttggtaccagttcacacatagacctttatcattattagtttggcagtgaaccctaggatttgctattctggaaatttccttggaaccagttcacacatagacccttttcattcgaaatttcgttttatctgtgggtaccggtagggagttcttccgatcgaaattttcaattcattcgaaatttcgttttatccgtgggtaccaatagggagttcttccgataaaaattttcaatatgatttgaatttagaaaaaaaaaatagccgtgtcagagtatagaactcctgtaatggggaagctaagtactccccctttgtgagttcggccgaggtgcaagttttgagatcgagtgtttgatcgcacggtaaagataaacacaagcacatatacaggtttaggccgcggtggactatggatgattggaggaattataaggtgacgtaggaggagaaactcaactccttgcttgctgaattctcggtggcatgaattctacttatatacatgaaggagagtccacaataccgttgcatgcatggagtggagcctactcctctaaacttgatatgcttagtcttgtaggtcttgacactcttcttaaaaccttgaagatgtagatattgtagatctcgataatcttcttgaaaccttgaatatgtagatcttgtaggtctcaaactctcaatactcttcttgaaaccttgaagatgtagatcttgtacatctctatactcttcttgaaaccttaagtgcttggtggggctcgcagtgccccaagcccccctacaccttgagctctccagggtaaagggaacccctgctcccacttctccgacaagcagaattcctaaaattttgccaacaccgcccctccccctaggtttatgctttttgaaatagtgaaccctagtacaccttgttaatgcttttttttttgtcacatcaccaacacaattggagatccacctaaagccttgtggtgtgataggagtcaccaaccaccttgaccttgagaatctccttgatatccccaacgagctgctcagcgaccttaaacttgtgctcaaatattcttccattccgctcttttcaaatgagccaacaaaccatcaggaagaaagaatcaaaagcgttcctatagcttggccgaaaaaagcttcgcgcttgctgcgaacactctgctagctgcaaaccgctgtggcccagtgggtcaaaagccgcattaggacaatggtattatttgtcatgcacagcagatcttgcaaataacgtcaggtttagtttagtttcaaggatttctgaaccagcacagttacaacaattggtttctactctgtatccgctaaaaacttatgggcagctgcttccaagcgtaaatgggggaaaaaacttttcgtgtgtcttgcaattcagagattgaatgttcaacatctgaaaatctaagcaaagagtggtcgatttggtcaagttctggtggctacaaaacaaccagatgtgtgtcatcaaacaagaaaggtgcagaagaacatctcaaaatgttaatcatatgttcctaaggacataagaaatctgcttttgataggtgcaacagctttttgttggtccatttggctaaacagaaacggggtaatttttgacaacaagatggtgacttctcctttgcaggttattgctttagtcacccagtggctatgcatctggtctatcctccacaaaccaggtctttaggatactattgtggtggtatcacgtcgtttggatcaagtggcacgggagttttttttaccctggagcatgggtggtgatctagtctacggcttgatagtcactaatttctttgttttgtgttgagggtctagttagatcatgttttgtagctgtgtgcatttcatgcagaggccgggagtgagctcagttagaatgtatcatcttggtgtatttgactgagttttaataaagcttccattatcgaaaaagaagaatatctcgaaattaagatgatcatgcattccacatagaaggcgatggtcgaaaaatcaatggaatagttcagagaaatcaccttttgctcaaccacatatcctgattgcaggtgcattcccttcgtccatgtgagcaattgagcatatatcgacacgacatggccgttttctgtcgaaataatgatctgagagcaatctagtagtgagaaacataaagcacgcaaccgatgaacgcactgatcttcagcaaagtgtatagttgaagagcttttcacaactgattcacaaacatactgaaatcaactcaactggatatattgcagaacagtatatgttgagttgggataatacctcccctcattgaagaagaagaagaaggtgcatttctccagtttgggattccttctacaccttcactcgcgttgcaggttcagctgataaagaacggcggaaggatcccgcgagattcttcgacgaggacccggccacactgccgaggaagaaagatcttgcgccatggctgacgcatccaagaaccagtggtgcctgactgcctggaatggccggtggtcaccatcccatcccataatgcccctgtgctcaacaaacagcgcactcgcggcggagcgcctcggcggctcggcgccctcaggatgccgtagtggacggacggccgcggtggccggcgaggcggcggagctttggctgtggggttgagaagcggcgggtggacaggtgggggccagaggcagggcggttgacctagtgcgagggattcggaaacgaaggtggtacaagcggacggaggtgccccatggcgtccctgaggctgagggtggtggccgtcgccggccaggacgccgtcgccggtgaacgcggaagcccggaatctcggcccggtccaagccaaaaaaatatatgggccgtacgtacgccggagtcacataaatgggccgcacgtaggcggcactagaggtgaaaactgttggaattgttagcatatcttcagaaatgatgctagatcgatcgataattaaccatatttactatttaaattactcagtattgatatttatatgatgaaaaataaattagaaaaaacaaaaattataaataataaaaaacagcacggtcggaaacagtgttaagtcgaacgggaattttcatgaccgttttcaccccgcaccactcttccgtccgcgctgctgtctccatttcccaactccgcgcgctggttgttcacaattgctaactatttatttatgaaagacataccggaaattctcgatagatcgagcgtcatttctgtataagcggtgagacgtcatggtactgtttttcgattccattcatgtataaaatttgaattttctatttatttttaagcatcatatttttatgcacgctaaatattggtaaatgtggttaatttcatatcaaccaagaatctctttttttaaaaaagatgctcaacatgaatcttttttctaccgatctggaccattctgctagccgatgtacaagtaggttgctgatgcgacgacggcatggatgcagcatcacatcacaaagcttgagacgaatcatggtgcaaaatcccactcagcaaattaatggaatagttctcttacattggatgtgaggatcctctcaaattccccacaggcactgatttttctcaattatacttctgaacaagcacaaaaaattggaattgggttgcagctagcgatcatcgattcttgagaaactaatctcaagacgtgaaagaatcaagttgctagaagcggacggaggtgccccacgtctggacgtcgcggagggtggaggccagccagtcgaggccgccgtggaggccgtcgccggtgagcgctgaggctccctgacagtgccacctccggttcttgagctcctcgtacgcccccagccgctggcacacctccgacgagctcatcgcccctttctgcatcatgcatccacatgtcaattgttgtataactaatcgccattggcaaattgttcattgattcgtcaagcttttagcaattaccaggtcctgcttgttggcgaggaggaggatgacgctgttgagcatgagggggtcgcggatgatggcctggaactcctccttggctactcctatcctttccctgtccatcgaatcaaccacgtagatctgcaactccccacacattcagtttcagacattcagatttcagaagcaaagcaatgatcgatcgagagagagattcagaagatgagatttaaccagggcgtcggcgtttctgaagtattgtctccagagaggtcggagcttgtcctggcctcccacgtcccacaccgtgaaggccacgttcttgtactccaccttctccacgttgaaccctgatggaattcgttcatttcacaggatgaaagaatgtatgtctgtcaatgcaggtccaggaatggattatgtcatgcccatttcggcgatgaaataaatgacaatgaacacgatgtatcactaccgattgtgggtatggaggacagaacttcgccaatgtgcagcctgtacagaatcgtcgtcttcccagcagcatccagcccaagcatcagaacctgattaagcatccatcagaagagaaaaaaattctgaacctggttaagcatcagaaaggatgaaaaactgagaatggtgaacgatttcagaatgctgacatgatgttaccttcatctcctttgtgcagaagctgtcgaacagcttcctcagggactgccccatgcctgaatatgatatatgattatgatctatctaccattagttctttcctcttgattaatctctgcttcttcttcttcttcttcttctgattcaggctgccttttattgctttgagaataggaggtagttctcatcgtgcaaatcagcagatgacaccccattactccgattgtttttgcaatgcgcgcgttgccgtttgacttgcacctaccgacgaactgaataataataataatacttgctttgtgttgctgggatgctggtcgatctggagatgatggaaccaccagacagccacaaccgacagtgtttaatctaatttatttattgccggattctacaacattacaacgtaccctgtttcaactagacatagtaaacttttgtttggatctaagcatggtgattgatcatacctcttagtgaaaccttggaataaattacactccatgccggtcgaactattagtatttttaccttcatcctgtacaaaaatgcaatttactcttcgtaatcatctgtttatgaagtataaactacactgtgaataaatgattaacggttaatttaaaattgatatattacataatcaagcaaggtcgttgtagtatagtggtgagtattcccgcctgtcacgcgggtgacccgggttcgatccccggcaacggcgattttactcctttttttaatttgggccatattagattggagcccatatcgatcagcccacgggccgaaccgctatatggcgcccatgttgcccatattagattggggcccatactcctatcggcccacggcccgaagagccttatagcgcccacgacaaagcgttgggtcgtcgcttgctgcttctagacagttctacaacggtcgaggctgctccgtgctctcctccgctctgctttcattctactccccggaaaaatgtcctattcactttggtgcccctgagtccgagatgcttgctgattctccctctttttgtttccacagtttggctttattttgttgcttttgtgttgttatgaaaaggatctactatacttctttttctttccacagtttggctttactttcctgcacattgagtaggattaaaagaagagctagtaatgatgcaatacatgtttatgtacattatcacattgggtttattcaaaagagctaactgctgcagcgctgcagcaatagctatagtggctatattagtcagccagcaatgggctacaaccaacacaaaccatatgcatatgtaaaagtattgtatttaattttattcaaaatgcagcctagcctaaatcgctgccactgaacggttggatgtgcaacacagtctagacaactgctattaagagctaccgaacaatcattaaggccctgttcggctgcacatgcttcaactgtggtacagccaattcgaatagtactatgtgtctgtagctgcagcagcaagggctgcattgtagtgcagccgagcagaacctaagtgattttgtacctatatacttttataacttttgctctatagtttttcatcgagagtataaaaccttaatagtagttccatgtacggtattgaccaagtttaaagatctagtagaagaattcttaatttaaccatactatgaaatgaaaaccaaccactgggtgtacatgttacataattgaagcttcatactacgagattttgtacttctacacctttacggtttaatacgttctatagtttttcgttgaaaaatatttaaactttattagttttgtgtacgtatgacagagttttaagatcttatagaataactcttgttttaaataaaccccaaaccaaacgttgagtgcacatgttacatatatagtcaaaaacaaaaacaataaattgaatacgatttacaagtaaacatagtgtatagaaagttactagctcagctgtgtgttgctgcggctgcaaagcaatgacaactacggtatcaacatgagcaccaccaatgctaggtaatgcagctgttgcgtttgtgtaaaagtagctagcagaacctagccatgtcgtgggagcttttggcaaccgtactgctatagcttctttcaaagtatcaaatttcttgtacggtctaaattatcacctgaactttaataattcatatttttagattttataaaataaactacaagacaaaagataggaaaaacaaactttcgaaattctcatcgtatgcttctcggaatttgagctgctacaaacattccattttttgcctataatcgattatcatttcagacttggaaaggtattataacggcccatcgtctctcctgcttatttaacaaccattatttttaaatcttatatacatatatgtgtttgtgtgttttttagcaactttattaacttttatgtttttttaattcaaatttaaattatggttaacacgctaaaaagaaaatgatgaacttgtattgtgtatcactttatttgtttcaaattatgaggtgtttgttcaaatttatatgggtgtgaataaatctagacgagagataaataaaccaaaatatcttataatttagaacgaaggaagtagttcacaatcaattctcccaataagaaaagaagtcaatactcatgttttgcatgcacgagagactgacaacatgatcacacttagactatgtttaatttctaatataatgcacacttcttaaacggtttaacggtgcatatttttgtaattttttaaatgcaaataaacccttattcagggggtcagacagaaaggtagcaagcgcttttgcaaaaccctggcgtgtatttaagacctcatcccttcccctcccccttcccccaaacccctcctcacccgcagcgccccaacccaaccctccccgaggtcgcagccttatcctctcctctcccctccgcgaggtcaggtgagctcaaaccctatcccctcctcctccacctccgccgctcctccccgccccggggcgctgggttctccctcttccggtggcgacgtggtggggtgtggtgtgttgacccccgcacgattcggttgccgcgtggttggaggattcggtggatagttctcgccgcgcgattcgtggggggcggagagctcgaggtcgcgccccccgcttggttttgaggggggccttttgatggttgctcgtgcgggctaattttgcgctagaactgttatatcagtggaaattgttggtttagttagcacggggactacagaatgtatcagtggaaattgttggtttagttagcacggggactacagaatgttgttggctccagcgttctgttcgtctggttgtgacttttggcatggggtgttctaattcagccaagtagagtggagtaggagggtgcatgcgatattctgtttggcagttggaatgctagtgttttcatgtatgctagtgatggccagccatttgaagctgacgtaactgttagggtggttgaatggcaaacatttaaatttgaaggtgtagtttcaagtgctagaatgtattggttggccattcatgatattcgagaaggaatcctggcagcagagatgctttagttggtctctttttcgttcagttttagctatctcatacatatgcaggttatcaactcactgtaatataccctgaagtccagttgttaattaatcttctaccttgacactgtaagagatgtagtcaatgataatatgtggtaatatgcagagagagcacaaaactatgtttagcttggaaaatacatttgcacagaatgcacaacaattttaagctcttagctttggttggcaatacatgaactttcatgtgggacctccacctcagcttccattttctgaatagaagcttaagcatgcttatgattgttgctccatgttaatgttgtcattgctgaacaggaaatcatggcttcaacattcggtgccacttctacggttggcctcatggctgcgccaaccggaattgtatcagacaagaagccatcttctctatcttcggtgtcatctgtttctgttgccagccgaccacgcaatgcacgccttcagaggaagtgcaacttcagggtaaaagctgccaaggagttgtacttcaacaaggatggctcggctatcaagaagcttcaggtgagctccaaagttcttggacacatcttatcaaattttggtcactatgattcttagccttgaccaggcactcattagttatttctacatgtcagactggagtaaacaagcttgctgaccttgttggagttacactgggaccaaagggaaggaatgttgttttggagagcaagtatgggtcccctaggattgtcaatgatggtgttacagttgcaagagaggtatattacagtgtttattgcgtcaaatagcattgaatttccttacaatttgcttgtttgctgtatgctatacttccacagaaaaaaaatgtttgttttgaaaagtaaaacagtctgcacatttgctcacaagtttcatgcgcaagtgtatttctgtttactattgctggttgcatttttgcacaccatgttctatcataattacctttgtgggttctaatatatgatcctctgacaagatgaactaaagtttgatagctggtcattgacttaactatagtgattgtgcaccatttgttttagtcatgatataaagaatttttcaattttattttcttattgaacaagtcaactggaggtttctggattatctgtgtaacctagttccagaatttgagcagaattttcaagtaacgatctctgtactgcaggttgaactggaggatcctgttgaaaatattggagctaagttggttaggcaagcagcagcaaagaccaatgatttagctggagatggcacaactacttctgttgtgcttgctcaggggctgattgctgagggtgttaaggtatgctattagttgagacatgagacctctattacttgtatggtcaatctgttaagagtcgttaatttgtgaactaagtgaaaataattcatttgctctttttcaggtcgttgcagctggtgccaatcctgtgcaaattacacgtggtatcgagaaaactgcgaaagcactagttgaagagctaaagaaattgtcaaaggaggtaaaataatcgtcaggctctaatgctttcagaatgttttagttgtggttgtggcaacctggtgtttgttgcaacaatgcttagctagactgagtcaaatcagatgatttatctatgtagtatatgcttttttttgttctacttataaaaaacattttcttgctttaggttgaagacagtgagcttgcggatgttgctgcagtcagtgctggcaacaattatgaaatcggtaatatgatagcagaggctatgagcaaggttggcaggaagggtgtggttacccttgaagaagggagaagttctgagaataatctctatgttgtggagggaatgcagtttgaacgtggttatatctccccgtattttgtaactgacagcgagaaaatgtctgcagaatatgagaactgcaaggtagcttcagcctgagcacacatacccctgctgtatgctgctttaatctgtttcagtttcttattgcactatgtttccactatttttcagcttcttttggtggacaaaaaaatcaccaacgcaagggatcttatcaatgttttggaggaggccataagaggtgcatacccaattctgataattgctgaggatattgagcaggaggctcttgctactcttgttgtcaacaagcttagagggtcattgaaaattgccgctatcaaagcccctggttttggtgagcgcaagacccagtacttggatgatattgccattctaactggaggtgaggtggacttgcgatctggtgcatttggttgggtgatcattaatgctgcttatttatgatgattctggagcatctggctggatgattaatgctgcttatttataatattttttttctctgcagcaactgtaatcagggatgaagttgggctgtcacttgacaaggcagacaaatcagttttaggaacggctgcaaaggtggtccttaacaaagagtcaacaacaattgttggtgatggcagtacacaggaagaagtgactaagagggttgcacaaataaaaaatctcatcgaggtatgttatatctgtttaccatggttaatttggcacaatagtgcctcgcaaatttttttttttggcacaatagtggttctatattccaccatttctttaatctagttatagactgtacatatctggaaatgtagcttgattggttacatgcttcatctggtttcaaactgaaagctttctctattatgaggctgtatattgaatgtgttgtttgtacaagaaaagaaaagcatcagtcctgctcctgattgcttttttatctatccaatttgcaggctgccgaacaagaatacgagaaggaaaagctcaatgagaggattgcaaagcttgctggtggtgttgcagtcattcaggtataataagaaatggacaaaatgccatgttatctgtatctgttctttttcttggttctttgtttggaaagatagatagatgtggttatgtgggtcgtaatccaagttttgttacttttgataggtgggagcacaaacagagaccgaactaaaagagaagaagttgagagttgaggatgccctaaatgctaccaaggttagtctgttgttataactgctttgagatagaaatagattaatgtttgcttcttaaggaagaaaaattaaggtagtttgttgctcactgagttgatatcaacgttcttctggctttggatctttaaaccgcttcctctttgtcaggctgctgttgaggaaggtattgttgttggtggagggtgcactcttctgagactggcagctagagttgacgccatcaaggacaacctggagaatgatgagcagaaggtttacaaccatgatctactttattcattgtttttgttcgagtgttctataaacctcatctctcaaaagttctgtttttgtgcctgctactatgtatatgggttagaaatgaccatctcgaatttgttgtcctttctaattgacttgttgtatgtattgcttgaactttttaggttggagctgaaattgtaaggagagcgctgagctacccgcttaaattgattgctaagaatgctggtgttaatggaagcgttgttaccgagaaggttagatcttgttcactaacagaaaatcatatgttcacatgtacatctgaataacataaaagatgatgttttaccaggttctctctaacgataacttcaagtttggttacaatgctgcaactggacagtacgaggatttgatggctgctggtatcattgaccccactaaggtctgttgctccccattgatttccgatatttttgcataaaaatttagattggtggattccctatattttagctgaaataattatagcagtgtggactgtgcagttacttttgtgttcacccttcagttcttacacatacagccattgttttgtgttgatgttagtagtttctaatgaaggttctagatccaaggcttagtgttgtggtcctagaaagattgaattggatgcaccatacaatttgctaggtttgatttagttactgcaagagagtgaaattaactttgggaaacgctaaaggaaaagcatgaacacaagtaaaagaacatagaattagactgtagcccttgcacatggttgacacactacgattgttgattcccttttccctaccatgcttcatgagaactgcgatgagctaaagactatgctttcctgatgatgggcaacaggtggtgagatgttgtcttgagcatgctgcgtcggtggccaagacattcctcacatcggatgtcgtcgtcgtcgagatcaaggagcctgagcctgcgcccgtcaccaacccgatggacaactccggtaaatgatattggccaaacgcactacacttcaatttcatgtgatcaaacactccctgaactgttgctaactttaaatctgctccgtctctttctgtccaggctacgggtactgatgactaagttacagttacttgttctccgggaaggtcactggccgtcaatttttgggtagtaggcttgaatctgaattttggtgagatttgagtagtttcgagacaatttgatttgttcccatgggaagtgaaataaacagggtcactatagcaaaatttgtggtgtaactggaacggctgtcaaattacgaaggaagatatttgaaagatttcatgctctctggggtttaccgttgacattcatccatttctggcgtaatttcctacagcattttcttggcaggcaggcaaagcagcgcagcatgggcttgcacgtcttcaactcttcatgctttgtctggtgactcgtgtgcatcagtaagaatttcatgcgagtatacgtttgtgatgacagcaatatccgatgaactcctgtattattacacggaccgatgactgataaagatgccgccggcgacctttcaccgctagtgtagggcctttttctttcaccgccggcgacctttcatcggacgtcgccggagcgagagaaggtatcgttaagagaaaaaaaatcggatgagtattctatcaaatgccatataccaaatccgttttctctaatgctgtaagaacacacgcaaattaattttagttcagtagaaaaactattgcgctccatcagttctcgtcgagagagaggttaaaaggcagtcactgaacatggggcccacatgtcagttagaacccaagaggagagctcgtcgatcgattcccccgcgaaacagaaatctcgctctcgccgccgccgccgccccgcgtctcctcctcctcctccctggccggcggcgtgaatttgaactactccgtccggccagcctccgccgctccatgccatattcatcccctcctccttaaatcctagcaccctgacacctccagtcgccttccctagccctatcaacccttgtgtttgtgaatggttggatggattccatctcggtgaatgatctcgcgggatttttttttgggcacaattgcgatccgatccgggtatcccaccgatcgaccgaagccgggagggcacgggcgatcaactggttggtttattccgcgacctccacttcattccattccacttaattcctgtacggaattgcttcgttttactcagtctggccgatcctaagcatctttcagtttgttgatcttgatttgtctatgtctactctatttcgggttatataagctgcagtttacctcccaggatttttaactgcggcttatgctttctagcaccctccgctgttagcatttggatgtgtatgtcgtacgtgtagccagtacctacaattaatttctgaggagatggattttggtgctatttttctagttaagagatggattttggtgctatttttctagttaagccgtcactagtaggttgtccttgcttcctgaaaagcaccggtagattgtttgatacttctgatgacttctcctggtcagtgtctctgaacattgtacatggtagtcatacgtctgaactttttgacacagcacatgtatttgctacttggttttgtttgtttcattctccattgcgttatctgctgtctattgcatctcctgcataatctcacttaatatattactctactgtatctcctctgtagtcaacagtataggctatagctgtattaacatggtctgtctatcttacgtaagtgatatgtcgtgttaaacatttgttcttggcggtgacagaacatcgtctttgacacttcattgtgatcccaattagagactaaaggaatgctttccaatgcaaaaggttgagcttacgaacgatcttgtttttgccactaaggagattcagctatgcttgcctacaagatgatttctgacggcgttgatatacaaggcattacatcaaatactattctgtttacaaaataaaatgaaattgattttcagtaggcggatactgctggagttaattcagtagactacttgtgatatcaccaaactgcagaagcactagtcactaaacacagatagatgtccgatcatgtagattcttatttatggtaaaccaataaatctgtacctctagttaaaggtatatttttatgccaatcgtctaacttttgctgcccaagtactcccttaattccgtgaggcaaatgtgactacttccggcatacttgatgccagcctggttttaggtctagtatgaggcttacactatgtgctgcatcagcacttaatttaagtcgatctgttccagatggctttatgcctcttctgttatcctgtgaacttatgaatgattctgttatcctgctctagtactcgtatctactttgtagaaacaaaaaattgtattcagtttatcggaatctggtggtgttgcaggtccgaaacaatgtgcttgctgatgtcacaatgtatataggattggcaacatgatcagaggctatgagcatggttatgtgctgaaaataacctctgttggtgatggtaggcagtttgattgggttattctccatagtttgtaatagttagtgaaaaatagatcagttgagcatgaaaactacgatattatcgtctaactggtattatcttccaattgcttagtcgcagatatcagtattctggaaaatggcataaaatgtgggcatccagttctgttaattgctggtaatattgatcaggacactgtttcaatccagtccttgtggccaataagattggaagtgtatcggagtatggagactgcaagaaaacctggatgatatcactttccaattggaggtgatatgagcttcaacatctatatactgtttttttctttcaagaatacaactctatgtaatgtgaatagtcaagtggagatacactctaacccccccccccccctacactctttcagtcagattctgtatctatatttctcaatttctgatcttcctgcttgcacttattactacgattggcatgcaggctgaaagtgagctcaaaggagaagaaattttgggtggaagatgctttgaatgcaatggaagtgttatggttggtacccactatagtccatatcagaaggtgaatgttctttttagatcttcaatccatcactcgtggtgcatgtattgttcatcagccgtcaaattccctgtgtcagcatttagcagtgtcagttcatatacttctggcacttttatgaactgcattattgtcttagttgcactactttcttttgtaatccactgctaattcagttagttgtttgctttcttgctaggatgcagtggagaaagctattgctgttgctggtgtctatactcttttgaggctggcatctaaagttgacttcatcatagaatctcgagaatgattagcagaaggtgggtgaatgaagctatcatttttgcgacacatcgaaagtgattatttatgggttcatcttattttctttggtggagattattttcatggtggcatattgtagaacctttttggtcaattaacaacagatcgtatcgcccttcctgtaggttgaggttgaaattgtaaggaaggccttcagtataatccctgaaaaggtttgaagtttgaacaccattttagttactccaagcattattaatgcatgattcaatattatgcggctgcgtactactgaaaataatactattagatctctacagtcaggttcttgctaatgacaacttaatgctgctactggcaagtacgaggacttaatggttgctgggactattgaccccactaagagcaagttttatagtatagtccattgctagctctaattcatatatagtcaatttaatagccaattcatataatatttgtttactatactattaatatctggtcccacctaccatacgcacattacgttttggagtccgtgctgtagctggctacaaatctatagtctgctgcttttctctatcttcttttatctttttaaaatatgtttacagctagtttatagccttctattgtacctgctctaaggcatgccattatttgatgaattctagttcctggttactgtatggatcttatcatttcatttaagccatgctcaaatactcacaataatttttgttaactatttttctcctttttcttttattagtcattttatttttcattctgatgagctcattactcattagccccgtagtagtgttttcttggtcagtttaagatgtttgatagtacgaaacattaacctttcacttacatatccataccctaaatctttttacttattatttgtgcttagagagttacttttgcaaaaggaacataataggcggtgagttgaggtgtcgcttggagcattctgcattggtggcaaattaagacattcctggcttgagagttgagacgtggttgtcgacgccatagagagcgagaacgtacacctggtcttctgcaacctgcaaaccaatggcagctagctctggtaatctctgcacctgatcccatgcacgcctttgactgtgctatcttgcaaatctagcatagggataccacgttgcagaatatggattctgattgagcaacggcacttggcttttctgtgaaactgtggcaactaaatcttttgcttacatacagataggacggctgcacttagcaacactacacccgtagctaagtgaagtgatttcatgaatgggtgtagcgttttctttaaccttcagtaaaagaatacttgatgccaaataggagtagttttcaacttaacatagggatagaaagtaaagtaaaatgggggtgaggggttcattggatactcaagagaagtctgtgattatgtaaggcccggaattttaaacaggtgcgtgcgcatttggcttgtcacacacacataggatgcccccctctgcttggctgcgtgttcgcttgtttctgcgtgcgcctgcacagctgcaaattttcaccagtgccagcagttgggaggtagcagtagcagtggtaaactagcaaaggcaaattcacagtggggggcctggctatccatccatctccttgaccttttttacctggagcatggaaggaaattccaaaaaccctcttgagctctttcgtgcttagacaaaaagaaaataccgtttgctccaagtccaaaccattgtacttttactgtaaggcaacccaagcacacatatagatactgctacattatgtctgcgtatgcatatagtgaccgttgttttgggtctttgtggttggtaaccactccttgcactgacagtatgactctacttattagacctgtgctgccgtgcattagatgtagtagtagtataacgttactgctagtagtattttgtttgtgaaggttagtaaaataattgatggattgtaaacaaagtctaccactatagtagcagtagtaatacaagaatagtaaaaaaacacaagatccgggtcggccggcctaggggtggaaggtggccgtccacgctccgtgcaaatgtgatcttcttcttcatcctagagaagaggagaggccaacggccggccattaatattccctcttcgatgcctgcataaaaagctgtgtactgtactactacccctctctctctctctctctctctgcctcactggcacctgtagtttagcgccgttgcacgctgcctctgtgtgtgtgacctggctggctggggctgtatgactttgcctatttggtgcctcgctgtactcttgggcccggggtctacttgcgaaaaaattttttaaccaaacaagatggaggaaaaagggcaaggattgaggaatatctctgtggtggagatgggtgattatacttgaatttgctggtgtttttttttctcattacttttgcacctccaatctttgcaactttcctaccttttggggaagaattaaatgtctgttcaagtctacaggggaatttaggccctgtttagttcacaccaaactttccccaaacttccaactttccattacatcacatccaaaactttcctactcacataaactcccaacttttttttccaaactaccaactttccccaaacttctctccaatttcagaaactaaacacacagttagtttttttttctatgcacagagttgaatagaaatttcagttaccccaagatatactattttaccagccatgatttttgaatcagtagtgcattagacatatcccaccaacaaatgaatgtagttgtagattatcccccaactaataatgtgcgtgtgcaatgattctgtcatttgcaaattgcaattgccgcctcaaaacgcaaatgccaatatgtgacacctgtgaagtgaaaatggtgttggcatcataaaatatttaaccaaccccaaagcatgggtaccttctaagttagccacacaactaatttaacagtgtactgctatcacacagctgtacaactggcatatcattgctatacaccagtacaaagtgctcgtgcccaccgttttatgctgtaatctctctcaacaactgaatagaaaatcaaccacaaaactccagctggtcaattcttagggatattcttgatgcggcgaaaatctctgaaagccaatctttggtgccacctgggtattgtgcactttgtactttgagctggaacgaacggcttgtgtcagttttggccgttggtaagggacaaacaatactggagaagagtattcatttccctcctgcaatatcttctcacagtgtagtagtatggtctaatgcgatccatacggaattgtacacaggagtacatccacatacatagaattgggtggtggccccaaaagtactctccatctacttgtagtagcctagtataatactggaatgtgatgttttactaactttgtaagcaaatcatgcatgtagccatgtaacttaggctcctttggcacatggtaattttcagaaagttgttacattcatccattcatgtaaaatccatgcatttctagtatcttcaaaaggaatatataggagtatatttcacaccattgatgtgtttatcttgtgtcttacaatactcctacctaaactagttcagttggttccagcgggggatgttaatacatgccgcatgagctatcagtcatgattgcagccaacatgtaattgtaatgcttctccaactgaaattgtcgagttgggaggtgaccctgacctgcacaaaaaggtgaaaaaaaagaaaaacaatcttgcagagaaagttctgcaatattatccatcgagcaaaccaaagcacaggtaggagaaaaactcccacatgtacattacctactcactaccggccagatatacatatatacagagtagtgtgtagcctggctaatcaattactaagagaaaaaaaaaacctccaatgttgctgctagcaatcttctacccatgctcatgcaaaggacagctactgagagcaagtttagtagtacaacccactacttactataagccaatattaaagctaacatgtataataggttagctataaggttagctttatttttttttcatcctctctctttatctctctatgaatttaatgcttatttcttggagcttgtgtggagctagctcttgcatgagagccatcactccccacttttctttatctcttccacataagcatttagcttgcttatagctcaccattatcctttctctcagagattgttgcaagggaggaggatatgcattgttttttatctttagttttttctttaagcaaatagggtagtgtagtactttgggtcatggggaacagcaaaaacagctgtctggggttgcatatgattagtagggcaaaagctagtgagtgtgtgtgtgtgtgagagggagagtgtgtgtgcaagagggaggaggggccttttgtgaaaataatgataagttttggggagcaaaaggtgagaggggagagggttttccaatccagcttccaagtcaaaagggtcgcccgggaacgaagaagaaagctcaaagctaagctgggctggctgctgcgggcatgccagcatcattgccgctcttttctgctctgttggcatccgagacgcctcctctgtaaaggcacaccaaagctctcttcttggaccctcaacaaaaattcagcaactgcaaatactattagttattatagttatgtcagttagtagtattagatacagggatcaattatcccttatttaattctccctaatgatccttttctgtgttttgtttactttctctctggatatatggtgtgccattcacaaagtgattgacttgctttatttcattgaggattctttccaaccttgtttaggctctggcttgtttgcccgttgattgagttggtccaagaatcaggatatatgatattcatgacttactggaaagctgttaagcaacagcactaacactggtactaagctaggcatgttcttttaccagatcagataattttcatctgtttactttctgttatgtgaaaatgatccgagatttattgctgtggagagcacacaagctggaaggaaaagatgagtatgggtgccatttttgggcttggagggtggtccttttctctgctgtacattttttttctacaggatccctgctgtacaatggtagtagcttcttgcttcaatcagggcaaatggaggacagattttagcttgagctaacatgtgagcaggctgctggccacagtgcatgtttgcacacatggtaggcccttaactgagtggactgaatgggggtaaggtaaggtgaaaaccagactctcaaattcactttcattttttccagttccattggaagatgtttcacatgaaatccaactgcatgatcctaaaaggcacttattactcctgtagtacattgcttgtaacatctctaataatgcgcgggtcattgtcgccgaaatcttaacccgattcccttttatgtgtctgtactcctattagtatatactaaaacatccatgttgttcatgaaaatggctcattgctggtgacatgctgatgatcgcatcacgggcgtatcgctgtccgcagcaatacgttttgatgcgaactgaaaacattttatctgtactcgcatgcctgcttcgtaatgtaatgtaatgcttgtgatgttattgcaagcgatgtttgatataattgcttggttttatgtcatgacagggaagagagggaggtggtcgccgtcatggactgatgagggccgtgcgtgttcgttcgccaggccaggacaacccagcaagcatgctaactggtaagcatccatcaaagcttttctctggaaaacaaaacttggcctcagaaagtgggttctgatgaagaaaatgggtaggaaaaacagaaaaaaaaatgggtaggaaaatgaaaggggagatggttgtaaaacccttatcctcccatggctccatgccagggaggcatggagtgatggacacaggtcaagaggagaggtgcaagtgcaagaaggctgttttctttgtaaaccagctagtagtaaaaacttgcaattctctaatcagtgagccagtgacccctcctgggtgcaggtctcctaggagatagggcaagggaaatgaggccaggtatccaaaggcccatgtctctatttaccaggaaatgctatgggtccccatccatgcccccctaaaacaatcactgctttcctcctggaacaaaacatactattataactttataagggatgtaaacatgttgtatggtaaatttagctagccagacatgattaataaggatatgcgctttacaatacaaaggggtgttgtgtagtatgaaagatgactatattgtattataatttgatgatatctttaatgcaataggtttatatttaatcattaacaagcacaagtgattatagctatgttaaaatgactagttttatgatcttctataatcgatacgagaagacagggcagatgtcccttttgccaaccattcaaactcatctcgtttgataactacaagattgaccaactctactcttgaacttatgcatatgatccataaaaacccaagcatatgtggtggtcactattctagaagataccaaccttgtgaactatttcgtctcatgtgctgctaatatgctatatacgagctacgtgttgagtacctggtatattttcacaacacaccaatatctctagtatttcacctcactgcataaaatcgcaaaaccaccaaagaacaccctaatacggctgcaactaccaccataaacatttggccatatgtaaaaacaaacgtcaccaaatcacaagggatgaagtcacaactcacaagtcataacctcccagcccaaccaaggaggaaggagggacttaggccaactcatcaacaccaaacagtgtccaccctctcttggtccccctagcagatcccacccccataaaactgcccctccattggttggctccattggcacaagcacaaggccctccacttctctcttcactcccttccagctccccccaaaaccccatttcattccaacctttcaaatccgccatcaccacctttttttccccacacacacacacacacacacacacacatatacacattgacacatagcagtagtgtgtgtagtactagtacaaacacacacaacacaagcttctctcttcccttcttggttttgcccaagaaacgaaaaccaaaaccaaacccaagaactctcctcaaaagaaccacctcacttcatagctctcacaaggctcacgcacacatagagcttgtgagagcttcttctttctctctctcttgtccttgtggtagctggtgcttaaaggaggaggaggtgaggaggaggcgcaatgtcggagcagccattgccgcagcctcggagcagcatgcgggaggcgctggagaaggaggacaaggagaaggcggcggcggccaaggagaaggccgccgtccccaagaacggcggcaacgggggaggaggcaagaacggcggcggtaacggcggcggcaacggtggcgccggcgcccagcccggggaggagacgacgagggagattcaggtggtgagggaggcgtaccggagggagccggcggcgccggcgtacgtgatgccggaggagccgccggccatggtggagctcgtcgggtggtacctctacggcttctgctcctacttcatcacccacctgctgctccccgtgctgttcccggccatcatcacccaggtcgccttccccgcctccgacttcaccccggacaccaagtacatcgtcaagggcgccacctgctccatccatgagatgtccatgtaagagagactcagctcccttccctccactgtttgttcaaatcttttcacttcttcttggctgttttctctttgtttttttgagggggtttggtggggttttttggtttgagttttgaaggggttttcagtttgtttccttggtgatttgttttgttttcttctgggtgtatttttctcactccttttttttttcctctcttcaaaatggttgagaaaaatacttgcatctgtgtgagctaagctagatttaccaagttactatcatttttcccccttgtgtttgcactggaagtagtactattagtatttattctttcctttttactagaactttgagcaacttgactagtgatgactcttgcagtgaggtttttcttctttcctagtgtttcccctctctagctcctcttgtttaagacctctacaagcttatgtctccgctttttgaagtttccacctgatgtcttcctaaaatatgcttcttgttttgtacatcaaacgaacaggcatagtgcacttaggaaaaaaaaacttactcttttttctctgtagttttcttgctagtctcttctctgctcttgttcttggtttgaaagttttgagctcgttttaactttacatcgtccttcatcttgtgatctgtactcgtagttctctactccacctttttttaacctcttttacccacacatcttcaaggtaccccaaatgtgaaaataaactggtgtatagtacttcaaagattggatttttccgggctgcactttatatgtggcgtatatgcaaaatcctaaaaagaaatagcccgtgattcctgagattccatgtttctttgctctccattattagcagataagagattcttgtgcaaagctccaaaagatgctactgtttggtcctagatattgttcagtgaggctatttcccacatcccacatttctcttttattaatatattttcgtttttcctgagattttctctacctagacacgtaatgaactgcatctttttttgtcagtttctttttgttgtactactactagctgtgctcttgtgactgtgagagacaagatttcttgggaggaggataaggtcaaacaagaaatccctaggggtgcctttgtaaatttgttttaaaaatcttccgaacgttgagaaacattaggtggtgagatcgaaaatgtagtactgaatggacagtggaagccataagtatgaaatttatgaggtaccccaagccgaggcctgtgtgtctcattaaatatggcctgtgaaacttgcttccatgcttcagataactagccatatttcatttcaactactagtagtactgcaaaatttcttttgtgatccatgcagtgccatatacccctggagatggtagtagctcatttccttggctgatagatctagtttgtgtagctgagggttacattgcttttgtctcacttttgatagaaccaagaaaaagagtgcgcaaaagcagggccatgcttttgcctattctctttggcctgccctcctccctcccttttatttttttctcttttgaacaggaaaagaggcccctaaaccgttgcaattttgcctttaaccccaaatgctgttgagggctagccgcatgaccagccaactggtaggtgcaccacagtatggcatgcttaaattgcatcaggccaactaactgcccttgattgcaagggagattgttgatgctacttaaatgtgtcaacgttgacacctcaacacacaaaagttaccatcttttaacgggttaatctggtatgaacccctggaattctagcacggtgactttcagcaggcaatgcatgtgcttcttgcagtttatgttcacgcattgtttgtacaccctggaagcttttactgcataaatttcatagcatgcaatgtttacctgtacatgttcatgtgatgcaaccaaaccatcatggtcacaccaagtttgtgaaatgttggcaggtaccagaggctgaccaagcattcgattgccattgatggatcccggctgtccccgttgggctggagtggcctatcatgggcgattggaatcctcattgcggctccgatcctcacccaggctgcacaccaccttgaccgtggccagtatcagtcgctcatcctcattgccgcgacatcgtttggctcattcttctgcctcctcactggcttcttcaagacagtctgggtgttcctcttctacatcctgttcattggtgcatccatcattgttgctgaggctgtgcatacacgcaatcttggactcatgatccgtggccttgcagcacatgactctggcaagcaccttgtccttcgccgtcgtgctgctgccagtcagctcaccctgtattgcactgccattggtggcattggggctgcgctcatggctgctttcatgtaccacatgcttcggcgcactgaccagctcacaggcctttgggtcgtctccatcttcagtggccttatctggttcattggtatctgccatggtctcttcacaaaccgacccagcagctcatcgcccaccacagcatttgagcctaacttcttcaccaagctcagctacagcatgacccttgtgcgatacccacaggccatcggaagcttggttgcagtgttcctttcatctttcgccacaatgtgcatcttcaccagtggcacattgtatgctattggtggtgtttgcatcaagccagtccttgtgctcgtgctctggatactctacttcctgttcccgttgatctcacttccgctgctgcacccaatccagatcatcatccgtgctgatgctgttcgcatgcagctgcttgggttcatcatctgcctatttgtgtctggtgctggtttctacttcaagagccacaggtggagagccgctcacatcattgtgatcgctcttgtccagagcacagccaatggtgtgctgtactcatttggtcgcattctgctgctcgatgcctcgccaccagggaaggagggtgcttttgcggtgtggtatgcatttgtacgctgcattggtgctatgattggcttcgctgctgcatccgctgggcctgggcgtgctggaggatcgtttgctgctgcgttcctaggcagcttcctcggcatcattgttctgatctttggtaatgtgagcaacatcggggcgctgaaggctgctgggcatctgaagggaatggaagacgagaagaggctgggcatggagaaaggggaaggcatgagtgcggttgccgattccggcgagggaagggggagggtatgatgatgattaaatgggcttgtgggaaggaaagattggaaaattgctgtggaggttgtgtttgtgagagggatttgttcttctttcttgtttctttcttgttcatgtttcagtgacactgttaattcggtgctttgccccccttggatgcatgatgatgatgacatagtggtagaggaagtgtgctagttgttaatgtgttattctttgcttggaagacaattgtaactgatgatatggttctttgttcatcgccaccgaaattctctctggcagtcatgcttcgtggttgcttttctgttgaaaatgtgattgtcaaagtgaaataaaacccttatataatatttctattgcattgtgcaaacaaatttgcgcaatcttgtcacctgatttctggagggtgaaatgcaagatactattgtcactatttcctgtcaaaacaagaattattaaaaataagtccgggagctggaaactgaccggtgtaccaggcaacattgttattccgggtcaaattctattattttttttccctgtactctatttgaagttacctttgaattttcaactttgcccagcaggttctttagggttagggtttagggttaaactgaaagagcactgaggcttaaactgatttcgtgttcttgaaacctggataagggctcttttagaacgcaagagcaagaatttacaagaaaacataaaatccctatataatttctctatatcaaataaaacataaaaaaaaaaacttatgctaggtatgctggataggtcatgttatatcatcctatgtattttttctttttcagtaattatatcatcctatgtatttttttctttttcagtaaatctctattctgaatttttatttgcacgtttcccaagctcttaaacgtcatgttttgtgtaaaattttctatataatttttttagaatatttttctaaagcaactttccaactttgcaactagctaattcattacttcatatcctcaaatagctatcacaggagtcggattatccataaattttagctattttgttgttcggatgaaaatatagatattatcaactgttagagacacatggattttggcatcatttgtgatgccatcctaatgacttttctgccaaatgataaggtttgcagtagccgttgtaaactgtcgaacccttgaggataccctccatacctttgtcgaaggatgcatccgggcttatttccagacaaatgtgatgtaatccttctgactttatcagctgatcattgcacaaaacattgtacttccaaccatttgtttagtgtaaacatcagcacaaatagttgaacacaagcagttactagttcttacttaaaagctctggataattttttctatgtgcattacgaatgatgatcacctgacacatcccctttgcatgacaggttaatgaagggtttaagagaacaacctcatggcaaaatgaagccttaatttctctttcagagtttgttgggatgaaatcagctttgtacattaaatagtttgtattattttttctctaaaatcataaaagagtttgtttttgtgttgtgttcttctacctcttgcaattaaagaaaatgtacctgctcaaagaatctctcacctcatcaagacatcaacagcagaaacacatcacaaaccaggagacgacttatccaaatcaacaaccaaatgggactgcaatttagctcaagttgcagtccatctacggcagaattaacaataaaaacaacaacaaaaaaagagaaaaatttaaataatggtgattaggtcaagaagcatacgtacaatgaggtttacggagccgtccatatcaagccgtctcgacgtacacatcgggtcatgagtaattagtctcgtcggctgcattaatatactaccagtactactactaatgacttcattattctcattgcgcatgaagggtgtgatggtcaactcggttaattaattactatttggacagatcatttggagaatttagaaaaaaaagtacactatgatttatgggagttcatatatagtccaaaagttgcttatgaaaatactctatttgacaatttgtgccaattccatagtccaaaagccatcaataaagtggactattgtgcaagctctagatgcttgagtggccatgaaatcatccatgcatttttataattttatttagtggtagactttggatgcgtgaagagcaaagtttatgggggcgtattagagaagattaattgtgattttgggggtccataactgtgactttttcctacccaataaaacaattattgatggcaaagactaaactataagccagggaggcaagttgatcttcccccctattatcaggatttgttttttttttgaaaatagaatttgaatttaatctttttacatatatacacccggctacatatgtactaactacaagtaaagtaaagatatatacaaagaatttgtattattcgaagctgaaatcatgcttgaaaatttctaagttccaaacaaagccttggactaaaactcatattaattgtcacttcaacttaaaacaaagtagtcaagcattagctttacagaagaaacatggttagccatgtgttgatggaccacttgttgagttgagaataattatactagtttatgatggtaaggttggttaacctactcaaggagtagatatttatgtggtgttggcatgacatatttagaggcagggagacagggaggcaagcagcatgggttgggcatgatgatgagcccctgtttcctaatgtgcctgccctggccctgccagtggccagtagtaggtaacccatgatttctgtgggttgcacaccattgcttgttttcctctcatcacctcaagaatggagtattcttgtttttaaaatatcaccctaagttctttattattttctttgaaaaaaagaataaaatggccatgagttattttccaatggagtagtgtttttttctactgactccatttcataatagtgcttggcaatattaactaactaactaacaaacaaatggtttaattgaccactgatatcttttaaaccgttcgatcaagttggatgggactaatatatttaaatttaccgtgtaacatactttactaatattacttgtagatttatttataaaacaagagtagtcgaactaaaacaatgataagttaaattttgagaattgttactatgaaacagagaaattagaagaaattcagaaagagaaagagggagaaggagagcatgtagtatgatgattgcacatgtgcagtgcaggtgcagggccccagtgtcatctcctgcacttcacttgtgccatcctcttcacttgtgcagtctttactgtaagaattttcttgcaagttgagaagaaacagacaaggggagctcttctttcataccgttgccagcacggctattcaagcaaagtctctttgactttgacctccacgctggcacttgccctacgctttgctatcccgtcccaaacgtttttctcctgtttctacatcactccatcaaaccgcccgtctaacactccgaagtacataatccgtacttcacgtcgatgcctaaaaacgtactactcccccacattccaatattaatatacaacggactataggattaggtttttttttttaacagagcagtaatatacaaggttgcacttatattaatatggtgggattaagtatttataaccatgacttaaattgagatgtacataaatcattttcttatagataatggattgtttcattagtcaataaaaacatcctacacctttacatcaactcatcaaggatgcacacatgcagtaaaaataaaagtgaaagaaagatgaaaaaccgtagtaggtaacatgaacatgtcatgttgtctagcgatattttgctctattacaatcatgaagagaatatcgggattatatgctatactttggaacaacgccttcagaaataaagatcttttgatgatgtcaatttctaaaatgtatttgaatttaatggcattgccttctaaaatcaaagtgaccaaagaatttttaaacttaattttgatttattgtatttcaccgtagtttatttttttagcattgacttttaaaccacgaatataaatataaaagctttatctataaattatttttaatatctttgtttgtttttctatgacataccagcctagcttaactgcttaagtgctcaaccgatcagacacttcgtatccggctttctataacaagcaattgtccttttaccgttttatctgctattgcttgttatagccgttacgctgaatttaccacaggtcactcacgtatagatactaatactgtagagtgagctgtagtagcagtaaacgtcgcttaaaaggcgggaaaagctaccgttgcaggcaacaacactgaactacatgccggcaattgcctgtcttcttcttgttttaatcattcaatcacctcgtcttttcttgcttaatccatccctctggcctcttctcttcttcacctgccatcctcattactttactccattgcattcttgtttacaagcttaatcaccataggttattactagtcagtgttaactaatgcaagttgataatagccgttctctgatcgccggttggaaggtaaagatatgaaattaaggagttgaccagcgcaatttctgcactagacaacaaactgatgttttggagtcattcatacatcagattataactaatcaagatgcctctaacccaaccaaagcctgcgtgttctcttatctgcattaagccctgcttgctttgttgtttctttcaggaagaatgacgaaacttgagccggcaagattccttcctgcatcaggttcagttcagaattgtagtttaagaacaagtttcagttgatcagcagcagcatcagctgaggccaaattctcctgtttgtcaatgctctggccaacagtttcagatcatgatattattatctaaaaaagatagtttcagatcatggtcagatttcagagggtaagaaaaaaaaagtaagtgataataataatacaattggttaaggacagttttaacaagtaagctcacacctgaccttgagagcaaaagttctagagctgctctgattcaaaaggccagccatgctcagattgctttatgatgtccttttgattaatcaatccaaactaaactgatactagtactgcaaagtcatcaccaacacgaacaaaagaaaataagaaacaagaaagcaaattaaaggacagaacagtcaaagcgagcgcgccaactctttttgaacggcggaaaaaagaaacaaaaaccagcacaaaaggtgaaggaggaagatgaactcattcctcaatcctccagcgtttacctgtcgctgaaattggggcgaccctgcaaatctctgaagaccaggatgatattcagatttgtccatacaaactattatattgtttttgtaaaaaaaaatcagattaactgttgaattagattgtggtggtttcaactttcaggtgtggagtcaagaacaagtcatgtgaatgcaaagtgcccaaaaagcctagatttgaagtcacataggacacctatcctgagcactaactgaaatctgttgtcacttgatgcataagatttgtgtacccatgacagccaacaatggctggataatgttagacatattggttgacatcacaccaggccacgaattcctaatccctaatccttcttccttttagtgccaaagttggtgtaggagcagtaaacagcaacatgagtatgtcctaagaattcagaggtactgtagaaatgattaacatatcttcatttattttactgttctactaacttgtattagctcaaattaatgcctagcaatcctttgatgggttttgcaaaaattaaaaaaaaacgtactttttttctgtccaaactatagttgttgtaggacaatagtttataaacttttcctatgtgcgacatgattattattttgaaggtgattggaggttacaaaaaaaactttctcatgcagtagctttcagtgtgaacagtaagagaacttacacatgacatcttccatctagaagtgcaggtatcatgaagaaaaaaaaggacatggcaacaaatccatttatttcagccaaaatagattatgtaagcagcagccagccatctctctgcaatctagataagaaaagagaaaaagaaagaaaattaaagttgaggtgacaagtgcacataaaagtcttttaaacgtctaggtatgaaattatgtgatcctttcgcatcttccaaactccaatccgtctcatctgctcctcctcacatcattttcggttttcctgtgagcgatgcaaagtctactcttgtgtgtgcatgtgtggagactcagagaccacgattctcactgcaaatatatcattttctttctctctttttttttcaccaccgttcaactctctctttttgacacaacagcgatctccctgtcgtgttgtcaacttgtcatttaggaatatgtgtgtgtgtttttcttactggatttcacctatatattttgttcattatgatctgtactttttccatgttatcaatttgaaggtagccagggtttttgggattcactgatcttacttaccatctgagtgcacactcacaagaaccataaaaaggcccttgcatgatgcgtcttccatgtaatcgaaaaaaatagctcctgcaagacgacaaaccatttagttacccatactcttttcgtacatggtatctccaaaccttgtcacataatatttaattcagttctagaaccggttgaccccaaaacataaaagcggcaccctccatttccatctagtggtagtcaaatacgatgaaaaatccgggtgcaggctagacttgaatttggacccggcgtacatatctacatacaatttggtcaatactctcaatcttttccatgaaaaaaatcaaaacttgtccaactcatgacgacatagaagctgcatctgatggtcacattcagctggctgggtctggaagtacaaccgctgggccagtgttgatttcttggcacaccaaagccaaagaaggccacaaggttatcttcaaagtctcaagtctagtcttgttccatatgaacacttgccctgtttgtcatttctcttttttttttctcacttgatgcaaatgttgcaacatcatcaagatgttgaggcctcacagggctccaaatgatggggcatgctggagagaaattaaaaggtaaaaaaaaaagagaggacaaaagatgatgctgatgagctttattccagtcattgttaaacagcaactggccggctaggtgtgccgtttggttttccatattggcaactaggtgagcatcaagccatttttgacccaaaaaagggatcaaagtgatcacatctacatgtaaaagaagataagagttgtagattcttacggagtacattttactttggatgtataattggagtgatcttttttaaaagcatgccttcgaaaaaaatcttgctgatgaactaggcatgtggttggtctgagaaaccacacatgtttggctgcaagaatacctttttttctctcagtgagatttttttgtccacatgaactgtaaacattgatagtgaaccatcattttgaggtcatgttggttacaggtaatactgtagcaaattttagttgggcttgcaagaacaggtggtgaacatcaaatgattagctttatgaagctgtctggatggtgagattaaaaatagttagtaaaagagacgaacttgtctattgtagagtggatatgcatgtactattgattactgccaataaaaaggacaggacagccatcatagtgggttaatttagaagactagcacaagtgctcagtgatttgtttgtgattttttttattttaaaaaagaagctgaaagtgagaggatggacacaggacaggagaattgtctgctacttgaagcctgataactacagatgctacaaacatagatcttttggcccagcccaacataaccaacacatatgagctttaggcccagcccatgtagccaaatagcccagatggaataaccagaaactggctaggctgcaccagtggtctactctgctgccaacgatttgtcttgtaaatttcaataagaaatcttttactagacaatcttttctcttgtaatctaaattgtaaaacaactgaagctcagataagtacaaggagcagcagagcacctatacattctgcatttatatacatgatcagtgtgacataccattgcaagaattttcactggaaatgggtttcagatatgtgaactgatgacccatagatagcataaacccccagagaagatctcctagcgtatatattcttccctaatgcgtctgaaaatttgatcagagatgcataagtcatgaattttatttaggccatatgataattcagaaggagcatgtagagttggagataactaatagtgaaatcgagactaaaaatatcaacaaaataatccctaacccaaactgcatgcataaacaatatcatggcccgtggaaattaaattcgataactgtatctcacgagataggtaggtacctgagtgcctgaatttcaaatctgtcgaaattaaaaaaaggaatacccactgatgaacacacacctgaatgtcatatgctcgtcagaaatatatttttccactgcacatctgcattcgtcatactgctcgatcaggtggccggcttacgtcatcgtggatgcaggatgcatatgcagacatggccggagaaggcagcgacggaggctgctcgtcgccggagatccaagaaggcgggggttccccttgcgcgactaaacaatacaataggagataattgtagggacttttaaaaaaatagaccaactcccggtttgatagtggatttatgcataaacacccctgttcccgttcgaatttacataaggaaacctccactgaactgcacgcaaagtttaagaaacgaattcaacttaacagttggattccgtttcgaattaacaaggaagcaatcggttcggaataacagttcaaattagatccggattcaattcaattcatcatgcaataaatatatgagctcatggcacctgatcggcaatcaatcaccaaacgtgggtcgtctcagagatcgatcagcttcagaattcgccgtcgatcaatttagacatctatcagctcgcgtgacatcatcaatggcggcggcggcagaagagaagaacaagaagatgatcaaggtgatcagctccgacggggaggccttcgagatgacggaggcggcggcgagcatgtcgcggatactcctccacatgatcgaggacggctgcaccggcgacggcggcgccgggatcactctccccaacgtcgccggcagcgccctcgccaaggtcatcgagtactgcaccaagcacgccatcgccgccgccgaaggtagcagcagcagccgcaaggcgaaggaggagctgaagaagttcgacgtggagttcatggaggtgggcatcgacatgctgtacgacctgatcatggcggccaacttcatgggcgtggagggccttctcagcctggcggcgcagcgcacggcggagctgatcaagggcaagtcgccggagcagatcagggagatgttcgggatcaagaacgaccacacgccggaggaggaggagcagatccgcaaggagtatgaatgggccttctaggctatcagggtttaaaattgtggaacgaaattccagttttatcggaggggacccctccgatatgatattatttcggccgaaattttaattttttttctttctctttatgtactaaaaaagatgtccgtgcgttacaacaggtgaatgatattttaatcttattattgttatggtttggctagcgtgaaattcactgtggaaattcgcttggatattttttttagaaaatcatgagctgtaattaggagtctgacattaatcattaggagtctgacattaatctcaagttagtatgtaaatttttttaaaaaatatttcttatacgactccttttatattttcaaaagcaaacaagtttaaaatccgactcaaacacaaatatgtattttcaaaagtgaacgaatttgaaaaccgactcaaacacggatgacgtactaaaatattggcaaaaacattttcaatttttataatagtagagatttggtaatattttattcaaatttgaccaaattttgttcgaacttttggaaatttcggtatatagacaccctttgctagaaacgccgaaaacaaaagattgaaccctgccttttagtagtacttactaactacgtattactacactcttcatcctaaaatataaatatttataattatgaatttagacatgtatttgttcaaatttatagccaacattattatattttaggatgaaggcagtacatcatacaattcacaaactatagtagagttaatacctccgtcccaaaataatggtcgctttgacttttttcttgcgacatttgaccatttgtcttatttgaaaaattggtgcaaatatataaaaaaaataagccatacttaaagtgcttttgataataaagaaaatcacaaataaaatagataataattctataattttttgaataagacgaatcatcaaaagttaaaaaaaaacttaaagggacaagtattttgggatggagttagtagttattattcagaagtaattagtaattgattttgtgcaatttatcactcgcatgcattgccattgcttaattaccttgtcctaatttgtatttgcaatgtacttagactcgatattcgattgaattcatggaaaaaaaaggatgcgcacgtagcatctgatcggcaatcaatcaccaaattaacataggttatagagatcggacagcttcttcgccttcgtatcgatattttacggtgccgatcgaataaattattttagttaggattgaataaattattcggagtcatgtgaccccgggtaatcgaacgtgggaacaccactacccgtatccgatgggaaatgtagctcttgatgtttttggcgccaagatatcaatatatggccattatatatcccccatagaacaatcacatatactccctccgttttgaaatatttgacattgttgactttttaacacatatttgaccgttcgtcttattcaaaaacttttgtgaaatatgtaaaattatatgcctacataaaaatatatttagcaataaatcaaatgataggaaaagaattaataattacttaaattttttaataagacgaacgataaaacatgtgcttaaaaagtcaacggcgtcaaacatttcgaaacggagggagtataaggaaaaaaaatctaatacacttaattgtctctgtaggaactactagagggaattcagttctaataaatcgtcttggttccattataaggcattattatgcttcagtaataaatatccatataagtcgctgcctttctttcactacgctgacaaaaatgcaaatgtttttttgcttctggcaactgtgcttctgttccgcaactaaagctgtatcactatgtgctattttattctgttcttgtctgatgattctatttttatgggggaaatgagctggacatgcttgtttctatggtttacaactgttgtatgtctattttgtttatctctattagtatcaagagcaatttgccaatggtctatgttataatcatcatggtttatacattatttattattggattaaattgaatggtaatttactgaaagatatttccaacattataaaccccaagaagatcttccctggcgcgtgtggaagtttgatcagatattaagcattttagataaagaaattaaataatctggccctcttcaccaaccgaatgtatcagagattagcatttttggataaataataaggcggccgagaagagggtagatttttttcttcagttctttgcgctccaatccgaaccgcacgcctctcatctgacggtcgcagttgagtcggtaacaaattaacaaggtgataagcgatccagatttatgaagaaacacccattcttctcttcgaatttacacaaggaaacgaattcatcttaacgtacatttggattccgtttcgatttaacaagcaaagcaatcgtttcggaatagcagttgagatattagactcggattcgattcgattcaattcatgcaaataaatagataagcacagatcacctactgatcattggcaattaatccaggtctgagatcgatcgatcgatcagcttcttcaataacaatttcggggacggctaatgggcgatcgatcccctcgagaatttagactatttaccatcaaattcgcgtgcctcaatttttttaccacccaatccgtatgccctttataatatgtcattaggactgctaattagtttatttggtaccacttttatctatctttttatctatctttactgtaattttcttttcttaattttatttgtatatattttcaagatttgtggacatttttacccctgggcccacctgtcagatcaaagaaagatactctgggtctggatcgattcgctccctccaggcgtagcgccaccgccgccgccacgcgcttcttcggcgtcgcgtcaccaccgacccgctgccctgcgccaccaccgagcgccgccccaccacccccgccggcactgtgcggcagcacctccagccgccccagctattaggcagcacatggcatggaaacgtagtaatccttcacaagaacatgccatgttttccatgttccatagctagctaagctttttagctttagcagcagcatggtgagtgagtgacaagattcatcggcatggtagcatctagcgatgcatgcaaagctactaacacagtgatgtttgtgtagccacagcgccacagatcgtgcagtggggccgtcgagttggggcggcgggggcgcacagtggcgccgccggcactcggcggggtggtggcgctcggcggttggggcggagtggcgtcgagtcagctgcggcggcggcagcgctcggcggttggggcggcgagctcgcctccccttcttctctttctactacaccataaatttttttaaaaaaataaagttagaaaaatttatgtatagaaatattatatataaaaatattgaattcaaattcaaattttaattggatatataaacttttgacttataaatattcgctatacaaactttagatgtgtaaaatttaggtgtataaacttaataaaagaggaaaagaaaaaaaaaacgatcgccgctagcgatcaatagctcagtaggactttcgaacaatttctccgtgcaaatcggttgctagcttgcttgacagttaatgtcatctatggcggcggcagaagagaagaagaagaagaagatgatcaaggtgatgagctccgacggggagaccttcgagatgacggaggcggcggcgagcatgtcgcggatactctcctccacatgatcgaggacggctgcgccgacggcggcgccggcatccctctccaagatcatcgagtactgcaccaagcacgccgccgtcgaaggccgcagcacggcggcggcggagctgaagaggttcgacgaggagttgatcgacgtggacacggacacgctgtaccacctgctgatggcggggaacttgatgggcgtggagggtgtcctggagctggccgtccagcgaacggcggagctgatcaggggcaagtcgccggaggagatcagggacaccttcaagatcgccaacgacttcacgccggaggaggaggagatcatcaaggagaacgcgtgggccttacagtaaatcataataatttgttaggcgtagtaataataattagtaataatagattttttttgtttatgcttttgcttaattattggtagtatcttttgtaattgaaatgttctcgagtcctaatcgatttgattagttacatttttgcaatattgttcaatttaacatgtgcatgttttggcgccaagatatctgagacatggccattattccccagagaacaatcataaacaatctaattcaccttaattaatcgtcttggttgcatatatatgatgcttcagtaatgcagggaacatatgtttcagtacactgcactcagcaggctggtgtagcaacatcaggagaaattttatggacatgatccttgatcagtatgtaaaagaaaaagggcataatcattcatgaaacaactctcagcgacatccctccggcgtcacacaacataaccattaaccaacgataatataatattaaggcagcattcacatggtcacagaacatagaccaaccctgcacagtacatgcaagaacctgcatttctcatactacagatacaacttcagtgtactcttacaagaatccatacatatgccacaggtcaagaaaccattaaatcacactagcaagtacggatatggcttgtgcaacgctggctaaaacttgatgagaacatcattggttgacatcataaatcaaactgggtaccacccacatgttgtctacttgaaagtctgggacgcggtctattctactaggaactggctgaccgagctcgaccgcagtccaaggttcaccagaatctccagatggtttcgcaacataaatccagttactctttccgccccatctttcagggctcgtgcaagagaatgtagggtccctcccatcaaggttgacaaagagagcctgattttccaacctttccatcttcacacactcaactgtttcagcagaaaactcaagacgaaagacttgaaaggtgcgaggcaattggtcgcggtctgttgacaaatcaaccatgagaagcatttcaccacaggccaccagccatggcccagaacgtgggcctgtaaccatttcttctcgtcgcagaaccgctacttcctgtatgctgagctcaggtgcaaattgcatggtgtgaagcctgccaagaacatccatcgcaaaaatctcacctttgaagagcacaatctgaagaatgtgctcaccgccataaccgtgctttgtccaagagtttgttccaacctgccaatagaatatggaagacctcgaacaaagtatcagatgtgagttgggtgaattaagtggagccgtaaggatgccgtagtagatatccctgtcgcccatgaagttgagtttgggagacttcagcttagtgctagtgtaagcatcaacaaagaggcagttcttctcatgataggagaagatgagatatccatatgagcagcccaaatagcgcatgcgatttggagcatctggcggagctgaacaacgaagggatatgtttctcttggatggatcatcaagctgccatttgcagtaagataaaagattgtccttcaaaaggacgcgaaggggacggatattaggtgtatttagtttgaggcagagaggtgggaagttgaaagtatatacggatggaaaggaagatagcgcagctcgccaagagtggcaggtggcactaaaagcaagcaagtcctggaatgagctaagcaaagcaatgatttggtgaaggaggctttccaggagacctggccaaacatggggttcacacaaggtagaagatgtaggcactgatgagtggcaggttttcttaaagggcctttctgcagcagcaacttccctgtcaaacaaagaaaaattcagagattactggagcagagaaaacattcgaagataaaattactacttcctactagtaaagattgagagatagagtggagtgatattgatccaactgtgttgtttcagtgaagcaatataaagcagtaacttcacctacagcttcttgagtcattacagtgacccttatgagttatgacacattgaggcaaataaaactgaccatttcattgaactgtaagtctgtaacgaactaacgattcccagaataagatgtgcatcaacgtcctagatgccaaccaaaacaatatacgccagaaccacctacagctttgatatcttgaacaataccacaattgtaataatctgtttatattgtgccaaacctatttttgtttttttcctcccttcccttcaaaataagacaaaatggtacttcgtattccaccctcccaaaattaatgaaaatgtttattttgacagtatgaatatgcggcaatacaccctatttatctggaaaaaagatagtgcatttgattaataatttattaatagatctggttggttcctttggcagccaacgcagcttcagccatcagtgattcagtgtcaaatgctaccatacaagaatgtcaggtaccataaacttcttggaactatatacctataatcaactagaaatctacaaaactaagcaaaattgaagcaagaacggaaaccaaattacctgtggccgagagcgctcagctccgttggcggcggcatctcctggcggctcccgtccatggccgctgctgctcctaccactcactaatccgtagcttcaccggatccgccggccggcgaggagaccgggcaaccggcggcggcgcgtccgagcctccgaggcgaggcgaagcgaagaagcggcggatatggatgcgtcggcgaggccatgatccatggcccatgggaggcccaaataatccgcaggcccgtagaacttcgcagtccggcccaaatattgagttgggcccataattttcggcccacatggagagaccaaactggcccacgttgaaggccataagacgagcaggagaaggggagagagagggcaaaccgacatcgccggagaggtcgccggcggcatcgtcgtcctccccgtcgccggagatcggacctcctccacaaggtctgcgctctctctaccctcccgccttctcgcgcctaaaccctgttcctcttttttttttcttgataaatttctcgatctcttgtgtcatccaaccctaaccaagaaacgggcgcgttcgctagggttggaatttccactggatttttgttgttagatgtgcttgctaacaaagtaacaaccctagattgatatggttgattaggtgggtttatcaatcgtgtcatgtaaatcaacgtgcctcttctacttttggggttgatttttttaatagaaaaatagtactctttggatgagcggtgttgatttttttaatagaaatttggaagccaagcatgagttgattgatgtacaaatggagagaggaatcagtacgcaaaaatacactcagatcatttttatgcgcgttatttgattacacagtactgaagtgctccatagaaaagctcaaaactgtactatgcaggaaaacatttcgattagagaaaaaaactagcccttttcctctatgatattgtatatttgtatctccctgaacataaaaatgcacctggttgaattgaaatcttctttcccattgtataatgacgatttaggctcagttcgtttgtgatggttctcaacctctccttctcgatttccgcgcgcacgtttttcaaactactattttgatgcgttttttgtaaaaagtttttatacgaaagttgtttaaaaaaatcatattgtttcatttttgaaaaaaaaattagctaatacttaattaatcacgcgctaatggatcgttccgtttttcgtgccagagccaaacgttcccaacctgctctttcgaacagagccttagatgtcttctgcatgtatttggtagctgaaattctagcaggcttccagattagtcagtttcatccttctaacttgtgatcaaattcgttatgtgttgcagggagttcggcaatctgccatcatgcaaagccccagcaagatctctgatgcctctggctcaatgccccctgccacgtctgtgcgcaaaggttccaagaagaactgcttcactccattgttcctctgttgggctccttcgtcgacattctcgcctttgctggcacctgccattcttggcgtgctgccttctcatcatacccatcaaaatctgcctttcgcaccttactcccaccactcctcgtccgacccaatgtccgcgtcaaatccccttgtatcccttctaccagcaatggtcctcacaagctactacgctcatgtcaggtcattgatctagccaaccgaaacaccccgctccgctgccagattcctcgagaaactctgcagaagatgctttttgcaggctcttctcatggtcaactcatatgctgccgcagtggttactgtctcgttgttgatgtgttcaccggtgctgaggtttcaccaccacgtcttccattcagcaaggaccatgaggagatctacttttgtggcactctgacggctcctatcacgtcacccaactcacatctccttatcagcaaccggtcatctctgttcgattggccggttggaagtgactcctggtctgagctcaagcttcctgttaatcgggtcgatcagattgtggaattcaatggtcagctcatcgccgtgattgaatacaagctgtacactttgcagttggcccccaagcttcgcctgaagaagatgaaaaccctgtggtgggatgacatgagtgaatgtccatatttgagaccatggctagtggtttgcgatggcatgcttctcattgttgaccactacataactttgtcatttggagcaccagtcaactacagaccgtaccgcctggacatgtcagccaagcctgcaaaatgggtggaggtaaagaagctggagaactgggcactctttatcgggggtgatgcgagaagcccgccgtttgctttcaagaacccggagcgctggggagggaggagcaactgcttgtactatgctcactactcccagccatggagccttcatgggttgggtgatgatgcagatgctgtgtgggatcctaccactgatgataaccttgtgttcaaaagaaactggtacagtcagctgcaggccttctgggtgtatccaagcatgttctattcagacggagacggccagtgattggcacacgcacgagtgctctgctcttattagcttcttctgaaattgcccccttgtgatgtagagcagagacttgtgcaacttggcctagaaatctaggagatcctcatggtggtctttatgtctagtttaacacttgcagtcgttttgtagttcagttattagctgcattaccatctgatagtagggtgtgactgcactggatgcaagtgtagttaactagttgttgcttttccactggtgatggtaggtaatgtttcgttctgtaagggtttggaacttttgttcttcttcacagcaatggtttggaacactaatgtaatgcttgtgcactttgtcttgtgatttggtgctgctccaaattttcttgcaggacaaatagattttcttgtactgggatattttctatgtacttctgaatcggaatcacattggtaactttgatctgtaattttggagtttcaggaagcagaaagaagcctagtgttccggtaatgggttgataaacatattggggcaattacaaatttaccacagttttaaattgttattgcaaaactacattcgaatagcattcttgcaaaatatcataaaaaccagagtcttaagttagattaagaaaaacaatggacaagtttgcaaatgccccaaacgtataagatttacataaacccctctcgatcagatcaaatccactccccgcaaaaaaaaaagaaagatcaaatccactcaactgcacgcgtgtgcatgtttcagaaacggattcatcgcaacagttcgcattgaaattagactcggattagatcggtttcatgcaattaattgatttctccgtgcaaaccggtcgctagctcgctggacagttgtcgtcatcaatggcggaagaagatatcaacaagatgatgagctccgacggggagatatcatcaatggcggagagggcggcgagcctgttgcggcaactgatcgaggacggctgcgccgccgccaaacccctcgctgagatggtcgagtactgcgccaagcacgccgccggcgaagctcaaggtaaggaagaggaagtattagacggcgagtccagcgacgaggaggagacggacatactcaggctggaggccagcttgatgggcgtggagaacatgctcagcgcacggcggagctcatcaaggactaggacaagccgccggagccgtcgccggagaacgtccccttccacggctttcacagtatacattcatttattgagcactgctacacagactaaattttcttattaacaatcatctcaaccatcttattatatagtatatatagtaaaagcagcaagctatattacacgagaatgcgccacatcatcacaaatataatagccatcagataaagggtttgggtaaactatagccattggatcaaacggatacatgtattaaaaaaaacataaatgggctaaacatatggaaatttccggaggtttctgttacctcctctagacacatgataaaaatgagtggggataaagagagaagaaagatgaggtttctagtgatttctcttattataaccatatagtacaacttggaaatcaatactttgtaaaataaaattaacttattatatcaaagccttcttcaaagcttacctaaactaatagaccatatagaaaagttcttaaacagattaaaagtcacgcaaagcgtgactacgaggctagtttaatttagcactgctacacagactaaattttcttactctctccatcccaaaataattttcttactccatcccaaaatgcttgacgccgttgatttttttaaacatgtttgaccgttcgtcttattaaaaaaatttaagtaattattaattattttcctatcatttgattcattattaaatatacttttatgtatatatatagttttacatatttcacaaaattttttgaacaagacgaatggtcaaatatgtttaaaaaagtcaacggtgtcaaacatttatggaaggagggagtattaacaatcatctcaaccatttaatttagttatatgaaagttataaaaaatcaacgtacactcatagcgtgacacgtcagttttagtaagaaaatgttaatacgtatagccttttccttgtttatttattattagttaaagacattattattcagagtaattagcaatagatttttttattccttgtaaaagattttgaatcctgattaatgatttatagtattttgcaacggatttgctaaatgtgtcgccagtttttttaggtttatcaggttttggaaaataatatcgctcagcagataaacgtgccttcctgaccagtataaaaaagaaggcaaattttcagggaacaatgctttcatgaggaatccatttatgccgagtcaataaaccgtagttaaatcacacaagcagtatggctaaaaacttgatgacaacaaaacgaagatgatagatagatcactggttgatgcaagccgacgcttcttcattcaggattccagggatgtactcacacatgacacattagtgttagtgttagtaagagtttactaataaaatttcagtgagttagtaaaccattactaaagcaaaagacatgattaaatgatcgtccgattttcggttctggaaactagtgttaacctatctatcatgcgccttcttgatcgctaagagaaggtaaagtaaattgcaatgccaaggcgttccgctaacgaagtcaatcatgaaacaactctcaacaacattcatagtacaatttagcctaaagatatatatatattgtgcaactcatgcgtcacataacattgtcagctatataatgtaagtctggaactgtcgaaacatgaattcggcaataataaaaggggtagtgcacgagacctaaaagtggatggatacggagacaaggatttagacaagttgaggccctctcaatgagaggtaataccctactcctgtttgggaatttgaatccgccgggtgtagtatagatctgacgatcatatgtgctcatgccccctagagggcctcctgcccaccttatataggatggagggcaggattataagatagaaaccttaaccaatacggtatcggtttactaaatctactttacaatcttatcaaaccaggactttagaccgttccgtaatatacaaggaaacgtaatacccaagtcatgatatgttacatatttcatagatatgagttatctcctataactagtcggataaccatgccgtgtgggtatggggtacccataatctccacagtagcccctaagaccttcgcagtcgaaaagataatcttctcacgaactagattattccaaagccgagtgcttcaatcatcttcgctatgatctcccgagtacttttaccgaatcagaagaccgtggagggctgaaaaacaaagtcaggtgcatcgactagatgcacctaataggtgtagccccgactatgtggttaattgaataaaccaagcatacagtcagggaataaataatccaaccaactgagtggtttttgatcattatagttaaccaagtgacttgatatcaatatatagcatatgcggtatgaatccccaaataacatgatccaagtgatataccgactgctttgtaaaaattgatgcgagcaatctaaagttgactacatcattgaaaattcacttagcaaaacagctataaaaaagcttgaatgcagtgaataaagaaatttccaaagtattgggcatacaccatgcgcacactgctttaacagatgtgcttaagtccttaaaagacacatggtttcaccacacctggaaatatacggcatatgtggtgtaacatccgagtaaataaactcataaggatttaccaaccgcctggaaaatgaccacaatatataatcagcctaagccataatattggtcaataaaaatgcacacttacgtggcaaaaagcaatgatattgtatccaatcaattgcttgataaacccaaatagcgccttgactatataaaaaagtcagcggggtagctataaaaaacttcactgttgggcaccttttaaaatgcattgtaccaactcctaaaaagttgagtaactatggtataaaaagattttaaggtattgggcacttgatcacgcgcactttggcctaagcaaaaagtgcctaagtccctaaaagaacgtgacaggtcacacctgaaaatatgggctgcagacatattaggcctaggccaaaaaatatgccttcgacatcctttaaaggatgacgcatgtaacatgctcccgagtaataaatctttcgggtgatatagaccaagtgtagctcatatgaatagcttatgatctgagtgattatcccttatgggatactcccaaatagatataataattgaatcccgactggcgtaagtattcggttgataacccttacggggaataataaatagtccagtctttgagcatagaaaatattggtggtagtgaagataatgataccaatcaaaagtgatgaagttgcacagccgtggaggcgaataaactagtcgatagcagtcaggtcagccagcaatgaatatgaaggcgcccagcgataaagttgcatagccatggcagcaaaataatcagtcggtgacagacgaggcagctggtgaagaagatgaagatgcccattagcggtgacataataagtcatccgtgaaggcgaggatatcggtcggtggtgacgaaagcaagccgagggtgaagatgtagacacgcatcaaaggcgatgacgaaatccaccaatcatgaagatgaagaaaatagtcggcgacgacaaacgcaaccgacagtaataatgattagcagcaacaaagatgatcgactatgatgacgaagttgcccatcaaacagcagtagaataggctatgttgaagaggcttgacaggatattgatgaagatgacgatgtcggtaatccagtcaatagcagtgtagcaaccaatgataatgactaagacgctcatcagcgtttgcatagtaggtcaaccgtgaaggcgaaataacaagccagcaatgacggaagcaaccggaggctaagacgtagtcatccattagcaacgacagagatgtcagggccgatgaagtagaggtgctggtgatgaagtcagtgacaataatccatcaaactgttaagaagatatcaaagctcaagtaattttcttgatgtgtgcataacgaagattgatgcaacaccccttgatttgtaaagatggtagtagaacttggagttgtagctgttgcagatgcttcacttgaagaaaagtaaatactgttatccaactcatcaaaactgagctgattggttgataactctaaactcccggacatgtagatagaatctcaaactttgatacttggaaaaatttggagcagattgtggcggcgtgaagaagccaaaattgccggtgtaataataagagttgctgaagtagaacgtctgctctgaagtgaagaccaaactgatgactcccgaagtagattccatagaactcgttggctgattgattgattgcttcatcttgacataaagcttgtcgaattttgagagtcttgtatttgtgtagcccccgactctttggttagttgagaaacaactgaacatagagtcgagaattgtagcttcttgtcgtcgagtagtcattgcttgagtgaagatacgcatagaagatgtccgagtaaaaatcttgaatattggaacaccacttgttatagtaaaataacacggcattatacttgttgacgcatgccgagatgttgaggctcttgtagacgtcgtggtcggcgaagtagcaaagcttgcgaagtaaaggcaatagagtttgccggtgccgaagataataaagatgaagttgctcgaagaagtagagtgatgatgaaaacaaagacgttctttaaccgcggcaaaataggccagccatgaaagtgaagacgccatgggcggcggcaaaggcaaactggtgatgacgatgacaccagtcaatgttgacgaagacatgtagctgtggaggcgaacaaaccagtcggcgtcagacaaggcagccagcaatgaagacgatgacgtccatcagtagtggtagcggtataaaccagccgtagaggcgaggacaccagtcaatcagtagacaagacgactggcggtgaagactataaggccaatcaatagtatcataatcatgcagccatggaagtgaagaaaccagtcggcagcagacgcagacaacttgtgttgaagataacgacgcctattagcggtggcggcgacgtggccagccgtgaagacgatagcaccagttggcgtcatacgaggtggtcggtcggtgaagatgtagatgtctaacgacggcggcataataggccagccgtgcaggcggagacaccagtcggcggcggacgaaggcaagccggcggtgaagtcgtagacgcccaacaatggcggcataataggctggccgtgcaggcggaagcaccagtcagcggtggcgaaggcaagccggcggtgaagtcatagacgcccaacaacagcggcataataggccagccgtgcaggcggtgacaccagtcggcggacgaaggcaagtcggcggtgaagtcgtagacacccaacaacagcggcataataggccagctgtgcaggcggagacaccagtcggcggcggacgaggcggccgctcggtgaagacgtagacgcccaacaacggcggcatagtaggccagccgtgcaggcggaagcaccagtcgacggtggcgaagacaagctaacggtgaagatgtagacgcccaacaacggtggcataataggccggccgtgcaggcggaagcaccagtcggcggtggcgaaggcaagccggtcggtgaagacgtaggcgcccaacaacggcttcataataggccagccgtgcaggcgaggacaccagtcggcgacggacgaggcggccggtcggtgaagacgtagacgcccaacaacagcggcataataggccagccgtgcagggggaaacaccggtcgacggcggcaaaggcaggccggcggtgaaagacgtagacacctaacaacagcggcataataggccagcggtgcaggcggaaacaccggtcggcggcggcaaaggcaggccggccgtgatgacgtagacgcccaacaacggcggcataataggccagccgtgcaggcgaggacaccagtcggcagcagacggaggcaggccggaggtgaagacgtagacgcccaacaacggcggcataataggctagctgtgcaggcgaggacaccagtcagcggcgaacgaggttgtcgacggtgaaagcgaagatgcccaccaacggcggcgtaataggccagccgtgcaggcggaaacaccggtcggcggcggcaaaggcaggccgacggtgaagacgtagacgcccaacaacggcggcataataggccagccgtgcaagcgaggacaccagtcagcggtagacgaggcggccggcggtgaagacgtaggcgcccaacaacggcttcataagccgtgcagacgaggacaccagtcagcggcgaacgaggcggtcgacggtgaaagcgaagatgcccaccaacggcggcataaaagaccagccgtgcaggcggaaacaccggtcggcggcggcaaaggcagtgtaacgtcccgccttcccccaggccgggcccgcttatatctgatagctttcataggtcatataacgtcccgccttcccccaggccgggcccgcttatatctgatagctttcataggtcatagactgccctcacagaccaacacatatcttttctgcacactttgtcctcactcatgtgcacccgggttcccggtcggtcacccatcccaaattgctccaggcccagcacgcttaaccctggagttctttggagattggcttccggaaaagaagttgcaacttgttgatatgagtattctattaatcctattaagccctaggccgggatgttacaccctcacccccttaagagagatcgacgcccccgtcgatcaaccctaggccaggaacgtcctctcttggccacgtccatgtgtccagtgccagcgcatgtgccatgctgtgtaaccactccgggtctacaccagccatgcgcaccatgcctgcgcaactgcgacacacgcgcccgtgaaaccgcgagagtcggctctgataccattttgtaacgtcccgccttcccccaggccgggcccgcttatatctgatagctttcataggtcatagactgccctcacagaccaacacatatcttttctgcacactttgtcctcactcatgtgcacccgggttcccggtcggtcacccatcccaaattgctccaggcccagcacgcttaaccctggagttctttggagattggcttccggaaaagaagttgcaactggagttctttggagattggcttccggaaaaaaagttgcaacttgttgatatgagtattctattaatcctattaagccctaggccgggatgttacaggcaggccggcggtgaaagcgaagatgcccaccaacggcagcataataggccagccgtgcaggcggaaacaccggtcggcggcggcaaaggcaggccggcggtgaagacgtagacgcccaacaacggcggcataataggccagcggtgcaggcggaaacaccggtcggcggtggcaaaggtaggccggcggtgaagacgtagacgcccaacaacggcggcataataggccagcggtgcaggcggaaacaccggtcggcggcggcaaaggcaggccggcggtgaaaacgtagacgcccaacaacggcggcataataggccagcggtgcaggcggaaacaccggtcggcggcggcaaaggcaggccggcggtgaagacgtagacgcccaacaacgacggcataataggcctgccgtgcaggcgaggacaccagtcggcggcagacggaggcaggccggcggtgaagacgtagacgcccaacaacggcgacataataggccaatcgtgtaagcgaggctgatttgcatgtagattcgtctctctgattttgttgacatgatgggcttggtgcagccaaccggccttagaggtgttgtgtgtggcatgagcgaacgctgcatcatcaacatcagtagtcgagccacgcactatgtcctggcgtacccctctcggcaacatggttacagtaggaagcattgcaccgacggccatacatgcaataaaaaatcatgagaagattaatatgcgttagtaattaatctaaatatataaattacaaggaggtcaggaaccgcagcactgccaaatcccatcactcgttaatgaacgattttttgatctcaattgccatcctgggcatgcgaccaaccatgcatcgctccagtatacatgcaaaataaacaaatataatttgattagccttaaaatattacatgcttaactgtgtaatacatatatcaagctagggtttgatattaagccgtgcatatcagttgatctgcatgtgaagcactcaattgctgttgatcccatggacatgaattgttcccgtgtcgtatgaaggttacgccggtacctatacagatcgtactgggcgacgagaagacacaccgggacttcgtcttgatctcagccggtgcgtgaaaacaagaaaaagaaaggtaataggagattagtctgcagttagagaacaatctaactagtgaaacgacaaagccaatgacattggagattgaatcgatgaaatcaccgagattgatcccttcggctggattgaatccgagatgaaaaagacatgcttgatgaatctggtgatgtcgcacattggttccatcacactcgtgacaggaaactcgatgctcccttacctgacgcgccaactgtcgaaacatgaattcggcaataataaaagggggtagcgcacgagacctaaaagtggatggatgcggagacaaggatttagacaggttcaggccctctcaatgagaggtaataccctactcctgtttggggatttgaatctgccgggtgtagtatagatctgacgatcatacgtgctcatgccccctagagggcctcctgcccaccttatataggatggagggcaggattacaagatagaaaccttaaccaatacggtatcggtttcctaaatctactttacaatcttatcgaaccaggactttaggccgttccgtaatatacaaggaaacgtaatacccaagtcatgatctattacatatttcatagatatatgagttatcccctataactagtcggataaacatgccgtgtgagtatggggtacccataatctacacaggaactttttgtgctggaagtctggaacttggtactgttgaggatttccactggtgatgctagataatgtttcattctgtaagggtttggaacttttgttcttcttcgcagcaatggtttggaacactaatgtaatgcttgtgcactttggcttgtgatttggtgctgctccaaattttcttgcagcacaaataattttggagatattttcttgtactacgatattttctatgtacttctgaatcggaatcacattggtaacttcgatctttaataattttggagtttcaggaagcagaaagaagcctagtgttccggtaatgggctgataaatatattggggcaattgcaaatttgccacaattttaaattgttattgcaaaactaccacattcgaatagcattcttgcaaaatatcataaaaaccagagttgtaagttagattaagaaaaacaatggacaagtttgcaaatgccccaaacgtataagatttacataaaccctgtttacacccaaatttggcacctagagattaaataggagaaattgccaaagtttggaagtctgccggtttcctccgagtagggccggtctgaccgccgtgcgttgggctgtcagactgccggtttcgggccggtcagaccggcggcatgtggccggtctgaccggcaggtccgagtccgactgtgtttcgtcgggtctcaaggtttccttgctcgggaaggcatgtttcgggtttcctttggtttctaccccgagttggacgtggaggagggcctgtagagggcaaaaccaacccctatataagggatatggccagttcaattataactaatcaatctacaatcaatcaatcgaatcgtttttcatattgcttttaattttctcttagtttgtccatctttgtcgatttgcaccgaaaattgtccaccgccgctgcgagagtgcgacacccctttgttggtttatcctgaaaaccttccgttttgcccacgagacgggtagttatctagaaatcggctccgctagccggtttagttatcaaaacccatcttggtctagcttttggctagatcgaggtggttggcaactccaaatcaccgcaaggcgtttaggtgctgcgatcgtgcttgtcgacttttcacaaaaagttgccaacacgaattttggcgactccgctggggaaatccgttcaacgccatctcaacttcgacatcgccatgacgaagcctccatcaaccaaggcggaggtggatccatccaatgtgctgccggtgatgatggagagtcttgatgaggaagcacgcatggccttcgatgaacacatgaagaagtatgccgacgagcttttaaagacatgctcaaagacccgtcatggcgtagtcttcaagccggatttggtgtcttcatctacttttgacaaggtaagtattgaggaattatcacaatctcttcaacaacaagttgctcatacaatagatgcatctatggttgctttcaataacaaattagaagcatcttttgaaaataattgtgaaaagtttatgagaaataaactcggccctctcgtggccgattttgtaatcaaagataaagcctctaccagtgctagccaagctcctatagatcaaataaatagtaaaaccgatggagcgaagacacaacaaatcggcgagggctttccggcgcaaactgctgatcagaccgggccagataaagccactgccggtcagaccggccagatctggccgggtttcaccccggcggtcagaccgggactcaggccggtctcaccgcgcctatggacgccggtcagaccgggctctggaccggtcaaatcggcacaatagtgccgattcaggggatagattcaatgactaatgttagttatttgtattatcttagaacatttggtcctcctgtatctactgctgcaagtaatccccaagttcccccacatgttcctaatgcttataatgatgtttctagggggtatcctcctgatactaggcaaggccaatataatcatattgcgccacaacatcaacctattaggccaccaaatccaccaccaaatcaacataggcctgataatatagagcacttgattagtggaattattagggataaattcaggattgaagctaggaatcgtgctaaggtttaccaaaagccgtatcttgattactatgataatgtgccatatcctcgtaattatagggttcccgaatttaccaaatttagtggtgaggatagtaggactacatgggagcatgtaggtcaatttttagagcaatgtggagaggctaatagtgatacttttaaattgcgcttattttctttgtctttgtccggtactgcttttacatggtttacttctttaccgacaaattctattcatacttaggctcaattagaatagatatttcatgattatttctatactggtgaaattgagcttaggttatctgatttaacatcggttaagcaaaagtataatgaacctatcattgattatgttaagagatttagagatgttagaaaccgatgttatagcttgaacataactgatagagatttggctgatcttgcttttaatggtttaattactcctattaaagagagattagatggccaacaatttattgatgttagtcaactcatgcaaaaggctctggctcaggaaagccgggttaaggataataaaaaatctgttagaccatatgagaaaaagcctaatgttaattcaattgattactttgaggctagtgatagtgatgatgagggtgatcatgacatatatgttgctgagtggacatggactaacaaaaataagccttttgtttgctctaatttaatgccgactcctcgtaaagatcggcaaagtgagattaagtataggtttgatgtggccaaatgtgataagatttttgattatcttttgcaagaaaaacaaattagattacctaaaggccatattgtcagggttatggataccacatacccaatagtagttgactaaatctcggcaggacccaccacataccatgtcttatacggaaactgactttgagttggaggaagttctggataaggaaagacaactagagttctatatggaaacggcaaggactagtcggattgtatccatattggactccctagttctacttggacaaggggacacctatgggtataaatacaagaccccctaggaggagaggggacacgcaacaatagaaggaacaacagaagccaacatacgccaggacaagccgccggatattaacatcagagatatgcctaggaggaccctatctggtacctatggaggccggctgtagggatctagcgttatctctgatctcgccgggcacgagttcgaggaggaagactaccctgttgtcgactacgagttagcacttcagactgccaagtcgacaacagatagataggctaccacaaatattgtactggtgtgattatggtgaataagagcaacgatcggcttcggccaacaggatgtagggttattacctgacaattcaggggcccgaacctgtataaaaatccctgtctatctcttttacctcaatctcgcgtatatcctagtaccaacgatccccatactatgcaaataccggaatcgcgacatcaaacgttgacacatatcataccatctcaagaagaattgaagcgtcgagcttattgtaaatgtcatgattctcattctcattctactaatgattgcaatgtgtttcgacgacaggttcaatcggccatagatgaaggacaattgaagttcactgatggttccaagatgaagcttgatcatgatcctttttcggtgaatacaattaatttcaatgataagaaggtgttgattcggccggagcaagccgaatctactaaaggaaagggagtgatcattggtgaacctaggccaaagatgatagtgccaaagaaactggaggttggtgtatggaaggagaataggagtgaggcttcaacttctaaagcacctaggaagactaaagtgactttggacatgcttttggagaagtatgagaagcaaggtggtgagagaactcgcaacaaaggaaaaagaccaagatcacctcctagggagcgatttggtcattcaccaaaacggtcgcaatcacctccatatcatcattcacaagacatgtcatggggaccttatccaatgccgccaccgggttatccttatccttactacatgccatggggggcaacaccgccaatattcaaccatatgcctccaatgcaattcaactaagggtggggaggaccaaggaggccaattcatgagcgcttgtcttcaccaaataatagccggttttatggaaaaaatcgggttaatgaagaaaagagggaaggaaagcgtgttaaggtggaggcaaggacttcggaggtgattaccatcaaagtgggatctcatgatatgccaataccttctggagatggagttgggaagtcatcaagcaacaaatccgaaattgggaccagctcatcgcagttggccggtctaaccaggccctctggccggtctgaccgtagctctgcggaccggtcagaccgggccatcaggccggtctgaccaccgacccaatgtcggtctgaccggcgcttctagccggtctgaccggtggtctacgtccggtttgaccgggcttcaacgccggtttgacaggaggtttgaaaggagtagtgcaggggcttcattgtcttcaagcaaaatcaatagggggcattatttacctcctggaacagagccgaaacctaggtggatccctaaggatttaacggctactcaaaggagaaggttgcagcatcttcgggcccaagagataagagagaaaaaggccgaagagcaaagagataagaggttcaatgaattgcgaccaccaccttttggaggcataaatccgtagagagggaagaaccggttgttgtagaggagaaagaagaacaatcggttgctaaagatgagtcatctccaaaggaggacatggatatcaacatggtgtgtatgttgcctatggagttttgtgctatggatgaagccgaggttgctcaattttcactaggtcctaaagatgcggtttttgagaagcccgatgaatcaaaccgtcatatgaagcctctctatctcaaaggtcatgttgatgggaagccagtctctaggatgctagtagatggaggtgtcgccgtgaacttaatgccgtattcattattcaagaagttggggcgtgaggataatgaattgaagaagaccaacatggttctcaatggcttcaatggtgaaccaatggaggcgaaaggtatcttttcggtggagctcaccgtgggaaacaacacactaccaaccgctttcttcatagtcgatgtgcaaggtaactacaatgttattttgggtcgttgttggatccatgccaattgttgtgtgccttctaccttgcatcaatgtttgattcaatgggacggcgatgatgttgagattgttaaaacggatacatcggccgaggttgcaatggccgatgctacatttgaatggcgtcatgggaatatccaatgcttatcggggagggatctttctagctatgatttcattagtatctccgatggcaaatttgtacttatctctgtaaagccggctagtgtagcacggctaggctatataaatttgtataatgagtaaagaagctaatttagagtggttgcaaaagagggtgcaagaatatcggtctacaaagaacgatattggtgaaactattgaagattttgatgaagtagagaagcttggacaagggtttacatcggccgatccattggaggaaatagacataggtgatggaacaaagccaaggccgaattttgtaaacaaaaatatgagagccgattataaggttaaaataatcgagctacttaaggagtatgtggattgctttggatgggagtatcatgagatgccaggtcttagccgtgagtttgttgagcatcggcttccaatcaaaccaggttttaggccttataaacaaccacctcgtcgttttaatctttgctatatgatcgagtcaaagaggagattgatcggttgttgaaggcggggtttattaggccatgtcgttatgcggagtgggtttctagcatagtcctggtggagaagaaggggagtggtaagattagagtttgcatagattttagagatttaaataaagctactcccaaagatgtatatcctatgcctatagccgacatgatgatcaatgatgcctcgggtcataaggtgattagttttttggatggtaatgctggctacaatcaaatctttatggcggaagaagatatgtacaagacggcttttaggtgcccgggatttgttggtttgtttgagtgggttgtcatgacttttagattgaagaataccggtgcactatatcaaagggcaatgaatttgatctttcatgatttgctaggtattatcttagaaatctatattgatgatattgttgtcaaatcggatggtatgaagggacatatagccgatttgaggttagcttttgagaggatgcgccggtatggtttgaagatgaacccacttaaatgtgcttttggtgtgtcggcggggaggttcttgggattcatggtgcatgagagaggggttgagattgatcctaagaagatagaaaagattcgtgatttcaaagcgccgacatgcaagaaggaggtccaaaagttgctaggtaaggtgaattatttaagaagatttatttctaacttagcgggtaaaatcgatgcttttgttcctatactccgcttgaaaaaagaagccgattttacttggggggcaaaacaacaagaggcatttgaagggttgaagaagtatttatctactccacccgttgtgcgggcgcctaaagccggaaagcctttttggttgtatattgcttccgaggataaagtcattggtgctgttttgccgcaagaggaagatggcaaggagtatatcattacatatttcagctgccatcttttggatgccgaaacgaggtatgtctttatagagagactttgtctatacttatactatgcttgtaccaaattgaggcattacttgttatctagtacatgcatagttgcttgtcaagccgacattattaaacacatgttgcaatggccaattctaagtggaagaattggcaagtgggcatatgctttgattgagtatgatttggattatgaaccgttgaaatctatgagaggccaaattgtatgtgattttatagtagaccatcatgtagatattgcttatgaagaaggggtttgcttagttgaagttataccttagaagatttattttgatggttcttcatgcaaagaaggtcaaggtatagaagtagttttattttcacctaatggcatgtgttatgaggcatcggttcatttggagtattattgtacaaataatcaagccgaatataatgctttattattcggcttacaagtgatggagatgattggagctaagcacgtggaagcttttggtgattcggaattggtggtgcaacaagtcgccggaatctacaaatgtttggacggatcactaaataggtatcttgattcatgcttggacattattgctaatttcgataattctagagcaaatgatttggcacaacaagcatctggctataatgtgaagaagggattatttctgatactagaagagccggtgcttgatttttaaacctttgtgcaaaattggcaaaactggagaccaggggcggtctgaccggcgttgcacggccggtctgaccggtgagcaggggcggtttgatcggccacatgccaccagtctgaccagccaccccgggcggtctgatcggtcttgtatggctggtctgaccgattctggacagagcgatggggggcacgccgcaattgattcaaagaccgaattagctgtgaattcggacatttgtgcccagggaacagaagagtccagatcggctacgaccagatcggctgagtccaagtcagatagggttagccgatacagccgattccgacaatatgaatcggtttacattatcgagctgagttaatgtgcttcacatggattgccacacatggatagagttctaagaaggcaattgtatctattaattaggatattttatgtaatttccttagagataagtttgggcaaaagtctgctgcaaagacttatggtatcttagagtttgttagagataatagtcgtgtccgacaaaggacatattttgtagtctcgggtataaatagaccccgagtcccatgtaatcaattaacacacgttcaaatacaatcttggcgcatcgccacccttttactttcgttttgtttcgacgagttcttgctttcgggttgaactgcatcggtttcgatcttcaactagaggtatgacttgttatggtggcttgcgttctcgagattggtgcttccatcattatgatactctaatcctatctatgtaagttgttgagttatcatatatcttatataatctctgacaatatcgctatctaacctccaatcggctagtgtctatcgctggagagcagccgattaggttaagtatcgacgttggcttagattatataggatatctaccactttatgaagcttccaatagcttgattgcctaaatattgtctttcttttcatacttatggctgcatcagttgagtttgatctcataagtcgtgcttagaactataatctctagcctgcttcttggttgtcgattagagtagtatcggggtttcagccgatcttacctaatttagccttatatttcatgtgcttaattgatatgttaaatctgccctttatgttaagatcttattgcttttaggtgtgttaaactttacgtttgatatattttacttgctttaatatcttaaggtagagtagtatcggagtattagccgatacaagctagatctatttgatcagctatgctgtgaatgattatagtttccttgttaatatatatttcggtctaagtgatttatactgtctcggcatggcgaccgatctatcccaattacttgatttaagtatatatcgacatgaagattatttatcattgatatctacagccgattgaatagatttagtttctttattattgcctcgcacagccgatcgatgcaaagatgacatcggctcgagtacaaatgatacgtcatcggcggctggtcgatcggctatcatttatggactaactactatttctttgtctttatttcttgttgattgcaggatcaaatcaactggcatgctcatgaacctcaaaggcaagattttggacctgcactagagttaagcagatctcccaggcctcgtgtttttacatcaacactctcttggcacgcccggtgggacctgagttttcaacgacttcatcccgatggccgaaaaaccaccaccatcaccgggaacaggagtcaaacctcccgtaaataaaatgggggccaaaaatccatcagctgaagtggacccaaccaatattgttccaatcacattggataggctgacagctgagcaaagggatgaacttgaacagatgatgagcaacgtgaagaacaaattcatggattcttttcaggagacccgcagaggaaccatcgtacaaaagtacaagttgaaggtggtcgcagccgatgaggtcagcccaagttcatctcagggtgacaaaggtactgcaactggctcaggtaacaaaagtgatattcctcaagatggtacagttgaagaccttggtgcagatggcaaccaagagccactgcaattcaataattttcaagataggatcgactatgccgtgcaacatgccttgatcaatcagtctggagtattagttaataccttaaccaatatggtaaagactgttgtcgatggttcgatagccgaacatcaagcttcaggaccagtctatttaccaggaggtgtttttccaaattatagaccattggtcacagcaaatcagtcgaatgtctcccatgcattaccggctcagccgatggcttcagcttcaacttctgcacaagctacatcatcagtgtaacgccccgattttcgttcgggattaaaaatcattaaataatgcattttctagaaattaaataaaagttaaatcaacttaatcaagtgaattattgggagaattaaaattttcccttaaaaatcattggccgggaatattttgtaatatcctttgtgccctaaaatactctccggaattttccgtgaattttcggagctcaagaaataattttaataacacaaagatcattgtatcaattaaaataaaaagaaaacaattaaaatcctctttcctctctttgggcccctttcggcccaacccctcctttctctccctctcgggccggcctcctccctcggcccgctcggctctctctctccctcaagtctgttttgcctccccagccggcctctccctccctctctctccgacaggtgggacccgtggaccccacctgtcatccccaacctcaggccggcagctgccgttgccgccatggccgcccgagccgccccacgacgctgccgtttccgcccaccttcttcaccccgcgcgcgcgcgttcgtccgtgggacctcgccgcccacgtccgcgccgttttcccccatctctcccctccaaaaccgccacccacaccccacgatgccgcccacgcttcccggcggttgccgcccactccgccgcaaaatccgcaccaccccgccccttccgctcgcgcccaagtggtggaactgcacccccaccacctcctccaccgtttcccccatttccccccaagaaaacggcgccggtttgccccgccacgagctccacgtcgacaccccgcttcccgccggttgccgccccaaatccacctcgctcgtgctctctcccaccctctcgaggctataaaaacgatccctgtgctctcctctcccatttccccaattttcccgggcccgtcgcgccttctcccgctctccccgcgtgaacccgagctccgccgctcgtcgccgtgcttccagccgcacgccaccgccgctccagtcgcccccgcgctgcgccgccaccatcattggcatcgccgtgccgtgccgcaccccggcccctactccttttcccctctccgcctccgaaacaccactgcaccgcgcgcccgagccccgccgcccgccagcgccctccagccggccgccaccgtcactcccgccgtcgctgctccgcgcaactgtcaccgacggcttcgttgcgtcgtcccgtaccccggcatcccctccgctcctccattccgccgctggaaccgtcactccaccacaccacccgaaccgccatcatagcagccgcctccggctgccactcgccgccgctccaaaccatttccggcctcacgtcctcctccagtggcatcgcagcgtcgataggaagcccggcgttcccctcatccgagctccccgtcgccgatgcccgttcccgccacgcgaggtcgcggccgccctcgtccgcttcctcccgggcgccgcttgtcgccggagcagcgacgccatcctccgcccgagctccgccggccgccttccgtcgccggcgcccctcggtgaggaccccctccatctcctctccctttcccctcttttcgtcgcctcccgcgcgtgctgtcgcgccggtggtcgtcgccggcgaccatcgggccgtgcgccgtcgctcccggccggccgatcggtcagccggctcccgctcgcccgtggccgcccgatcccccttcggggcgatctgggccgtccacgtggccctcccgtgccgcccgagtcggtgcctctgtggcgccacgtcggcgccacctccgctagccgtccgtcgtggccgccaggtgtctgccacgtggtgcgcccgcggaccagcgcgtgcgtggactcggtccacggtgtgcccgccacccgtgagtcaccgacaggtggggcccgcttgccggcgccacctctcccccgtcggatgacgtcataattgatttaaattgcgcaataaatcggtaataattctagaaatccattaaaatggctcaaaacttccaaaattcatatctaattcattcgaattccgaattgagccattcaacttgcaaaattcatctaaaattgagctctacatgtttgtttagtttttatgtactgtttccttggtttttattagagtttttcctcgttttgcgtgccagcgtgtagaatccgtcgtttcggaagtccgcggtcgcgaggaaaagagtttagaagatccaagtgaagaagcaaggcaagtcacacattccccttgagcatgttgatcctaatttataaatgttttaccgtttacaaataaatatgcatgttttgctaattacacggggtcagggtttacctatctgctcgcttgtgccatgtttacttgatatctatcctttgtcaaccttgggtgataaattgactagctcgtgttacttatgtgacctagctagaactatatgcttagccatgcttaattaccactagctcagtcgatgggataattgcagtattagacattctagtatcttgttgagctgcgtgctcgagacgtctggccatgtttcatggtcgtaattatccaactaaaatacgactgaatggtgggctgtgggtgcatggttttgcgagtcgcacccatggcaattaaggaccggttcacgagaaaccctggaagacttacagtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacacggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacttaataaatcgacccaatgcactgtagtacaggtgggttggttgggcctgttcaacgtggtgtagcgttgatcagtggagattttaatgtcactttaattattcaacagttttactgtttgctaaataaaatgttttacaaccgcctttatgcaaatagccacaaacccctccttgtatccccttgcacgtccgcatcgttggtgtggcttgctgagtacggtggttgtactcagccttgctattattcccccttttcagaagtgtagtgcttctgagctgaagacgaagttggaagaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtatattacttgtcgttttgtgtaccctggctggtcctggacagggatttaatacacaaaatagtctggaaatttgggctaaatttctgggcgtgacaatcagcaccaagacagatggttaaccccagattgttgaccagagaacaaccacaacatgctgggcaaaatgtcaatcggctgactcaggagcaagttgctgcaatgttcttgccaaatccgacaatagccgacccaacacagccgttgccgactcagcaagcacagccgaggtagcagacagttcatccgactcagcagcaaaacttacaacatgcgtcagcgagattgagaacacctgacaatcggccaatgcagcatactgtgaaccaagttattcctgaacacttggtccatcatgtacaggccgatcaatcagttgtgcctcagattatccctgaacatttggtacgtaatattcaaccgaacttctagaactatcaaggaagaaatttgaattatcaatatcagcctctgtcacctcatgtttagtatcagcaggcaggatcgcctcaacctcagtttgctcctcagttcaatcagtttgagctaatgcagcaacaaacacaaggagtacctcagcaaacatcatgggctgatatgattgccgatgtaatgagggagcaggttgggttcaaaccaaaagatactggaaatttgtatcggcatccttatcgaatatgcggcatattttttggaaattcggtaagtggtctcctagtagggaaggtccttatcgaatatgcggcattgttcgagggaacgcatattttttggagacacttcaaggggagccttttcagcgagcaatcaacgggaaatacttgaagaaatacttcccgagcgtttggcaagacgcttaggaggtgctatggccagtaattggattatcgccctaagaccaaaaacatgttctatgcttttggattcacgttgttcataaaaaaggtagggggggcatgtgtttacacccaaatttggcacctagagattaaatagaaaaaattgccaaaatttggaagtctgccggtttcctccgagtagggccagtctgaccgccgtgcgttgggcggtcagaccgccggtttagggctggtcagaccggcggcatgtggccggtctgaccggcaggtccgagtccgactgtgtttcgtcgggtctcgaggtttccttgctcgggaaggcatgtttcgggtttcatttgatttctaccccgagttggacgtggaggagggcctgtagagggcaagaccaacccctatataagggacatggccggttcaattgtaactaatcaatctacaatcaatcaatcgaatcgtttttcatattgcttttaattttctcttagtttatccatctttgtcaatttgcgctgtaaatcgtccgccgccgctgcgagagtgcgacacccctttataggtttgtcctgaaaaccttccgttttgcccacgagacgggtagttatctagaaatcggctccgctagccgatttagttatcaaaacccatcttggtctagcttttggctagatcgaggtggttggcgactccatatcaccgcaagtcgtttagttgctgcgatcgtgcttgtcgactttttacgaaaagttgccaacaaacccctctggatcagagcaaatccactcaactgcacgcgtgtgcatgtttcagaaacggattcatcgcaacagttggtttacgatttcgtaataagttgaaattagactcggattagatcggtttcatgcaattaattaatatatactaataaaatagatgatcgacaaagcatattactaattgatttctccgtgcaaaccggtcgctagctcgctggacagttgtcgtcatcaatggcggaagaagatatcaacaagatgatgagctccgacggggagatatcatcaatggcagagagggcggcgagtctgttgcgggaactgcggcaactgatcgaggacggctgcgccgccgccaaacccctcgccgagatggtcgagtactgcgccaagcacgccgccggcgacgaagctgaaggcaaggaagaggaggtattagatgatggcgagtccagcgacgatgaggaggagacggacatgctcaggctggaggccagctcgatggacgtggagaacatgctcagcgtggccgcgcagcgcacggcggagctcatcaaggacaaggacaagccgccggagccagagccgtcgccggagccatcgccggagaacgaccccttccacggctttcacagtttgcattcatttactgagcactgctacacggactaattttttttattactaaacttttactaataatcgtctcaaccatttgatttaggtatatgaaagttatgaaaaatcggcgtacactcatatagcgtgacacgtctaccctaaagttcaacaaatatctaccctatagttcaacaaaaacaaattctttcactcattcactcatcactcattctttcattcctcactcaacggtccagattacctcactctgatccaacgctccggattcaccccacctccctccccaccctgacagcccgacctggtgacctgcgccccctcccccaaccctaatccctcctcttcccctctcacgcgctgccgccgacgcccttcacctctctgccaacgccgcccgcgtctccgcgccgacgcagcccgcgcctccgcgcatcgcccttcgcctcgccatcaccgccgccgtcgattgcctccaccctctttgatgccctatccccgccacgcgcagctgcctcgccggggatgacctcgcgtcagtgacagtggtccagtgctcaatttgctgctcggtctgcgttgacactactgaggtctacggcgaggctactcccctcaggtcttatctcaatcccccgcctacggtggtgtatggttcgcatactttgtagtgtcctgttgaacttcgagtcatttttctcactaagaaaatggtaggtgataagatatcaggtacttcggttttattgtctctcaaacatcagtagttcggttgtgtgtttaaccaaatgaagcataatataatgtatattcttatgacaatgtattagatcgaacaatggtttttttaggagtattaatttggcactgttattagatccaacaatggtttttttaggagtattcaatttcaatgtaatctggttcttgatctacaaagggttcacgtgtactgtgttggcttggggtccagtctcctcctcctgcacgtgatgtgtgctgaacacggcggagaaataatggactgccaacatgatcggacaattcattgcttcctttagtttaacttgcagtgtgaatgattttcctattaagaacgcatgaagtcagaattaactgaaagaaagatattgcgtgtttaattaaactatccacagaatctgagtaattcagttcattttcttcacattcttttcaagaatagtctctgatatttcgtattagaattgcatgcatatatacaaccctgtctaattatatctgttcaaaataatttcagccagcttgacaagcaataatttctcaggaacctcaattggcaatatcaccacacttctaggaggaggagaggctgctccgcgggcttcgtagggatcccggcgagctcgcccccgtgactcctgcttcctctggtgtggctaaatcagttacggctcctctggggctttgcttgtgccttctgttctgattaggttaggacaaatttgtaacggctttgtggtctaacatttgctctgtgcggccgaattttttggtggccctataataattgagttcaactaatctaccctttagagcaactcaaatatcgatctgtcttttgttaatccaagcaacacatatgctgcaatggataagaacaaagaatatggtgctgttataatttacatgtttagaaaaaaaaactaatgcagtaaacacaattattcatggaaccaatgataatttacacttgctatggatataatgtcctgtatatttcagaatagagtaaagtgcacgagcggtccctaaacttgtgcgggtgtgtcacctaggtccctgaactctcagaatgcacttttgggccccttaacttatcttgggtgtcatataggtctaaatgggctccaactcactccgtgtgctaatgtggcatgccatggtagcgcctatgtgtcagtagaacccatatggcagcgatgcggtcacaagttccaccacggtgagtgcctttctgcgttcatatctccctgtactgatttgatcttgactagcataattatatgcctccctagaatttggcccagagaaccccaggtattcatttttttggcccacgaaaaaagcctagcccatcaaaacaaagaaaaccctaactcctctccagtctggctgtctcccccgtgcgctctctcccctcccactcgacggcgtcacggcgacggcgctcccatgacccggtgacctcgacgcgagccgtcaggctagccgccggcgtgactccggtgctcccgccgctcctccaggctggccagctcccgccaggccgccagccgcgcgcccatccgtggcggcagagccgcgccagcgcccgcgcggccgcgtcctctctccgtcccgccgcgtcgtccggccgtccaggggcgggcccaatgggtagtctaggtaggcccaggactaccctagaatttgacccagagaaccccaagtattcatttttttagcccacgaaaaaagcctggcccatcaaaaca

SEQ ID NO: 58681 - DNA, 810 bp, Oryza sativa
tgtttatctcgggctggaacaattgcgctcagctcctacattataagataataatattgacaatgaatgaaaatcagtgtgattacgaagatatgttaagtcagacataagtaacaaagtcacaaagtcgtgtacctgtagtcccaaaccccagttgttgagggcctgcagtagaatagtgacaaatgaaatcaatcaaaatgatgattgatgaaaaataaaaggcaagcacacaagataatgggatttggatgcaaaggtctaacaaacgttcaattgagtattagttatattgcccattaaatcagccaattgagaccatcctaacctgggggctgttccaatttaactggactgccttgtcataattcattatagcctgtagaagaaatagacagaaacgatcaattagtaagacatgatctccaacaagttgaaaacaatataataaaagtattatccataaaattcaagtaaataacttcaaggcattttttccaaagtaaatgtaagtcaggctaaccaaattataataaatccttactctcaataaaatatactatctaaccaaaaggaacaatgatagaaaaagaaatcagatattatgtttggttcagtgctgctagagtgctaagaattgcacgcccactatttaccgtggacagtattactagtttacatgtcaatgacagcaaaagaagacaaccattttacaaaccgtacttgaaccaaaacacttcaacaaatgcaggcatattcctatttcatcagctcacatttgggtttgcaattcaaattgttcaattttca

SEQ ID NO: 58682 - DNA, 6538 bp, Oryza sativa
  unsure (1)..(6538): unsure at all n locations
gctcttagagtagaattgtttactgaagaagcatactggtactttttcaaggtgtgcacagtcggaagcatggatgaacaggagcacccaaagctggcatcaatagccatggatatggccagggagttggatgggtgtttcatgggtgcaagcatctacagtgtacttctgaaagcaaatttcaacgctcggttttggaacatggctctggcaagcatcaaagaattcaagcaaacgaacctcctagtatacggcgcatatattgacaatccttggcagacgtctgaaccgacatatgttaggacggtaaacagaatttcctctgaataccttgtgattcttgacgactatcagacatgtcccatccaaatcacaaaccctgctcagagtgaagctgaagttcctgaggtgaatattcaagattttctctttgcgagtgttatacctcaaggaaaattcaaggttcttgcatggacatctcaccttccacctcactacaactacatgctcagctgtgaggtacagaggaaatatcgtatggtcgccaaaaagaagagatcgcaggaactttgcacctgacagtttgattgttttctgaagctttgtaactgaccatgtcagaacctgctgtataatgcaattatctgaagatgtcatctaaaactgagtttgtgaaatattttcacctactataatagccactaagatatatgtttctgttaaacttttgtgcttgggagatgttctagttgtttctttcttcttttttggctgtgtgcattttatgcagaggccgggggtgactcggtttgattgtatcatcttgatgtaattaactgagtctaaataaagtttccattatctaaaaaaactatatgagcgagggcgtagtccaagctcctatgtaagattactatttgtaagaggttgtcaaactcaattcatcagcatctattaattttgtactgtttgaagtttgaagatttcaacatgctgagaattgatagctactgattgatcctataggacgcggcctgaatgaacagttatacactagaagttatgtattttccataaaattgatttgatggttgtttggatgatttgacttgacatattgaattcaagcttgaaatttgaattcaaaaagtttctaggaatgcaagggagtttgtatgttggatgaatttaaataaattttgaggagaacataaaacaagatgaaattttagggagatatcaatgaatatttgaattcaaatttataatttgatgtccacacagtgttaagaataaggagttatttggattagtatatgtcctatttcagtgaatggggatattttaattaattttgtaatggttttacaagggagatgtaaattccaaaattcgagttctgagatttttgttaagatagaatgttttggatcaaaattttgggtttactaggaatgatttaattgatatcttgccactaattcgttgatacacacaaagaatcaaagttttaaaattatgctttttaattaaaataacttttagctgctaaacaaaagtcagggtgttacaatctctaacctttctaaggtgttctctctttttttcaggaatacgctaggagcatatctttgtattaagaggaataaaagctatttacaaatcaaacataaattttgaaggggacgggataccggagcggaacaaaggacttaaactacaatctcacaaccaattaagatgacctagggactcataaaaatagagaccaagtgccggtactaccacctttgctaggcgccataactccgcctccgcagccattgttttcactacttccacccatggccactgttggaggttgaagacctagttgtttctctccttccagatcatccaagctactagtgccacaatggtatcaaatccctgatgacgatctttcgcgacttttttcctgctaaggcaaagccactaatggaaggaggcctcatgcaaggggaggcaatctggctgattaatcaccctgagaacccaccgccagagctagcgggattatgggcaatcaaccaagatatgatctatactctgttcatgttgattgcaaagaacacagtggacagggtgggggagccccggccccgatggcgaagacgatcagtagcctagcatctattcgctgcgaccaaaccagaggaagtagcgacagcggggaggggccagtggcttccagattgtaaggtgttctcgctcgtgatcgaggtacttaattgtaaagaatctatagcacaaaaaaggaatttcagaaaagttgttagctggtcagctgccattccggttgcgaaagattgttggtcatcgttgagctagttgaggatgttgatgacgacaaatggagaaggatgtactcttcttcacgaagttgcatttcagctggaagcaaaatcataatcacaagcccatcagacaagatcgcaaagcttggaacaaactcgatctcttcatgtgaagtttctgtcacgagaggcttattggtacttcttcaaggtgcttgcattcggaacctcaaatcctgaagattaccctgagttaacatatgtatcaataccatgccaacgtgccatgtaggcatcacgtacaataaaaccgtcactgaaatcgtctaggaaggaaaaacgagccaattttaaatgttaaagagaggttatatacctagttttgtagttgagagagatgagaataagactcatcacgtcctccgcgacaagcccgtgccgtccgatgccccccgactcggcttttctttttctcccctcaaatcttaatgaaattcggtcaccggtctttggctgacccggcaaaaaaaaaaaaaaagagagagataataagactcggcccatcgatgagggatgagcaatggactttctcataggaaaaggaccacgcgcaaactccgttcggaccagcccatctaccagcgggccctccttcccacttcgccggcgttggcgagctgctcgtcggcgggcggcggacggcggcggcgctccggtggtgggcgccctagtaggctagtgctctgcctccaactcccctgatttggcagcgattgatgccgtccgccatgaagccgagctcggccggcggtggcaagtggccgcaatagccctggctggatctggagacgtcggcaacaatggcggcgccggacggcgatgccactcctccgtcctgctcgtctaattggcgatccaaaggttacttaattttcaaggatttatagcatattctgaatattttatttttcccatagcagtcaactattgatctccaaaaggaatttcagaattgcggctaccataatcgttgaagaaatgtagctaaaaaaaaaaaagctctctacctttttcagtcaaaaaaaaaatgtagctaatcagctgattaaggatgagacagcaaccgcagttcgaaaaactattggtcaagccaacaaaacaaaaatgtattttgtatttgggcataacagttgtgctactactactagacaacattatctgatgatcctggcttggaataggatgggaaattttcaacagttgggaaaattggttggtaccaatggttttaagaagaagcatcaatatattcgttcctattacgtcaaaacaatgaaggaatatgactgcttctggcaatactcaaatgcagaccaataggcatcactactgctatctttgccagctgtgctatcagcagtttccatttttatcagttttaacatgctggctttcataataaaatggtttaaacatgtattttcctcatgtttgtcaggtcattttgtctagtatgcagactgttcaactaaaaatacacgtgcttgtgaaacttgaccagagatctatggtgctgaactaaacttgtagaatttcctttgctgctgtcgtcgtctcagctatgtggtcaatcttcgacggttatattaatccaaaccgcagggaaaaatacaaacttgaattcaaacagtttacattcaaaagcatatctaggttcagacacattaaaaggtatacggtatatctatgttctgaaatgcatctctctttatggagacgtggagctactcgagtttgacgctgccttaatctctattcctattacagattttcagactacaaagtttctctcaggtcccagatcttgttgatccgttgagtaatccacaaagttagagactacacagtttcacatggagatatttctgtctgccattctgggtgatcttgccagtagatccatatcattcctgatcaacaagtgctcgaaaccgacagtgctaaccgtggaggagaaactgcaacggctgctgctccaggcatgtttcatcgtggaggagtcagatgaacggctcatcataaaccaagccatgctgcagcaactgaacatactaaggaaggagatgtacagaggttattataccctcgacagcttcagatgccatggtcatcaagaatataatcccaaagatcttgaggtgagtagctcttttgcaccatcgatgttcaatcctgccaagcgtgtccggttctgcagggtcactggccagagtgtacaagagcatctgctgcaacaagtttttggcagacttgaagtcaccattgaagatatgagtgaatttgttatgttcctgaatagttatccacgcttttgccgtcagccatatagcatgcacttgcttttagacgagtgcttgttcagtcgccaaatggagatggagcacatcatgaacttcctgctgaaagaggataccaccggtactgaaaatccaggtgtcctgccgatcataggtccaggaaaagttgggaagagcaccctgattgaacatgcctgtgacgacgaaagggtgcgtaaccacttctctcaaattgtgcttttcaatgacgacgatcttgaagatgcaaacatattgactcttagagattctggtgtaatcaagcatcaaaaccatgccactggtggaaaaaggatactaatcattattgaactaaccagagatatcaatgagggtgcatggagaagattgtactcagcttcaaaaagtcatgttgcaagtggtagcaaaattatagtcgcaagccgatctgaaaagattgcaagctttggaaccacacaagctcttagagtaaaattctttactcaagaagcttactggtactttttcaaggttcgcacatttgggagcataaacgcagtggagcacccaaagctggcaccacaacaatnaatatgccaagggaattgaatggttgccttcatgggtgcaagcatctacagtgaacttctaaaagcaaatatcactttcagttttggaggagggctctggccataatcagagaattcaagaagctcaatctcttactctacggtgcatatttttttgatgatccttggcaggcagttgaaccatcatatattaggaccgtaaacaaaattaactcggaatatcttcttgttcttgacgactatcaaatatgttctgctccgaacatgattcattgtcacaaaaactctgctcacagtgaagatgaagttcccatggtgaatgtgaaagattttctatttggaaatgttaaacctcaggaaaattcaaggttctcgcctggagatctcaccttccacctcactacagttacgtgttcaactgtgaggtaaagaggttacatcatatggtcaccagaaagaagagatctcagaagctctgtacctgaccatctcattgttctctgaaactgatgcataatgtaattatcttaaattttaatataaatctgagcatttgtgaaatagtttgacctactgtctgagcaaatgcgtagtccaaactcgtatgtaaaatgtgctatttgtaagagattgtcaaactgaagtctatcagcatctactaacattctatatttgaaatctgaacatgtcaacattcgtgagatgaaaatacattcattgcttctggcatgaactaactgctcctatcttaataaaagatacacaaagtatcaagtgctgctgttgacttctgaccttttttttttttttttgaaaccgaagactgcatttgctggtgttatattaagtaggatataaattaattgcttgttgacttctgaccattcagtgcttgttgtaatttgcaagatacacaaagtatcctaatccttaatagaagacaatgcaaacactttgtagcagtatcagaagctataccagctatggataacacgttggtggcaacgtcagctagggttcttccaacaatgttggcaccggatggcgatgcctccttgctgtctgtgtctgctcttgatccaggtacttatttttcaaggatatgtagcataacatgaactttttattgtcccagataagtgtattgatcaacgaattgaatttcagaaaagttggcttccgctcaaatggttagccataaatctattgttgaagaaatgtagtacctagtaaactgtttaaggagataacaacc

SEQ ID NO: 58683 - DNA, 6850 bp, Oryza sativa
tttagctttcgcctccactgagaagaacctcttttgtcctgcccactgcatacgctcagttcctttgcagatgaaagggggatgttgcagaccctgcacaaagaactacagtcaatcagtggcaaaagaaacaactatacaaaatatgttgattatggtaaaaaaatatttagtgaatatttagacagatagaagagttagagctggggtataaatatcatttcccaccaatcccaaacctgttatccaaacatgcgttagattattagattttaaagtttaaactaggaatcagacaaggtgaacattggtctgtaccaagttcggagaagttaacatgttctaaaagttagtagctgatgctggacatgtcaccctgcctagaagtaattatgtggcctcacaggtagaggcatatgtgctttgtataaggatgcgaatgctacgtacctagcaggtctgttcctagaatgcatgactttgtattggaacttaacagaaagcgtggatggggcagatatgattatatatcacttggcctacaatttcagtggcagataacagaaagctgatgtggactaatctcatgggaaaaaaagtattaagccatgcaatgggtgtcagtataatcagactccaacgtaaagaactcacaaacacataaacataagattacaaataactccaacggttccatgacaagaagaaaatcgagaaaaacaatggtctttatacaatagtcaaataatcagatggcaaacataaaaatagacaaaaacaagaaagagcaaacgaccattcattggaatctgcagaacaatggatcaatgttctatatagcgttgatctgactcaaaattgaaatgacaactttacaaactggttatagcaaatcccccaaatcatgatagacccaaaagttccaagttcgtaaactagatctagatgtgtccaacttattcaaaaaagagcaagacaattataaccacctataagtgaaacccatgtctattcagtactaccacattgccagaaatcatatactagcatacaaggcccaagaacgtagcattgttggcccaaaattttgggctgaggggtgtcatgtcactgatcaccagattacaaattggacaactgaagctaggcctcttcagaaattggaacatatttaaacccacacaccacaatccataagacatgctgagcttctagcatatgaacaaagactgtctgaagcctaaagcaacgtgtctgcagatataccatacttgggaggttgttcgtcaatgactagtagtactacacaacaaattcgtaaacccctcttctgaaatttcacgaacattcgcacgaaaacaagtcactgactagattcaaggagtctctttttttttcaagctggaaaccttatttgaaggagccagctagcgtacgaaattaacaagattggaatcgcggatcaaggcgtgctttttatatatatatggactcacctgcaggttagggatacggcggacacgcgcagcggcggcggcggccggagacgagaaggccgtcgtcatcagctgggcggcagggtggagggagggcagcggcggggcttggcagatcaccgccgaggatcccgagaggcggcgggagatcttccccaacgccgaccgcaccatcgccatcctctctcctcctcctcctcctctctctcctctctctctctctcttcgtgtggataccagggtttgcagagggttgaagctaaattgatgaaaagaattcaggagacagagatgatgagaattaaagctcccctaaaacttacaaggctctgtttagaactttttttctcttccaactttcaactttttcgttacacatggaacttttttagggtttacacacacaaacttccaacttttatgtcatatcgtttcaatttctttaaactttcaattttagcgtggaactaaacacaacctaatagtttttcttttcggattagagtctagaaaataaattaaaaacttgttttttttagcttggtataactctgagtagctcccccataatttaacaacctcattgtttggcatatatgaggaaaaagagaaacgacatatttagaaatgaaaattagtttgtgaattgaacttttatatatgtgtcctttacgatctaaaaacaaaggctgaaaaataaactacgatgaaagatcctcaaagattaaaaattcaaattttagctgataagtataagaataagaaaaatatgaggctgtaaagctccccaataaggtttccctttttttattaagacaaattttatctcggtttttgttatcatgcttatcaaattgttaaatggtgtatttcataaaaaaataattccatatacaaacaccttaaaaatatcaaataaaattcaattttcaattttaaaacaattaaaactaaattaattatatgccaatgactttattgttttatgtgcctacacttaatctcgtcttgagctaaatcgaacgcagcccaagtccaaatttattcattttgtcaaatctttctaaaaattgaacgcaacccaagtccaaatttattcattttgtgaaatcactctaaaaatcgaacgcagcccaagtccaaatttattcatttgtaaaatctttctaaaactcggacacaacccaagtccaaatttattcattttgcaatttctaaaagtagttgtagctgctagaagtatcctaaataggagaaaacccactatgactcggagaagaataataacactgaacctgaattaattattaataaactaatagtgccaatttttgagagcatgagattttagaagacctgaaaaggctgggtttttatcggctgacattagttcagtgacgcgaggtaaacaaagtcacaatgacatcataagtttaattgcttcagagcaataatataatcagcttgaaactgacaggatacgagatgcaatcaacatgacatcatcaggacgtaattagaaaacactggatagacatggtcacaaggacagtagtaccattaggatcatgtctaatttggttatttaaagacgtaagacaagggtcctgcttaaaaacaacatgaccttagacttttggtattcagtagaaaaacagatttgacaattgacatgcactcgttgaattcaactccaccaacataaaattcaaccaattcagtctttggtcccacatgactatacattgacttgcaacaaaagcaaaaataacagcactagactgttggtagtagtacatttgtagagaccacatcggcaataaattatgcatttggaattaattagtaggtatcttcattcaccgctcatcgtttgtcctataacttataaaccattactaaaatataaattttaatttctttttttgaaaatttaaattttaaaatttaattataaagttggttttaacttttttttaacattggtttttaatcaccaagcatacaaatataaaaaatttacccacaaattattctttaatttgctttcaccttttttttttctgatggtctgacccatatggttggacttcttcagtattgacattgccgcgttatttctcaacgtaatgaaacgaaagtaaaagggacctaacggaatggatgttattttcaaccatactattttttttataaagttttttaaaaaatatctacgtttaatttgttgccaaatttagtatatacattagaaatcctgctaaaatttttacatattacaatcttgctaaaattttggtaagagtacaatctaaacatgcccttaaaagaaattaatctccattaaaaatgcaaaaataaaaaagagaaatgccacgtcagcaggaaaccgcgaagctagccacctctcctttctccccctctaaacaaacgcccagaaattgattgaattttttttttaaaaaaaagagaggccgccccaaatggaggaggtcgccgtcgtcgccgtctccgtcgccgcccaccaactccgccgccctcctcctctccgcctccgatgccattaaccctacgcgcacgggcctcctggtcgccgcaggcctccgtgatgccgacgtggtggaagcgctccaagtcggcgttccagcgctcctccgccgtctcctccgccccggcctcgccggcgagggcctccacctcgtcgtgcgcggcgcccggccgccgcagcgccgccggcaggtgcgccgatgacgccgggggcctcctcctcgcgcggcgcaggcagctcacgcggcagcggaagctgcgccacgtcgacgacatcggcgtcgggctcgagagcctcggcctcgtcgtcgcgaactcctcgcctccccccagaggccgcgcctccacgtccgcggccgtcggccaccccgtctcgatcccgatcgcgaggtccgcgagctccgccgagttcagagccgtgcaccagccgccgccgagggccgccacggcggcgtcgcccgtgctgctcccgctgccgctgccgtctcccaagccggtggaatcggacacgtcggagccggatgttggtggcgagagggcgacgaggtaatgtgattatattttataattcttttcccctctgaattattggatcatgtcgaatcctgcgattgaatgaattattatgtatgtgatgatgatcaagagatttttttttgtatttaattgatgcgatgcaaggtaaaatgtgattgttttcctcaaaataaattaagtttttgttatgctgcgaagagattaagacgcataggaaggtgcaaattttgtgattgattaggcatttggatgttgggcatagcaatgttaacctgaaactgcaaatctatgttgtttcctgatgctcacttgtcttgtggttgcagggtgacaagccagattgttcaaaattttcctgataataataataatcttcctgacaatagttcaaagcgtactaccacctctagtcaccacaggaaggtgttccgagagaagttccaagataagagttcaactgaaactgccaactttcggttgaacattcctgctaaaagtgctccaagcagtgggttttcaagccccgtgtgcagccctcgaagattcagcaatgccgaatatacgacaccaactgctcaaggtccccaagcgtggtccgctccatctgtccgctcggtagattctatggcaacttcatctccgcggatttcacctgaaatatatacaggggttacagagcaatcaactttttctaactcattgagaagtcctattctaatgtcgaagaattccagtgcccctccatcacctctgcacccaaaattattcccagaaaataatatgtcacgtattgaaggcaatgggaatgtcagtttccacccattaccacgccctcctggagctataaactcaatgcagacaagcattgttaaccagtctgctccaaaagttgaaatgccctcagtggctggtcagtggcaaaagggaagactcctcggtagcggcacatttggctgtgtatatgaagctaccaatcggtatgtgagtgtttttctttttttggtgttatcaaatttacggatgctacttcatgttgagctttgaatgcaatttactgacattaacatgcaggcaaactggagctctttgtgcaatgaaagaagtcaacataattcctgatgatgcgaaatctgccgagtctttgaagcagttagagcaggttaattgactgtgtcctaaataagattacatgatgtccatttggggcaacataaaaatcttccatttatcactgccattagtttatctaaatgtattgttatattagtgttcctgtttactttttttatgctgagaaataagcttctatgcccaatctaaatacaatcaatcttcctttgaataaaaaaactaaactctaatgccctccattttgtactccatttcttagttcccactgcaagttgaaaaatgcagtattttcccctccaatgacttgacattttggcaatttcctttgttcactgagtttcctatgtttcaggaaataaagttcctaagccaattcaagcacgaaaacatagtgcagtattatggaagtgacactgtaagtccctgtggaaatctgatcaagtatgtccattgtcatgatttattctgaagttgtttttggatcgtgcagtttgaagatcgcttctacatttacctggaatatgttcacccaggttcaattaataagtatgtcaaacaacattatggagcaatgacggaatcagttgtccgcaacttcacccgccatattcttaggggtttagcgtttttgcatggccaaaagattatgcataggtgtgtgcaaatctctatccttgtttactatttttttgttgctacatcatctattagtttgactccaactgctgtgtgtgtgcagtactttacatatccttcttttggtttaaatattcatttcaacatggacaaactgtcttttctcagtttattttggcatgttctgtctaactgtgtcttgctcacctcacaggcctcatcttcactttcacctatcttgctattacttcagaaaatcattatctttatgcaaatcatttatccttttaattgctattttgctgcatgtaaaagttggagaacatcaaactaattttagtttgagtaaagtgtacgggcggtccttaaacttgtaggggtgtgtcatctaggtccctaaactctcaaaatgcatatccaagtcccagaacttgtcatagtgtgtcatctaggtcccaaatcaccacaatccctttacgatcctacgtggcgttgatgtggca

SEQ ID NO: 58684 - DNA, 10601 bp, Oryza sativa
  unsure (1)..(10601): unsure at all n locations
aatttaaggaccgccaatgtactttactcttttagttttttgtgaagatactagtactttctgcacttccagaattttgtttatgttggtctccgcttcaatttatgttaccttatgtcatgtatgtgaaagtaaacatgtcgactcttacagggatatcaaaggagcaaacctgctagttgatgttagtggtgtagtcaaattagctgactttggaatggccaagcatgtgagtatatcctcaaacagagtacagtagcatttgtacatatggtactttattgtgtatatccattttaaacagcatttgcatgtcattttagaatgactgagcaacagcttaagctatcatctaatatttttccaaatctaactagcatcactaaacaagggagttgttggatgcatttgatatgtgcatataacttttatctgctgtatgttgttgagctcttgaatcccattgagtttatgttcattgtcagcactatttgacatataattgtattttgtggtactattagctcagtcatatgcacggaaccgtttgataacatgctctgctttgggtaatttttaaaataaatgtattcccttattacatatattctgtttaatgtactgcttatgttaatctctttcttttagttaagtactgcagcccccaatctttcactgaagggaacaccatactggatggccccagaggtaggcatacacgtttcttaataagttaaaacatcttctatcaaggttcaaagaaaaacaaacatcgagctgtataagcggtagctccatatgatgcagtgtttttctttgaccttatactgttttatccatactaaagataggagctcgctttgtttagcttctcctggatttggttcctgaattgtagggttgcagtatttaaatggatacagaaaaataaaaatactttgtccgacacatgtgcccagcacatgggcttgtacagctccaacccaaactcagtttatgtaacagataatgcaaatgttttttaaagttgataggtttggttttgtcttgtttgctttaattcaattgaaattacattctttaattcagttggtctcagatgattaggctacccaatggtttagtacgacagatgtctgacctgaaacaacctcactaacattgctttttctaatttacagctgtgttggaagttctactttcaatgcaaataaatttagctgtaacattcttcggaaaggagctacggaaattctgttacactcttgtacctttatgcctattgaaatctagattgtttcttctcctgcagatggttcaggctacacttaataaagatgtgggttatgatcttgctgttgatatctggagtcttggttgtaccattatcgagatgtttaatggaaaacctccctggagtgatcttgaaggggtaagaacttggagtgttcatctttacatgaagcttagtaacatgcatgtcatgactgtagtctgcctattgtaatccctaaatatgaaccacttcacccaaccaacatttcttggtatcaattattgtgtttcaatgcaagtgtcacgcacacataaccattgtaatacctatgtaacatgttaatgtgataggtgtagccactgaatggcttggtagtttgggtatgaacaactatacataaaaaagtattattctgaaacactagtcataataaatcatttttgttctacagcctgctgcaatgtttagagttttgcataaagacccaccaattcctgacaatttatctcatgagggcaaagattttctgcaattctgtttcaagaggaatccagcagagagaccaactgcaagtgagctgttggagcatccatttatccggaattcaagtcattacaacaaacatggttccatacattcatttgcggggattaaatccaatgtaagtctatgtctcccagataagctctttgccacccacatgagtatgtgatgtcactttatatgacaggataataataatggaaatggttcaagagacaaagcagcctcgaagagtgattcctgcgtgaaaggaaaaattactgtagggtgagtagtttccttttatttagtgctgtcttaccttaaaatgttattttatttgatttttcatcttcttagatcataacatagctgacatgttttatttgccagtgagccaaccaatgctaggccttccgaatcgtcagcttttcgattgactccactatcaatccaggaagttgcacctaacttctcctctagacccttaggtctaacctccaatcctagtccatcagccaatttagtgaacactgtatattttccgattgcaaactctcagcgtagtcctttgccaagacctaatgaaaaggaggctctgttctaaagatatcaagcatgccatggggagtgtgatttccatctcggatcatgttcatgtgcacaactttgaatgcgaactcggtcctaactgtatttatagaattaaagcagagaaagaataggaagatataagaaggaagataaatcttgtgaatcttggatgttgcgctgttatatcagctacacagcaataagataaatggtggaagacatcccagaagagacataccttgcactaacaatcatgtgatggaagacataaaagttttgcagcagccatctttaactaagttaaccatttttgtgcaatagttgcactatatgaatttgtacagcttacatgttcttgtaaaatagtgattgcctatttggacatgcgactaaatgttgctgaatgtgacggatccatgaaagcatgggatcttcattgttttgggatattctgatggcattttttttttgtaacatacaatcaggaataactgtagataagttgaaagtcccttattctaatctcatctaacaggttccactgctgtgtaatcatatttttgttgtatttttgtacaaaatggtgtgattataaatactagtatttacccaacatgtttcatttgatttattggcggtaaaaagctttagtacagtacttactttgtatgtgcatactgtatgataaattacaaatcggtaaatccattatgaacactagatgaccaatggctcaagtcaaactacctacatacgcgattgagaatgtgctagtttgtaaactagttgtacaatttcttcacaaaattaatcgctataaacagtcgcttaaacagttgtacagtttttccacaaaattaatcgctataaacagtcactttagacataactcgtcaccgctcttcaacttccaaattcaagcttctgaaaatagtatttaaacccacatgaaaaaaaacatataaaaagaaaagacattaaccaataaaaagtctttatcatgggtaatagaatttgtgacactaaccttgtacaggattctgttaccattttgatgtttacatgcaatacagttcataccaaagtatacaacactggaaagcaaaatgagtacaatcaagcaacaagtttagtgcggtgcatttgtcctctggaacatacaaaacctgatgtcgtttgttggtaaatgtaaaaattcatgagtatttctggcctagagaaacttagtaacatctggcacaccttccttgccatgctctcagtgattgaatgacagaaatttattgtcatgtctttcagcattgctgcccaaccgaatagctgcttcacaagagcaatttgatgttcggttcccctgaagttattgatttctacctcatgaaggaatgccaactttagttcctcagttttccaatttggtggaagatcacaagtgcaacttgatgaacatgcagctcgtgcctggaacgaatggcatattagtgtagtaacatcaacttgcctaaagttgccgggctgcctaaacaccctcaggatgcatcactgaacagagattgcataagaatgacaactgcaaactagtttgaagccaacctttcgcagaaattgtagttatgtgctatgataaagttgtgcgaaaaacgtaagtataaaattacctagatcctcaggtatcgcaaaattaataacaaattgccaatcagtatcatccctaaatcctaattgtgtttccaagagcgtgtgatagccatgtgacaactcaaactcagccaaccccatctagagctacgtccaagtattaaaaaaaagggcagtatgacacttgctgagaaaaatgttgtcaagacatgcataagccataatgccatatatttacaacatatatcagtaattcaatatcaattcaaatcacaacctagggtagggaatctagccaaataaaatagcaaatcaagcctaggtgtgacaaagcatgaaaatgcagactgtagtccacaatttccttagtaactctgtattatataagcaaattaaggatagtttttagcttttacctgcggattactagaataaatatctgttgccagctccaaccttcttatactagtgctcattctcagaacatggaatacgctgggaccaatggcatgtccacttgccaatacagtaaggcccaggaacataatgtcagggagcattgtcatttcttccatcaagtattcattttcaaggtcatttagttcctgttgtagaaagtaaaacatataaggacagaaagatctcacttgaaaaaagttattagcacaaaccaatcagttgccatacgttaacactttaattttcattttcttgtatacaatctggagattctgaatctagaaaagaggggatcatatataacagttggagtagagaaacatatcctttggggaagtgattaggggtcattacaagctaacaatttcatttggatttgtaaaaaaaaaaaggtctggacactgtaagttataagtctggccaagtcagaaaagtgcattggttattcccatgagcatactgcatatctcaattttagaatggcaatgataatatatagtgcacaagtacaaatattgtctgtactcggttcacattcccttgattattgaggtatcatgttcccttcaataaataataaactagtactgtattgcatagtgctagcatatgctagttctcatggtaaagtggaaaatgtagcaccatcaattaacagtaagatctagtgggaaagaataaaattttagtgtgatcaaacatgatgtatgggcttgactcttgagcaatgcaaaacatacatgttagtacctcaacagcatttactaaatttcatatgtcttgaccaaatattaagatattatgcaaatgagtatggtgagataatcatctatgaaccaccttgatttgttcgctgcagtgaatacacggtaatgcacagtgctctcatctatgatgctagtagaggaattgaactcaccgacatataggcaagcgtgagggaaagacggtcgagggcatcaaactgaaagcgctgcaacagccttaaacaatcgccattgtggccgaagtcctcttgtccaaatgcaagataaaagtgagttcccagacacttgacatttgccatgttgccaaaccggacggagcttggatcgaaagcatcctcccagtggagagtctccagctgaggggctgagatgtcggccaccggttgactcatagccagaggatcggagaagcaggagatcacatatagcgcgccgagtgccggcgcaacgacattgagctgcttcaatcctttcagtccccccaaacgaatctgcaggagagactccgagtggatgctgagattgctcaacccatgggcattctggatggtgagtctcttcaggaatggggaccgcggtgaggagacggcgtcgccgaggtcgcacgggcggtggaaccggacgttgtcgagtgagaggagggtgagccgggagaacacgccggagcgcggcatggcgacggcaatgaaccctaggtccagcgcgaggttggcggcgctggcgaagcagggcagctcaagaacttctccagcggcggcgccctccccctcgtctctcttcgtcttcggcaccacgttgagaagccctagatagccggagaggcggcgcgcggcgagggggagccattccgcgacggatccagcggtggcgcccacggcggagacgaggaggaggcggaggggaggcgctccatggtaggcgagggcggcgcggatggcgcgggcgtcggctgtggagacgaaatcgagctccgggaggaggtaccagagggagcgccagcgccgggagaggacgctggtccgcgcggcggcgctcgtccctacccggagaaggatttggacgagcaggtcgtcgggaagcgcgctgaggcggtcctcgccgccgccgccgccgccgtcgccggcggagagcttggcgcgcttggcggtgccttcctccccatcgccgtcctccatcgacttgggtgggtttcgtgttcgggggcccaaaatccggaatactggaggagttctagggtttcgatttgatatggtatgaattcaaatctcctcttcgttttgaatttaaatttaaaccttgcgatgaacaaatttggattaggctcctcatttcaccacaaattacaaatcccatatagtactccctccgtcccataatataagggattttgatttttcgcttgtaacgtttgaccactcgtcttattcaatttttttttgcaaatataaaaaccgaaaatttgtgcttaaagtactgtagataataaagtatgtcacaaataaaataaataatagtttcaaaaaaatttgaataagacgagtggtaaaatgttgcaagtaaaaactcaaaatccattatattatggtacggagggagtaattcattgtaacaaaacatggctccatacggaactggagatgcggttggttagtgatggaggcatgtcacgagggtcttcgaccaaacctaccgaaaccaccaactcatgaaatgtcggttgaacccaaggggtgcgtctaagggcctgtttagttcacgaaagaaaatttttgagtgtcacatcggatgtttgaccggatgtcggaaggggtttttggacacgaatgaaaaaaaacatgatttcataactcgcctgaaaaccgcgagacgaatcttttgatcctaattaatctatcattagcacatgtaggttactgtagcacttatggctaatcatagactaattaggcttaaaagattcgtctcacgattttcccctctaactgtgcaattaatttttttaatttatatttaatgctctatgcatgtgttcaaagattcgatgtgatgtttttgggaaaaaaatttgagaaactaaaccaggcctaaggcgannnnnnnnnnnnnnnnnnnnnnnnnnnnnntaatgacgaagaccaaagggttcgctatcaagctcaccatccgcctgaatcatcactaagggcaaaggccataagacgaagcaaagaggccatcgcccgaagtagaagatgccttcggctaagggcttaggaggctctgtggcccatggaggcctttcgccactaatgggctggcccaagaaaatcgccgtagggcccatgaatacaaaagacattgtatacccacactaatgtctctatcataagggtaactatgtaaatttcccttattaactaaaccctaaagggtatgaacctgtactttgtagggtctattcgttttgaaagaattttgtaatacatagaaataggacaaatagaggaataagaatagtaatttttcaagaggtttgattggacggagaatttcttatatttttctccctacaactagtaggagagaaaaatttcctttggtattttatatctatattcttctgaatcgaatgacatttataggaattaatctttagaaatccatgtcctttggaattcctccaaaacaaataagccttattcatttttactactgatttagctggtgagaattctgataatttaaaaatttggaagtagccgcatatgccagaagctctccatgtgccctttgccaccattattaatctaggatgttactcctaacatttcccttagatccttatgtatgtctagcctcccattgttcatcaaccaatttagtgaacacattaatctttcaaaaacaaactctcaggtctcagcctagtccacattgccaaggcccactggagaagaggttctgttctaaagatttacagcatatgccaaggaagcgtgacttccatctctgttaacttgtaccttacacaattgaaacatacaaagataacgagataaatcctgcacatcctccatgttctaactttctatcagctgctcaaaattaaatgatggaatgaaacattactgcatcacatatgagccctgcctgctctaacactcatgtgatggaagatatgccaaagttttgcagccattaactttaagttctaaccaattttgtgcagcagttacactacatgaatttgcacggctcacatgttcttgtaagatagatggctgacctgcattttgtctaatatctgagagcattttgatgtttacatgcaacgcagttcaaaccaagtacaaaactagaaagcaaaatgagtctaatagtcaagcgtcaagtctggtgcggcgcattagtcctctggaacatacaaaaccttacgccatctgtggtaaaaataaattttcatgcatatttcaggcctagagaaattaagtaacatctggcacacctctttcgccgtgctctcagggactgaatgatagaaatttatcgtcatgtctttcaacactactgcccaactgaatagccacttcacaagggcaatttcatgtccagttcccctcaaattattgatttctacttcatgaaggaatttcaacaaaagttcctcagttttccagtttggtggaagatcacaaacgcaatctgatgaacaaacagcttgtgcctaaaacaagcagcattctattagtgtagttacattaactttgcctgaaaaacacctcgggatgcatcactgaacaaagattgcaaaagcatgacaaatggaaactagtttgaagacattgtagttgttatgtgctatgataaagttgtgcgaaaaaacgtgagtatgaaattatcaaggtcctcagaaattacaatatcagtaacaaattgtcaatcagcatcatctcctaaatcttaattgtgtcaccgagagtgatagccatgtaaactcagactcagaaaactttcaatctggagcaaaatgcttccaagcattcaaaaaggaaagagcagtatggcactttgtcaaacttgcagagcaaagtttttccaataggacatacataagccacatgtttactacatatatcattatcaattcaaatcactacctagcgtaaggaaactagccaaataaaatggtgaatcgagcttaggtgtgacagaaaatgaaaatgcaaattgcattctggacttcctcggtaagcctgtagtagataaacaaactaacaatagtttcagcttttacctcgaggtcaagagaaatatgtgttactagcttcaaccttcttacacttgtgcacatcctgagaacatggaataagctggggccaatggcatgtccatttgccaatacgttgaggttaagggacacaatgtcagggagcattgtcatattttccattaagtattcaaagtcacagaggtccttctgtaggaagtaaaacatggcgattatatatagcaattggaaaggaaggatagaaagatctcatttaaagaaagttattagcatagacaaatggttgttgtaagctaacaatttacttatgattttcttgtaaaaaatctggagattctaaatctagaaaacagggaatcaaaaagagcagttggagaggtacagaaacatatcctttagactatgtgattagcgaacaggacatggtcagtagaagctaaatttcttattaaaaaaactatggccattgcatgtctagctaagatataggaaactgcattgctcattctccttaagcacacatggtatctcaatttaaatttggcaatgataatatacagggcatcattacttggtttaaattctctccactattgagggatcatatttcctttcagtaaatattaaactaatgcagtaccgcataatcattgcacataattctcatggcaaggtggaaaacataacacatcaattaagaggataaaaagacataatgggaaagagtgagattttggtgggctgaaatgtggcgcaggggcttgagcaatttaagacatacccgaaatacttcaccgacattaactaagtttcatctgtcctatcaaatatcaggagattatgcatatatgtatggtgataatctaagaacctccttgatttgtttgctacattgaaaacatgagtaaacagtgctctcttctgtgatgctagtagtatgatactatgatgtactcaacataggataggaattgaactcaccggcagaaaggcaagcgtgagggtaagtctggagatggcatcacgccgaaagcgcttcaagagcctcaagcaatcgcggttgttcttaaagtcttct

SEQ ID NO: 58685 - DNA, 12032 bp, Oryza sativa
cgccatggcgtccctcctgcacgccgacatcgccctcgttacctgcacccacagatcgatcgtcacgacgacggcggcggaggcggcggcggcggcgtgtgagtgactgacctcgaaggagaggtgggaggagcggagggcggaggcgaggcgggaggcggagtcggagtagccctcgagggaggcggcgccgaggcggagggcgcggcaggcgtcgcagaggcgggaggtctcgtccatgtactcgtcgagccaggcggcgccgccggggaggtggagcgagccgacgagccgggcgagccccgcgtgcgccgcgcggatcagcgccagcgccgcccgcagcgacgccgccgacacgaactccgccgccgccgacgacgccgccagcgaccgctccagctcgtccagccccctcgccagcgtcccgtagaacgccgccaccgtcgacggcgacggcttcatggccagagatgatatctccgagatctcgagagaggttagctagctatagctatagctacagcttatggtggtagctagctagcaatatggagggagagcaataatggcgcgagcgaacgaacgaacgagtgcaactgtgcaaccgtgcgggatggatatatggagttggggttggatggcgaccttgttcttactcccaagcccaacaaggctctactagctagtagtaggtatagctaggctagccttctttgcaactctactgcaagcaacaatggcctctctctctctctctagagatctctctcatgtggccatggctgctggtagctggtgaggaagagacttggatggatggatggatgtatggaaggaagaagatgggagggaaagggggctcctttgtgctgtgtgttatatagggccagggcacttctccaggggggctacatgcctttaggctttagctatgtactgctctttctgccacacctactgccagtcaaagcctagagaattttcattgatttggggtgaatttttcagggactggcaaaaataactgtggatatatatggtaaccagaaatttgttcaaataaactttaaacaataaggaccattttggttttgattccaaaatatatatatgtcctaccaaattgttggtactttgaatagaattttagctagtgttcggtttgctatcaaaatatgcccaataacacatataagttgctaaaaaaatggcactactaaaatttatctatattttggcattgtcaacattttaacatgacagtaaaccaaacaagccttaatttcttttatcttctgttgtcaaagatgtcacgatgtatggaaaaaaacatgaaattttgagagattttgagggaaagctagcatatttactctttttcttgatttgatccactagtaactagtaccaaattaaaatacctgaaactcaagagagatcgatttgaaattccaaatcgtgctaccaccgagcagacaacatgtcaattacacccaaagttgatagtgcgagctatcatcaataataacaatcatcatcatcatcatctcatgagaggtagggtggaccgtggacttaattccctacgagatcgagtgattgatcgaccggatatatatgttcatgggtcacctttttatttcccttccttataattagctcgctcgcttttctgaaagatacttgtcagtagactgtgtttttttttttgacacagtgatgatgtggagttgtggatgccctagctagagagagacagttgatggagatctactgcatttggcactagtgttcactggccggtcagctgatccatgcaagcaagctatccctttttcttcttttcttttttttttctttttgaaaagattgtatgcaagatacttcgtccgtttcatattataagactttctagtattgttcacattcatacatatgttaatgaatctacacatttacgtgtatctagattcattaacatctatatgaatatgagcagtgttagaaagttttataacctgaaacggaggtagtacttgttaagagtatttattctgatatggatataccgaagggtgagaaaggagacaacttatatgtatgcacaaatcatttgtatgcatgttctcatgtcattctactcaatctcctttttttttgtttttttttaccatcgtgtgtcattctactcttgactgaaattagttatcatcaaacaaaaactctaaactatgagcacacttttttttttgacatgatgagcacaatgttttaggggtattggatccaagtagagaaatcaatagacaaattaggaaggtagggaattccctttgttttgtgggttttacccatcacaaatacattggcaccgtgtttagttacaaagtttttcttcaaaatttcaacttttccataacatcaaaactttcctgcacacacaaactttcaacttttccatcacatcattctaatttcaaccaaacttccaattttggtaggaactaaacacagcctagctctacttattcttgtgattgtgcatattaatgctctacaccaatatccaaaaaagatatagttcccaatttttcttttggcaattgggcttttgtaaggttgtggtctatgtggccatgacaaccccaccctagaaagcgaggatgcaaccaactaaaggatggcgatgagagtcggaggatgagtggtgtggtatggatatcggatggaatcactagagagaagtgaaaaggatggaggggaaacgagctagcgattgatgaggaaaaccgacgagcaccataagggttgaaggtgtcaaattagagtggagaatacaagaaatatatatactttggaagttagttttgtttttattggtgggcttgggcaatggtggagcataattgtcgactatacacaatcacgatttatgccttcttgctctctctatcataatatccaatacagaggtagtcatgattcaatacattttcatggccaataacatttaaccaaaatactccatgtgcaaaccttgttcccatagtaacctttttatcccctaggattcaccgttaatgtttgcagtagctaccttttttttagttctctatagagatatactttggtcctcaaatttgtgttctaatgcacttattagggtctgatttgtgatgcgatcagatcctccacttgtgtaggggtgactagctaactgcagaagatccgatgtgagcaaagattacaggtgagactaatccgaatctgaaaatttgactgatgacttgacccgaatctttcctccaaaacggtcatcacagtggggtttgggccccctcattgccatgaaagtaagaaaaaaaaatcaccaaggctacttaattgctactagtattagtttcaaaaacttaataattactattagctactaattagtactataaactagtacctttctctacaaaagtaaatccttccattcctgaatattagtagagtaaggtgatcgtatttagttggatataatgttctttatttagacgtcgccgaactagtactatacattcgattcctctcctttttcatttcgaataaaatgtcttttttccccttgtgatggggcatggacatctgcataaagttgttattatatctttattatgctgtgctaattattacctcatatgtgacaatgcaagatatggcaagaagaaatattatttttttttcttctccttttatcatgagctttccatcttgggtggacacttggtgccactaggagtaggaagctgtaattgagagatctccttgcccttgtgaatatatgtggtactagtattgctacattgaagctaggtgagcttgcttttgttttgggggaaactggaccaagatttcttaatcttgtgaagtgatggtgatggtggtagtagtggtggtaggctagaaaggccattgattgactcatgtgcttacaggaccccatttcataagcaatatatgcaaatgattacaatgtatctatgccctcctactattttatatagcacggttttgtttcaccgtgaaatatcgaatcaaatcaaactttgaccattaatttctcttacaataacattttatttacccaatatcgtataattgtacaacttttgtaccactaaaacatagtatatttttaagatcacaataatgttctctgccacttggcatacaataaaaagtgttctaataataaaagtctactaaacatatgctatctctgtattttcaatatatatgacactattatctttatttgatcaaattaaactttcaaaactttgaccatcgatagctctcctcaaaatatttagtttgaaaacatataaatcatatagattggtttttctttataagttctttgtgatattataattccgttagatattatccttatattctaatagtaaaataatgcacatcagagaccgaataaagtcaatagtgctacacatttaaatgtgacggcagtatgtcgggctaatatgtgatcgaagtcaagtgagtactgtacacggtgccaggggcggaggcaaagtatattagcggtcaagacaactttttattaagcaaactcaatataaacttaggcacccgcccgcatcagcttaaactcaatctaaagtagagtaaattaagcaaatgacacccctccccgtttcgttctagctccacccctgcacggtgcgcagctccattccactcacttgcatccatggcttcacttcacaatccattcttgcccatgcattgcatatgccaccatcatcgatggcaataatatgctgaacccgtcgtgccatcgacggtgggtttcctagctcccagcctccctcctgttaccgagaagagggctaatcatctcctccttgttccaaggctctctgcattggaatgaatgattcaccatgtgactgaccttgctgctgccctcttcctttcctcgagccatctgtagatatcagagaaattcatcatgctgcagatgacctcgaatcgaatccatcgagtagcttagcttgtagctagggttcctttggttaatttgctccaatggcattgctttggttgctcagaaaagaaaagaaaaactctaatttcatggggtttggttaattcctaggggagggggggggggaatggggatgatgatgcatcatcctgcatatatgtttgcatcaaatccatatctcgaacccccactatatgtctatgttggtaatgcagagatcttcttttcagattctctcacttggcccaagctttaattctcccttttgttttttcctcggctgcatcttgctggaattaatcctcctcctttttatatatatagcgccttttgctttgggattcgatttttcttttaatttcagagtgtaattaaaagaattgtaaaaagtttccactgaaaacattatgtaacaaaattcgtgaaactatattaccataatttctagggttacgcgctgcatgccaaactacttgtggttttgtgcaacatagagcataatacccaggattttatgatattcactccaaaaaagattgtaaaaattcgccactgaaaacatgaggtaagctttttttttctttttctttgtaggaaatagagcatgttgttagtgagaaattcagaggaattgatttatttgcttttgtacttactactacttattttatgatgtttttttgtttgtgctgcactagttcagtgaaaatttgtagccatgctaattgcagaatttatatatatttatgggttggtgttcgtgggttgttggagaatgtgatgctcttggactcggaggaaggtatgttggtcctgcttctccatgcagatctcgttggctaattaaaaagccttgccttcagctcactttcagaacacttttcagctggctcaagactcgattatcttctgtctatgttcttccaagtggaaattaaagaaagaaaatatcttttgtatcagaggttttctatggtcgttgaagttgcatatgtatttttagcgttaattaggaggtatatgtacctatcaatacctctcgaaagaccattaaaaaaaaacctgtaccagcaaggaaaactttaacactgagagtattttatttctgtgctctagttctaggtttgctttttctctgctcttctcatgactcttgatttgatttcaagttacgccatgtgaccacttctcattttatatgccatcttaatcaaagtatcctattgtaaggtgttggcttgtcttaactatagaaaaataagggggttaaagtccccattcttagtttctcaccaatatgattatgaatcttgatctcttaatctataccttaaacctcaagtcatgccccccggaccacttccctctattaagttccaaatcctatggataatagataatcagttatctcaatgctgtaataatagcaaattagccatatggttgacggcaatgaaaaggtttataggatagggttgtcaactattcttcttttttccttttcttcattcagtgttcatttccaattgcatcaattatttgtcaacatttaagagcagacaatatagcatgccttgcttggattgtttgtctggaaaggctcaaacaagacctacatattctgagctttaacaaaatggggcccaaacaattctatgtggagttcctgatgcatataggtcatattcccttttacttggcaaaaaaacatattttctttacgacttctgaagccactgccttggccattttggttttcagttttcagccgaaattggtagctggtcatcttcatcaaacctcatctcatcttcttgtcgaggaaaaaacagtgatagataaatataatgttgatgatacatttatggctcttattttctagctaattgtagatgaaaagggggaattccaaattttacaggattttcattggcatcaattctgatggaggccttagccttttattagcttccacataaacacagatggtaatttacacctttttgcagatcctgaaaattggtttctttggaaaaaagaacattggtaacattgtgcacactgcaaaatatggtataatcacttatgcggaaaaatatgtatgacattagagtatgtatccaatttcttccatgagaatatgatatctaagatgaaccttgctcagcaatactgagcaggattctagtcgtactgccgaagcatctctccctgttgtgtcctacttttttcttgcatcagattactcaagaaagatgaggcgagtggcgatacgcgtgtgagtgattcccattgcaaatcttcatagatgaactcgcatgaataatatatccccctgatcggcacagttcatcgtggccccgcttgtcggtgactgttcacgggcattttcgtttcgcagagagaatttttctagcttctaatccacagagttgaagaggactaccatgatggttatggttttacatgtgcaaaatctaggacaggataggccaacaaaatgcttttaggaattaattcttactgaatacttcctaatcatacacaattccttttttatgcatatgtagcagccaacccaaatgatgtgttatatgtgatctcaagagtgttccttttttctttcctttctttcttttttcttcaattggccacctgaagaaaagattggctccacacatttgaactgtgcccttttctgatgcttttgcatgataggtcactctcattgttcacaccaaagctcaactaaattattagtttaatggagatcaactaaattaaactagcttttctctttgcttttgatcttgctttggacacgagccaggagatcttaccgaaatctagagcggccgaatccaccaccatcaccactgattagtttggaatctgcaagcttaagctagcattgtacaataattctccaaagccctaatcatggcgtccacacccagcatgaacccctctacccttctacccttaagaggggcccctgaaaacagcgtgaagacgggttttcagtgacggtgaccggtacggtctccggaccaccatggtcgtcatcgtcttcgcaccctttttattttttcggttgggtgataaggtgatgatcaggggggagattggagaagattgtgctacaaaagtggcagcttcactttgtgtcgctggaggaggcatggcaccctggggtctaatcagccatcattccatcctcaatttttcttaagttgggagcattttgcatcactcttttgagcttttgggtggaaaaaggaggagaaaggagaggggaggaggaaattcacctttgtttatgtcaaccctcctgttgcgtaatcgcgccttcctgcactgttttaaggatggatgaatagatcagttgtttctaagaaaagatagaagaaaaccgagcgaaagaaaaggcgaaaaagggagtctctttgagcaaatggtttggtcatggattttcaaaagatggatgtatggtttatttcttgccaggtgagtgtagatactcactcctccccaaggggaatcacccaatgattgacagaatgatcattgataggcaaagcagaaagaatgaggggcacaatcccatcggattggcatcatataaagcaatcttgatcttttttatgaatgccattatgagcccatgattagatctcaacttaacaaagaaaactttgtagaacaaatggtacactcatattccaaaggacaagtggttctctttattcttgtacaggtgtatgtatgtacaaactagaattacatgatcagcagctttacaacgtgcaatgtacattagggtctttttgttgcagaagcttgatgcacacacagttgcaagggggcagtttccatcagatgccagcacccattatctcccaaaaattcctgctatttctctgcaatactgaaacatccgaatgctagattcaaatgctacagtccacatacttcttgcaaagaagggctgaagatcttgacttaagatgtcccttctgatttattgttcctgtcaaccagtaataaacagccaggttaagagcttgttcactttgttattaccattttcgaccttaccaacatttggtagtaccaaattttggcatattttaatgttactaaattttggtagtgtccgaagcgtttagtttaaagatttaccaaatatgggtagtgtttttaagagtggaagcttccaaattttccaaaatgtggtatggtagcaatggcaagaatttgtttggtatgttgccctaccaaaatttggtagggttgaaaatggtaataaagtgaacaaaccttaaatttgataactggtgttactatgtctatgtgatatgcagaaaagttctgatgcactagtaattattctcgttgcatgagaaacttgagctgaattccatgtataatatacagatatcgcacaataagatgtaaacttatttgggtacatatgaaaatcgagtgtcatacacagaacaaactaagggtttctaaaagcacccagaaaaactccattttagctatcttgtccgaattaatttaaataaacaaaacttttgaatataccagaaagaacacagtaataatgtcattttaatcaggacataggatctaactttcaaatgataacaaagtttcaaaatgatactggtttcccaatccttaacctgtctagaatggtgcctaaggaagtccataacacctgcttagagaacacatgtatttgcactttcaggtgctaaaaactttgatttttttcaaaggattgtaacactcattagaatgacaagaaaaataacgaggactcagagacgcttgcataactctaatttctgcaaataaaatagtggaaacatgacacaacacatttatattagacagtccaactttctggtgattcattgcattgggggtagacagacttcaccatccacattgggctcagcacggaatgttagatgcaggaattccggaatcacagtgccattgaatgcgatacatgaggacacaaataaccaggaaacattgtattctgctcccctgctcccccctagtgattcccaaggtgtaaagcaaatttattttggatgcacaaatataacatagtgcttcctattcacttgtgaagtttgggtaataaacaaaagtacatagaaattttgtgcttctgtattagcaacacaagtttagacttcaggccaccctaaggagcactgcttgagcagagcattctgctaacttacacacacaattgacggaagtggaaagcagatagcttaagcttaattagtcccatcacgattcaactacaaccaaagcatagatattatcccattcctcataaagaacaatgggtaaatcaaggtcaccatgccaactcgctgcagggataacagaggagcctgcagtctgggtaaatcaaggtcaccatgccaactcgctgcagcgataacagaggagtctgcagtctggaagctttgcaggagcacaaatggagctttaagttcgaaacaatgtcttggtcatgaaattttgtactgagtaaaagtctttattgtttcttttcttcaatttaatatttttggctttgatatacatctgcgtactttgagcctcgttcattgcccttaattcaaatgcgcattctctaaaaacaaaataaataaaatagaaccacgaacatcaacaatcaacatacaactaaccaaatcagacaatctgctggccgttcagtagcttaatatctacaattaagtgcacaagcacacgtaagaattaattcttaaccggatgaaataatcaggtaattctggacatccagatggaggaggaggagatttgtggcaatggaggtttcacctctcgcccagggaccggtagaacctggcgaagcggccgcgctccttgggcttgggcttgacgggcttcttccggcggagcccggcgatctcctgcaccagcgggacgtgcaccagcaccgtcctccacgccacgtaccagcctgcgacccgccgccgccgcgagcagcgaacgaaagaatcagggaaacccctcgagccaaaagccgaagcgagaggaggagagggcggccgtactgagggcgatgatggagaggacgaaggcgaaggcgaggaggggccggaggacgaagacgacggcgatctcccacgccgccgccgccagcgcggctcctcctcctcctcctccggccatggcgccgcggcgacgcttcgtcggcagaagggggaaggtaaggagacgtggggaatcggcgggttagtccatgacatgtggggcccacgaaagcttagaggagcaaagctaaatcgttgcgtagaagtttgtgttactagcttgtgccttgtggcaggggtagacggatctggaattcgagaggtgtttcataacttgccctttaatgcaaacggatttgttatgtttcaccaaatgaaattcgatgtttcatcagtgtgaatgaaatgtctcagtcgtgatttgaatgtgttttaatattttaacaaggtgaaatatttttttaacagtaaaacattttatctggtagagcgcccgatttgtaagttccctgcctgaatttggcccaggtgtgcgcacaattggccgagtgcatgtaaatttggcccacttgcgcgttttataatttcatcccatctatggtcaaattcggcctgaatgtttacgatcagttttaagggtacagagacgattgccaatcaacacatactagcaattaatcttcagagtccccagggtaacataacatcttctaccctataattcaccaactacactcatgcaaacctcattcatcaaatccgacggtccagaatcgtcgaattcaacggctcgactccgcacccatgcctgcccgcgttcctcctctcccgtttcacccgcccatcgcgccgccgccggtttccaccacgccccc

SEQ ID NO: 58686 - DNA, 11359 bp, Oryza sativa
caggagtaggagtagtgtccaaggaacaaagacgtgtctcctcagcgattagatctgcaagagcctccgccatagtaggacgtgtaggacgtccaagcaactgaactctaatggactcaaattgagaggaaagtctcatgacaaattgatacactagattttcttgatcatgcttctctctcgccttgcattgtgcacaacctgaagcaccttttggagtctgtgcctcaagctgtccagacaaccgagtaaaggcattataaaattcttcaatggactgatcttgttgttgtaagttgtgcaaattctgcagcaaggaaaaacgcaaagctccgctttcttgagtgtacctctgtttgaggtagtcccacatctctttagcggtagtgtgatccctgaaactcatccgaataggcacctctacactcatgaatatgaatcccataacacgatcatctgctgttttccacgccttaattttagttgcatccgttttctcatcaggaggatcatctgtgaggtgagatgcttgaccaatcgacctcaaaagcatacgagctgaaagttctcattcttgataattttgaccatttagcttaatgtccgtggagagcagagctccacctccaagaaaggggtcggatgttgccatcaagaccagcagaagaaaatttgacaaattgactggacagagacttgcttacaggacttgatgtattgtctcctgaattagcaccagcagcacacagcggcagcagtagtggaagagcagcaacaacggctgagcggagcaaccgcgtgacgagcggctgcaatgagcgatgcactcacgcttgacggacgaatcacactgacttgctgtgaatcccgctgctgatccggacgaggaggacgtgaagaagatttgcccgatagggagccgccgccggcaagccggagcgccggcggacaacggggatcgagggctagggttcagcccatgagctctgataccatcttacagtgatagataaatttggggaatttactatgtactattgacttatggtcaaggaccacatataatgtatacaagagatgaaaagacacatataccctttaacatctacatgtatcaaacaatcgcataaccggagtcctaccgtcaagcttggggaaattgtcttggttagggagttttgatatttcatcaaataaaattgaagggcacattccaccagaaattggtagtatggtgtctctattcaatttgagcctcgcgaacaacttgctccatggaaacataccagaggaactaggttctctacagaatctcgagtatttggatttatcattgaacaacctaagcggaccaatacagggatcaattgagaactgtttgaaacttcaatcactaaggctgggacataatcacctcggaggaagcatacctattaaactagggatgctgacataccttcaagaattgttggatttaagtgacaattcatttgccgggatcataccaagtcagctgagtggtttgaacatgcttgaagccctcaatctttcacacaacacattaaatggcagcataccaccatcatttaagggtatgatcagcctctcatccatggatgtgtcttacaataatttggaagggccagtgccacacattaagttcttggaagaagctccagttgagtggttcgtgcataataaacacttgtgtggtacagtcaaagctttaccaccttgcaaccttattcagaaaggtggcaaaggaaagaaattcagacccattttacttggtatagttgctgctgctggcatatctattgtgtttatcatgtcactagtgacatggcaacgcagaaagatgaaatatggggagcaaagtgaaaatggagttggaaacacaaaagtgttttcagtctggaactttgagggaggagatgcatgcaggcagatttttgaaacaacaaaatatttcaatggaactcactgcattggtatgggaggaaacggatctgtctacagagctcaattgccaacaggcgagatatttgcagtaaagaaaattcatatgacggaagatgacgagctaatatttaagcgggaagtagatgctttgatgagtattcggcatcgaaatattgtgaaactctttgggtactgttctgcagttcacgtcaaatttcttgtctatgaatacatggatagaggaagcttgtcaagatatttggagaaccataacactgcaattgagttggattggatgcgaaggataaatattgtaaaggatgttgataatgctttgtcttacatacatcatgattgctttgcacccatagtccatcgagatataacaagcaacaacattttgcttgatctggaattcagagcttgcatatctgattttggtatcgccaaaattctagatgtagaggcatcgaactgcacaaagcttgctgggacaaaaggttatcttgctccaggtaaaattttataatgtatcagttactttatcctcttgtattttttgttaacattttgacaagtatttgagctaacagcttaggcattcatctcattagtattttctgataatagttattatagtcaacctcgcaaagatgcatcttagattgtacaaaatagaatagaattccttctatacaaatttattgaaacaaggtcttaatattgatgtggcagagctagcatatacaacaagggtgacggagaagtgcgatgtttacagctttggagtgctcgtctttgagctgttcatggggtgtcatcctccccttccgaccgttgccgccgccgccgccgccgggatgccacctcgccgccgccgccgagtccggccgccgctcccaccctcccctcccctcctctcttccaccaccgcaacaccaccgccaaccccgcccgtgggcacccccaaatccgaggccgccgaccgccgccctcctcccgcccgccgccgcctccccctcgtctccgccgccgccgtcgaggaggaggacggagagtggcaccccctgccgctctccgccgccgacctgtccctcccgctcaccctccccacggggcagaccttcctgtggcgccgcacgtctctctccccgctccgcttcaccggcgccgtggggcctcacctcgtctccctctcccacctcccgtcctccgacggccgcctcgccttcctcctccacaacaacggcggctcctcctcctcctccgtccccgcggcggcccgcgccgcgctctccgactacctcaacgccgccgtgccgctcgccgacctctggcgccggttcgccgccgcggacgcgcggttcgcggaggtctccgcgcggctcgggggcggcggcgcccgggtgctcaggcaggaccccgtcgagtgcgtgttccagttcctctgctcctccaacaacaacatcgcgcggatcgagaagatggtgtgggcgctggccggctacggggagcggctcggcgaggttggaggataccaattccaccaattccccacgatcgagcggctcgcgcgcgtgtcggagcaagagctccgggatgccgggttcgggtacaggtcagttcacaaaggattttcatctatagtcattgttacttatgttggagtagtattggttgaagcatctataggttcattttgatgcttactttgtattttccaattaacccatttggcattggtaggatctagatcttgtgttaattataattcagacataatgggtgactaaattcgcgtgctatatcaatgtgctgataatagcagagctcgtagacgataaaacgatgatcctaccattactgtttatacgatgaatatgtagagaatctcaacttcacatttgtgtggtgaggtttcagctttggggaaataacattttgaatcaggcgtaacacttgtttggattgcttgaatcataactcagttctatcatattatgtatactacatttgatttgagatactagtcaatagcacactgatttgagcaaatgctgtgttctaataaatgaacagggcaaagtacatcgtcggcactgctaaaatattacaggccaagcctggtggaggcgagaaatggcttgcctcattgcgtacaagggaactcccggaggtgattgaggctctttgcacccttccaggtgttgggccaaaagttgcagcctgtgttgctttgttctcactcgatcagaaccatgctattcctgttgacacacatgtctggaaggtatgaaaatgagtactgctacacataataaaattttcttacaaaactcttatactaacaaatgtctcaaccgtttgatttaactagatggaagttgcaacaaatctagatttactcacggcttaccacattagagtttgtaagaattttgtaagaaaattttagtatgcatagacttttccatgaaaaattgttgataaaattaattaattcacatccatgtcagttccctcactatcattttacacattcttactatttgaatgggaacctgttttgcacattctaccctgatcatatttacttccaatttttgttgaaccataagctctgcataacaaggtttgccctttttcattttttttagttgggtgagggtgggactttcatcatttgaatgggaaatagtattcaatgtattcacaattgacttcactctctagacataaaaacaattaaagttgatgggaagtcttgtgaaggaggttttttcacatgagttttatatgacctacaaacaattgtattttgtttttaagcccttcctatatggatttaatgcaggttgctacacaatatctgatgccggagctagctggcaagagcttaaccccaaaacttagtgttgctgttgccgatgcatttgttgctaaatttgggaactatgctggttgggcacagaatgttctctttattggccagctgtctgctcaaaaactcatggttgctgaaactacaaacacttccacgaaacctactaaaaggaagcgtagtggaaacaatgtcaaaacatgacaagaaatatcacatgtagagacaatgccaaggttgactttacacgcggttttgtttcagtaaccataacatgtttgacattcactaactaaagttgtgttatttattgcggggatatcaaattatttaaccagtttgcactacattctgctctacgttacatcgagtaaaatatttgatttgacgatggatcattaacatatatggtcctgggatttctataatctcagtggcacaaagttctgataaatgtttccacatttcagaattgttcttagaacacaatggcaactctcgtggtagtaggatccaattcaaggtatattgaatattgattacattaaaaatgcttgttagcaacttctgggttatagccttagcaacttctgggttatggcctagtgacataggaatgtcgagtcatttattctgacttttttgaaacattgatagcttttttcctgagactttgttgacttggcctgcttgtcaaagatattgttcaaaatcttcaattttaattttgtcttgttatatgcatgaatgcccactgattttgacatagcaaagtttaaagttgttggcaacaaattagtgatctcatctgtataattgccaataaatagatattgttatgttgcacgagacatgcttggtagatgttgtatccctataatggtgctgtcgtgtagctaaggctgttggcatgagaataaatcacactggccctgtgtggtgtggattggaattgttttcatttttttttatgaacttatagaagttgcctcttttgtgggcttgatgttaagagtctcaagggcacatctgttgatgttaagagtctcaagggcttaatgatcaatttgggaaggagggagtagtattttgcattgcgcttactgtcttcatttatataaaacggcttgcatggcctgtttacaaagcgattataaaccaaagattggttattgatgcaaatgaaaataagtttctgaaacaatttaggtaacactactcaagagttgagagcaatgttaattcaaatgaaggattttgaaaagcagtgataggatctgaataatttttcaatttcactggattcttttataataatcattttcttcctagcatctacaacacaacagttcttttttcttaacttctttttaacatcatgtagcttggtgttccatacctttatgatgctttggtggttagtaccttacaacgaggcgttcaaatgccgagtaggtacggactgctgtgggcacatccacgatagaggagcacattcagaaaactggtattttgttgagaagctgataaaaaagaaaaagttcaagttgttctttagcgctcatatctgtttcatttttttgtggtttgcaggctgtgatttcgtattctatcctgtaccagctacctaccatggttttgagaagtgcccaaatttaattcttgccgacagactttctggtctctaggttgttttgcattggaagattattatggtaaatgagtctcctgaacattgcaggatatcttaccattgttagaactcatccctacgctattaatttgtgcgctgtttatttgaattaaccatctgcttatatctaagggaaatagcaggaatcccctatgagttcatcccttttctaccagcaccatttctctcttgtttttaaagttattttaactagtaatatgcacgtgcttttctaccagcaccatttctctcttgtttttaaagttattttaactagtaatatgcacgtgctaacgctacgactatattgatgtcaaaagataatacatgttttgacaactaagcatagaataatgtaaaatcaacaaactttagaaaactttaatatgtggcgaggaaggtaagtacgtgttttttttctcattttgatttggagtgtttaatttatccaaattctctatagtgtttatactgagtgatcaatttatccaagttctctatagtgtttagtgtttaatttaagttccaaacgaccatgaaaccttatattacttaggtggtgtttggatccagggacttaactttagtccctgtatttagacactaatttagagtattaaaaatatagattatttacaaaactaattacataaatgaaagctaatttgtgagataaattttttaagcctaattaacccataattagagaatgtttactgtagcatcacataggctaatcatggattaattagacttaatagattcgtctcgtgaattagtccaaaattatggatgggttttattaataatctatgtttaatatttataattaatatccaaacatctgatgtgatagggacttaaaagttttagtcccatctgaacagggtcttaggccgtgttcttcccccttctttctcaactcacttctctcgtttttcgtgcgcacgcttcccaagctattaaacgattagttttttcaaaaatttactatacgaaagttgtttaaaaaaagtcatattaatccattttcgaaaaaggctaatacttaattaatcaagcgctaacgaatcattctgttttgcaggttggagggattagttccctaacacagccttatatgacacaaatacacgctatggtttatgtctgaagacctcaaacttgtacagagagttatacatacatttgcatatatatacaattcgaaagtgaatgctaaagcagattgcttgttttcagtaggggtcaagtaataccagcgtaacaaatagataaatgtttcctcacaaaatagtacacaagtgatactattttacagtacatcgagaaatcagggaatacttttatagtaaaataatccacgatcctcattggcaagacagggaatgaagaggttcccattatctgacatataatctaagtataacaaatacagctaatcaaggccttaggcagtgtgcatcaaaaacaacaagaacaaagatgaatgattgatgctagagctcacaatggcaaaagtagttgagttgttgatagccatcagaaaggacaatacatatagcttaatctcatcacatcagtcagaaacaaaccatgaattactcaaagcccttgtgcaatattcccatcatcacagcgtaacaacatggagcatcctcttattttggaaggtcagttaccttcctgtccttgaaggtttaaggttttcagaggccattgaatgcagcttgaggtgcccgttaagacattagggcagactccccttgttgatacatcggctgatgacctgtagactgcggttatgcacccatccacaaaaaagttaattagtatatgcggggcatactatcagctatatacaaatgacaatcaaatagtgtgtctgtgttcccaaatcagataagatgtacccatttcatcagtgaaggtcaataagtatgacataatctgagagcatattttgagagtttatgaactcccgcatagaatattcatgtctttgatgcacaaaaaataattaagccttctaagaaaagaagtaacgaaatatcataaataatatttaggcaagtacgtatattttaattcatagtgaaattacagcctattattaaaatatagcaacgattgatatgcactacctaatatcgacgaggaagcgcatgtccaagattgcatggttttagtcagcggggggaggatttgagcagaggcatttcaaaaggagaagatcagtgtaaatcctagcaaaatctccataacatatcaatagattcaaatagaaagccaaatctcttatcacatttcaccagattcaaaggaaaaaccaaatactcgcaagaaccagcttctccaaatcctagccaaatcccctaatgcattatcagtagttctttacacattacacattacacaaatggtagtatgccctccatagaaaaaataaaaaatcaaaacttttaagattcatagtctccactctccacacattatttttttagccgggccggcctaagataggcggaccaaatttacttaagaaaggggtatgtacatatttacaaggttccaacttcgacaagaggctgtcgaagtaaaaggatgttgtcacaagggcaacttcccgaaagaaaaaacaattacatcatgctgttgttactctcctaaaactttgaaaaccccggcttctttccagaccacaacctcctctttaatcaaagcaaagaggctacccgctgtccggctctgactctggaaaacacgtgcgtttctctccttccaaaccatccaacagacaagcaaaactagcgtgtcaaaagcgcccctgcagctagtctgaactccttgccacgccaagagccaccattcccctagttccaaccctgcttcagccggcagttggatgccaattccagcccaacccttgatcatcctccatactctggtggtgtatgggcaggaaacaaagagatgctcacagtcctcgtcgctgctggtgcatagtgagaatgtttgatggtgtggccatccgcgcttgctcaggttgtcggccgttaggcaacggcctttttctgccaaccacataaagaacttaacctttgtcggtgttctcgtgtgccaaactagattgccacaacgcgcctctgtgtttgccataaaaaacatgtcataggcagaggaaggggtaaatcttccattcgaggcccacttccatattgtctcatcctcttcccctcctcgcagctgcaccttctggatcgcatcccaaatttgaaagtactccccaatggctcggttggatggagctcctttgatgtcgcgcacccacctatggttctgtagtcctctcgccactgtcaaacccttgcgctccacatgactgaagattaacggaaatctcgcctttatgctcccaattggcagccaatccgcaagccaaaactttgtgttttcccccatctcccaacacttgccgtgtggctgagaagaacaggtcctgtaactccttcggctgcttagtctcaatggttgtccaaggtctgtcgcgatgctctcctctctttgccaaccatttaagccgtaacgccatgccgaagaagttttgcatacaaagaaatcgctggtggccgcagcctgcctcccatcccgcacatggcgccagctgagattgccttgtttaccagggcctgcaggacgtccatcaccaatacagtattgtagtgcttctatcccattagactgactcagttaatggagagatgtggacagggttcagttgtaaattcaggaagccacttagagaccataccttgtcatatatcttggcatcattcagtgagcctgtaaaatttacagaagatagaatgagctctttcttagccttaaaaaagacatcaactttcagcaatgaaaagagacagacaagggtaagcaaaagtagcttaatgaattatagacggcactgaaatacagaggtcaaacctgagataaaaaaaaatgggggtaaatattagagcagggcatcactctgaaaattattaggtagaatccttttatagatgctatttgactcacgactcatcaccacaaaaccaaggactgaccgataattattgtcaaccgtgctaccaagactaaaaagaaaatgatattaaatagattttcaactgaatggactgaaagcatacattcacgttaggtgataagatttcagcaaaatcacaagattcaaccagaaataaaaacggtacaaacagcaggttaatgccatagtaccaacaagtagatttcattcgcttaattgttccaacatagcaaaaataaaccacattgatcttccaaacaaaagagaggatttgagcagataaaatgattaagaggcttaaaatggttctaaactcctcagcaggattcgtaccataaggaaatctcaaagaggatcttacctagtgcgggcaccggtgtagtgcaagcgtacgggccgatatgtgcgccaagcagcagcggctgcttcattgcacgcccttctagggctgagatcgcggttgattcatgccggcggacgggcaggccgcgtggtgacggaagcagaggcttcgaagcgtgttggaagccagaggccgtcgcatcggcggcggctgagggggaggggaggagctcgcggcccgcagacggcggcgaaggggattctcggcgatggtgtagcggcggcgacggggatacggcgacgatggtggcgtgggagagatggccaggagagcagtggaagccggcggtgcgggattggggagggggagggatggtcgggggggggggggggg

SEQ ID NO: 58687 - DNA, 9713 bp, Oryza sativa
  unsure (1)..(9713): unsure at all n locations
taagtcaatagtacatagtaaattccccaaatttatctatcactgtaagagtagataggtaagtttggtgcactcaccccaccgaggagataattgtccaaacagtttatttgagctcatgtcaatatagacaaggtttggatgaaggcccaactcggagatatctccttcaagttgatttcgctcaagacgaactctaactagggttttgcagtttagtaagcttgttggcaatggtccaacaaggctgttgtgatcagcagtgaaattttgtagccgacttgctgcgcatagtcctgatggtaactcaccagagagattattaagactgatttccaaaaactctagattcactaagttgccaagttcttgaggaataaatccaaaaagttggttagatacaagatttatggaatagagtttattcaaattccctaagctgttcgggatggaacctgtgagattgttatcagcaagtgataagttatttaggttcaccaggttacctagttctttaggaatgtgtctagaaagtttattgctccaaagcaacaagttggagagtttagtcaaattccctaagctgtttggaatggaaccaatgagcatgtttttggaaagatttaaattctctaaattcacaagcttacctagttcttgagaaatatgcccagaaagttgattgtgccaaagaaacaagtgggagagtttagacagattccctaagctactcgggatcaaacctatgaggttgtttaaataaagcgaaaaagttctttaagttcaccaggtaacctagttcttgaggaatgtgtccataaagttggttttcaaaaaagtgacaactcaatgagtttagtcaaattccctaagctggttggaatggaacctgtgagcatgtttttggaaagttctaaattctctaaattcacaagcttacctagttcttgagaaatatgcctagaaaattggttttcaaaaagtgctaagtcaataagtttagtcaaattccctaagcagtttggaatggaacctgtgagcatgttaaaggaaagatctaatttctctaaattcactagcttacatagtttttgagaaatatgcccagaaagttgtttgtgccaaagaaacaagtgggagagtttagacagattccctaagctacgtgggatcaaacctgtgaagttgtttgaataaagcgataagttctttaagttcacaaggtaacctagttcttgaggaatgtgtccagaaagttggtttttataaagtgataagacagtgagtttagtcaaattctctaagttgtttggaatggaacttgagagcatgttgtcacaaagccttaggccctttaagttcaccaggtaacctagttcttgaggaatgtgctcagaaagttggttgtgacaaagatccaagagcgagagtttagtcaaattccctaagttgtttggaatgtgcccggaaagttgattgccccaaagaatcaacacagagagcttagccaagttcccaatactgtttgaaatggaacttgaaagtttgtttatgccaagcctcaagtcttctaagatcgctaagttcccaacttcttgaggaatgcacccagaaagtgtattatatagaggtataaggtagtgattttagtcaggttccctaaattatttggaatggtacctaataatctattggaattaagtttcatggacctcaacttcaccaaatttccaatctgctcaggaatatatccagagaggttattatctgaaagatccaaggacttgagctctgttaacatattgatattgatcgttctgcaggagcagggatctgagctctttgagggacgcaccactccaagggatcctccccgtaagcttattgtgtgagagatcgacgcttgtcagcatcgtcagtgcagagaagttgaggacctcaagtgagcctctcagcctcattccacgcagagaaatcttggtgatcacaaatttcccttgtcgagcaccgcacccaatgccacgccagctgtggcatggccatgccttgcgatcccaggactgcaggggttcctgggtttgcagggtggccttccaggcgatcagcgctccagcttgctcttcgatggatggcatggcaatggcaggaggggcaaggagtgaggacagtagtatagctaatggcaggaccaaatttaggggagataagggatccatggcttgggtagagtagaggactttgctcaagctaaggttggtctgtgttgttcttatactggacagtgttgactgctactgtccatgatcagcttgtaagtctatatggtacagtgcttactaccgtaccacatttagttgcacattggacttggaaaaaaaaattcaacgatcgtaagataagtgaaagcaacatggatggaacacttacatgattagttctctggtctaatccaaacaaggttggagtcgagactcgaaacatgagattctcaagtcaattaagcaaatatggaagtcatcacctttctaaatcaacgtacccagggggcaagtagatatggaagaatggagccttgttcagattctcaagtcaagtagccttcctcccttactggttgactagttgttggagaaaaaaattgaaaatatattatttatttttctttttctcagaaatatcggggatttaatcttatttgtgtaaatagctgggagaccgagcggtcggtctagcttgctcaaccagcgagaccgacagcacacacacccttgccactaattagtgattaattatcttgactagccgtcaccggtacgttgcacggctatttatcgacacgtgtcatgaacatcaattaatttagttatatgttgaatgtgttttcttactatggcttacatgaaaagaataatccaaattaatcattattcgtgggttgtcttaagtttttcaattaaggctgtgtgtgtttagttcccttcaaattttcaaaaattctgtcacatcatatgtttggacacatccatggagtattaaatgtggacgaaaataaccaattacacagtttgcatgtaaattgcgagacgaatcttttgagtctaattacgtcatgatttgacaatgtggtggtacagtaaatatttgctatgacggattaattaggcttaataaattcgtctcacagtttacaggcggaatctataatttgttttgttattagtctatgtttaatacttcaaatgtgtgttcgtatacttcagcaaaaaattagttgtgaggctgtgtttagttccctttaaacttccaacttttccgtcccatcaaatatttggacacatgcatggagcattaaatgtggaaaaaaaaccaattaaacagtttgcatgtaaattgtgagacggatcttttgagcctaattatgcatgatttgacaatgtggtgctacagtaagcatttactaatgacggattaattaggcttaatagattcgtctcgtagtttacaggcggaatcaataatttattttgttattagtctacgtttaatagtcaaataggtgtccgtatacgaaattttttttttaccaaaacaactaaacacggcctaagctaataataaaataaatattgaaaagtctaagatggatacgacttcatatttaaatttagtaattattagatattacaaatctaaacctacaaaatccatgatatttccaacggtatgttttacttgtaaagtatatagccggtccctaaacttgtacgattatgtcatttaggtctcaaactataaaaatacatatccagatctcaaaacttattaaattgtgtcaatccgatcccaaactgccatgccatctccaggatcttacctggcatgccacaccggatgatgatgtggcagcatcacaaatcctacaccaactggcaagtgggcccttctttccttttttttcccatcctctcatttctccgtttctcttctttttcctctgttcttcccactgcatcgaccgtaaccatgccctctggtcgagctgtcacctcggtgacacgaacagcgcagcgtccacaggcaagaaggcaacggcgcggcagccgcgtcgacagaaggcgcgccatcgcgtgggcagtgacgttcccgcccaagccgagaacaccgcgaccaccaagtcgacgccctgatgctcctaggcagctgtgctcagtcggaagttctgacggagcgccgctgcttcgcacgccatcgccgcttgtacgacggaacaagatagaaaattggagaagacaaagtgaaaaaaaaaaaaaaagaggaaagggcaaaaagagaaaaaaagagagtttttttttaatgtgggtcccatttgtcagccaaagtagaggtattgataataccacatcagcgtctatgtgacataccacgtcagcaccatgtaagatgccggaacggtgatggctatgttggaccggaatgtcacactttggcaagttccagggtttgaatatgcatttttagggttcggggacctagatgacacaacgattcaagtttagagaccgggtctgtagtttactcttttacttaacataaacattaaaatattacatagctactatcgtagatattaacattaattgtattattccttcaacttttacaagcttaaagatttacaaattatattgctaattatatttttatgtggaatcacatattggtcggcacatattaaaaaatttatatgaacaatatgttgataacacgtgcaaatatgtgcccaaagccatcaataagaaatttttatcgtcgaattttttattggattgtgactccatgccaatatcaaacacaactcactattctcgctattgatttgttgtcgaattaaaaattattaaatggtgaaaaaaatataattaagactctctcttgatacttagtaattcataatttctaaactaaattaataaaaaaactccaaaaaaaacaacagtaaggctttagcgtgaattaaaatcagaatacaaagaaaaacataatgcttataaaattaatagcaatagcccgtgcaacgcatgggttgtcggctagtataattagcaatagattgggagcccatacattcccgattactcgttgttcttcttgcatcggcggtggaccttcccgattactctaggagcaggtacaatagaattgttttattagatgcaaaaataccatgttagattgtttggtgctttcaaagagagaagagagagaaggaatgcaggccacaaaataagcgccaactacaacacattcctccacacctggtgagcctcattccatgctcagctcttcgtgattggtgaaaccgtgctagcctgcgcacaggataggaggggagagagaaaaggtaggaaggagagaggaggttagacccactttatagtaaattatttttatagtcaagagattagggccatgtttctttcagcttgggattattataatctagattattgagtcagattattataagctagattgttataatctatagtagaataagcggttagttgtttctttcctagattattagagcagattattggtttgcaagtctaaagagggagtggggtggcatggtgggtaatttttcacccaataatctggaaaaagctcacctaaatgagcttatcagattataataagctgggctccagattataatatgctacttcaataagttgtctgtttctttcagcttactcccaataatctggattataataatctcaagctgaaagaaacagggccctagatctatctactcccttcatctcttaatataagggattttgacattttgcttggactgtttgatcattcgtcttattcaaaaaatttagaattattttttttgacttactttattatccaaagtactttaagcacaacttttcattttttatatttgcacaaattttttgaataagacgagtggtcaaacagtgcaagcaaaatatcaaaatcccttatattatggcacggagggagtattatagaaattacgggtctgtttggtacaactccagctcctagattcannnnnnnnnnnnnnnnnnnnnnnccaaacggttcagattcgccaaaaactggatcggaacggggtggatcgctccaaaatattgtattgaggtggagcggcgaaaatgtagctccacggctccactccgaaaataattacagcactacccattccttttcactgaagttataggaaaatgccaccactctacccccttcgattccctcccgcattgggcgagcgacgcattcccaaccccttcctcgcccttctctcgcgacggtggaagagaaatcgtcgcacggcggtagcggctgcgcacgtcggtagtggcggcgcacggctgcagctcccttcctcacccttctctcacaacgacggcggcagaagcaactccctccctctctcggctggggcggcacgcggtaattgaggcggtgcatgacggttggaatggctccgtggctgcgcgatgcacagcggcgggtgtggcacactggggcgacggcgctcatggcggcggggttgaagcacctctaaaactatctatagatgacatgtataaactatttatagattacagcttacagctgtctatactattaaacttgctctaatggcaccgatcagagctgcttcctcggcgatcgtgccaaaaacgcgagttccttttggatttcttttttgaccaatgataaccgttgcattgtcatcccttagagggtattgttaaaagatcctcgattcctaatgcaattgatgtagtagtggcttgatggaagcccagtgtttttatttgatccagtatatgggtggtggtgaacctctcattcaccttcggtactctccgaactgtgcgggatggtttcccatcacacggctcaccaccaccacaagtagagaatcccaatgtgctttttactaggaagatgaggatgctattctttaaagaaccgagcttgacaagcatttcccatccatctttccccttcttgatgagcgcactacgactcattcaaaagagagagtaaaaggaagaatttcccatgccaaaggatcagaactgatcaggtctcaatccatttgtacttgcaatttcatcatgatccttatcaacacaactaatcgatacatttataagaaatgaaccgcagcgaaccctcagatgacccgtcttgccaaatcagttactggtcctaaagaatttgtatagctcatggtatgatatttgtctggagtttatggtgatgagaggtgtaattggtgtggtttgatcatctctcagttcaccgattcatccatccggtgtgatggacgactctccagtagaagatgtgacatcgtcgcctaataaccagaagaagcactccttcattgggcgtcatggaggtgccagtgctcacggatttttggagttctagagagcatggatgacctttgcagtttgcaacatcaacttcattgagatggatgatatgagttgcatcagtttcaacattgatgagttgttcggtcagattgtccattaattttgctttgtagaaagaaattcttctgtatgttggatatcccagtcctatggcttcataagacaaggatattcgacacctattctaacactataagtggagagggtgggagtgatggccaaacacagcggtggtgacgacaacggttggaatgggaggtgatcatgggagaagagtgacatgccgcatgaggcacggaggcggaaaaagcgatattacacattctctcaagtctactgaagctctgagaactgagatgacctgaaaattctgcaatttatcaggctccgttttgaatgtcaggcaaacagtaagcaattctcagcttatctcatgaacaatttcaaaaatgataaaaccaaaccgttttaagcagctactacttatcatcactgaaacataccaacacaaggagagcagagacaaaagatgcatctgaaaactttgatactaaacatacaattatacagtatttgctagaataggagaacaagaagcctcattgccatgtagtcagagaaaatggtagccatgtataccatccatcataaatcttagagattcgtattacaatttacaacaaagcagattgatcaaacaaggtagcatagtaagcacaagaacatcaccagcaacacgtattagggtcgtgtacaaaatgcaggtatgtttgacaaccacgcaattaacaccaacgaagtagagagaacacaaatcatcatacaagtgatgctttataatacttgacaagttgacattaacaggtgcaatagactgacctacctatggtgtgaattgccacattcttgtggggaaaaaaccctgagcaacatgagaaacagcaattttctgacaacattcactggtagtacgcagggatgattatgtcaacatgtagatggtcaggattgctaggtccttcagctgtagaaaacatccgagttacatgttgcattgttggacgacgtgatgggttggggtccaagcactggacagcagccatgatcactctaaatatttcacttgctgtctcagctttaggaagtgggatccgggcgtccaacaaatccttcaatgttgtactttccttggccatggagaaggacaaaaggaaatcaccaggatgatgccccatgaacagctcaaagacaagcactccgaagctataaacatcgcatttctctgtcacccttgttgtgtatgcaagctctgccatgtaaaaatttaagactttgtttcaacaaatttgcatatgtaaatagtatagaaggcattcgatgctatttttacaaaatgagatgcaaatttgcctaattgtatctaatatactactatgaatcaaagatatactagtaagacgaatactttaacagttagctcgaatatttgtcagagttacaaactaatatacaaaaggacagagcaactgatttagtacaaatttacctggggcaaggtaacctttggtcccagcaagcttcgtgcagttcgatgcctccacatctagaactttggctataccaaaatcagatatgcaagctctgaattcctgatcgagcaaaatgttgttgcttgttatatctcgatggactatgggtgcaaagcaatcatgatgtatgtaagacaaagcattagcaacatctttgacaatacttatccttcgcatccaatccaattcaatcgcaatgttatggttctccaaatatcttgacaagcttcctctatccatgtattcgtagacaagaaatttgccgtggactgcagaacagtacccaaagagcttcacaatatttcgatgccgaattctcgtcaaagcatctatttctcgcttaaatattagctcgtcatattccatcatatgaattttctttactgcaaatatctcacctgttggtaactgagctctgtagacagatccatttcccccagttccaatgcagtgagtttcgttgaaatattttgttgtttcaaaaatctgcctgcatgcttctcctccctcaaagttccagactgaaaacacttttgcgtctccaactccattttcgctttgttccccatatttcttccttttgcattgccatgccactagtgacatgataaacacaata

SEQ ID NO: 58688 - DNA, 4158 bp, Oryza sativa
ggatgggaaccgccgcgacgaggcggcgtcaccgaactcgcacgggccgtggaaccggacgctgtccagtgagaggtcggtgagccgggcgaacacgccggagaccggcacggcgaggggaaggaaccctaggtcgagagagagcttggtggcgctgccgaagcaggggagctcaagaaatggggagccatccttcccctcctcgtcgtcgtcgtccttggcatctctcttcggcgccatgttgaacagcaacagatccccggcgaggcggcgcgccgcgacggggagccattccgccatgccgtgaggggcggcgtcctgggcggcgacgaggaggtggcgtagggaaggcggttcatgggcagcgagggcggcgcggatgctgccgccgtcggcttcggggacgaaatcgagctccgggaggaggcaccagagggagcgccagcggcgggagaggacgctggtcctcgccgcggcggtggttcctcctatccggagaaggacttggacgagcaggtcgtcgggaagtgcgctgaggcggtcctcgccggcggcggcggcggcggcggcggcggagagcttggtacgcttggcggcgccttcgtccccatcgccgtcctccatcgagttgggtgggtttcgtgggcctggaactcaaacgtgttggcccagcccaagtgccttacataactgaagcagcagaggaagtagaataggaccctgtttagatgggactagaaattttaagtctctatcatatcgaatgtttgaacactaattataaatattaaacgtagactattaataaaacccatctataatcttgaaataattcgcgagacaaatctattaagcctaattaatccatgattagcctatgtgatgctacagtaaacattctctaattatggattaattagacttaaaaaatttgtctcgtaaattagcttttatttatgtaattagttttgtaagtagtttatatttaatactctaaattagtgtctaaataaagagactaaagttaaggtccctcatccaaacaccagaaaagacgaggaaataaatcctgcgcatccttgatgatgtaatcctctaccagtctacagatgctcactacgatggagtataattgtgtaaggaagcattgttgcatcactcaatgtaagttccactccctctgtatcattatattataagtaatcaaatattttatagaaaaaattagcaacatctaaaatatcaaattagtttcattaaatttaacattggattttgataatatgtttgttttgtattgaaaatactactatatttttttctataaatctagttatatttaaaaaacgacttataatataaaactaaacgtagggagtaactttttttttacagcagtttgtaatatataaattgatacagcttccttagagagcatggaaactagccaaatctatatccagtaaactagcatactaagtctaaagctcaacacgtaaccataccacgtcatcactcactagcaataattatatatttaacttcatgcaagcatacaacatcatctacagtttatttaattatacaaatcaacatgcaagcatatctaatcatcacccctcacatcatttacataatattttaacaaatctatctatcatttttataatatttaacatatacttattaacacgtttcacatcatttgtttgtttcatggtaagtactgataaacacagatcactagtacagatccttccatttgtgacggcccataacaagactggaatttgcgggccgtcacaaggaagtaatctcaatcgggccaaaatttcgcccgattgagatatggtcgcacagccatggtatatcggcataaaactaaaacccgtcacggatgacacttatctgtgatgggctatagttgaggcccgattgagatgagggttccatatctcaatcgggccctaaaagaagcccgtcacagatgagggtcatctgtgatgggctccaactagaggcccgattgagataagtttattgcccgtcacagatgacactcttttttgattggccttttattaaggcccgatagagattacttgtatgcccatcacggttgattgttttagggccgttacagatatttgttgcacagtataaatactccccaccacctagtgtaactgtatcccacagttcactattttggtgggaggctgtagggggcgaatttttgtcctttttccaaggaaaacagaaattaaattcccaaaagtaatcaaaatggatcaatcaagtgagtaatataaatcattaattgagcaatttcatcacgtcttacttttgcaatactgatcttataatatgtgcctctaatttgttttttttagcaattgatcgaagttggatgtatgccaaaaatttgaaacgtcattctacagagtaccgaaagggcataataaaatttatgaacgccgcggaggaggatcggataaaaagaaacagtgattacatgtgttgtccatgtgcagattgcaagaacgagaatatgtttgatagcggaaaggacgtacacggtcatctgatacaacgaggattcatggagggctatacatgttgggtgaagcatggagagcaagaatcaggaagtggagcagcagcagacagaagtggtgcgcataattaggaagatgaaaatgagcatgaaatgtttataccttctccattgggcggtgaaatggttgatgtggatcacgatctgctgcaagacatgttacgtgacgttgaggacccagcccagaatgagagagatggaatgaaattcagcaggttggtaagtgattccgagacgcctttgtacgctggatgcaaagcaaaacacactaagttgtcagttaccttggacctaatgaagctgaaggcaagtagtggatggacagacaagagtttcacaaatcttttaggaattttgaaggctatgcttcctgttgagaacacattgcccgagacgacatacgaagcaaagcaggttctgtgtccactggggttagaggtccgtagaattcacgcttatcccaatgactgcatattgtaccacaagcaatatgcggacttggatgcttgtcctgtctgcaaggcttctcgatacaagcgaaagaaaagtgctgacgaaggaaataagtcaaagaggggtggtccggcaaaggttgtgtggtatctacctatcattgatcgtttcaagagaatctttgccaacccgaacgaagcgaagttagtacgttggcacgccacggaaagaaggaatgatagtatgcttagacacccagcggattcgattgaatggaggaatatagatcgaaaacacaaagactttgctgccgaccctagaaacatgaggatatgtctttgtacggatggcatgaatcctttcggtgacatgagtagtactcacagcacttggccagttcttattgcgaactataacctcctgccatggttatgctttaagtgaaaatatattatgttgtgcttgttaatccaaggtccaaggcaacccggcaatgatatcgatgtattcctggagcctgttatcgacgatctggagattctttggaaagaaggtgtggaaacttgggatgcatatggtcaggagaacttcaagctaagagttctattgttttgcaccattaatgactaccctgcactcggtaatctttccggacaaactataaaaggaaagaaggcaaggaacatacatgaagccggtggctgaagaaatcacgaaagatggtatacatgggtcaccggaggtggctcccgctacgtcacacatttagaagaaagaagaaaatttttaatggtaagagagaacttcagcctgctcccaaagatttgtccggagatgaggtccacaatatggtcaaggacataagcaatgagtttgggaagaaaagaaaacgtagcaagacaaaggagaagggtatgtggaagaaaaaatccatattttggcggctaccttactggaaagatcttgatgtccgtcattgcattgatctcatgcatgtagaaaataatgtgtgtgagagtttggttggcctgatgttgaatattcccgggaagacaaaggacgggttgaacgcgcgccttgatcgctta

SEQ ID NO: 58689 - DNA, 12883 bp, Oryza sativa
aactaaatgcccgattgagatgaggtcatctgtgacgggctttagcttaggcccgattgaggtcactagtcatctgtgacgggctctagtttaggcccgattgaggtcatcagtcatctatgacgggctatagtttaggcctgattgaggtgagtatcatctgtgacgggctctagtttaggcccgataaaggttagtagtcatctgtgacgggcgctagttgtggcccgatagagataggtcatctgtgacgggctatagtttgactggtcgtctgggtcaaagctatcggtgacgggctttacttagggcccgattgagatatattcattcgtgacggccgtttgcccgattgagataactcttcacatcagtgacttctagcctgtgacggacgctgtgcccgattgagatggggcttaccgcccgattgagatgagggtatccgttctagtggatgttttattatttttttcctttttactcctagcttgattgtcgaaaaaatatattgagaattacttagtaattcccgcaacaaagtacgggaaatcacctagtaaaatagcaaatcaagccttaggcgtgacaaaaatgaaaatgcaaactgcatgcattttgtggcttccttagtaactttgtcctactcatatacttcatttgataagcccaacgaactaaggatagcacacgtgcgaaagatgaatcaacgcgattgtgttcttgtaatatgccattgtccaatgcattgtgaacccaacaaaacgctgttacttatagaagattcacattgcttacgtacaaattataatttacaaacatggcgctaatgaagattgttctcaatggttctgctcagtgctcttgtgaagaacattatcttcttcaaactgttatcttgattcatgagttaagagcttactctagaaattgcacaacagaagtactaatgtggttaaacagggaaaacatacagaatggtgacggccagatgtgaattcctaccgacgcccatcgggatattatcaggcatgaagtctatgcgataaaggtgcatgtatttcagacgattaagagcgaggcgacttgttggctataaggttttttacagcctttttttagcccacacatataatagttagctatttataattaatatagcgtccacttgtttctctcacagaattttttggttcttgcgttcaagccggctgtaggtttataacccacttctcctctctttcctctcttctctcctccacctcagcatttagccgatttatagcctcctattatacttgctctaagggcctgccgaatctccaacgtgcttcagctttttagcgacatgcaaaacaagataagctattagcatattacaactttaaaaataagtttatttttatttgattatttttaaggaacttttatgtgaaatgttttttttaagaaaaaacatagtagtactccctctatcccaaaatgtataagatttgggtggatgtgacacatcctagtactacaaatttggacaagctagaatgtgtcgcatccactcagaatcccttatattttgggacggagggaatatcatttaaccatttgaaaagcataacataaaacagggaagtttagttgggagttgaagttgtagtttgttaattagtcagtagaatgaaggcaaattttgctacagaacatcgcgacttcgtggttttagctgtaggacaccgcacaaactctttttttattttgggggggggggcactttctaaacatggttatttgccagtggacaccacacccattaaaatattaattttcggttgaatatgagagacaaatagcgtgaaaggtcaaaaatgcccctgacctcacttgtcatattcttcttcctccttatttcccttttctcctagtcccacgccgccaccgatgacggtgtccccaccaccgacttccggaacgacgaccgcgtcgagctggcgacgctggaatcggacaggatgtgctgcaccctgaggcgacgcggcctgctgtggggatagccctcacctccacaggaggaggcgacgactactgctactgctgtgactatcctgtgctgcaccctgaggcgacgcagcctgccgtggggagcccttacctccacaggaggagccggtgactgctgctactgctgtgactacaagggcggtggcggtggcagcgtcgggcggtgtttgggaagcaacagcgttagtggtgggagtgaggacgatgccgtggacaatggaggcgccggcacggccgtggtcaggagcaccgacgcggtgtggtgggacatggcgagagatgggtggccttgcacgaaagcgggagagcgtggcagcggtgaggcggagggagcgaagttagtcagcgtgggccgaggcgagttgctgccacaatgctaccgcacccttcatgtgtcgccactgctccttgcactcccgcaccgtgtcctcctgctgcaccttggatgccgtgcatcccgtcgccccccgtgaactagtgacgctaccgccaacttcggcctgtgcaccgcatgctgccgtcggtgctccccgcttccacctctcgcgcctcacttgatctacgccacaactgtcaccgctaatgtcatcgcttcgggcgtgggcgtcgttgcatggtgtccccgcgccgccgccgtcctgattgtcccctttcctccgccgtgcctctgtcatcgtcgcacactccgcctgctagttgcgccgccactcgcggctcgcagtcatcactagagaaaagagaaaggagggagatagaggatgagataaggaagaagagaggatgaggaaaagaaaggatgggcaatttggtcactccgcataaaaatataggccccatatcgcctcgttagcacgaatacattattttaatgggcgcggtatctgctggtaaataaccacgtttagagagtgtttttccttaaaagtgagttcgtcttgttgttctacagctaaaaccacaaagtcgcgatgtcctgtagcaaaatttacctagaatgaaagaatggtgacatatcataaatctatatatagaaagatacggagaccaagttgattatacaataattaacaaattagaatatacgaattgaagaaattttaaaataaagtgccagtgtcctcagttcctcactacctgatcaacaagcatgaggagagacttcaacgaaaatttgctactgcaaatgcggaagaaaaggtcgatccaatcatctaatcatcgcaacattctaactaaatggatatgctgacaagcaatagaaagacataattactgctactcctggtgatatggagtattggtgtcttcactcttcaggtgatatggagtattcctgctactccagtttgcagccaacacattcctgctacttcagtgtgaactcaacgtttggtaggcagaattctaagtgctcagtcataaagtagcaagcataatctgaagtagtagcattacttgtttatgaaaaacagaaatgtaattattgttccaaattatgcacacttactatgctaagtgcagtactaaactactaaaccacaacccgtgcaaaagactcatacaaaatactaacaagcgcaatccatggacaaatcttaatgcatgtcaaaactacaccaaacatataaagcaggacctctctagccacacaaacttttgagtctaaactttacctaaccagaacacacaaagcaaagcgagcaaaagacattttttagataatggaagcttttattgaacctagtcaattacatcaagatgatataattaatctgagaacacttctggcctttgcataattaagatgcacacagccaaacatacaaaaccacactcaaatggaaaaaagaatgacatggagtattgaagaccatcaatccaggggcgtagctacggggggtgcctgagggggccaacatccccctatccaaccccctccctgttgtactaactagcgcattagcatgttaattagtccattatcaataaacatgatatagaaaattaattaataagaaagagacaaagagacaacgcaaatcaactcctcgtcttcattgcttcggcttcacatgtctctccgtactcccattgcgtctcgctgtcgagcatggtgtctcaagtctcaaactgttaaacattgaatgatacaactaaagagctaaattcaagcttttttatagcagaacacatgatattttgttttatcgtcggtattgcttactctgacttacgacttgtttgtcctgcccacacccccctaacgataaatcctggcttcgcccctgcatcaatccaaagactaaattgccaccaatgaacaactctttggccatctcctccaaaagcatagagtattaagagttcaccaaccctaagactagatcgtcacccatatccctaggtaaataattccttgaccaccttcttcaaatggagacaagctccaaatccggcgaaccaggcttctgtaggatagcccatgtacgaagccaatggacaagagaatatataacctgcaaagatgaaggtatgacttttttttttaccaaaaaccacattattcatgcatagccaaagagaccaacaagtagcagctgctcctaataggacacgtgctttcaaattattatgaattccagcaagccagctcctaaacatatgcgctacataatgcggtggaggaagtccagatgctacttggatgatggaccaaataaaatgggcaaaacaacattcgaagaaaagatgtctaattatctcgtcattgcaacaaaaacaacagttcttattgccttgccattttctttttgtcaaattatcctttgttaacaccactccacacacaagtaccaaagaaaaatcttaacttttaggggtatctttaatttccaaagacgcttattattgttgggaatattgatgtgagttagagctagataatgagacttctccgaaaactccctatttgaggttaagttccaatgaaactcatattgctcctaagttaattgaaaaccagtgatgcgtggtaataaattattccacaccgctagttttgatcctataaggtctcttctccatgaaaaagatggaggattgttttcgaagacttgtgcaactgtagcctgcatatgcctaactatgttgtaaaggcaaggatactgttatttcaaagttgaattgcctaaccatttgtcttcccaaaacctgatttgggagccatctttaattataaaggatccaaaatggagaaattcatgtttcaccttcatgaggctagaccaaaagtgtgattcctcggccttccactaaacttcagaaagaggtttatcacttagatacttattacttatcaactgttgccaagccccttccgtggagagtaacttaatcacttactaagcagagccatattcttaatttccaaatcatgaattcccaaccccccttgttccttggggcaacacagtatgttccatttagcaatatgatactttttttttctgaccatcactttgccagtacaacctgaagcgaaagtagtcaagctttgtaagtatccctgttggtatgacaaagaaggacatcagatacaacaggaggctacttagcaccgagttaatgagcgagcaaaaacatatagtacatcacgacataatcaacgggttaattccagttaaagcttgacaatgataatattagtgcaaacatctttactcgtcactaatagatcataacagaaccaactccagagtttggcacgacctaattatttatcagtagaaacaggagcaaaccaaaagtgatagaaacatagtggattgacttagaactagatttctttagcacactttcatctagtgcaccttagctattgattttactcgctgtagctgctctttcgctgttgcccttcatcttagctacacatccattagcttcaacacgagcatttcttcatttcctcttctcaagagtaaaattcttctcatgtgttgtgtattcattttcccagttctggacctgatagtcgtgcttcatgtaggtcttttcccagttagaaacctgatagggaacacctaccgctaccccaaccatgacagaagatcgccaaggttcaggttctcaattttcccgcgccctccaagcactcaatccttcccattatatcacaacaaccacctattctcatcatatcacaacaaccacccgaattattgggtaaaaaacaaaacaaattatacacaaggatgtcaaaccttaaaagattgtcaataagaattactaatgaaaaccacccaaagctttcaaacacacgacgctattcgtgtctcattcatattcctagtcctattttaataaaattactatatcatatgatttttcaaatacattgtttcaatatgttgaaacatatttttgctaatatttttaaggccagttaacatattcatcttctataaataaggtcaattttcattaacgaataaatatgtaatcatatagtgttaattgttaaacgctaattttctaaagctcttatttcgttcaacattaattttctaaagctcttatttcatttcaattgtacgtaagagaaggagtcatgatgtttatactttacacctatttatgcaatgcgacctatagctattttcacacttctcaatatattacaaattataataatacataagtaactaattctttattatgagaccatttacaaatatgcaactctccaatcaatatttatattgtaacataaggattgttatgcggcttatgcccattagatttgtaacaaatgttgtattctgcttttttctaatttaattctagtatttcttggactatctcattatttctacatatggaattaatattgtacactcaatgtgttatagacaactctagtacaacacagaggtaaaatgcttactcatttgcatttgtgtatatggtatacctatgcctagaagattactagatatacataatgtattatagcatatttcagggcagaattaacatagttattatatatactagttgataccctgcattttgctgcggggtatatggatgaatgcatgccactagatatacgtaatgtattatagcatatttcagggcagaattaacatagttattatatatactagttgataccctgcattttgctgcggggtatatggatgaatgcatgccatacattatagaaatggtatatgtatatgtttaaataatatgaaaataaagttaaaatattgatttgacattgcttgcatattgagttctgaaaacacaacaaaattttaaatgatatatcatgtttacatgatatttaagatagtctagataataattgctagtagatgataatgtgacacacttacatgtaatttaaaatactctagaaaataattgctagtgggtgattatgtgacacacttgcatgttgagctttagaagttagtgggcatcaactttatactaagataggataagttttatcactactctggtgtttgaaactgatgaagatgaagattgagttggttcacgtaaaatgagaaagctattagcacatggttaattaagttttaattattacaagttttaatgcaatatatttgatattttaaagcaacttatatatagaaagttttcgcacggaacacaccgtttagtagtttgaaaagcgtgctaacggaaatcgaggtaaaatatgtatcttagtgagaaaagaacattgttaggaaagttttttttttcattttttaagaaactaatcataagcaacatgctttacaacaaaataaaaatatttatatatatgtgaaagatcaattggagatcttgaaaagctcttgtaccaattaaacatgcactaaggactatagatgtcccctagagagggtggatgaatacgcatttcctacgattacaaaaacttgcagcatgttgaccagacattccgatgccgctatagatagtttgacaacacacagtgtcgtacaatccgacaacaaccggataatctgatcaaacacagagaaaaaaggagaactagcctactagagtgtagacccagacagtccgataccgcaccggacaatgttcgaaaatcctagagctattggacaattcggtcctatagagaaattgaaacctatgggagattaagtactttgcacactagttataaactagaactaggaggtggtcaacaagatacaagcgtgcaacaataagatcaccaaatagctcaacatgaaagcataaatgaaaagtgaagatagcaatagacaatgcactgactttgtttactaaagttcggatccaacctgtacacatctccattgagggtcttagaaaagtcggatccctttttcctcttccaagctaccacctccctattgagttgtgatccaaattcatttgtacttaataaaggccagcttctgtcgtagtgaagcggaggcctattcctgggaggcttgggcctaaacggatcgtcatcccttttagggttccaccatatatatacctcttgtaagccaccgtgcggcgatgtaacctcaccccagatatagtgaagatattttgctggttggcgcccgtggtttttttctctcctgttttaggagggttttccacgttaaaatctcgtgtcttctatgattaatctattgttctttatcgtttgtttgcctatcgtttcctaacactcccatggtgtattggtctcttcaagcaatcaccaagggcaagctcatcctccaagcgatccacttggtccaaagctcaaacgccacacaatttccctccaatgaagctttctctaccaagcacccaccgagatgtagcccagcttccactatttcctcttcccttggagaggcaaggtatcaaccttcacaaacttctcttgggcataccacactccacttggttgcctgcaggattctccttctcctcttacaatggctcaagttcttcaacttgaagcataccaactccaaattactcccaaatccactccctaacaagcacacaagctctagccttcttataaatgtgcaagaactcactctcaaggataaactctccctaaattcctaaaaggatattcaattagctcttggggctcttgggcaagcactcagcttgctcaagtagaagagggtccaaacgtattcaaacaactccatggcaccgactatatatagcctcaaaggaccctttgatatcgactgaagttctcactgcagggagtgcagcaattacctgtcctctacagggtatgaagtggtcagagcacaagaggctcctctccaccaaagttaatttgcaacctgacgcaaaactgatggaattggaaaggtgagtaaacgatattataaagactgcactgtttaaagagggctctcacactggattagtaactagcaagtctactgtaataagtgtgcatacccccatttgaatccagtaggctgcatttcaaattgatggaccatgtttcttgtttcatttatccaatggattttaaaacttgaaaaattgtttggcgctagctctacagtatatataatcgtgatgatcaaatcatcagttaataacacccctacccataccctttttctcatgttttttgttttttttgggctccttggaatgctgccacgctgttttattcgaagcagtgctcctcaattgggtaagggagactgacaacactctattccaacagtcatcccacagtttgaataaagcaagcggtcccctcgtgtccggtgtgcttcactggttatgggcggtgagggcttgcatggaggccacgcaccaccctacatatttgtcataaaagcccctgataatttgagaaagtaagaagcaacccttccatcatatttttctcgttataacttttatgaaaataaccatatacttctaagaaatataacacgaagaagagaaaattcggtttttaaggatggcgctgtaatccgaaccagaataaggatatttttgcaaaataacctcccaaacatatctcctcttgtctacctacctcatccccaacccgtcactggcgctactcccctcacgcgcctcctcctagcgccaccgccgctccaggactcctcctcctcagccttgctcgcgcccctcgtcatcgccgtccaccccatctcctgttgccaccctcctcccatgcccataaacgccgtcataatcccccacatccctacctccgtcatgcgtgcccgcgtgagccgtcgccgtctagctcatagatccatcaccaagcaatgcttctttcgtccggtttgtcagtgcagcgataacccagtcgacgtgctcttcgggcagcggaccgccacatcaggtctatggaagcctcaagcctgggaggtgcaacgccgtcggatctggcagcggcaagtgcagtttgggtacagctgcaccccctgcaattgcatttcaagcactatcctcctggctgccgttccacctcttccctatcctcgtcgaacaaagaatgcgataaagtgagcgagcaagtgaaacgagatgagacttcacggtgcgcctcctacgacgcgccatcgcccgcgacgtgctagtcccatcatcaacgcggcggcgacgccaaggtacgagagccgcgcgctggtggtggccagatccagacattacctgcccgcacaggcggcgcaaacagctgacgcagcatgggaacatcgggtatatatgtccttcgcagactcatctccatggataagaagcctgcgaggaatctcaccggctttcttgccaccactgctggcactgtcgtgaataacaacaatagtggaaagttgcctggtctatcacggaagttgttacagaaggcgctgtcagagcacaagaagaacgcactgacaaaggtcaagagcagtggcaacacgcgggagcactccatggtgctgcgcgacgagtgggaggacgagatcgctacactccgcctccagttcgagcagaaggacattgaggtacacacatagacacatccacctcttccccactcctctgtgccttctgtgaattccaacgtggccttacattgattgcagggacactaaaactaatctaattaatcttacagggacaacaatgtagctacacaagtctcatgcaacaaatattgaagacaccaaggtgtagtaaatggcaatctttatgattttgctttccacagatatcttacatacaccatctggctttgaggtaagaaatatggcattatctcaggcttttaaaaaacataaagaaaaggatagtataacttgaataaatgtaagatgttatctacactactgctaattctttatgatggtatattgatattcttgtagaactcaatgatatcaacaagcaaataggctttttgatatgggcaattggctgataaaacaagagaaggggtttaggtaaactacacacatcattacatgcatgtcataaaatattctgcaacactgaaaagtaacaaaattttgcctatttatttttcaatttgattctgttttgtttcaaggcaatttctgaacaatggacaagcaacaatattgatgaattacaacagcaatagctacaatcagcaaggcttctcttctaatcacaccatgctacaaacaacattcagatttaacacgcaaaaatatgcagtttagcaaagcttccctacatgtacttgaaaaaaaagagccatccaaaaaatatactgatacaaataaaaactccatacccatattcaaaaatcccagctagaaccaaacctaaaaccaaaaacagagggttcaaaaccagtagatgaatctgtatgccacagcacactcacaacatatacagatatacaaatcaacataagcagggcccccctcaaaaccaaagaatataaaaatgggggaaaaaaagaaacccaaacacagggaaaaatcaccttgaatcccaaagcagatagagcaagcgtgggatctaaaagcaaaccatctcaaactagaagaaatattccaaaaacaaaaccaaataacaggaggaaaatgaagggaaaaataacctaaaaccacaaaggggtggagcaaacaaggagcagatccaggctggagatgggaggaactaaaactagagaaaacacagtaggcaacgagaaacgcagccaccgagcctgtcgcctccgcctaggcctcattgccaccaagatgtctctaaagaaagccgaaagagacaagactatgacgcggtatttcactgttcaaaataggggaaatgctaacaggccggcccaaagtgaaacccaaaatgctcaaagcggattcggacccaaaccgtaacacgaatcttggcacaagactgaatggatgaaaaattgaagttttggacctcgaaagctatcaacagcaccatagcaaatctattaaaataaatggtttgattaaaaaatgattagcaaacttacatggtatgttcctccaatgggtataaaggtagaaggaagttcattagttcaactgaataaagaacataaaaggaaaatgtaatgtcaataagttaataagctttataaaacaaaaatcatgtcttgtcttccgatagttctgccttaattgaaaaagacagtgtttttataaactcggcaaatttcttttgatctaattcagctttgatcttctgaaagttactgttgaagtcatgtagaaaaatttccacctcaacctctaaaaccttgaaaatgaataaacttttgctgatttgaagtccaatgcgagttaca

SEQ ID NO: 58690 - DNA, 2054 bp, Oryza sativa
gtttaaggtggtgcatatgtggtggaggtggtatagcttttggtttgagctccaaagcatctaggtttaaggttggtaagtttatggaaagcagccaaaagaaggcaaacaatctttcgatttaaggctacaacaggtacaaaggtaattcaaagccaaaagagaccaaagtcagttatcattatgctttaaacaacattaggtgaaaatgaggcttcactaggtgcctactagcaaaggcggtaaatctaatcaaatttaattggtctaatagttttagcgcacttgagccatcagaaaattctcttcgacaaaacaatagaagaataaatacaatattttgtagtatagctgaaaaaacaggggcatggagttcaaattctcttataactaaataagctaaaattattcacatgatttggcacaatgtaaccaagctgtaaatagctaactgctctgtaactaggctgtaactggtctgtaactaagttgtaagtgcttgtagctgctctataactagcctaaaagtaactaatttctctattatgagaccatttagaaatatgcaactctcctatcaatatatatattgtaacacaaggactgttatgcccattagatttgtaccaaatgttgtattctaccttttaaatttaattttagatatttcttggattgtctcattattgctacatatagaattaatattgttgtacactcaatgtgttatagataagcctagtatgacagaggtaaaatacttactcatttgcatttgtgtatatggtatacctatgcctagaagtttacttgatatacgcaatattgcaagggcaagatttaacatatttattatctataaaagttttatcaatactatagaacatagttattatcagtcctcatgatcatcgttgttgcgtcgttgttgtcgccatgatgtcttcgcggtcctggcgatcatggtcttggtcaagatcatggttgtcgtcccgacagttgctcttctgacgtccatcttgggctcatcgattcccgtcatcacgccggttccctcactcctaccttcggccgtcaatttgattgcgaaggtcacgatcatgagggttttggcacctcattctcggtgtgaaccggagaggtggccactttggggggtgatttccgcttgcactgccattgttgcctcatcctcggtaggcattgaggggggacgagatcggtacaggagcgaagaccggaaagatgatggatccgacttggaccacagtgaaagctggctaggttagacctcccaggccaggctgaatgtagaagcccttgtcggagaatcctgctcttgaattcatctcatagaaatcttttagcaccaagtcccctacctagtgtgccactgtcaatggactatatccaaagatggtatttggagagtatagtgatcgttggaagaactagggtatacatgagatcagatcaagcaaacaaggaacaaggatttatactggttcgggccctcaaaatgagttataactctactcaagtttatatgtattatggatgggaataccatatagagtacaaatgaggaatagaacaactagatgaattcgcctactaggagctattgaataaggccttggcttcctcttctggatatggctctggttttggcctgtaatttgatgcccctccaacttcttctgcaagtacaactcgaagagattaagttggatgtaggtttaaggagaccttatcttccacgactaagaatttgacaccttctactctgatcagataatttccttctttatctcccgtatttccttaattgtagggtaccatcccgtatactattagggtggtgtttggatgagaggtgactaattttagtccctgtcatatgcgctaactaggagtattaaacatagactaataataaaactaattgcataaatgagagttaattcatgaaacgattttttaagcctaattgatacataattagtacatgtttactgtagcatcatatatatatatatatatgctaatcatgg

SEQ ID NO: 58691 - DNA, 8689 bp, Oryza sativa
ttcctgcagcccttggaaatataaattgaagatgttttcgcggtccgttatccgtgtttgagtcggttataaaaattggaaatgtttccgtggttcgtcatccgtgtttgagtcggttttaattttatgttttggttttaatctatatttcttctctatctctatctctactattataaaaattgaagatgtttttgctggtattttggtacatcatccgtgtatgagtcagtttttaagttcgtttgcttttggcaatacatagccatatttgagttggtttttaatatcgttcgcttttgataatacagaaggaattatataagaaatctgttttaaaaaaactcgtatgctaacttgagatgatcggactcctaactgcaactcatgattttctaaaagtatatatccaagcgaactcacacagtgaatttcatcttaactaaatcatattataataataataagattaaaatagacttcacccgttgcaatgcacgggtattttttctttttctactaaaataagaagataaagataagcgatggtgaccggacgttttggcccagctcaaaagaaatggaaaaggatcgcatttgtggaggtaatttaggaccatcccaactgcagcggctcaacatcaatttgaacataattcggagaagatcggagttcgatttggcatcggtttgaatttttatttttccaattctaaacctatccatatacctgatacacgcactcgtgtagtcccgaggaggcgcaagatccccaccaactcgggagcaacaggggaggaagacagacacgtacgagccaaagatagatggcgccctggagcaccatagcagctcaccgtagggataattctttgttgccatgaagaacatgtggtaggccaacgccacagagaaccgcccatcactcgtcagtttccatctgatcgatctcatccgccgactcaagttttctctccgtttctccagctcctgatacaccaacagaggttgaggaaattagggagccaaaatacactctactgttgtacagacaagaattaacatacgaactaattaacaagctgctatttagagcaagtttaatagtatagccaactactcactccaattcatctatagctaatctaatagctcattcatacaatagttacatatatataatacactattaatacttggtcccacctgtcatacatacactgtgtcttggagtctgtgctatagctggctacaaatctgtagtccactgcttttctctctccttatttatcttcttaaaatatgtttgtagctggcttatagtctgctattgtacctgctcttaacagccagcgaatcagcaactagtaagaaaaatcaggtgacatgtaccaacattgtgcaataaaaaccaaccaatggaaggaaaatgtaatacttagtacttatctatttcacagtcggatattgattatcttgtgcccctgaccgactccgatccgaggggaaattaaagtggaataaaatctatataagtatttttgagctacctacccacggagagagatagagagatagaagaggatggcgatggcgcggtcggcgttggctagggtttcccgccgcctcttcggatccgtgatgtgcccacgcccactcatggggatccccccagcctcgccgcttcccggaccagcagcagcgcgcacctggcccatccctaacctccaggtgaggtgatcgattcactttaggcgcttggtctattcagatatactacttccttcgtttcacaatgtaagtcattctagcattttctatgttcatattaatgctaatgaatctagatagatttatatgtttagattcattaacatcaatatgaatgtggaaaatgctagaatgacttacattgtgaaacggagggagtatttgttaagtttggtcaatgcagtgaagacgcaacccccactgtttttcacaatccctgcaggttttcagtgaattatcaacgcttttaagttctgcctgattttcctttttttcttctttggtatcaatgatttgtgttttgcatggcgctggctttcttgagttctagtttcacggaatcattctagtttacaattgaggtttcactattgtttgtatgggttccataacattggagtaccacccaatggagagcttgatagttttgcatgtgaaaatgtccacttggtcatgggatttctctgcaattgaaagtaggttaagtgatagtactgtcttccttgtcccactattttttcccaactgccggtacaaactgtaaggatctgcgctatgcaatgtaggagtattcatcttcttacaaagaaacagtttctctttgcccatcaccctataacttgtggttagggtgcaattacaacttggatgttggaaaaattttcctatgtggtcctctgaatcaaagaaatatctatccaaaaatcctataaattttctttcgattggctcaaaacataagggttttggaggaattttaatatcaggcccaaccttcttggggaaaaaaaatcctttttgtgttatctcttctctactattataaagattgaaaatgttttttccggtattttggtacgtcatccgtattttgagtcggtttctaagtccgttcgcttgtgctaatacaaatccgcgtttgagttggattttaagcttgtttgcttttagaaatacaaaaggagtcataagaaatctcttttaaaaaacaccacatgctaacttaaggtgaaagtcatactcctaattgtaactcatgattttctaaaatatatatatatattcaagtgaattctcacactgaatttaccctagctaaatcgtataacaataataaaattaaaattgcattcacccgttgcaacgcacgggcattcttctagtctcttctgaattctatgtttttatgcactctacagttattcctacggttgtgcactctaatcttgcatttttttctctatttctatgtgtctgagaatcctcaaaagaaaaaaaaagatcctacattatgaaggaccctttgatatcgaccgaagttctcactgcggggagtgcagcaattccctgtcctctacaggggaaccaagggtatgaagtggtcagagcacaagaggctcctctccaccaaagttaatttgcaacctgacgcaaaacttatggaattggaaaggtgagtaaacgatattataaagactgcactgtttaaagagggctctcacactggattagtaactagcaagcctactacaatcagtgtgcatacccccatttgaatccagtaggctgcatttcaaattgatggaccatgtttcttgtttcatttatccaatggattctaaaacttgaaaaattgtttggcgctagctctacagtatatataaccgtgatgatcaaatatcaatagtaggatgctagggctatagtcttataattgttttcatgctatattaatatgcattctctgctaccatgtgtatgcaagcattgtgtactagttatccatttcaatcacatatacttttgtaggtcggcagtcaagaggacaacagcatggatcgataaaccgtgcaacgcacgtgtggtgattttagtgttttgcactggtgctgcagttgcttacgcttggatggcgagactcgctttttttcccgaaagagctaaacttgatggtgatggaaaagctcatccgattaagcacgcatgacgacttagtaacttaattgcttgttgtcaggcagagtcaattacgtttcatgtccgtgagaaagtgtagttggacggtcgagttctaatcgttccggcaaagagcattattttatctccttctccctcctctgtttcatattgtaagtagcccgtttcatattgtaagtagctcttaactttttctctagttaaatttttttagttcattaagtgtaacattgaatatattttgataataagttggtttgtgttgaaaatattgttacaaccaatctactccgtaattattattgataacttatctagttggacggttaattacctgatgaatcatttgtcagttgattggctttacttccccacaaaagaaaaacaagagtttattggaattacaggtagatgaggggaagaactacactttagtggaaacaaaaaggagaacaattcagagttggaaaaaaaaaacaagttctcgatatacatcaacaagagtagttttggatttacttcaaatgatggtgaccacgaacaagatataggcaagcggcaggaacaaaaacaaacaaattttatctacactgaacaagtaaatgtcagatcgtcctggttggaatccgtcagaccgtctcagacctctgagcaagtagaagtgcctcaagttcttctctccgtttctccagctcctgatacaacagaggtcgacgaaattagggaacgaaaatacactctactgttgtacaaacaagaattaacatacgaactaacagaatatttagcagcgaatcagcaactagcaagaaaaatcaggtgccatagaccaacattgtgcaataaaaaccaccatattctgaccaatggaaggaaaatgtaatacttatatcctatttcacagtaggatattgattatcttgtgagcacgcatttacttgatgtcatatgttgtgactcaaaatacaggctcagtgtcatgattactaaatgaaattaggaaccaaagtactcacctccagatccttgactgcttgttctcgtgatgttgctttctgctgcctagaacgcttcaacacaccaatgcacagcacaccctacatattcatcaaagcttttagtacacataagaaaacatgtggcatgcagtataaacagggtcaaaattggattatttgttcaatgtgcattgcaagatcatcctctactacatatcattagaggcaatatctcattttatgatgctgatgcctgtatggaaaacgtctgaaaccacatttcaagtttacaacttcataatgttattagtcatttaaacaagctcaattagctactgaactaactgtccaaacaacaatgagaacaaaattgcaaggcatcaaattattctgccccagtggggaattattttctgctgaatttaatatctaggcatctgaaactaaccatgttttaaagttcagaattttaaaggctattacatggtactagtaatatttaaacacaaatgaacacccaaaattttgtagactcaccgagattatatagatcagtccacatgcaagaagcagatagctggcaatgtcttcaagcaaaatcaaatcacccctttcaacatttgggtatgcctttgtcatgacagcaacactgcaacaaaccaaatgaaaaacattaatccaccacaggaacagaatggagtacaattcaacaaggacaataattattattgaagtttttctactattcatctgttcattacactgttcacatgcaaaaacattacagttaagatgttcacgatcccaaaatttatggtgcagttggtgcatgcaacagttgtaattcatggttcatgtactgtgagtgcaaagaggccaatatggtgaatggcagttgggtgattacggttttactctttattcatggactaaacaagttctctgcagaagaatttttaaaagagactcaaatttgtacgcaaaatactactgagttgagagtatgttaatgtactaatgttttgagacctaggtaagcatgtgtgagatatttccagcaaaacttaggtgcatcctgtgttcaataagccacaaagggattcttgctgttcatcctagaatgggaaacctctggttcacagattgatgcaaatcaacatgtgagaagtacaacacactgagaggagcacagttcataatataccttatcaccttaatacagaactgttaagaggttatcactcatcaatataatgaaacataggtgctagctgggcaggcttaaccactttatatagaaatagcaccaatatggaaagagcatatcatattgtgaatttgtgatagtccattttagagccaggttctgaaggtactctgtgctcgtcatgttatatcaaaacaacatggatgtagagtgtttgtaaaatattcaacaagtattcttgcaccctgttacaggcttacagctaacccacctgtttgaaatttaataacccagctaactaattttattgatcttcaatttctcctattacttgcaaaaaagcaacaagaatgaagcatatgcactgagtagtctgtgcaatcatatattccaataaaaatgcagaaattgagaaacagatttgggatcataatagaaggaataggaatctaaattcctccaggatacttacaagatctgtaacattccccttgcaggccagtactccaaaatctagtcacatcaaagagtataaaacatcagtaaactaacgggtcaataaaattatgaaaaaaaaaaactcgagctaactagttgaaagatactgatacccacacaagacaagtctgcaaacgttccatagtattaccaaacaaataattgtgaggattcagcagaacaagcaagatttggaggctcaaatgcaaaattattcacaggttaacagcttagcagtaaataatttggatttatccacaaaacagctcatataggaaaaaaacaagctttacataattaatctatgtgtaattaacaaacatactcatatgaaacaacaagtgcaatcgcaaaacaaaatattactgcaaagttcattgccatctgcgaagtggcactattaatgaacaaattggacactaataatcgaaggacgccatccaataaatattttttttgctgtaactcaagaatacttattgaatcggaaactgtagcacctgaaatgtaaatcgagtgaaaaatggcgtgcaaaacaagaaggaagaagcaaaaccttgcagaatttcatgatgaatccccactctgtctcgaccacccccacgaacagcgagatgaccaccgcgtagcaccggaatatgcccccgaatatctgcaacccaaccaaacagcccaaatcagctcgtagccgcgccatggccggaaaaacgaaaaggaaaggcaggggcctacgcacgtcgaggccggtgcggaaggactgcacggcggagaggacgttgacggcgacgcagagcgcggcggtggcggcggtgacgacattaaagcagcggcacacgatgaggagcgggtcggacctggaccgcgtggggcgccgccgccgcggcgtgtccccgccgccggagagctgctgctgcgcctccggcgcggcgccgccgcctcccgacgccgacgcggcccccttggccatggctagcctttagggttagggttagggttagatttccgagaagcttcgagctcgaggcctcctcctcctcctttagtggtgaggtggccttcttctcttctattctcttctcatataaagcggaggtggaagaagacgcggtgcaccgtggacccggtccacgggtgtacgtggaccaggagactcaggctcagcggtgttggtgcacccggtccagggaaagggtggggtgtgaggggagggtggcagaatgtggggccagatgcgtcccgccacgtgggcgagtgaggtggagggatgagccaatgggaggtgagctcgtggtagctgacgtcatgaatgctccatgctgttaggtatgggaagcattgataaataaatctagtactacctcagtgcagccgtggatatccgtgtctaatgtttaaccgtccgtcttatttaaaaaatttacgaaaaatttaaaaatatttagtcacacataaagtactatttatgtttatcatctaatagcaataaaaatactaataaaaattttttcaaataaaagaacagtcaaacgttgaatgtgaatagtgtaaaactgcacttattttgggacggggattagaatattccgatggatgatgattaaatttccagaacgaggattagtagtgtacatgtgttcaaatgaggacagtaggagcatgagagttgctcagatgattcagcatttcaagaagtgtgttcgatttttgttcgctttctgaataagtattactagcagttttaggttgtgttcttaagctatggttattaacctccactctattatctcccgcgcgcacgtttccttaactagtaaatagtaaatagtattctttttaaaaaagaatctataaacaggctgctaaaaattcatattaatgaggttaattaggttttgaagcctaaaaagctcaagattacataaaatggtaaaagtataatttaatcatggaaattgcaagttaggcttcaacctgaacaaggtatagttatatatggaagcaagggataacttgctaactggtattccgtgcagctcactctgctagtttatgtttttttctctttttctatcgtagcaaatgcacatccattctacctatgcaacctctgcactgcaatgcagtcagctaaggtggtgtttggaaaggagggactaaagtttagtccctctcacaaaaattttagttcctctcatagagacttatgcttttgtgagagggactaaaatttggctgcagg

SEQ ID NO: 58692 - DNA, 21864 bp, Oryza sativa
aagttttgagatttgattgcacgcattctactattattactactagtatatatatgtaagaaaaggagatagtaactgtgaagtgttcataaatcctaatgtctggagctatgtagatgtaggtctgttttgcttttgcagagattgaccaaccctctcactggtcactgcacattcctaatccttttcaggaccaccaaaagacaccccaaaaatctttgcacaagtcaattcccagacaggttatgagccagcactactgtagtacaatcctagcaaagtgcaattttccactcctttctttaagcatttgcaaggaaaaagatgcagcaagcttttgagcaggtagagggagatctctccaagtctgggtacagtttgattctaggacactagaacaggagatgaatagaacaaatggagggataaagtagggtagggacccccccccccccctcttccctcccctatcacacacagagagcagagtacggcagaatcagaactgaaagtgtgtgtaggagcagcagctgagccttttggcagacaatccacacttgttgactctggggctgggagcaacagcagtacaggtaggaactgagccaccctgccctgcagccaagatcacaggcaaggctgccatggaaagatctccacagcccagccagccagccatgaccacaacaccccatccatcatctatcacaagccccataacctgactgactgacagtcacacactcttctctatctctttcactaaaacaagttgaccccagagagcaggcaaggtactcctcagtaaccagaagtagacaagaaatgcaggaactttctgtgccttattgaccacatgtgtgagtgtgtgcccaaaggtgagcaaagaactcacttttgttcaggcaagcaggggcagagtttgatgctgcagagcaagcaggagggcatggttgcagggttggttggtctctcaccagtgctagcttccagctttcatggccccgctcatctcatcagttcaggcagccaagggagtactccacctccactacttgtacgctcctctggtgtgacagtaaccatggagatactgtaaaagttcagaactgtaaacagaagctgtggagacggatgactgcagttacatacaagaatgttagtagtactttgtaatacaaacatgatgagatattgagatagatgggtgctgagaatgcagtcagagaatagtgtaaagatagatggcgatgcaagaatgagatgtgagtatgtgtgagatcaagaatgagatgtaaagaccagtagttgcgggcagggcttagagaccataattacacgagacaaggtgtgcatacaccacagtcaacaagagaggggaaggtgaggtgaggggggatgcagcaagcaaagcaagcaggcaggcaggcatccaatgcccccacacacttggtttctctcttgccctgatccatgcaaccagcagacagccctgcgtgtgccatgatattggctaatttggtgctttgctcgtgtgaggtcatggcaggatgcaacacatcttgtatccgtgtgtaggagctgcaaaaaaaaaaaagaaatagtagcatcaatccgtaaacagcgaggccgaggggaatgcaaaaagtttcagataaacctaaacctatgtcaagggtttcagtttgaacaaagtgatgcaaaagtgtaaaatgtcacctcagggtcactgttgaggaagaagaggctgaagctggtttgttgctgatgttgcgattagcagatctgctatctgctactgacgtttcaactgcactagagatcatcagaaaagactagccagaaaatgaaccctcactgcaagacaaaccgactcaaacacataaacagggagatttagtgcctggtaggaaacaataacaactataaagatttgacacaatcttctcaatagtcatcggaggatgcatcgaatatgtaacagggaaactgcacctgacagttcagaaatgtcccaagtgcaaataggaaaagatgtctgcacaacaaacaccaggagagggccatagcccatgggtttcagatggacaccgacataataatacaaaccatattagattgcatcaacgatttatatggcaagtatctgttactgcacatcacacagcaccaaccacatgctacatttgtactcttgtatatgtacagatctcagaatgcttattatgtatgagcatgtcacgcatcagatatatatgatggtggaatcaagaaagttcattctcagctgcaacagaacgagtaaaacacttgtaatcacaagacagatcagaaacagcagatataattcactatggttgtaccaggatgtgaaagctcatagtaaatacttgagaatgaaacagcagatataattcactttatgtacaagtaattttcatatatgtatagttgttatatattacaggaaacactctgctgtccatggaaatgatcacttgatccatcctcacagatttaccgtaaagcaatatgtccatggacttttcactaaacttacaagcaagtactttaaacagctaccaagaacatctcttgtccagtaattgtccaaaataactcctgaatattagcataccctcacatctgaacagaaaggtagtcttgcctagtttatatagcaacaaaggttggtgcagtcctcatggcgaccatttgattacatgattaacgtgtctgctgccatgaatagtaaggtcaaaccaataattaatcaaatttatggaacatataagtggatgagtttgtacgaatacatatgcacgaaagcaaaatccaacatcccaatataactaatagtatataccagctaatcaagaacggacataatattctcttaaaaatgtgacaatcttaaactaatagatgatcgtgtagcatgtactgatgtaaatacgaggcaaataccagcacccaatgctaacaaatactaacaggtaaaatattgtgcctgacattctgcatcaattgctcattttctcttgatgaacctaatttagactcaacagaacacatggtatgtctccggcacataatcaagacgcactagttcaaagtactacgttgtcttgtgcctagacagcaaccaaatcaaaagcatgcattggcatcaactaatatgaggcatataaaattttaaattaatcgcaatagcgtccaaacagcgcaggtatgaacccaaggcttgctaattctgtttcaccagcctacaaaatctgcaccactaagacgctactcaaatcacaggacaacaaaattaccaacccgacaagaacaaccccagacaactcaattcaccatccagcgtttcgccacaagcaatttcagcatctcacgcaggaacgcggaggagctcctctggacggtccccacccgtgcagtgcactgaaacctagatccggagtgcacggaacaaccaaactgttcatcaatcccatgatcccagcacaaacccagcacaatgatcacggctcacgtgatgagccttacgttacgagacagcacgctacatcccaattatccaagcacccgatcaggggggctacggaatatccacacgctaaacctagtttggggagcgatcgaacagagatggacacacaccctgaccacaccaagcacacggaatagctagctatctaaacaaatcacgaagcgtgtgccgcgagtagactcacctggtacggtaggtggtaggaagtgttgggggcgaaatctctgtagggcgtggggctcaggtggcggcggtggcggggccgcggaggtcgtcctggatgggggggaaggagttgcagcagtagcagcagcagaagcagcggccccaccgccggaagcagcggcagtagcaccaccgcccccgcacccgcgctctccccgtcgccggcgccggcgccggcccgccgcccgagtaatccattagaaagaaagagagagtgggtgtgatgaagaggtggagtgggtggaaagtttttgggtggaggtggaaaaggaaggaatcacatatggagtgaggaaagcaaagcaaaggggagagcttcagtgtggaagcgaggggttctggaagctcctcctccatctcttggattccatcgtctgccttcccgccattcccctgacaccgaaagcgcgcgagttccatcgtctgaaaaaaaaaacaacaaccagtcaatccacctacctgaagaagaaacgaggtgtggcttgggaatttgaacttgattggcagattaagaagatgagaatagtgatcaccgatggaaaatgtcaaccgtcagcacgcaatcagtgatcagtccaagatggcgagcgtgtccactcgtttctatcccttggagttcaggcaaacaagcttgaaaagaaactaatcagctctgcaagaaacggcctccgcctacactgattatcctgatactccagaaagaacagtgatctactgatcttgttctcttacagtttcaaacagatccacccaagaggcgttggcaaacctaataacaagatagagtgagtagaaagaattctagtaacagttgagactcaataacgaactgcatcaaatttgtaaaattcagtaatggtgctaatggaaagtagccattttgttttgaggatttcacaattaacaatatatcaattcagatggtttagcaattaaaaacaaaacacataaatattgatagacctgagagttcattagttaccaccacctgcacgaaagttcatcatagttccatccaccattttaaaagaggattaatatgcctacaatcttcataagacagggaataacaatttgaagcaaactaaaagataaaatcaattgcagtattcatcatttcacagaaaataagcactatatcatggcaaaggtggtattgaagaacagtctgtgcaaactgcaaaggaagtctattatggttttctccatactcaccttggttactgatatatcgaccataaataccttggccagtattttggccatcctttgacgatgtccatgattccaatcatactcaataatgtaaaatctttttcaccaatagtcattgcatgagcatactccatcacgaaacacatggaaacgatgacggtcacgcacaatgatctcccgctcgtagagcttggacacaagcttggaatgcacatggcaatcacggcacactcgaaggttcttgacaatacgaataggaacgccctggggaatgtttaagataccaaatgctaatgccagcctctcgctgtggtaggatagggcgatgcccttatcttcctcatcatccatgtccataatcacctggcttgtatccttaacatagccaattagttgcaatctcctctctatatcttccaatagtgcatagattttccttgtgagaggatgtcttgtatccccggaaataaattcatggaccaaaccatttaactctatgaagctcaaacctgtttctttcttggctcccctatcctccatcatctgccgaatggtccttgcttcttcccatcgaccattgacagcatataggttgaatagaacaacataacggccaccatcatatggctctagctcaataagccgcttacccacacgctcacccacattgatgtcattgtgcatttggcatgatgacatgagtgcaccccattgagaagcatgtggctccattggcatatccagtaacagagcttcagcttcttctacattccctgcacggccaaggagatcagctaagcatccatagtgctccctttgtggcttaatgccataatcctgcatggacttgaaaacccttttcccttcgtccacacgccctgtatgggtgcatgcacataaaacagcaataaacgtcgactcatttggcatgaaacccttctgaagcatccttcggaataattcgagagcacgctcaccatagccattcatcgcaagcccaccgatcatcgcattccacaacaccacatcgcgacgatgaactccatcgaaaacttgccaggcatcctccatgcacccacatttgcagtacatgtccacaagagctgtctcaagcatgagatttccacgcctacctccaaaactccctgtctccagatacctatgaacccaacgccccctttcaacggcgccgagatgcgcgcatgccttgagcacgctcaccagcaccaccacatctggcctgaattcctcccgcatcatccgatcgaacacccataaagcctccccaaactccccggcacgcacgcacgcgtccaccatggcactccaggaaaccaggttccgctcgggcattctggcgaacacctcccgcgcagcgcccaggtccccgcccttgccgtacccggacaccatcgtgttccacgagacgacgtccagcgcggcaccaccggagtagagcaccctgcgcgcgcggtcgaggaggcccagcgagcagtagagcttgaggagggagttggtgacgacggggtgcgcgagcgcgccgcacttgaacgcctgagcgtgggcgaggcacgcggcggcgaggcgcgcgcagcctgcggacggagaaggggacggggaagacgacgacgacgacgcgagggcggcgaggaggagggagaaggtgaacggggtgggcggcgatgcctcctcgcggatgcgggcgtacagggcgagggaggcggccgccggggcgccgcggcgggcgagcgcggcgtggagcgggcagcctcgggagggcgccgacgagaaggcggcggcggaggaggaggaaggtggggtccggagccaggggaggaggcggcgggggagcgcgggcgccatggcggacaccttgcgttcagaacagaggtgcaaagaagtttgagccttggcgcgccacgtaaaaacgaagagactcgcaaacgaatttgaatccttcagctgacgtttgtccttgaattcgatttatttcaccatgattttgtacgaaaaataaacgattactagtactactgtacgaatttggtgtagaatcttttgcattccagacttatcacgggtgttgggcacatggtaaaaggggtatcagtataatgaactccaggtttattttactactagtatgaaatcaggcactggttttccaacttattccatattttgcaagatacttgagttgtgcaaatcacagtagcatatgaaatattcccctctttttatcaggaaattttgttacacaatggtctagtatgtactaatagattttatgttcagatgttgtgctatttttcaatgataatagatgtgtatctgctaagcttcttttttctgtagctctgcgtgcaggaaaacacaagcataaaatctgaaaatgatgtctttcggagatgttttcatcattaaaggtcaacaaatgtcatggatcttacagctttaagtgaagcaacacagatatgaggctcaagaataacaactctggtatatactaacatctaaactatgatcgcagctatatatggctagttgaacatgaaaattgtggcaccgagagggggatcaaagagaacaaaagggacaagaaaacaaaaaccatggcatcccagcaatgtcgccgaagaacgtttgtactccataaactgccctggcttcttggccaccaaaacatggctgatcacttcacggaacaagccacacatacaaagtttttcgccccatctgtctaaaccggggtcaatttttagtcacactttatgttcctgtagatccttctcacaaacagtgtcgatccaagatacccgacagcacctggaccaaaattcgaaccggtatcagttgaaaccatcaaattcttgggtttaagcatgctaccggtgtagaagagcttaccgcagagtgttcctaaacctaggcagaacataagagtgtagccgaagtagaaacttgtctgaaagaatcctgacatcttggtcttcacatggtaataatatacggagtagaggtaaacatagacggcagtagaagcagcagagaagaatgaagtccactgccagtggtagttctccgcattcagcaggaaatatgtaccaacgattgttacacagatggtgacaattatgaggatcaaaaagactagcaacatgaacccatatacatagtacacctgtcaatagatgatcaggaaggatgcataagtctcaactctcagggctccttagtaatgaagcctgtatgggaaaattagtgttgcctgttttaccttgtagttccaaaatgatgtgaagacaaagtacatctcaatgaagatgctaccaaaaggaagcagtcctcccatgagggcaatgacagaaggcgtgaggtaccatttcttctcagggatagggcgaggaatagtctttactctgcatggattatttggggcaccactccagtttctaccaacaacagttcccaaaagagcaagagggaaagatatgaaggcccacaggatgaacacaaccaccatagtaccaaatggtatggcagctaatgatcgatagaatatagcgattgtgttaagcactaggccaattccaaagcacataaacggaaatagtgatgctgtcataatcattgccttgatccagtttttccctgctcagcaaaccaaggatttaaatgaggtgagcatcttatagtaaaataggtgtgtgcctgttcaagatgtaaagtaaactgagttcatacccccatgccgtgaataaagtgcaccactgacatatccagagatgaatgaagtaagggcataacaaacaatgaatgttgtgacaatagctcctcgcctacaataagaatataaggtgtgagagatgcgcttttgcatagaatcagaaagtacgattagacttaaatgcttcataaagtagttcagctacttgtgaaataaaagcaaaatatcaaaaataaagataaatgtgcactccaaagaaccttttaagcagttcattgacaggccgaaaattagaaaagggggctgggtttcatgtgaaggcggtaattatgatttgacaattcctcacatgtcataatgtgattgtagttataaccacacattcaggcacacctagaatctggaaagccttactgcgaaaaccaatgcagtcctgtctacgttaacaaattgtgtattttaaactggaggtggtgtatgctgtttggcttgacaaaagtaacaagtgacaggatggagaaaacttaggggcctaaggcatttagtagaagctgcctttatagaaatcggtgttaattgtagtgatttgaggtaaatcataaatgatgtgcatacccaatatacagcattccgatgattgccaacaaaatcactagcagaataagagcagacaactgtgtgccaacaccaacaagggctgaaagaagagccaaactgcgaggaggccggaaaacatccccatggacaagcttccatccagattcttcactgacatctctttcctgatattgaataaaaatgtcagcaagaggatgtatgaagcgcataacagaatttgtacattatttgaatatagatagtcaatcaccagagtttcaagatcatcatcgtcgcgggcatactttgcatagtcatttcttagagtgcgcatcaaaatcattgacactagcccagtgagaaagataaccatcatgaaagaattgaagattgagaaccaatggatctgccataaaatggattatctgtggtcagaggaaatgctgcaagatatacatgggaaattgagaatcaaggcataattttttatgtggaaaattggcaacaaaatacataagaaccaaggtgcagaaccaggctttaattgcagaaactgagttcttacctggtgttcaaagaaagggtagtcaaggtatacatcaaagcggtgagcaaatgttacattggttggttcccacttgacagaatatgtcatatccaatgccttacccgcatcaataagctttggactttcttgagtaagattaacatgaataatctacaggaatgtaacagtagtaatactcagtttcttgaaggtcctgcgaaggaataaatgcaagttcatgaaacccaaacctgattgccattgtatctgatgacgatgttcttgtgagtgaaaaggaaatatttgttatcgctatttctgtctgcctctccaacaaaacctgttaagttataagttattagactatatataagatctttgagagaaaatagtaatgataaaagaggatacataccccatagaggcaaatcatctttgatagtggcatagaatttcccagaagtgtgcagaaaaggataataagtaaatcaataagtcacagtgcgtaaaaatgtttatgcgtactgaaaaatggcaagtaaacacaccagcggagtcaagaaggaaaccagaacagcttaccaatgaagaattcaaaccaatatgaactctcaatcgcatcagataactgtttggccttgtcaggatcaagttcaattgaacaaatggtacccttgtcaacatcccctgagacaaaccatgatcagtcttaaacactgcattttaccttcccgtttcaatgttcaaaactgaagcagcataaaaagaacaatgcacaacaaaagtgattgctcacttccaaactttatgtcgatctggctgtcaatcagctcatttccaccgagaacctccccaagccctccccatttatgcacggggttattggacggatggcaaaacggaaggctgtagtagttgtaagtttcctgtgggttgttgtacgggccaaccttgttcacccagagcataaccttctcctccgattggtactacacaaagcgaagaacacgacacatcgtaaatgttccaaagcaccagacaaacacattcttcctccaaaatacacagtaggccaaaatatcacctaaatcctgagttaattaccgcaagaccaaacattacagtcagactaactgcactagacgttacagatcaaacgagtcaaactttcagaaggaccacggatgccgatagagacgaactctcgcattgcaacccctccatttctcaccactcgcgcggcgagatctctagcagagaccacgcgacgagaccccgatccagcacgagggagggactggctacccggagatcccgccccgccggagcccgcgccacgcagatctgaccctcccacccgggcgagcacggatctagcggaaccacggcgcacacgtccccgccacggcggcccgaacagaccccgtcgccgccgggtgggtggcgaccgagtgttccgacgccgaagcgcgcgccccccgtctgttgttcccagcgaggcggtgaagtgggaggaggagctggttggttttttaccttgtggtcggagtcggaggcggcggcaaggggggcgaggaagacgacgaggaggacggcggcggcggtggcggtggccgcgtgggcggcagcggaggccattgggagggacggcgagtgcgaggagaggagagggagggagcgcgggcggacgcgcggtgcagtggctctctcctctctgctcctcctattgtgttattattacgagagtactactactagtactagtatttttttttctttctttttgtttttttatcctctcccgggctgttcgttttgtttctctcttttttttacatttattaataatttaacactgcttgaaacgggcttcgattgttttacattttaacccactttcattcactcagatggtctcatgtatttcctccataaaaaaaataatctaaaaggggatatgatttatccaaattcgttacattaagagaggttacatcctggtcacagcgtgttttaggtttttcttttttttacggatagagtatcaatcctataagttttaattaaaataaattggacactggaaaaaatattaaattatcaaatgtcttgtgtgttggtgtcatcaactggtgttgctgacttcctgcatggaggagcgagatggttgatggggttgaggaggttttgaggagaggcacctctcgccggttgagggtaagggcctgtttgtggaactttagattttgagaagcagttgtttgacagccagtttctaaaaatctggaaaagccctgaaacccagcttctccagcttctggtttcttagttcattttttagaatctgtaactacatattctcagaagctgtgcattgtttggggtagcttctagcagaagcagcttttgtaaaaagctgcagctgggacaagctcccccaaatagggcctaaggctgtgttcgctagtttcggttaggaacacatgtcctatgcacgaggggtctattagcgcgtggttaattaagtattagtatttttttaaaaaaaaatagattaatttgatttttttaaaaaaagtaactttcatatagaattttttttgtaaaaacgcaccgtttagtagtttgaaaagcgtgcgcgcggaaaacgagagagtggagttgggaacctatgagaaagaactcagccttataaaacgtgcaatgtcttacggaggggtcgattagtaaacatattactttctccgtcccaaaatgtaactacctagtataggatgtgatattatctagtcctacgaatctggataggaggtagtacaacaaatctggacagcttcgtagtggtagcactggtggagaaaccatttatactcccggttggcaaccccctttagtcccggttttccaaccgggactaaagatgggcctaaagatctttagtcccggttgaaataaccgggactaaagatggatctttaatcccggttggtaacaccaaccgggactaaacgggactaaagagagggtagcggcagttccattaggtctccttttctttttttcattgttttttagccagagtttaatccctatatttcctctcaaatcgagtgggatgcatatccaaatcaaaccccaaatcaaaataacatcccaaaatattcacatcacaaatcttaagttacttgtacacacaaatcaaatacatcacaaatcttaaaaaaaaaattacacacaaatcaaatacatcacatattatacatctcagatccatacaacaaatcacaaaattatacatctcagtgaatcacaaattgtaaaaaaatagaaaagaaataatggatgccggtagcgccacctgccgccgctcgctactcggccttgcgcggcgcctgctgcgtgcggccccgccggctgcctgccgcgtgcggtcctgctgggcacgggaagggaggaggcggcccttgccgggatgggaggaagaaggggaggagggggaggagagggccgggatgggaggaggaaggggaggaggaggagagggagatggatctgaggagagatcggatgggaagggaggagtcggatgggaggggaggagggggaggagaaggccgggatgggaggaggaagaggaaagggtgatgcatctgaggagagaagaggccggttgttggtgagtggatagggaatatggattatatactacgcatgatttggagtaaagatctagaagatcccaaccgggactaaagtgatgatctttagtcccggtttgtgacaccaaccgggactaaagatccccgcccctctgacaagggactgacaggggatgaaccgggactatctttagtcccggttggtgttaccgggactaaagatcgtagaatggctgtgggattttaaaccgggactaaagaggatctttagtcccggttctttttgtaaccgggactattgtggttttggggcgaccgagtaaagatcagttttctagtagtgtagataatgtcacattctatattaggtagctatattttgagacagggtaagtaatgaatattgataagttatataagaagttttgtgcaagtgtggtaggtatttaagtagaacattagacgtgtagtatttatgtaaatggattaacaaaatatagaatagtataatttctattggtaattaaatagctgcctatgtgatatagtgtgacaaaggttacatgtagtaaacttatactacaaataaatagcatttttccttttttttccttttactttatcctttgaatatttcttgaattgtggatattttgtgttttcatcaaactcgttgttatagtactagagtatttttcaacttttttcattgtacagttgattgttcgtatctacttgtatagttttctttttccagtgtccctacatggtatttcactttttgttaaaaatgtcacttttagatttttaagatttgttcttcattattatattaatagaatacttgtcgatacctcgtgccatttcatcacgcaagacaatatataaaaggtccttttccattctggccattttgctcaatatataacggccgatccatgtttttttttgtcatcttaatggtaccaacattattcatgaccataggaggattattgggcacctagctatttatgtgcacagtgcacttgcaaagaaagagcatgtacttcatcattcttcttgtagtgaattgttcactgattttattatagcggtaataacacaaatataaatataatcaaataaaaccattttttgcgaggataaaaacctttttcgttgtggttgattatattatagtcggccaatagcgattgaatatacatactgggcattgcccaaagtacttttgacggtggatccaatggtattcttctaagtgattgataaatattgcttatcatagtttgagaaaaaaaaagtcaattgtgtgtcatgtacttctgtttggtattgaagagaataatatgtctttcatattgttctcttcaccaaaggatggattaagccttcttatgtcataagagtataaaaccatcctctcacatttctttccatttaactataaaacactactcaatagatcattaatcaagatgattttgctacaagtataactaggtgaacctcgcgcgttgctgcaaaagtttaatatgataacaccgagtaaaaatattgtgtaagatagctagataatataatcttgcgtaagtttatgtggtttataataatttaaatttaaatagtatataaaataatgattcaaatgtaaaagtaagttgatgtagttttatgagagaagaaaaggagggagatagtttggatcatagattaatcatctaagagctaaaaacaattgaggtgatatgacttaataaaagaagaaaataagtggataatttggaccgtaaataatcatctaagtacaaaacagttgagtgatatgggttaatgagaggagagagagagagagcacattttcggcatgtttggcacaactctagctcttaactccagctttaagccggagttgtgccaaatggtttagatcctatgtttttaggagtgaagttagcagagctactccttaaatatggactacgaggtggagctgggtttttattgctccatagctccattccaacccaaaagacccactgccttcaattttttttagcatatttacacacaaacgctacagaactacccaaaactcacctcctcacccctctctatccctcttgaaacttcacctcccatgggcgagcacagacggcaagccaacggcgatgctccgacgggggcaggcgagcagtgcgagcagctggcgcgagtggggaggacgcgctggtggcgcacgaccgttggtggggattctatttttttttaatttttttagatctagagctaaaagctagccaaacatttttcaacaggtcttcaacctccaacaggagctagattctattggagtaggagtttggagtcctaccaaacgggaccttcaactaagttatgaattaggatgaatgtaatccatccaataaaaaaaaagccaacttagaatgtgtcccctcttagtataatgaatcaagatatatctggatatgcgtgtgtatgttcatataaataagtgtgtcgtgttgtgcgttgtctatgttctgtgtttataaagaaaaaaaaactaccatggcatctccgacggattgagatccagtgcagttgttactatcactgcaactttagtagttgcaaggtagccgatggatcaaaaacagcggctcagatcatcagaaaatactgttcacgaatcactgtagcgtatactatgcaggggatggcagagtagatccaagctgttggctgcatcgatccaacggtcataatatgctatcactgctaaagttgtagtcgttattttaactgcattggtcataatacgctatcactgcttaattcatccccgaccatgagtagtcctaaagaaaaaggaaggagagtgtgagggtattgcaggaacgacgtgggtttctttattaccgtttccaaccaacgcgctgttggaaccttcgccttgtcttcgtggctatcttgggatcggtgagcttaacgacgcgatcatgatcatgccaggccctgtatagttcataaaacaaaaattttacgttgtcacatcaaacgcatacataaaatattaaatgtagggaaaaaaatcaattacacatatttgcgtgtaaattgcgagacgaatcttttaagcttaattgaaccatgatttgataatgtgatgctacagtaaacatttactaatgatagattaattaggcttaatatatttgtctcgcagttttctggcagaatatgtaatttgttttgttattagactacgtttaatactttaaatgtgtctacgtataatccgatgtgacaaccaaacctaaaatttttcccaactaaacaaggcctaatgcgagttgtcggaactcgggaaccctcctgttcggcgctgatcaatggctcaggccctgtttagttcccaaaacaaaaattttcacgctgtcacattgaatgtttggacacatgcatggagtgttaaatgtaggaaaaaaataattacatatattgcgtgtaaattgcgagacgaatcttttaagctaattacgctataatttgacaatgtggacagtaaacatttactaacgacggattaattagacttaataaattcgtctcacagttttctagtggaatctgtaatttattttattattagcctacgtttaatactttaaatgtgtatctgtatatccgatgtgataatcgaagaaaaagaatttccccaacttgactgcacgctgcagcccccagcttcggttgtgtacaataaaataccactgtagtagtactattctctagtacatcgtggtcaacactttggcagttggcacgaatcaaagtgaccttacgacgcggtaggagtcaacataagcaaaggcaaagaacttgcaccgaatcgggcacactgccgacaggttagaagcataattaagcactggaccgatacattgacgggagctaggaatttacaaaaaatactaggactgaatcaatcaataaagacctcaaccaatgcaatttgttgaatcctcaaaacttttcatgattttttaaaggatttacaagggattaaaggaaacaagcctgatgttcaatccctaattatgtgtctccgccccggaccgataaccgctttcaaatgcaagtttgagaaagaaaatgaaggaatagaaaaaaaaacaaaggattgtaaataatacagaaataactagtgcctgattagactgcagaaaaaaaaatgaaatttgagaaacacataaactcgagaagagaaacagaagaaaacttttcgttaggctgaaccttatgttaaaattaggtgatacacctgctttgctttggaatttatgatgggtatacgtgaaatattgcacgatattgaatattgaaacattatgaaaatgacgtagggagaagataacgtgtcatgcttgtacaaaatttaagatgctactacatctgttctaaaattttgtaatctaggatgagatttgacccataaaaattcattgtcttaagttgagtcaaatcccatactaagttgctatatttttagacggagaaagtactccttccatttcataatgtaagtcattctagcattttccacattcatatatgggaaatgctacttatatatgggaaatgctacttacattgtgaaacggaggaagtaatagctaatgatgatgagttgatatacttgtatgttgagctttaacttataataattgtataacctatatagaaagtatagtttctactggattcaatgggtccaatcctcaatttaaaatagtgggctcaaagccagcacaaacagacataaataatagctgtgggccgaaaccaccgtgtccgaacggcattgcattgcacgtatgcacggcaaaggttgaattaccacggccgtgtcaggtggaagaaagctgtgattcttcaacattggtaagcacatcgaagcattgttagtttggtccaatacctcttgaaaaaagcaggtgaaagcataaaaggttgcaaacaatgattgtattctgtgattgtccttttgaatttgattaatgggagcagcccaacattaccaacctgcataattcagaaggaaggggggtaattctcaattctgaccaactacccagccttattttgaatattgtacatgtatgcaaaactataacccaaaagctaagattttgtaaatcatatgcacaagcactggatgaaaaaacgactgatctgagcagctcattcttcgtcctcagtctcctcatcgtcgtcgctgctagcagctctgtacctcgccccgtccccaacattatctccctcttcctcagtctcctcgctatcgtcctcgtacagcacattcctcggccactggtgctcttcgacaacactaacaggaggttggtatggctctgtgtaacccctgcgcttagggaccttgggcagtggcatcttggccgtcaaggagggcttgcttcttcgcttcgacatcttcgaagaggcggcttgagcaccggcatcctggtagtgattagggtgctctttcttcagatggaggttaagtttgtactcatgaatgtatgccttggcacaaccatcataaggacagacgtatgggcgatcagctgagggagtgggtggagctgctgacggtttcggtgtgtgactattatgggagtggtctgctagaccactgcggtttgttgcagacccacctggattctggagaccaccctatatcagtgttatgaaagtaagtggtcagaactggttccttcctaagcacaaatctggaggtataattagatcttaccttttcatgctgttgcttgatatgagcccttaattttgattcctgtgtaaaccttcgagcacattctgggtacttgcacacatgatagttatccacagaatgtgttttcatgtgtgcctttaaattaaaatccaatgagaaagcctgcaataaccaggaccaaatatgttaacaagaaacataccaaaacctaacaaattaacagcaacaattaccgataatgccaaagggggtggggggtttattccataattagaatgtttgaccatatccaagcatggcccaaaaaaactcaatactattagagaaagggaataagtgttgatatgccactccatatggactatttaacatgtatttgaaatttatgcatcgtacggaaaatgcagtcaaggaatagaaatgaatgacaaagtttacaatggagagatcatattaattacctttccacagccttcatgagggcagacaaagttcttctctcctgtatgaataagaaaatgcctcttcagcttagagctgtctaaaaatttctgcaaagtcagattcaaaaagaaaataacattagcgaacaacccagaagcagcaatgccatagtgatccagaaaggccaacgcaggcaagaaagattacaggcagtaccttgtcgcaaccggcatagtgacacacatactgcctctccccgtgaacatgagcatgtttcctaagagcccctgcatcaacaaaagttttcccgcagccctcatagctgcacaggaagagaacctcggtggttggttcaggttttgccagttctgcttcttgttccttgtccctggatttgagagctgacaacctatcctctgtaaagaaataaggtgaaaatattaacagctgaaagggtagttcacagaacaaaaggcatgcccaagcccaacaaatgaattcaactagtttagtatccttattggttggacatgccgaatgagaactctacactgctcataaatatgtcgaagtgaagctcagatgtagtgcagactgcaaaggcatgggatattggtcaaaagatatacttgtaactcgctaaaaaaacgtttgacaaaatttcaattgttcgctacatttatctcagatcaagttatttatttactagaacaaattggtttatagggtctgaaatttggaaatgataaaaaaaacatagtaaatctcactattccaaaagtcaaaaggactacacctgtgcctcgcagtcccaggtacttggactgcaatgcttatgccatacagtaatgaacggacagcatgaaaaccgaaagcgaactaagggcgcgttttaactgggtgattggatagatcatagacagacagaggaaaattgctcatatggatggattaaatattactcactccatctacttttgatggtcatatttcatcttggtacacagaccaaagataagtaattctacttatcatccatttaagcatgctactagttattcctcgtaaacaagcgattcattaatatttacatttctcgatgcccatgtagtcaatcttgtgtggaagaatggagagtcacgcattaaatctgagaaagtcattaagaggataggttgttggattgaaatatgcttatgaaaaataaaattttcagatttggaaatatgcctatcaaaagtaaatggagggagtataaagctagcaaaaagcttagaaaaacttatctaaacaatgctgatgtagaaagcttttttttaaaaacaaattgtacttccaagagcttcttttttttttttaagaaatcgtacttccaagagcgttgcacaaataatccatacatccattagctgtttagaacgcgtactaattaccgtcaaagctgtcacaaagtcacaggccaagcaaatcgcatagctcccctgcggtaaagctagccaggggaggggccaattcagaaaaaaaatgcctaaacaggtcctctctgataaaccaacctcccatggaattcaagcagccggcaactgcaagggatcccatcgcgcatgataacatcacgcgcgagcatacggacgataaaccgcacatagcaaagtagtaacagggcggggaggcaaagcaaaaaattgaagagggcggggcgtacctcgcacccatttgtagagcgcgcatgggccaccggcgacgaccagatcctgcggaaccctaacaacatgtataagcgcgtggcgcggacgagagatcagatccgaatccgaatcaaaccaacaagaagctctctcccattagaagaagggattggaattcgaggaggaaagaggaacggaccactccttgacccatcggtggcggcggcgcccggcagtctgcatcatcgtcgacgtcggttaatttgcggcggcgttaggggggggctaaggggagaggaggagtggagggtttgcgttgcggctagggttgagaagcttgggggaggaggaggaggacggctgggatggtgacggcatggtggtggagggaggtggtggtggcggctaa

SEQ ID NO: 58693 - DNA, 52866 bp, Oryza sativa
  unsure (1)..(52866): unsure at all n locations
tgcgcgtgtggggacatgctgcttgtcgcgagcgagagagagagagagagagtcaagagcgacgggggcttttgcttggcctcgagggcagttgagccgagacggaatgcggagcagagggaagtactgaaaatctgacgttctgatcctctcacaaaatttattttataattaacccgtgtttaaaactatagtcaaaactgaacctcgagcttagcaccgagttatatgcttgaatataaaaaaaacaagcatatcagagaatagtgaacggtaggaacattaaaaaaaccaaaacttttagcagaaataaaagtttgcgcgcaggcggctgggctggcacggtgacggcgcaaggcaccggcgcgtgcacgtcggcctgggcagggcgcctggcggccggcggctggggtggggagggttggccggttgggatgggaaggggaggtgaggagaagaaatagggttagaaatgtgggcttttatttgctattgggtcaatggacctaaaatggtgggtggtgggagggttcagtttgggcttcttttaagttttgaatgggtataggtatttttcttttttcctatatatacatatatggaatatatacttcatatatgtattttttgttcaaaaatcttgggtattcatttgaatacccacgaattatagtgggcccgcccctggataagttgggccgatgaggacatcgggtcctttgaagggggtatatgtgatatcctggcctaattaggatttggcctatgtggcggggggtgggggtatgtgacatcctggtccaattaggatttggcctgtgttgcccatgagagatatgtgcttgtttagttagcaaagttggaaccaacttataaatcctcttccctccaaccatgccactcctgggtttaccttttacacgaaacaaggatgaaagtgtaagtggggtggtatgtgtaagtgggctcgtccgtcgaatgggatggctatgctattctggagggagggctattacacttttgcacgtcactagtctgactacctccttgacacctattggactacccgttggttagaccgctcgttaaatgtcggtcccgctggttaaaccactcattaaatgtcggtctgattgtcggaatccagaaaaaagcgtatcaacgaaactcttgaaagtagattaactttattgcatcaatatgtgtttacaaagtgcatctaaatcactcctctctcaactcacaaactaggattgaaacatcgaagcaaaccctaatttttctctccaaaagatgatctctcctagcctcaagccatcttctatttatacccataatgtggttgtctctagccacgaatccaactagaactaagacttctaatcacataggaaacataccaaaacagggaaacaacatccccatagaattccacactccaatattcctaaacttagactccaatcaaatttgactcatttttccatacgcgcacaacaccatgtgtatgccatatggaaaccttaacctccatatgcattgttctctagtccgagcatcccacatgatatctttgaccgtctggacctcaacttctcctaagcctagtcctgatctatcatcggttatactcctccatattcgagtacaagttcgcaccaacttgactcacatcagcacacaatagtatcatatacgaataggaaccatctgaaagtcataaacatgaagcaatctagaaattccacgaaaataacccgaaaccgactctccctcgaagtctaccagtctgacagtcgggctacccagtctgaccacccaaacataaatgtcatgatatttaacgacctctaagaatagtatagaacatagaacgataaaccaaataaccaaactatggtatgatgagggagcgataatgaataagagaaaaatataagaaataagctcatgtaagtgctcaaaggtttgatggcctctaagaataaataaaacatggaataagagaaaagtattcaaatcatatcataatgtgacgaaggagtgataactgaacgaaaagatatagcagatctaaatctaatgtaagtgtgatatgatctgatgacctgaaagaataagataacatattaaaaagaagatataggagattcaactctagtatgatgaatgagtgacaaatgaatcaaaagggatagatgatataaggccatgtaattgcctgaaggtttgacaatatctaaaaatggataaaatatggaatgaggatgcaagtggttaaatcatggaggagtgatgaatatgaaaagatatactaatctaaatctaacgcacgtttggtatggctcgatgatatgtaataataagataaaatattgaaaagaaaagaaaagtggttcaactatggtacggtgaagaagtgataaataaatagaaagaaatagattatatgaataaatagctcgaacaactaatgacctttgagaataaatagaacgtggagagatgatgatggaagtgatcaaatcatggtgcaatggatgagtactagatggatgaaaactatgtggtatatttaaatataacataagtatgctatggtccgacgatctctaagagcaagatagaaaaccaaaatgaagaaataggtggttctattatgatgtgacaaaggagtgataaatgaaagaaaagaaattgatgtgtgacacatgagtgataaataaaaaaaagaaatagctgatataaacccacgtatatgctagctacaaaacaaaactaaagatatcaggataaagtgaaaaggtcaattaggcctagagggggggtgaataggctaatttaaaaacttaagtaaagtagaagcagtaattttcggaactaggctgggaattttcggaacttccgaaaatgcacagagctagcagcgcacacaaaaagaagtatctagatctagaagtctaccacatgtaatccaaggcacatacagcaactagaccaatagcggcacaagcaagcaaagttagaggagagggatgaagagatatcaccaaggtgaagcttgcaaacttgttcccggagttcaaatccttgaggggattctactctccgttgaggagctcactaagagccgggtcttagctaactctttcctcaagaggttgcactaagcactcctccttccactaagaggtatctcttcccttgcggaggcgagatccgaccttcacaaacttctcccggccaaccacaagtagatcggtggctcgggagtgacacctagccgtctaggagtcctcaacctccaagagtaaaagatgatgcaaagaactcccagagatgatgcaagtgctcacaaatcttcacaaagaccacaagaaccacccacacaaactcgaatccacactctcacacacacaccaaatccaaatcaaacacgggtggagagatgaatcgaggaagcaaggctcaaatgaactagagagagagagagagcaagccaatggcacaaataattggaatggaaccagcagccctcacaagtgaggggaggtgggtatttatacccacatcacaaatctgcccgttggagtgcaataaaagggattttcggaacttccaaaacaatttttttcaagggaatttgcaccgggaattttgatgaaagcaatttgcaaacctttgataggagatggagtgaaaagaatggtcgaacatttaggccccatttgagcttatggctagcacgcaataaaccacacaaaacaatagccacaagacaaatggatgatccaaagatcaaatgagagtgaattaccatgagacaagatgattcaccctcgaaagagggaatgtgcgaatctattgcaaattgtgttaggaccaacattcattgaaaaatgagatccccatacacatagattcaaaatatccacaaaaatgtgactagtgtccatccatgaattgaatgttcattttatcacaaggagtaaagtaacctatactagaaaccaaaaacaaatgtatgcaaaagatcaagctacgtttcgagaatccaagatattgagttcacttctcaactcacaaaacctagcttcatctagaggcttggtgaacatatccgccaattgtttgtcggttctcacatgttggatatctatgtcgcctcttgtggaatggtctctcaagaaatgatggcgaatatctatgtgtttggttcgggaatgttggacggggttattagctatcttaatggcgctctcattgtcacataggagtgggattttggacacatttaggccatagtctctcaaggtttgcttcatccaaagaagttgagcacaacaactccccgccgaaacatattccgctttggcagtggatagggcgacggagttttgcttcttggaagaccaagaaacaagggacctacctaagaattggcaagtactcgatgtgcttttcctatccactttgcacccggcataatccgcatcggcgtagccaatgagatcaaacctcgctcccttaggataccaaagactaaggttaggagtgtgcactaagtatctaagaattctcttcacggccacaaagtgacactccttcggagcggcttgaaatcttgcacacatgcacacacaaagcataatatcgggcctagatgcacaaagataaaggagtgagccaatgatggaacagtataccttttggtcgacgtctttaccttgctcattgaggtcgaggtggccatttgatggcatgggagtgtggattggcttcgcattctccattccaaacttcttgagcatgtccttcaaatactttatttggcaaatgaaagttccttccttgagttgcttgatttgaaggccgaggaagaacttcaattcacccatcatggacatctcaaaacgcttggtcatcattctactaaactcttcactaaaagacttgttagtagaaccaaatataatgtcatcgacatatatttggcacacaaaaatatcattattatgccttttagtaaaaagagttgaatcggctttcccgatctcaaagccgtttttcacaagaaaattgcgaagacactcataccaagctctaggggcttgcttaagcccgtagagtgccttatggagcttggacacgtggttgggatattttggatcctcgaagcccggtgattgctccacatataccaactcgttgataggcctgttgagaaaggtgcttttgacatccatttgatatagcttaaaattgaggttagtagcaaaagcaaacaatatgcgaattgactcaagtctagctaccggcgcaaaagtttcaccaaaaactaatccttcgatttgggtgaacccttacgccactaacctcaccttgttccttattacgaccccggcctcgtcttgcttgttgcggaagatccactttgtgccaatcacattttgccgaggtcgctccaccaaagtccacacttcattccaggtgaaattgttcaactcctcttgcatcgccattacccaatccggatcattaagagcttcttccacccttagaggttcaagagaagacacaaacgagtaatgctcacaaaaatttgcatatgagaacgagtggatactcccttgttgatgtctcctaagatgttgtcggtgggatgatctctttggatactttggtggattcttgggcgagctaagttgatcggtgagggtggaacttgctcgtcttcttcaccttgattcaagcttgaggtagagggatcgtcggcttgggttgatgtaggtggttctacttgtgttgaggaagaggctccttgttgtggctccctaggacgtacgtccccaagagccaatcttttgattgcttcgctcggatcctcctcttcacctaacacatgtgattcaacttgctctacttgagagccattagtttcgtcaaatgtcacatcacgcgcgatctcaacaatactggaggttttgttgaaaacgcggtatgtgcattcatttgacccatacccaagcaagaatccctcattcactttaggagcgaacttagaggatctagcctttttattaagaatgtaacacttactaccgaaaacacgaaaataagagacatttggtttgttaccggtaagaagctcatagggagtcttcttaagaaggcggtgaagataaaggcggttgatggcgtggcatgcggtgttgacggcttcggcccaaaaacggtccgatgtcttgtactcatccaacatgatcttcgccatctcaatgagagtcctattcttcctctccgctactccattttgttgaggtgaatatggagccgagaactcgtgcttgatgccttcttcatcatggaaactctcgatgcacgtgttcttgaactccttgccgttgtcgcttcaaatgttcttgatcttgaggtcgaactcgttttgtgctcttcttgcaaacttcttgaagatggcttgtgtctcactcttgtcatgcaaaaagaacacccacgtgaagcgtgaaaagtcatcaacaataacaagaccatatttgttacctccaatgcttagataagcaattggcccgaagaggtccatgtggagaagctctaatggtcttgtagtggtcatcacattcttgacggggtgatgtgctccaatttgtttgccggcttgacacgcgctacacaccctatctttctcaaattgaacatttgttagtccaaggatgtgatcgtgctttagaagcttgtaaagattcctcataccaacatgggctagcctccaatgccaaagccaccccgtgttagacttagccactaagcatgtctcatgtttggctttacttgaggaaaaatccacaaggtaaagctctcccttgagaacacccttaaaaactaccgaggaatcattccttctatagacggtcacatcaacatcggtaaaaagacaattgtaacccatagaacataattgagaaacggacaaaagattgtagtttagagattttaccaagagaacgttggcaatggaaagatcagagattgcaatcttacccaatcccataacctttcccttttcatcgtccccgaagactatgttatcttgtgaagtgccatttggatcaagagttgaaaacattgattcttctctggtcatgtgattggtgcatccactatcaatcacccaacttcttccaccggagacatattcctacaagagatcaatttctagttttaggtacccatacttgcttgggtcctctcatgttagtaacaagtgccttaggcacccaaagtactctcttgatagaaatattcttgccccttaggcctacatacttagcaacaacataaccactagcattcttcctaagaacataagatgcatcaaaagaaccatgtgaagcataatcattagtaaggatacttttggccttaacaaaattgctaagaccttagggactcttgatcatcacactcttgtccacctttccttttggtggaggaacatacccaagaccctcatggttgaagttgtccctttgatagcctaggtactcctttagggccttactacccatatggcacttaagtaggccattgtgaaggagtcccataagcttctcattttgcttttgcaaagcactcaaagaaatagagttagtagcacaagcttcaatatcaatatctttgcatttcacacatggttcatcgcttgggacaatttttgaacaagatggctcgctagggagagagacactattctttaaggtttcgaacttctcttcaagagagaggtatgctttgtccaagccatccactctctcttgaagttgagcgttcgccacctcaagattagcatgagactctttggtttgcttgtaaagctgtaccaatgcctcatttttctctctctccttagcaagctcactcttgagttcatgacaccgctttttctcacgaatgagcaaaacatcttgcctctcaagtgttgcatattggtcctcaattttcctaagcaactcactcaagtgtggtagggattccttagttatggatttaaacaattcgtcatccataacctcatcctcctcatcactaacaagatcaacattaaatgacttgagaggagaaggtaccttaggctcctttgccatgaggcaaatgggagcatcctcatcacttgagttgtcgaagagtcttggtggtgatgaaggcttgacggcgaacgcgacgactccttcttcatcacttgagcttgactcggagtcggagccgaagatcatcacaaggtgagcttggccataatgttcccgcttcctatgcttgtgcttctccttcttctcatccttcttctcacccttcttcttatcttccttgatgtgggaaccatccttgaggtgggggcaatccgcaatgaagtgcccgggctctttgcacacgtagcacactcttgcggagtgtcttccacttgacttgttggagtagtgcttggaagaacctcccttgaagaagccgcttcgtctcatgaacttgccgaacttcttgacgaagagagccatctcttcatcatcgatctccgccttgctcttgctcttgcggttctcttcttcttcttcctttgccttcaaagccaagtcttccttcttgatgcttgcggttgagctttggttgatgtattggatgacatccttggactcttgcacgagcatgtcatgggcaaggatgcgtccgagaaaatcacgaggtgtgagagtcttgtagtccggacgctcacgaatgatgatcaccaaggtagagttccttggagtgattgctcgaaccatcatcttgaccacaacatcattggtcatgtccttggagccaagtcccttgatctcattgacgatcttgctcaactggtcgtacatgtcgcttgggctctcaccatccaacatcacaaatctctcaaattgccccttgaggatctccaccttggactcacgaacactatccgtgccttcatgcaagttccgaagcgtgtcccaaatcactttggcactctcaatgccatccacacggttgaactcacttccactcaaggcgctaagtattgcattagcggcttgagcgttcttgtgctcgttctcgtcgtcctccttggtgggatcttcgggattctgcaaaacatagcttttttcgactattctccaaatagatgggttaatagacttcaaatgcatcttcatcttatgcttccaagcggcatagtccgtaccactgaaatatggagctttgccgctataggtactcacataagatgtagatgtagggggatagtcataagggatcttagctcccttatcaccatcgatcccatcccctgcttggcccgacatgatctctccaagcggttaagcctaattaggatattaggctctgataccaattgaaaaggtcaattaggcctagagggggggtgaataggctaatttaaaaacttaagtaaagcggaagcagtaattttcggaactaggctgggaattttcggaacttccgaaaggattttcagaacttccaaaaatgcacagagcagcgcacataaaaagaagtatctagatctagaagtctaccacatgtaatcaaaggcacatacagcaactagaccaatagcggcacaagcaagcaaagttagaggagagggatgaagagatatcaccaaggtgaagcttgcaaacttgttcccggagttcaaatccttgaggggattctactctccattgaggagctcactaagagccgggttttagctaaccctttcctcaagaggttgcactaagcactcctccttccactaagaggtatctctacccttgcggaggcgagatccgacctttacaaacttctcccggccaaccacaagtagatcggtggctcgggagtgacacctagccgtctaggagtcctcaacctccaagagtaaaagatgatgcaaagaactcccggagatgatgcaagtgctcacaaatcttcacaaagaccacaagaagcacccacacaaactcgaatccacactctcacacacacacacaccaaatccaaatcaaacacgggtggagagatgaatcgaggaagcaaggctcaaatgaactagagagagagcaagccaatggcacaaataattggaatggaaccagcagccctcacaagtgaggggaggtgggtatttatacccacatcacaaatctgcccgttggagtgcaataaaagggattttcggaacttccgaaaattccagatatgagaaatagtcgaagtcaacgcaattttcggaacttccgaaaatttccagaacgcttctgtgtattttcggaacttccgaaaatttccagagagctctcaaacggttctgtgtattttcggaacttccgaaaatttccagaacgctcaaacacggttctgtgtattttcggaacttctaaaaattcttttcggaacttccgaaaatttccagaacgctccaaaagagaaatgcttcgaagaaaaattgattttgagcacatgcatcactccttatatgtctatgcatcatcccccttaatagtatggctttcctacgacacaatgcgaggaaaaagatacaatataccatttgatcattgccgcattgcatcgctatgtcgcattcatgggatatgcattgtattacaacacgttgaggacataacaaccttcatatttgcttgaataaaaatgttagtcctctctaatcgcattgtaatcaatcatcaaaatcattaggggcctagatgcactttcataaagaaaatcttacactcatatttaatatcacacattctatcttcgcgtcatctcatcccacaccgttctgcctacacatctctttctccctctatttttttttgcctttgtaggaaaacatgtatttaatatcacaatgaatttatttgttattgttggataaatctgtacgaatgtaagtgtgtgattctagttggattgtttatcagtgtgtatgaatgattatatgaacacaatttactatgaatcaatgcaaattgtatcacttttttttgcattgattacatccttttttttgaaaatcagtatcaccagcgattaatgtgaggaataggcaatgatactacttatggtagtcgtttcaaaccccggttgtggtacctcgaactatcatcatcatcaattatccactgttggttcaaaaacggacagggatgtcattgttttgattgacattgatgtgttatggtccgacaacctataagattaagaatttaagatatataagaaagaagaggtaggttcttttaccatgatgtgatgaaagaacaataaatgaatgaaaaaacatatgatatgaggacatataagtgcctgaagatttgacgactcctataaataaataatatatagggaaaaagatgcaagtgatccaatcttagtgtgacggaggagtgaaaaaaaagatgtagtagatctaaatctaacataaatatacatgatatgacaacctctaaaagtaaaataaaatattaaaaggaagtgacaagcggttcaactatggtgtgagaaaagagtgatgaatgaataaaaacaaatagctaatataaacacacgtagatgctggccacataacaaaattgaagacgtactaatgaaggaaaccttatacttatattcaatattacacgttatatctccatgtcatctcacaccttgcgccgttccacccacattttctttgtgtcatcacaccctgcaccgttccacccacacttgcctttctttcccttcctacaaggcagattgcaaggaagatcctattgccattgtttgttttcacaccatcccatttggaaccttttcttacgtgcgaacgatgctacaccaaaatctatcatgacaaaagcaaaaacctaccgaatccaaacaccataaaaaggcttcatattcaaaaattcaaaccagttttgactgtgggcacacattatcttaaaaaaatgactgtgaccaagtgaagtggtggcaactgcaacatagtcctaggctactataatttgtagtggtagaattattaattttgatatatacttaatactttgcgaatgactataacttgtacatagattgcttgtggtttttatacttgctagttaacaatagatgtttaattatgacagtctatacctattaatagatagttccgtcatgttggttaaaaactcatggtaccagtgggtacccagtacccgacgagcatggatatggttttttttcccacccagcgaagagtattgcacatgggcggacaaggagttttcgggtctcgggtcaagcatgttcttgctccacccaaactcgaccgacccattgtcatctctaaacataagtgtccatagtatgatgatatctaaagtataataaaatattagaaagaagagataagcggttcagctatggtgtgacgaacgagtgataaatgaataaaaataaatagctgatataaacctacgtagatgctagccacgcaacaaaaactgaagacgtctaaacgaagaaaaccttacacatgtattcaacaccacgcgttatatctttgcgtcatcgtaccctgcaccgttctatccacactttagtttttttttccctttccacaaaggcccattgcaaggaagaccgtattgccattgtttgatttcttacatgctaggaaaaaaatagtcacaacaaaggcaaaaaaaaaactacgaattaaaacaccgtaaaaatactacaaattcgaaatttcaaacccattttgactatggccaagatttatctatattcttttgtgattaaaaaattttgattgtgaccaagccaaagtgtgatattgatgaggagcatacgaggatgagaggagagaggggtggtgtggtggtggtgtggtgggggtgggggtagtcgacaaagcgcccaaagtcaaacccaaccaaaagtcattggctccatcgctgcggtgggctgacagcccgtacatttttttaatccacccccgaccgtggactttgcaccatttcgccccccctttttttagaaacaaaaaacccacaaaaagtcgcccacccaaagctcgcctcgcctagcgacgatcgcgagcactcctcctcctcctcctcctccgactccgatcaaatcacaccggagaaacctcgccgtccggccacaccggcggcgcgcgctctctcgctgtcgggggggttggcggtggcgcagccgcggggcgagaaaaatctggtctcggacgcccggctttgttgactaaaaccgggcgggcggcgggcggcggcgactacttcgcacgcgatccgcgccttccttcctcttcttcccttgtttggtgcctcgcctcgtctctcctctatttcttttcgcttggtttagttggatttttgcgttcttggtggtggtggtggtagtggtcgtcgtcgtcggcaacgcgggagacttagcgttcttggtggtgttcgcgatctttgcggcgtccagtggcagtggattgcggtggtgggattggcgcggatcctgttttgctcgtttggttgtcgatcgccggcggtggattccggtggtggaggtgtttgggttgtgagctcgtcggcggcggcggcggcgcattgggtgttgggggccgagatgggcggcgtgtgctcggcggggatcccgggggacaggtcgccggcggagctgtcgttccgggcgatggggctcgtggtggagcaggagctcaaggcgttcccggccgtcgccggcaaggtgcaggggaagcacaagacggcaccggtggaggtggcgccggagcctgatccgccgcgccgcctctcccccgagaaggccccccggctgtccaccggcggcggcggcggcaaggctcgccggtcggtctccaaggagccgcagctggtgcgctcctcgtcggagaagctcaaggccggcaagtccaggacaagcacctccggcaaggcaagtctcccgattctttttcccccctctatttcttcaagcaacaggattagcattgccatttggattaatagatggttaacatcgatcatgaacatttttgcttcaaagttgagagactgcaagatgtggactccgtcttattttgttgacgtaatttaggcatttcttacactgcaatttgtagcataaacaatgagacaatgatctagttgccttttatttttatttttttttctgtgtatgtgtatcagattgtgcatattcaggcatgagctttgcatttctgaataagctctcctgacctgctggctgctgaccggtttccaccgtgtaatggtgcactctttgcaggcttcagacaaaggctcggtgtttggtagagccagcacatctgggattgggaaagcagtggaggttttggacacactgagcagcagcatgacgaatttgagccctgtaggtgggtttgtggcgggcgcgaagatgaaggggagcccacaaaagattcttgcgtttgaggttgccaacacaatagtgaagggcatgagcctgatgcagtctctgtccaaagaaagcgtcagatacttgaaggggaccgtcctccgatcggagggcgtaaagcgtttggtttctagcgatatgagtgagttgatgagaattgctgcagccgacaagaggtttgtgatggatgagagtgatcttgttgctctagttctaacttccatgatctgtaaatgagatcttcacattctggtcatctttgcaggcaagagctggcgctattttcgcgagaggtgatcagatttggcaatcgttgcaaggatactcagtggcacaacctcgatcgctatttttccaagtaggttcacagcttcacactgattacatgtcctgatgattgatatcagagtatgatgaactcggttttgatcttgtgcttgtttgcttccaggctagaatcagaaattacgcctcaaccaaacttgaaagaaatagcagaagcagagatgcagcaattgttgacactggttcggcacacggctgtgagtacattacacccttaaatactcccctagtcacgaaataatgcgatcatagaatgtgtgcaaccacgataattttgacagaacattctctggaatatatggtttcaatgaaaatgatacgagtgaaatatttatggtataacacacatatttttctggatatatgatagtagaattcagtgatcaaagttgctacagttgagtttgaaaaggaaaaggaaatgtcacgctttgattttggaggcagtatgtatttagtggttatactgaaacgagaatcgattccaagtgttatttattatgctactagatcatgtttgcgtcaatcattaatctgtttgctatgcatatttcaccccatgtccatctgctccatgctagcttttcctaatacagtttctgtttcatttttatattgttcataggatctgtaccatgagttgcatgcattagatagatttgagcaagattatcgccgtaaattggaggaagagaaaaaatcagttgcttttgaaagaggtacacctatcatcatcaatacctcacacccttgtagattgaattaggaagccattagtcgttccctttgagaatgattgtttgagtacaatgaatgagcaggggacactgttcagattataaggcaagaattgaagagccaaaggaggcatgtgaaaagcttgaagaaaaagtccctttggaataagatgctcgaagacgtaagcgtttgtactgaaatttgcatgagatgaaatgtttgtataatgacagaaagataaccctgtcatctgggtttaatggttaatctgaaccatgtaatcttcattctgtttgtaggtcatggataaacttgtggatattgtccactttttacatgtagagattcaagaatcttttgggacctatggtatgcctagttgctcagaattttcaatcatcaagtcactaattcagtatggttaccaactgattactttggacttctccatgcttttggtctcccttttttctgtagatggagctttacaattgaatcaaccttcagagagccgtcagacgttaggatcagctggcctctcgctgcactatgccaatatcatttcacagattgacaacattgtaagtttttcttcaggttatttatatatttttctgttcatgtcaatacacaaaatttagatgatcttaagcttatcaggtgaactgtcaatgttttcccataggatttaatagctggtgatatttttccatactatgatattatccgctcgaaagtatggtctgtattcccccaagttatggccatacaggacaatggcatgagaaagatagaatgatagaatttgaaaagccacttaagttattgggattcttaaactgcaatggtttctttcagaactgctgcttttgtgttcaggcagtcaacctctgtaaatgttacagtcacaagtcacaaatttttgctgaaaaatatatttgtagagttagagatcttatgattctagtaaagaaaataatgcaaattatacttctactgaattgacatcaagtacaattatttgttgaacattgactgaattactgaatctgtttactgacttgattttggctaaccgaaggtttcccgaagcaccgttccaccacaaagcacaagagatgcgctctatcaaggactgcccccaactattaagtctgctcttcgaaaaaaactacataattgcccacaaccacaagaggtattttgatgcttaataaaagaatcgctcgataaattgcattagtgattcacatcctaaatttgtgtcttgctgtggtaggttccgatcactgaaatcagatcttcaatggagagaaccttgcaatggattatccctattgccaacaatacagccaggtatagcactgaaaagatccagccagcctttgattctactccagatactgacgttctgttcatcattgcttgtatgctacatcagagctcaccatggattcggatgggtcggcgagtgggcgaacacagggttagatgctcatcattgctcatccgtgcactccatcaattaatcagtccaattattgtgttatcaaaacatgagaaaacaggaccaaaaattattaccatgctaatcagagaacaagaaaaacacttcgcgctgttgattttaacaagttcaaagttcaaactataaattactccctccgtccctaaatatttaatgccgttgacttttttaaacatgtttgatcgttcgtcttattttaaaaaatttaagtaattattaattcttttcctatcatttgatttatttttaaatatacttttatttatatatatagttttacatatttcataaaagtttttgaaaaaaaaaggttaaacatgtttaaaaaagtgaagggcgtcaaatatttagggttgaagggagtataaaactgtagattggtcgaatgctcgaatatacatcaaatcagttagagttgttccacaggaatattatcacattttcatctggaagcatgtacgtacgagttgcattgctgtattgttatattatcttttatacataatatattccgtatcattatctagcagcgcaattgcgtgtgtacagtacatccagcttactgaacgcaagaaattctcatcatgtttaattccaaactaatttatttacacaggaacgatgcgatgcggagggcggctgggcagccagacgtgatcaagatcgagacattctaccatgcggacaaggccagacggaggcgtgcatcctggacctcgtcctgtggcttcaccacctcatcagctacagccgcccaagcaacggtggcaggtccaggtcgccgagcaggtcgccggtgcgctccccttcccttacgccggcgcaccaggtgccgacgacgacgtcgtcgtcctcgccgccaccgccggcggtggcgaggccgagcggcggcaccggcggtggcctcaccagggaggaccgcgcgatgctccaggacgtgtacgcgggccgccggcgtcgcgctccctgtcacagcaggagccaggagctgtcgtcagctcgcggcggcggcggcgccggcggcgacagctcgtcggcggtggcagccgcggcgcagctgagcaagaacgacaggctgagcaagagcagcaacgatgctccggcgcggagcggcggcggcggcggcggcgggaagctcttcccgctgagcaggaggccctcctccgccgtggtgtcgcccgccgtcgacttcgacatcgacggcatcaaggcgctggcggatgcacagaagcggcagtgaccgtgacgtcacagccaccatcttcttctccgccgcaaattttgctcaaactgtccactgctcaaacgcagcgacgccggaaaaccgtgagaaaaaataagagaaaaaaaatcaagaaagaaatggagatggccagatgatgagaaaccaagatcggtgatggatgcttaattagggtgtgattgatacatgatcaattaattaattaatcgccattgtatattgtaggagaaagaaagaaagaaaaatagatggatagatagcccaagaattgcagctgtcaggtactgtactaccatgagacaatcatggatggacatgttatatagtactccagctgtgcaatgcctgaagactagtagtactactacatatatcaacagactctgcaggcacatatagatagtgaccaaaaaccctcctgcttgtgaattttcaacccttcttgtcttggaatggaatgcacagtttcatttctgtttgtctgcactgttctgtgcaggtacattcactccatgtgctgcactacatgtacaatgtgggcttgcatgtacccaagttcatgagattgttggaggggggacccttgcaaagatctgctagcctctcctcgccctgtgtgggtcatggatgatggatcaatccatgcatggtccatgagggagagggagcaaagattcaggaagaaacagggagatgatcagagaggttcagaaaagaagaaagataacatggacgatcgcattgtccttgtgccatcctctgggctggagtccactctccagctactacagctgtggatcaatccatatgcaggtgcacctcaagggattcagatcaggtgcagttatagctgtgactgcaacttaagaactgcaagcaatttcagccgtccatttcagtgatcaatggctcagatctagtgatacagcgaccgtacaaacagtattatgtactacagtgttttgctacagtgctataaacagtatgcctcactgatctggaccgttccatttgcatctgttgatgaaaattggtactgcctaagttgcagtcccagcagcgactgcacctgatccggattccacctcaaggtatagctgcatgaggaaggggaaggctgccgcatgggctcatgggggcgcaataattcgccatgccaccatggtggtgaggagtgaagtggacaagtggtgccgatctctatgtgtactatgttggtctctatctcgcgtactccttccattctaaaataaactaatataagaaaaaaatgtgatacaacctaatactccctccattttaggttataagatgttttaactttggtcaaagtcaatgcttaaagtttgaccgagtttatagaagtaataataatattttcgactcaagataaatttattaataaatatatattcaattattaatttactaaaaaactaatttggtaatgtaaatattactatatttgtctataaacttagtcaaacttaaagcagtttgactttaaccaaaaataaaaacatcttataacctgaaacggaggaagtatattctttgcctccggttaggttcagcaaccggaggtaaatggaatggtgtcacatacataggtgtgaattacatcaggagatagacgtcgcgcttgtgtggttagtggttgggaaattaggcattggatatgagaggaagggggcccgtatcgaaatttattaagagaggggtgagacaattttttttagaactggctagccagaagatcgccctcaagcctttctcatcagttaaactagattaataccccaccgcgttgctgcggaaaattaaattgcataatatgtaaaaataaaatgtaatttgattatcaaaactaaaacaatttgatacaattttaagcctaaaaaataattgagattgcatgtttttaatgagagaagaaagaatagacaatttagaccatagatctatcatctaaaagatagaaataattgagttgatgtggtttaatgagagaagagagaatatcattaactacatttagtggggatgaactatataagtatatataggattgaatggcaaaacgaccgatgaaacctttactgactgcggtaaaaaaaaagtaaatacaaatggtttggatgcaattaaaatactacgtactagttaataaagcatatatacacaattaatgatcatttttactagtgtactccctctccgttggttttttaaaatatgattgaccgtgtacataaaagtatatttacccatgaatcaaatgataaaaagagaattaataattacttaaaattttaatttttaataagacgaacggttaaacatattttaaaaaaccaacgacgtcaaatatttagggacgaagggagtaaaaaaacaagcagctcgtgatgaactgctcataagctcatgagataaaaaatccaaacatggccccgttcgactcattatatgaccaccagtttgagccgttccaagccacgaccttccagctagctgtttttccgcccctgccagttagcaaccaagaacgaactcgatcgatcgctgtattcttctgctcattgccgcttgtttttcatctggaacgaagcagcaaacaattcaacacaacacgacgcaagacgcaagcaaagctttgattgtcatcagaaatgtcaccttgccttacggctcatgtcatgcacaccacatgcatatacatataatacatatactccaatttttaatagataacgatgttaactttttatcacatgtttaaccatccgtcttattctaattctaatttattttgtcatgaattgttttatcacttaaaaatactttaagcatgatttatatcttatacatttgttcttataaattattttaaataagacaaatgatcaaatatatgttttaaaaatcaacaatatcatctattaaaaaaacggaggaagcatgtactaccatacaaacaccaccattgccaatcaatctgccatgccaagacccagcgagaggaaaaggctccacgcttttcggcaaggaaacaatcgctgatggggttcggtggcatattgcacacacatgcacacatggagttgtttggttcactcctaaacattgccaaacctagctaaatttgtggcttataaattgatgaccacaccttaggcaacttttagctaaaagataggtgtatgacatgtagactttgaattgaaaaactttggcatgccacaactttggaagtgaaacaaacaagtattctagaaagtgtggtaaagtttgacaaagtgagggagtgaaccaaacagctattaactagtattccagtagctagcatgaaggaattaattaaagaatctcttctttcactcgcattatggttcccctttggctgcaaagtagtgtgtactctttctacaggatgaagatgctgcttgatgtagtagtttaattattgctagatggataataagaatctataattaatggacaattaggatgccttgtttataattaactttatatatatgcatgaggaatccatggactatatattattgtggactttagcatggggttagctagcttgcattgtcaggactcaggaggaaaaagagcttgagctgaccactatcaattttttttaaaaaaatccttaattaacaggatcatggcctgtgaataattgttgcatcactagctagtgagcaacttcttttttcaaaaaaggaatgaaggctaacatctttacttggcagacactccggtgtcttaagaatactcattagttcaaatttaaactgaaacattttttgtgatagtattttggagactgaaacctactacaagaattatatggtcagcatgtcgtaatataatcaaccagttggtgtgcagttacatcgactgttggttaatgatttatgacagccccgacaaaaaaaaaatccccaaggttgctataacaagtaaggtcacaactcgcaaatagcaaaagaaatggcaggaattaagaatccgtgcgagttgacagtgcggtgcttctctgataatctcgcacaatcttgtcgaaaaggacacattgcaatttatataaaaggaacagttttaatatatatagaacaccctatctttagatcccaatgtagcagcgatatatatatatatatatatatatatatatttatatttattaaatttgtttggtgctccatggtgcccgggcaccattgttgaaattgagtatatatacatatatacatatgtatacatatacatatacatgtatacatatatatatatatacatgtatatatatacacacacacatatatatatatacatatatatatatatatacatacatataatgtagcaattttaatatagagcaccatgtctttagtagatcccaatgtagcaatcatccatccatataattttggttatagccaataaacatggtatcgtgcgcttttattacgaagaatttggcatatacgaaagggattgtagcttagcgattacagtgctcaagtagttcagagttggttaaaaaaatcacttgctaaccctatataaatacttattaagaattaatcaatggagaacagatcctcatgcagtggacagtggtatcaaagaaccagtccgtataggggtcggggggcagagttcgcgatctttctcggacagattggttgagacttattcttcttaatgaaaagccgaggaacggtcattcccgccagtcaagtttttttttttaaaaaaaaacattgtcatatgctccaatttattaagagaaattttaaaccaagtttgatatatataactcgaacttgggtggtgcaagtatacattgaggtatgttctatacttctactcatatgttgccatgtgtataaaaacactataagcacgctcatttcggcagcctgccatgtctgtatgtaacattagctatacctaggttaagttctaagaagaaattagggtaagatacatcatcatttttcgtgagcacacttttcaaactattaaatattatatattttttaaagaatatatattgaagtttttgtaaaaacaaataaatccaagtttacaatagctaatacttaatttaatttcgtgtgctaatgagttgtcttgttttttttaaaaaaaaaaattcaatcctaaccccttttcgacactcagcctaaagatagtttaaattaatttcatgcttacacagttgatcaacaatggccacccagagaaactttagctaaagataatttgatcagcaatggtcacccagagaaactcaaccacaagttcaaacctaagcccaacctcagtgaagctatcacacaccaacttacctcaccggcaacaacaacaacaaacatttgactataactaatggtgccgatttattggagattattaaccaattaattattaagcacactaattaatcaaactaagaatcttgttgttcatgtatgatactcccatcttagttaatcacacgaattgattaattacaccaaaacacaaatccaaacccacaataataatcatataaactaataatagtaaaacgtacacgagtagtagagagagatggcacgcgcgcgagctctcatggcgccggcgccggcggcggcggcttggccttggcggcgaagcaggcggcgacgcgcttgcaggagcggtagaggctgagcacggagagccactcggcgagggcgtcggcgagccgcggccggcggcgccggagccggagacggcgggcggccttcgccccggcggggtagtagtagcccggcggcggatgcggcggcattgcgccggaggcggcgtactcggcggggacgacggcggaggcgtaggggtcggaggccgccctggagaggagcgagggcgggagcgggagcggcggcgcggaggggtagtgcttcccgccgccgacgacgccgggcggcggctgcttggaggaggagcgggatgacctcgccggcgtcttggggatgccggggcggtgctcccacgagaatgggacggaggaggcgcggagcggggaggggaggaagcggtggaacggcgacggcgacgtgggcggcgggaggaaggagacgaatggcgacgacgacgacgaattggtggaggagaaggaggaggaggagcctccgccgcctgccgacgacgggaggagccgccggcggcggcgccggcgtggagttgcggtggtcgccggcggcggcggcgggggcggcgaggaggaggagggcatggtgggtgggggcaactcgctggggccgtcgcgtcgcggcgtcgccttttatgctgccgcgcgcgcaatgccgtcggccacgtggcacggtgacgtggccaacccggctgcttcagtccgcagcaacgccaacaaagcttttaccagagctgtggcaaaattaaggctgagatcgtttgttggctttggggttggggtgtgtgggagggaggggctaaacatcccctttcttaacttggggagtgtttaacttacgttaaaattagaagtttgattaaaattggaacgttgtgtgtgtaggaaaattttgatgcaatgtaaaagttaaaagtttgaagaaaaagttgggaactaaaccatgccttgttactctcttgcgttatttataggcacgcctaccaaactgttaaatagtgtatttttctcttaaaaaaattcttcatattaattcatttttttaaaaaaatatgactaatacttaattaattgtatgctaatgagctgctttattttgagtgtacgagggattagttactgtctccaaccaactaacgcggtaatcattagtgcataatgaattgattaattattataattttaaaaagatttgtttgatattttaaaataaacttatatatagttttttatgaaatgggtcatttagcagtttgaaaatgtgccaatgaaaattgagataaaatatgtattttagttactccctccgtccctaaatatttaacgccgttgatttttttaaacatgtttgatcatttatcttattaaaaacttttgtgaaatatgtaaaactatatgtatacataaaagtatatttaacaatgaatcaaatgataggaaaagaattaataattacttaaatttttttaataaggcgaacagttaaatatgtttaaaaaagtcaacggcgtcaaatatttagagacggagagagtaagaaaagaacgggatcgaatagctcaaattcttcacaaatatgttcttctttttctttttgcaacgatttggcagaagctgtcgtgtttcaaattagttcaagtctttaagatcaagttgttttaaatattctggtaagtggttttagaagtgtatttcacgacaggattatgagcagagcgagtttaaagtccacttgtgcactgatggcacatttgaaattcggagcgccggattaataccactttagccctaccgtctcttcgctcttttttcctcgtcctctctttgtaaaaagtagaatgtgactaatgtgcgatgtttccttcaacaaacaaagcacaaaagcgaggctggtaacacaagttaacagtactgcaatttgaaactttaattcattttctgtgacgaaattgtaatatatacactgcgatttggaggtttaggctgctggtgatacgtcgttgaatcacatttctctcaaaagctttgcatggacagtaggttctccgattatttttcagcaccacgtgtacacgaggatggtgatggttgcaattaaccgttttaactctaatcactgagataatgcgcacggctgttcacttcatcctgtctttttttgagttgattaaagaatgggttgcagaagatgcaagggactgtatatatactacctccctactctagttaattaacaaattcagatttagatcagttgcatatagatatagtttgatcgatgtgatgcagtactgatcttggcagaacgatccaatgagtatggctacctttttacagtgcatgtacttttctctgtcttcagatttcagttatcttcagtagtagtagctttggagtgaaacttcccatttggaacaacgcactctgaattcaggcagcttcccaggattcatgcatgcccagaaatgcaatcccaattttcttcttttttttttacagacttactcaagtggtaaattgcaaatcacgatacaagaaacctaaactttcacggtaaaaaaagaagaagaaaacgatggaatttttttttcctcatgccagctacttccccttttcatccatttaaattggaaactcggcatcgcaaataacccaatctgaaatctacacgcccatggatgcatatgcatcgaatgacacatgtagcccatttcgccatcggggttcatcactgacttgacgaggagaaaagcaaagcgaagcaaagcatcggagagcaaaacacccagaaaagcgaagcaaattagagtaaccagctgctatcagagacaaaagctagcaagataagcactaaacaagctaggaaagcgcctgattttgattgtcattaggctttgcttttctgcaatcctctacctgcgtctgtgtcgtctgcgtttgttcagacgatggagatagctagctagatagatggcttaaacaattaattgtcctggttaattagttcatcatttgtcatgcatgctttcatggtgttaattgctactatcatttagtatcatctgttcggataatgtccctccatttgaaaatacaagacatattttgtttcactaatgtgatagaaaagcataaccataattaagtattttttaacaccaatttaacaaatttagttgtcacaaaaattacatcataatagagtaattgttggttaaattcttatcctaatgaaataaaaattatcttttattttgaaacggagggagataatacgccataaatgattctcctgggataattagtcaccatttatcatgcaatattcatggcgttaattatcatttaagtatcagctagctaggacagcgttttcagcttgcaacagacaccaggaagatgacaaaggctaacctagctgacgggagttttctgaatatcgagtacaggataattaaatctgtgttttgtagtatctggcatcgtgttgcaaccgataattcgaggaaaattaatttggggtgattcttctttcactttcaccctaatcttggagccattgtcaaagggccatgtggtacatgctgacctaatatattattgggtgaagtccattatttggcttggctctgaactttactcttcagtttgaagtccagttttttcttttaaagagaacggtttgaaggccaaatagtttttgtttttaccgtcgaatccaacattttacttcgcgtgtcgggtcacgaagatttagttgagataactgtcagtaaaaaaagatagagttcttgacaaaatgtgcatataacagacaaaattactcagaaaagaaatgcctactctgatgcctaaactctgaactgacggttcttaatttacagcatactatattcagacacaatagtaatatgataaacgtacgcatcaggtgtacctaatcttgttgaaattaagtggcatgagcattgcagtttaaccattaagcacttctttatataaaaaagaacatttttcacatgacgcaaaacggcaaaatggggagcagaaatgaatggcattgattctccagttttatattttcagcctccaattttactaccttgcctgcaactgtttgagcctgaaaaacaggtcgccgtcagattagcagggcaaatgcagcatcattaagcaagcaagaaaagctgtggtccggctaattgtggggggcactagtgtgcatattgctccataaagtgtgtgcactccgaaagctacattcataatgaaatctttgtaatgccctgaacatgttgagcattcactgacagtatcttctgaaaaaaattcagactactgtttacagatagtattcataatattggcacatgttttcatctttaacgcgattatgtaataaacaagaatgcagcatacacaacatttttactatctttaaggtatcaccaggtactaggtaccaggtaccaagaggctacatgccatccttgattgcgtacttgctgtctgaagattgatatgaatcatctgttctctactagtttgcattggtcttggaagaatgataagaatgaattcagaagctgtcaattcattggttccttcgttaggtcaggtagatagcagaacaacatcaggcaatgatatgcaaaatacaatgagtacatgacaagaaatactgcatgtaattagagtgtctgcaggtagcaattctaaacaggatgcagagttcttcgctgtgagagtttaaggctcagcatatgatgatcaatcagtcatccatgcatgtaatcttttgtacggtttctctggaccagattgtgcattaagacacatgagttatcatcattcatcacgcaagcaggttggaacagataaatctgcataattatgggagtttggtatgtaatggagcagatgaaacagctgctacaggagttgttctacaagaaaagaagagaaaaatgataaaaaaacgatctatggaaattttaaaaaaatcccttttgcaaatggccataatgatttgtgatagaaaaaatctagtaatataaggaaataaaaattatgtatcatgccgtaaaatctgaatgaatagaactggttgatttggaggtagaaattcttcctttgtagcactaatggaaattaatagaacaaaagaacagtagtgtttttcatctgatcagtgatgtgtcttcccaacttaactcagattaatctcaacagctatcttggatgcgctgaaaccaacttccctactccctagtacttacaaacatatgcgaaagccgaagaggaacatgattaatagatacagttagttggtcttggtccactgcttacagatgaagctgcgccaaactaaatacaatttggtatagagtcatatgtattgtcagtgcatgaccaattgagcatgataagcaaaaagcatggacaaacaaatacaacatataacgtgttggttagggatatcttcatgatactattttctgaagtatgttcagtgccttgcgactgataacagaatccagttatggtacagtggttcagaagttcattcagtcagtaaaattcaggtactacagcagtttgtcgcaaacgcatggtgtggtgaattaattcatctacaggccttttgagctggagtttcctatatgagagcttgtgcagaggccagaaattacctctataagcttacaaaaacaagagcaatcacatcatttgctagttgcttctgttttagcttaatcactaattgctgtcaagtatgaacctcaatgggaaactgagaaactgtaacgtggatggatccttgtcatgctcataattttatggcttagtgactgataaactgataactaacttacgcaataaatgagacatggcaagaagaatgaggaggcaggagagatgttcttctgtaggctggaaatatcagttatgcagcttcagatggttcagagaagcagtcagtgacatagctttaccagtggtaagttgtactggtaacaaaagagagattgctcagagtacaattgcagaattgcagcaatacttatctgcaaaatgtgtaatctggattgtgaaaagaaaaacccaggcattcagaacctgtaattaaaaaaaaaacgaaacgaaccaatcgggcatgtagactgctgatgaatgaagaacatggagcttgcctatcccctggactaagaaacaggtgaataaaaagctaagctgcacttcgtgctacgactgaatcacccaatgcatcgcctgttcatgcatgagctgctaaatcgcaaagaaaagaaacgaaaaagatcccaatgcatcgcctgttcatgcttgagctgttaaatcgcaaagaaaagaaacgaaaaaagaaacaggtgaataaaaagctgcacttcgtgctaagattgaaccacccaatgcatcgcctgttcatgcatgagctgctaaatcacaaagaaaagaaacaaaagaaaaaaaaggtcccaccgggattcgaacccaggtcgccagattcaaagtctggagtgctaaccactacactatggaaccatttctgattttcaaaccgttagattcattatttattcgtagcatatatttttttacatcgatgtttcaaatcttctctcgcggctaaacttcctatgagggatgcaaacgatggtcttttgtttccatcttggtattaccaatacaacatcttcaaaatgaaacaggggtgaaagttaatgcttaatataagccatgttgtcatgcatcctaacctatgtccgtcgttttgttttggcctcaactaataatagataaatatctaagacatagttatatgctacacacaagacatacttgagtatacatttttaaaacacgacttgtgaactttttatattgtgagaagaaaggttattgctaccgagacaatgacatgcagtgtcctctaaagtcaatgacttgaatgacaaatcatcaaatgttccccaatttaaagagtaaagagtggaaaatcatcaaatccccttttacaaaatattaatcttaaattagttttttttaacccactatgcaatctctatattctactggtgttatcctaactctttctctgtgccactttgccttgtactaaattactagtttttttagaggatgttaggtcactaatttattatctagtatacttagggctcctttagaaaaccagatttcagaagggaatcggctcctctaacgtttaagaggcacgccaccacctaacgtagcttgtgcatatgtcgtccaaattaatcggacggcctagctctatagggatatcgtcttcctccgctaatccttgaattaatctttagtttgttcttctctatcaaaaaaggaacttgccacatacccacagaataggaatgcctctggctacacgcgctactcaccggtaacagcacgccaatgctttggtccacgacacgcaacggcgctctggacctttggtgtactgatcacctgactcacaataccatctcctaagtcctaagttctaaaaaaatacaacagcatcatatatatagcggcaatggaaaaccggcaaatcaaccatcctatatgatactcttccctataccacaactttcaaaccacattcccctgatttttcaatagaaagacatcggagatttgtgctctttgtgtgttagcaaggatttttttcgtcccttggtccttagctttttctttgccacactacgatctgctcgaaggtagagagagaagaagtaatctcatgtattagcgactaagctaagccctctctaaaacgattgcttacgagaaactgttttgcgaaagaatcaccaggtgcgtccgattaatttggacaacatatgtgtgagcaatgttacgcggtgacatgcgtcttgaacattagaggagccggttccttctaaaagacatagaaataagaaaaacaacgtataaatggaatctctgcttggggggtgttaagtagtacaaataatcacatatttatctaaaaaattattcatcagtgtattaggccccccatgaacaaaccatatgcatggatactaggttgcgatttgggttagtccttggccaactagccgtagtatgtgttggctgcttagctttgcatgcagcaatcctgcaatagtaaatagctaaccgctgaggttaaattcaattaatatacttgtgtaattttatgtgttccttttgaactgcaacgatgttcttatatattttggcaacgtataataaggctaaaattaattctcttgtgttgccaaaacatatgtacacattatccgtgtgaggcttttagaagacaaaaatattaattgtcatgctatttttccgtattaattatcatttagtaagctgccccctcatgttcaaatactggctctgccactgaatgggacgttgtgctctttggaatattgttagattttaaaaatagaaatatttgagctagtgcctgatggtcctcgggaaataaatcacatgaattttataggaatcactcttgggtgatagaggaagtagagagaaataaacagaggacttctcacaggaagacaaatcacgaactcttaaggcatctgtagtgtttagttcggccaatctaatcgaagagttgaacaaaatttcaggtcagtagctatagtattcaaatcgttttgttttgtaggacctgtaaaagagaatcacccaatcattggtgtaccttttatgcatgcatgcacaataaatagtattttactccttctgttcgactccaatgtgagttcgatttgttttgacacctacgacgttcaacaacgacactgtgcatgattcgattctcctaccgtaaaatcgatttttcgttcacactgtagaggctcttgcctcatgcttattttcctcttgaaaaaaagggctggaaaatcattctataggatgtatattaccaaactatcgaatccattgaatcatataagaataaaactttaagaatgcaatcttctgaaattcttatgaaactaactaggtgtccgtaccataacattataaagagaacacctttcttctgaaatactaaactttttgagaagttttacaattgagcaaacactcagattctataatttgccatttgcaaaagcaaaggaggccccaacttgtttataggatcttaagagggggatggagaagaggggatgagcagcacaaaaagcccatcagcgcttcctcacctcacctatgtgactatcttcaattcttcatcccctcttcgctctcatcaacaagcaaatcgagaaaaaaaaaagaaggggagaaaaaataatataataacagaaaaggagatgaaaaaggagttccccggccaagcgccgacgagtcggttacactccgagatggacgcggcggcggccggcgggggcggggcggcaaaacggaagcgcagcttctccgaggacgacgcctacctcatcctgcacaggtaaatccatctcccccatctctctctctttccgttctctcgccccgcggcggaggcggcgggtcgtttctagggtttcgtttcaccggggaggggctgcccccccccccccccccccgaacctcgcaggtaccagccggcgacgatcctgacgatgctgcaggagatggggaagcaggtgggcgcggggaaggggatcgactggagggcgctggtgcggaggacgagcaccgggatcacctccgcgcgcgagtaccagatgctgtggcgccacctcgcctacggccacgagttcgtcgagagcgtcgagcccgcctccctgccgctggttcgccactcgccgagatttctgttacttttttatatatattcgggaaattgttgagattttatacagtagtagaagtagatctcagcttgttttcagtgttggttgttcgtttctctgatggtgctgtgctgctgtgaccgataattcgtaggacgatgggagtgatctagaatgtgagattgagattgtccctgctccgggtaatgaagcattagctgaggccacatcgtttgccaaggtatcactttctggaaagaccattatcttgtacaaccgaagcctataatttcgtatagcgtggatgcttctttcgagtataagatgctaaaactggttgatttccccttattttcgcacctttttttttctgtgtgattatgtagttcttgtgtgtgtgcgtgtgtcattttgggttcatacgaggcagttgttgcacatattatttgattatggtcgtgatctcctattttatcaccgttcagtatctatctgataatgtgtagtgtttctattattgttggcttccgcaagcacagtttatgctttgacactaacataggttgttgaataacttagtagttatgctagtgtgtatagtttgagatagacagaatatgggcaaacatattcaaaggctattattgatgctcaatactggcagtgttcatagcttgattggtgcttcattatcaactggaagatagtgctccgtgtgtttttcactacaaatagggcaataaaaagttcctttgtggatgtgaaaatgcatgggaaaaatgttctcttttttcagtgtgtggccttccctgccatctaataatttacaagttaaaattgtgtgtagtggcacacttatagtgcttgcaggcagtcttgaattacatgtgtctagaaagacataaaagggcaatcaattttagtttatggaaaagattgtcgtatggaatgtgatgcacaaaaccacctaacctctagtttctttggcaattttgcatggtattcttttgaggcctgtggttctgtgtaatggcacctgatcctgtcatgcaatttcagactattatcaccggatcttcacgtgaacaaacctctggtcaacgtgtcaactcagaagctgctgcgctaaacactccaaatgaaaagatagtgcgtgttccatctgataaacagcttgtgcctggtcaccgtctaacaaacggtacaggtccggtttccagctcaaagcagccctcccacacaggctcatctcctgatcctttggaccctaatggacatcccaaaaagaaaaagaagcctaaaccatggtccagagaggaggacatggaactaggagcaggtgtacagaagcatggtgaaggaaattggatggaaattctgcataaatataaatttgatagttcaaggacgcatcttcaacttcaacaggtaagatcaccttgtcaattgcataccagcacccatcattgtgctttgttcattcttattcgcctatatgggattaccattcctgaagtcgcccaacttatggttacatgcattgcaacaattctataatgaaagagtcggcacctccttgcacacagtgcaagtatttaaaaaattaggtgtgctgctgttgcaatcgtttgatcgcttttcatctaagcctatattagagttttcacccatcctagttgagttcttttgtgtaatcgtgcatctggcagttgtgactgctgataactgataaccatggttgatattcccccattttcctcatgtagacagctgtagtctaataagataatgtatgtttttttttcagagatgggcgcttatttgcaagcgtcaggggtcaaccaagcctgctacccctaaaatacccaatgttatgtcggaggaactaaaggcagcacaaaaagcattttcattggccattgggacgaccagatcgtctacattaagaccaggtatcgcaactggcattttttttcccatgtgatcttcggggtggtctttgctgatactttttgtgcttatatgaactgttcatgcaggaggtgtgccacatcacaatccaatggttactactacgaatcctgaggtgaaatctgttacagcaccttcaccattgccggtaccggtgcatgttgttccggtgcctgttccagtgcaaccagtacaagtgcagttaccaccacctcagttgcatcaagcacctgcgcaatctgcacctccacctccaaaagtatcaaatgcttcaaataagtcacgaaataattctaagaaacaagttgcccaatcaattcctgtgaatggccctttgtcgatacaagaggcagctcttgctgctggtgggcgaattgccgaaccaagtgttgccaccaattttttaaaagctgcacagtccacaaaagctgtgcacataagatctcgaggaacaggatcttcaaaatcttctacgggatctaaaacacctactgtggctggtgaacctgggacacagcttggcagtgatcaacacctagaattacaaagtactggtggtccatctcaagttttgactgcacatgcaactgaacaagttcataatgtttcagaagtcgctggggttaatcctctgggacaatccgctggagtgcatttatcagaaactaagaaagcactgaacaccacaccagtgtctggatcttctgacaaaatggaaatagatgacaactctaattattttgcagtcacaatggaggacttgttccctgaggatgtgaagcaggaagatgttcaagatcccaagattgaggaggccatagaccccaaggatgcagacatgttagaatttgatcgctttgtggcccaaggatgcttaaataaggataatgtggataagagcaaggctgccaagattgctccagaagctcaaagcgttattggcagccagaaaaaacagctgaagacgctgcccacagttggcaaaagcaaccctgtatttgctggacctccagcaactgcgaaaaagaccaaagctccagttccacagggtgggatgtctagcggcatagttggcgtgctgaatagatcattaggagggaaggcacctgctcctgctaccacaggcacccaaagtactgtccagaagcagcaaagcatgagctcaaagggcaacttgttagtgcccaagaatgtggcgcctggcaccgtaacaccagccaacaaccgggccaacacagcggtgaacggggctagcaaggtgaatccaccagccagccagaagccagcctaacatggtaaattccttgctataataacgccctaggacttttgtgcgcttagtttacttttgaaatgtaaatagggccacgtagataccatctattctttgcccccctttgcatttgtagctcaattcctttctgaaccaaagcactggtgaaaacattaggttagactggatacaccgtttaatcgctttgccttctctgtgatgtcttagactgatatgttccatttgttaagctggcctgagattatcatgccgccttcctgtacagcctcgcctctttctccgttggatagtttggttgattggccaaatattcagaaactatgtcattgtggcctgatcaaactgtgaagatggcacgccatgcaagttgtctctatcggctttaatttatggctttgaaaaaaacaggggatgaattctggaatggccttgtttttggctcaagattttttccatgctgcacgcattgcgacgaagatttggagtgtgatagcatttcatacactctactgcatgtactgtaattgatgatgataaccgcgtggttgatgtgtcaactgctaccgcacacagtggatgttaagacctctgtttggtgtaactgtcacacacggtggggctgcagcctggtgaccacgtgtgccgtggcagttggcattttggtcactcgtgtcttgtcaggtcgcttgctttgatcattctttgccattgcggtgacatcgtggcaactggcaatggacggacgctggcaatgctgctggttgttcgaagctgattttaagttttgccagaaatttattttaaaattagtcattttgtcgtctctaaaattgtttttgattagtaggagtaatccacaaacaggcggggccgagataacctagtacagtagagaatcttttggtcccagaataaaaatggcactattccactacagagtgctcgtcgtatgaagcatttgcccagcagttcgttcaaatgggacaatatttggatataaagaatcctacacattctttgtgaatttgtacgttacataatgccgaaattccctttgtcgccgaagtattcccttcggcatataccaatggttggggccttagggtgtgtacaatggtaattaatgagactattgattatgaatctttactaaaatggaagagatagaaagaagaaaggaaaaacatcatttctacagttaacaacaacgattatttgctctctataaaatggaagcttggctttactagggtgcttggctttactagggtgcgaaaaaggaaataacagtaataaaatagtactacctctgtttttaatagatgaccgttgactttttgtcacacgtttgatcactcatcttattaaaaaaattacataattctaatttattttgttgtgagttgtttttatcatacatatatactttaagcatgatttatatcttatacatttgcgtaaaatcttttaataagacgaatggttcagaaatgtgtttaaaattcaacggcgtcatctattaaaaaacggaggaagtggtattttgtttagtttaatgattagaacctttgttatgtcaactattgtagaggtatatccgctaaataaatatgtattatctaactgtacatattaggctctatctttgtacataaccaccatttacgacagttcaaaaagatatttatgcgaatattgtagtagtatgaaagtttccatggaataccatagggaagtactccatgcgttccaaaatatgataatttttgcaatttaaattttataccataatataaagaattgcgcgctgtttctcatgattatcattatttcaatgattctaaagccaatcggatgcctcaaaggaaatccaagtaaataaaaattttaaaatcaataactgaaatgacttaaattttttttaccttaattaggaattgataaacaacgtagaaatcattatattcgagtactagtttatttcggctgaaatggaaaataattttcatgctccgaatgcgaacttggagtaccataagaacttactacttgtacaaactacacataagtagcaataactgtctctaacatatcctctcggctaaaagccattggacatgatattcatccaggttggcatctttcggttttaggtcaattctacattaaaaattaagaaacttataataattgcataactttagaaatattactaaaatattatagggtcaatcgatctacttcgatcgtttgggctccggttgataaactgtgaaaaaataaacaaatttataggctaatttttttgaacggcgaatttataggctaatttttcacatctacattattagaggtttcaaaactatgctaaaagtagattattacaaaataactgtcaaactcaacttttttttctcaaaaatatcaaccttttttttttaaaaaaaaaatagattttaactgcggccgataataatctgataaaaagaaattgagaacttaaccttaccacggatcaaatgtaacttaatcgtggctgtgtttagttcgtgtactaaaatttttttaagtatacagacacacatttgaagtattaaatatagactaataacaaaataaattacagattccgcctgtaaattgcgagacgaatctattaagcctaattaatccatcattagcaaatgtttactatagcaccactgtcgacgtttgatgtcgcgattccggtatttgcatagtatgaggatcgttggtactaggatatacgcgagactgaggtaaaagagacggagacggggatttttatacaggttcgggcccctgaattgtcaggtaataacactacatcctgttggccgaagccggtattgctcttattcaccataatcacaccagtacaatatttggggtagcctatctaactgttgtcgacatagcggtctgaaggtctgactcgtagtcgacaatagggtagtcttcctcctcgaatccgtgcccggcgagatcagagatagcgctttcgtctctcctgacagtacccggagacaccgtaggggactagccgtgcttatccctgaagtcgatatccggcgtcttgtcttggcgtatgttggcttgtatgttgatcttctgtctttatctattgttttgtgtatgttgattgtgggtctctctcctcctagggggccttgtatttatacccataggtatccctttggccaagtagaaataggaaaaccaatatggatacaatccgagtagtccatgtcgtttccatgtagaactctggttgtctttccttatccggaactccctccatacgtgaagtcagtttccgtataagacatggtatgtggtgggtcctaccgagagttagtcaactactattaggtatgtggtatccataaccctgacagtagcccccgacttcgatgcaaatgaacgaattcatattctcaaccgcgtgcaggccttggagtaactgttatcgagctcacgtgaccgttctcgatgagttcggagataacgttagacttcctttatcagcctcgtgcgggcacctaaagggtttgtctgagtcaatctccgacgtcgaccaagaaagtacagaacagacgactaagtctcccgtcttgctgtaatcgagaatttggattgaagtcaagaaattttatctcggcgggtacaccatctcttcattccgtattccttgtcgagatccaccaaccattctcgagtgattgagaaggcgcagaatctacgacggagccttgtcaacatttgtcgtactcgccttagtcgatcttggtgtagaaccatagagacatggagtcttcgtcaatgtcgaatagaattttcctgaaatcaacactcagaaaaaaaatatcagatagaaatagcccccgagcaaacgctcaaagggtgacatgttataatatatatggaaactaaaaatgaattaaatttacagaccaatgttttgtgtatgagcgtcttctcttttaccgacttcgatcagtcagtttgttgagtcatacactctccttagctcccagccttgtcatcggagaattattctcgggagataaggctcttggacctttgacctgcctcgattgaacaagcactgatcctagcccccagccgtgaagttggaaaacccaatttccgattacatggcttggttaatacgcactgcgagaactcttacacgaccagatcttacacagtcttttgtctctacaggattcgacaaggccttatcggctctgggcgtccccagccgaagttcccttaggttcctcagaggtcttgtcaagacggcgtaaagggacatgaggataggtttcaacgctaggtgtcatcgtggtaagggatctctaggtaaaacacttggcgatattgtatacctaatatcaactttgttggagtagaggtaatgggaggatcgttactccgctggtcaaggaccaggtagtagtctaaactcgaccacttagaagtggaaatagtgggagaatcgctacaccgctggtcgaggaccaggtagtagtcgtaactcgaccactagaagtaaggcgagagagattgaaccaggagtaggagtctctttatcacctataggggcgctaaagttggtttattatatgtgcatatcatgtggccagcataactcacatacccaacttatagcatatccggatgtccgttcgcaatcatatcgggtgatcaagccgacgacgttcgcgaggaattatccattaataaccttttctcgagtagtccagccatggccggtgctatgagataggtcgtcggtcttccttggcaggttgggctcgacgactctgcatttgtcgagatcattctcgataatgtggtgtactcgaccacaacctactcgggtgctcaattgttcctgaagaatattttctagaaggcaagacatatagcagagaatatcgagtatgtactcaaaagactgcatggatcttctagcattatcaggacataacgagcagatgtaaatatcaggcattatgtaaaccgtaaacaagcatgatttatacagaagaaaacagagcgagcccccagcattaaaccgtagtcaattaacatcggggacactcgcgcaacagatattgtataaaaaacatgctctaggtaaacataataaatcatagatctaacaatgttgtatgatctgaataggtacgataaattgcagatcaaatattgcgtacctttgtagatacatgccggatgtatctacgaacttagcaggtcgacttagaagaccaatgtaccaatcaccttagctgcgtactgagagagatatcactgcgatctgacatcttttggtgcgccgcggcgctcgaggcttggatgatctcaatggatcatgttcgtaatgacgaagatgggtccgatctggttaggttggatctccccctcagctgaagtcgtcgagtagctcgttgtcggagaatccatctcttaaacccatctcatcgaaaccttgaagcaccaaaagatcccctacctggcgcgcaactgtcgacatttgatgtcgcgattccggtatttgcatagtatgaggatcgttggtactaggatatacgcgagactgaggtaaaagagacagagacggggatttttatataggttcgggccccttaattgtcagtaataaccctacatcctgttggctgaagccgatattgctcttattcaccataatcacaccagtacaatatttgcggtagcctatctaactgttgtcgacatgacggtctgaaggtctgactcgtagtcgacaacagggtagtcttcctcctcgaatccgtgcccggcgagatcagagatagcgctttcgtctctcctgacagtacccggagacaccgtaggggactagccgtgcttatccctgaagtcgatatccggcgtcttgtcttggtatatgttggcttgtatgttgatcttctgtcttgatctattgttttgtgtatgttgattgtgggtctctctcctcctagggggccttgtatttatacccataggtgtccccttatccaagtagaactagaaaaaccaatatagatataatccgagtagttcatgtcgtttctatgtagaactctggttgtctttccttatccggaactccctccatacgtgaagtcagtttccgtataagacatggtatgtggtgggtcctgccgagatttagtcaactactattaggtatgtggtatccataaccctgacaaccatattgtcaaatcatggtgtaattaggctcaaaagattcgtctcgcgatttatatgcaaactgtacaattggttttttttcgtccacatttaatgcttcatgcatgtgtccgaatatttgatgtgacggaaaagttgaaagtttgaagaaaaaaatttgaaactaaacacagcccgtgttttcttgtcgtgtggagagaaggagaagagagattatgtaggtgtgccatcaccatcaaccccagcctcaaacaagtcaaacaagtgcttggtagctgacacatatatacatcgtacatgatcatcacacacgctcgtccggtcgcccccctcccacgtggccccctcatgccaccttaattaagactgaccttatgcaaattaatattattattgcctaaattaattaccgaggtaatcaaatggtacagaattaggtgtttctctcgttggtcgttacgccttcgttgatcagctatctcagagagacgtgccctatggtttatgcaatttggccatgaaaatcgtatctttgtggatctcatatcaatttggaaccgtcataatatcttatgcgttgtccgggaggaaaatctgtttgtcgatcacttacttgtgtttaacttattagaagaccggctctcattgacaacacaaaaatatgtatttttaggcatcaacgatatgattatgtatgtttaggattgccatgtaggaaatgtttgtgactgatgtttttttaggaaaattgcaaaacaccccataagtctcttaaaggttggcattcgacattataagttattttgttacaagtacccatccctactcagtcttgttaagaaaaaaaatccccattatacacatgcttaaccgaatcagtccgttatcaccaatgtgagccaccctaagctaagctagtcaagtcaatcttatccaaatacttattagacttattctcatgtttcactgaatttttgtgtgcatatagtgaaacttagtttgacaatgtttaagttcttatcaataattttatttatgaaatctccaagaaaattgttaagattataatcttagaagtatttaattttggtaaaaatcacattgataactcacaatttatgaaaacatgtgattcagttaagcacgtgcatattggggggtgtttttttttcaataaaactaaataggggtgggcatttacaacaaaattgcctatgggtttttcaaaaaaaaaacttatgagatggaatgttaaactttaagtgattctcttgattgtataactcatagtttttgaatggcatggttctcttgatcgaggggatgttcaaaatttcgaatatggttctattgctacgatgtgtcgatgtttacttccattgtactagtaacttaaattatttacgcgttaattgaaaccaatgcatagactttggtacctccccaacaagtcaaaagatatgcatactaaccaactagtcggatttcaccccccctcccccccgcctaccacgtcgctcgtaagtgacacgggtggcgatcaacagacaacgctgttggttatatttgtcctctcctccgccttgctgccacttgagctaattactagccacgcaatggcaaggatgatggtggcggggcttcctctttccaattttccctagtgcgatagtgaagactctagggataagagccagtggatctagggcttctacgtccggatttagccacacaacgacagatgacgatagtgagtttctttctttgcaagctttcttggctccatcactactcctccttggcctcctggctaggttgtggggagcttcgaggggctgggttgccggtggtacgatgttgctgtggtttcaactttggcttttgcggatgacaatgttactatttggcatgtaggctggttatgtgtgatgagggagttgtcgaatggtgaaagccttgctagattctagctagcttcgatgacggtgatgctttcgagcatcgtttttcttcttggaggcatcctcacttcttcccatccctccacattggccttcaggtaaaaccttttgctttggtcctggtagagtggtagcggcatctcacgtcgtgtcctcctctgaggcgtcgctttggaggaccttctttgtgcggcaatggtcattgttgggaacctacgtcagctcagtggctttaatggctatggcagtgtggtaagatttgggcgagctattgatttgcactaaagttattctccgacgatatcttccacatttgttcgatatcagttgtcggcggtgatgtgagtgaaattcgaccagtgcaatgattggccactgattttggagattatatttcctaatttgagaaagacaatgtcttcttacaacgtactactgaagatacaacggttatgcaattcctcaacaaccataggtagaagttattagtgttatctctgtcattagtttggtgttctaaatatttttttagtttttaattaaattgtgattttgtaattcaaactattgttaggtaattcactgtaataattggctatagcttcttttatttcaaataacggaatgaattatattatatatatatatatatatatatatatatatttcctaaggtgaagagagaagagatgggaaaaatgagtagacaactggttttttttccccgaaaggacgacttaaagcacaaatatcgaaccaattcatttcagattttacctcctctccttgagaaatacaaggtgtattagatactactccctccatcccaaaaaaattcaatttctgggtttccgtgtctaatgtttgaccgtccgtcttatttaaaaaaatatgaaaaagtttaaaaagataagtcaaacataaagtattattcttgttttatcatctaataataatgaaaatactaataataaaaaaattcatataagacggacggtcaaacgttagacatgaaaacccagaaattgagtctttttgggacggggggagtatataactattgatttatcctataatacatagtaaattgtaattttcaccaagttaattgtaacttgttttacattgtacaagtatcagatttagcatgtactttcactttacaccagagtacattaaaataagttttacttaacatcagagtacaccataaaacctatataaatttcatgaaatttgaacaacatttcataaaatgtggtctaaattgaaaaagtttgataatgttcgcttagattcacaagatttttccttcaattatatgacacaatttagtgtaaagtgaaacttattttaatctagcatgtagtaaagtgaaagtatgtagtaaggcctcctttgattcaaaagaaaatcataagaattttgggggatttcatttatatatgatttttaggtgaatcttatggaatcctatgctttttctaatcctatgtttttttatttctgcaattagaatgggctctaaacctgatgttaaatgaaacgagataccataatatgtaatatattatcaacaactacaaaattaatatatataaaaatatttttaaatataaattcagtgacactacatactacataacactaaatacatatatttgtaagtttggttactagttaaaacttttattcgttgactctgcaaaaaaggacgccatatatcttcgaacggtgcagtactgtacaagagaatttattttgaacttatctatcagtaatgtgatgttgtctatatctatggagacaaaggcggtttcaactgccgtaccattccaagtttccaacacttctacaaaattcgccaatacacgtcgactaatcaccgcatatgctaatcctaatcactcagatcaacgttaacaataatcactcggattgcatgtacaaagatttatattgacgtgctctcttcgttatggtgcatgtaagagcatcttcactagcttctttaaatcggattctatctaatttggctagtcaaactagatgctcactttaacagactctctattgatcctctctaaattaacaatggacccacaacaacagtatgtactcttcttcctccctctctctctctcccctttcttccttctcttttcttcttttcccctttccttccttcccatcgaccacgcagatgccaacggcgtggggaggcaggaggtggcgcagggagtccgcaagcgacagggacatcagcttgggaggggcggcgacgaagctcagggtggggatggcgacatcggcttggggggagctcgggatggggatggcgacggcgactggagcgtggatttgctcctcgccggcctcccttgctctccctcgccgccatgccttccatccctcgccatcgagccctccctcccttgccgtcgacggcgcccgggaggaggcggcggccggcaagggggaggcggctggaggggagttggcggccggatcgtaggcggctggagaaggaactcgacgtcgatgggggagaggcgaatgagattgcagctactagccattgatgctgtgtttggccagccaaactagcttgctagatttggccacctgagctggtcatttggccagcgagatggcttagccatccaaatggagaggctgttggacctcattttcttgctatgtttgctaatttttagcttggagagtgggatggctaacctattggagatgatctaactcttagtgacgtgaaaaagaaacaactttaatacagatcatttgtagtactaccatttaactttaagtgactaacatgtaagtctgaaaatccttattcacgggcgcccgatgaaagagaaaaatatcgggcacgctccctcgctcacgtcgcctcctctccccgtcgatgccgcctcctcttccacgagctccctcgcccacgctgcttcctcccgcctccccccgccaacctcacccgcgctgcctcctctctcccgtcaacctcgcccacgtcgccttctccgtcggatcctccgccgcttttcgtcttccttgacgttgacagcgtcttcgtccccgtggtggcggccgacgcggaggacgacgcacgagcagcgaagcggtggtggcggcagtggtggtggaggaggctcgtcggctccctctttctctcctgggagcactccctcctcatctccgccatcctcccccttctcctcctccagatccggtgatgggggccgtggagaagaccgacgcgggcaaccctgtgttcgtcggagaggaggaagatgcagtctagaccaggttctgtgtttttttttgtgtatttcagctagtgtactcgtgatgttctttgtgtttggatcaaatgttgcaatagatatttggacagtgttccatatttctatttttgacatacgggtttgttgatgtttcaatggttcaaaagcaatgtttcagctaatatactcgtgatgtttctttgtgggtggatcaaatgttacagtggattttaaatagtatttaatattttcatctcgatgtacacggggtttgtttagatgtacatggggtttaagtgcttcaatggcttaaatcgttttgttacatacgttgaaccaaattgtttcatttagcgatctcactatgtttcacatttttttaagaattgaatcattctttcgctaagtgctaaaacattatttttataaagggtgaaacaacgccagactttttgggaaaaatcgagcgcctgatttgtaggcaccttcatgtaagtcacacacgtgacagatccacgtatcagtgatcaagtcagaggacaatatttgtttttacacatagagacttatttgcttttacgcacgataacggctcagagtcgactcttagcatttattaaaaaaattattatatggagctaaaatggttatctcagcaattatatattgaataatttagtgatatgtaagtattaactaaagagttcatatcaaaccatttgtacatgttaaatcatgcttagaaaattccaaaaataaaagaacttctaatcacacccaaatggccaaatcccaccataaaatgagagaaatcaatttcacacaggagcaggaggagagagaaaccgctactaataaataggagtataaaacagaagcctcctcgttaagcttcgaatcctcttccattccctccttcctctcctctcctctccaagaccaagaaccagcaggagcaagcaaggaaggcgccgaattcgatcggagcaggcaggacgggtccgggatcccgcgccgccatggagaagtacgagctgctcaaggacatcgggtcgggcaacttcggtgtggcgcggctgatgcggaacagggagaccaaggagctcgtcgccatgaagtacataccgcgtggcctcaaggtgcgtgcgtgattcgaagcgagctagggtttcttcttcttaatttctcgttttcttggctggtttttagcggggtttgcgggtggttttttgcagattgacgagaatgtggcgagggagatcataaaccaccgctcgctgcggcacccaaacatcatccggttcaaggaggtgaggccggccgcggaattcgcgggatttctgagaaattcgcggttcttgctcggtatttttattttctttttgaaaatttagttcgtaattttgggggaattttgttttgtttaggtcgtgctcacgcctacccacctcgcgatcgtcatggagtacgccgccggcggcgagctgttcgaccggatctgcagcgccgggagattcagcgaggacgaggtgatcatctaatctcctcgaattagacgggtcccaagtcttttccctctttttttttgccccctcaaaaattcgtgaggtttgcgtgctaattttaattttgtgttttcaaattgggggacgtgtggattgctactgttctagtcgaggtatttcttccagcaactaatttgcggcgtcagctactgccacttcatggtgaggacatcaataatttgttatttttctgttaatataaaaaaagctttaagtataaatttttcaaaatgttaagctgatgaggattgcgtgttttgtttgatctcgcagcaaatttgccaccgggatttgaagctggagaacacgctgctggatggcagccctgcgccgcgcctcaagatctgcgactttggctactccaaggtaacaatttcttctctctctttttttttaaaaaaaaggaagatttttatgttctttcataccgtgcatgttttttggtagaaaggtatacggaaagaagccttccttgttgaacttggcatgttgggaggacaaaaattttgacacgaaactgggtcgctatcctcattatccttattaaactcgtgccgctattgagaatcaaactttgcgccctttttttttctcagtcttttttatcggatgatgttatcaagcaatcctttagtttcttcacgtacataaaagagggacatcactcgaactaactgatggcaaaaagaacacttagacttacgaaaatatcgtatttattgctctttaatttagctctatagtgggttacttacgcgtactaagaccgttctttttgcgaatgtttttgtggtcagtcatcactgctgcactcaaagccgaagtcgacggtcgggactcccgcgtacatcgctccggaggtgctctctcgccgggagtatgacggcaaggtcagtctcagtcatcttgctcctctagcttgcctgtctctccagttgtgtccagggcagctggagactttgtgcttaatccttttcttttctttccttttttggtgtgtgctcaatccttgtgttatcttaaggcacctgaattttacacgcaaaattttaatatcccaaggtaactaagaagtttcacactagaaaatgtattgtaattttttaaggatggtgaaattaaccttgtgtgggtcacctatgcttgtgctagcttgctgcagtccctccggccccaacccaaacgtagtctgaacttttcatgtgaatgccaggactggagttttagtatgtgaacccaaacgtagcagacatatatgccttgtagaccaggctcatggtatcatgggggcacctctctaatcagtggttttacattcttggaattttgttctgaggtcaagtagacagggaatggacctgaccccaattgccagtgtttttctttgtccttacctctgtggggtggggattccagttttccaagctccaacttccaagtgctcctccaattatttgtgttgacaattttgtcaaaggagcaaagaggggggaagagatatcctaccgaaatgttcccgatgttgtcgctgggacatttttctttttactacctccgtcctaaaataagtgtagtcgtggggatccgtgtccaacgtttgaccgttcgtcttatttgaaagatttatgaaaaaattaaaaaaacatagtcacccataaagtacaattcatgttttatcatctaataacaataaaaatactaatcaaaaaaatttcaaataagnngancggtcaacgtttggacatgaatagtgtaaaactgtacttattttggaacggatggagtagtaatcacagcatgcttgatggtgatctctgccccctccgggtgcgtgcctgctttaattgttcccttgatctggttcacagttggtatacatggtgaagtcttgtctcgcatggtgttgttgatgtgatgatccaaaaagaaagttagatttgatagataagagcaccagattctgttgatggagatcttgttatcatgcttaatgatctgcttgatagtgaggattaataaaaacaaaatcgctgtgtgctttgttgtgtggtgaatccttgaccagcaaacagataggattcatattgcctaaaaaaattgtggagttccaaaaacaataatgtagttatttcttcagaggtagtacatagaaaaaaaaaagcatgaacagatttgaaatggttgcgcgtgatgatctatgtatcgtggggaggccccgtggacatgttccatgaatcgaattgtgttcccattcatcatgctttatgtccttttctggaccgtatttccatcatgttgatgtgtacaataggggccctcagacctgatcttttcatgtagccatcttagactgaacatctggttggtaacctgtggtcctttgggactgtttttcttcatccttttttttgggcgtttcattttgccatctgtagtttgtctggttaatattgatgttatttgaccaattgctattgcactttatttcatacttttttgggataccatgccaaactaccaattgaatttctttctagcatgcaagattggttgcctttgctg

SEQ ID NO: 58694 - DNA, 7561 bp, Oryza sativa
cacctaaggttgtgtttagatgtagggatgtaaagttttggcgtgtcaaatcggatatacggatatacacttgaagtattaaacgtagagtaataacaaaataaattatagaatccgcctgcaaactgcgagatgaatttattaagcctaattaatccgccattaacaaatgtttactatagcaccacattgtcagatcatggagcaattaggcttaaaagattcgtctcgcaatttacacccaatctatataattagttttttttatatttaatacttcatgcatgtgttcagatatattgtaatcttttaaaattaatttcattattacataatggtaatagatttgatcacaacgcagtgtacatgacactgctgagtacatgagcttaatgcatgaaacaacagaagttccatccttctttgacacggacatttttaccataaacttttcgcatcatttcgaacaatgcaagcaaatcaattccaagtccttactccccaggtgcaaatgcagcggcgtcaaaggtcttgcagattccggcgccactcttgaaggtcaccttctccggcgacgcctcggcggcgtacacctcgacgatgctgagccagagcatcagctccttggtcttcacgccggtgatcttcttcagcttccccttctcgacgaacgccgtcacctcaccggcgtaggacacgttctgcttgatcttcttgaagacgtgctcgatcttcttcttcctctgcaccatccagatgaacccggtctcccggttgtagccgaactcctcgatgtcctccaatggcaggagccccatggggaggccgagctctcccagaagctcgatggacttcttcctgcagatgtcatcgccgttgacgatctccgcgccggcgcggtggctctcgatctgtgaagccattggagcggtagtttcagagaaaattagaagagaagtttttggtttggaaatgtgttgtgttttgtttgtgcaaatgggttgagagattggtgtggtggaagatgagatgtagggttctgtttatatagagttcccaagtatcatgttaatttgtttgttcattgtgatgaagatctgtccaggctgcagatgttgcgagatcccccatgactgagaatctgagatttagtgtatcccatagtgtcatgatattgaagaaaccttatgctctttataataaaatcagtcattatcctagagtgttgtcgtcacgtcgtgcattaataaatataagcaagtataaacgtgtatcatcaactattaccattgtatcaatgagtatcatccaaagtgccattctgtatcatcaaaggtatcctgaagattttaatagcttgagacgaaaacttcattgattctcaaattaaaaaggaaaagtagaaaagaaaaagagataaataaacaactcccttaccaggcgtgtgtttctagaaaaaaaaagtctctctcttcccaggcgaaggttggagtgatcgctgatgatagcaaattccaaccaaaattcagcattcagagatgcttaatggagaacttaatttgcagagaaatacgaagccatgttatacttatgtcgcgttgagttgagggattcagagatgcttgggaaagttaagggccgctgtctcacggcggacaacctggcgaagagaaactggccgcatgacgccatttgcttcctatgccaacgcagaacgaagactgtcatcatttgcttgtgtcctatgattatatggcggcggtttggcgcaagctgagacgttggtgcaacattaacattgcaatccctgcggaagatggcaggccgcttgcagattggtggatcgcgacaagacggcgttttcagaacacgtatagaacggatttcgatagtctgttcatactaatttgttggcttatctggaaagagagaaatacaaggatctttcaacacatcgccaagtcggttgaccggctagcggatgacatcaacgaggaaatcgcaatttggagggcagcagggatttttttcccaggctagcgagtaatcccgattagaggcgggacttgccccattttttccttttctttccgggcttgagtttgcttgagaccggcgcgacatccttcatgtcgttgtaattaaaactttatttccccccgatcttaatgaaattggccggcctagctttggccgtcccggcaaaaaaaaaaagatgcttgggaaagttgcagaatgtctgaataaactcagggatgaaagcatagcgattctccgatgaaccaactccgtggcggtggctgcattacctctcttcttctctggatccggcgaccgtgaagcagcggcgctccggttggctgactatgacccccttgggccgttcgataaaggccgtgcggcccagatagaagaattatttacgacccgtgggcctcacgagcaggcccatcttggccaatcgcgcttcaacgccggcatgtgaatcaaaggggttcggcgtttaaaattccgacccctttcgagggatctctttccgccgtttgatcaccctgtacggtccagatgatccaacgatttcttgagattatttcagcttacttgcccatcgtggtgatcatgaaaacatttcatcattctgatgcactctgttctgctgtgttgcggttaatttgcgtctccaagagtagttctaagttgttgcatcactttgttgcttgacttgtaagtctgaatttcaagttgcctacagtaagggctgaaactgtataatatctgccactcacccagtagtataagattttactgaaacacgtcgcggtgttggggttgtgacttgtgaggattggtcgcttgctgatgcttgcgaattccaagtaaaattcagcattttatccatacatgcaacctaaagcgtactcgtcgccggtggccggctgcaaatctatctgatcaaggcgcaaagtgggttcggagtttaaatttccgaacccgctcggtatcttttgatgaacaaatgcttacgaaatatgcaggctccctatatctcgctttatatatgttcgtggcagtgattttcatatctggtagtcctatactttcccatgttccctggcgatcaggaattttgttgttgtgacgcacccagctttttggaatggatgggcttacatgaacactggtttgatcaacgttttggaatgaatgaattcttcaacatttgtatttggatgtagtcgtatctggcacaatggctcgaggacaatcagtacgtcaaagagactaatacgcaaaggttttggattagctacaggagactgaaaaacttgcagtttgctgcagagtggcatcaaagcacaaaacaaatcatcaagcgaatgtgctatatccattcagtgttttcagaatagctacaggaacaggatcaaacatctcaattcaccatatttacccatctgaaaggataaaaagaaagaacccaacagaacctgctcataaagttcagagaagatgaagacgacacagttatgagttatcgacatggctcacctggcagatgggacaacccagaaccaatagaattttcaacaagttaaatcactcctagttactggcagtgtgcactagtctatcaaagcttacaattttttaagtggcctgtcccagtgttcattaaccaagttgactagggtcttgtgcaaaacagtggttttttaaaacatgaatagatacaggaatatactcatatatgtttgcaattgaatacaaaaagatggtagatgtaagatagtggctttaagcctttttacataattaatattatgagtcttgtcatcatttcttactccagcttattatagctgacctaagttcttactccccgagggcaaaagcagcggcatcgaaggtgtcagagagcccagttcccgtcttgaaggtgaccttctccggcgaggcatcggcgaggtagacctcgacgacgctgagccagagcagcagctccttggtcttcacgccggtgatcttcttcagcttccccttctcgacgaacgccgtgacctcacgggcataagacacagtctgcttgatcttcttgaaggtgtgctcgatcttcttcttcttctgcaccagccacatgaatccagtgtcccggttgtagccgaactcctcgatgtcctccaatggcaggaggcccttagggagaccgagctctcccagcagctcaatggacctcttcctgcagatggcatctccattgacgacctcagcaccggagcggtggttctcaatttgtgatgccattggatgtgtagtttcaggcaaagaagctttgggtttggagatgtgttgtgtgcaaatggttagagagattgttggtgatggaagatgagatatggggctctgtttatatagagttcgtactgataaagatctttgcagactgcttaggcaaaggttatgaactttggattccaacttgtttatacaccagccttttctgaccatgcagttgataactgcatagaaattctgacgcacaaagtccctgaccaagtccactaccgatgtaatacatacacttcttcagcaaaggatgactctttatttattcatttatttatttttgcaaggagccagagatgacttataccaattaattagcagtgttcaggtccaattcgttgggctcatgatcagtactccctccgtccccaaaaaaaagacaaaccctggtttccgtgtccaacgtttgaccgtccgtcttatttgaaaaaattgtgaaaaaaatttaaaaagataagtcacgcataaagtattaatcattttttatcatctaacaacaacgaaaatactaattataaaaaaatttcatataagacggacagtcaaacgttggcacgggaacccacagtttgcctcttttttttttttgggacggagggagtactagtctactagacactagtgccatatcaccaatcaagtatcaacatcatttcaatgttttcagaaaagctataggagcaaaaggcagagcagagcacaaaatcaaaatcataacattatcagctttttttttttgccaggtcggcagaaagagtggccgaccaaatttcattaaaatttagggagtttattacatggttcatttcacgacagtatcagcttcaatcagcaataaaaggcaaagtgctgtgttgtcaaagcggttcgatcacaaatgacaaactaatgccacagagttccacatgggaggcaggctagtctctactctatttacaacaaattcataccttgacgagtcatccagtcaaatccatttaagagtaacacggcctaaaaccccagttccattaactgaaactgttacagcagttttttttaccgaactgttacagcattttaaggcacagaaaatgcagtcaactctctcaggtttttgtgttgacgatttcgtcaagttataattcagtttatttttacagagcaaccttgtcactactcatccgagcaagaaccaagaacaaaggattcagtatatcaattccaagtgggcttccaaagccattatttctcacttgcattacagactgaaatcaaacatctcgaccgagcacggtcagatactactctcttgtctcttcatacttcaactccccatctgaaacgacaataaaaggactaggtctgtgtcacgccccaactagctccaaacggaaaccaatgtaagacgatccaaattaacctgctaacctataccagtcccagaaaatagagctggtacaataagaagataggatatcacaacgacagggattttattattatgagtagagatgcattcattgttggaactgcgaacagactccgagttcatagctgcattacaataaggcagaagtggagactaacccaaagccacaagtatgacttgggaactaagccgaaatcgtaatagggctcgaagctgcttgctcctagaaaaactcctcatcagctagatcaactatgtcaaaagagcaccatttttttcttccttctttgcttctggggactctggaatcatcgtcatgatgtgatctttcgagggatgtcgatatctctcccgcgcctagttgcaaaagacgctgctctctgggcagagcgtctgaagagatagaagataggattgtggtttccgtttggaaggaaatcatttcttcctcccttcgaatccccccctccccccgcgtgtaatataaacttttgtaattttcctccccttactaatgaaattcaggtggggatcctccccctccccctgaactttctaaaaaaaagagcaccattctcttaaaaaaagaccatcaatacaatgttatttattcgatctactccctccgttttttaatatatgatgccgttgacttcttgatacgtttgactatttgtcttattaaaaaaagtaattatcatttattttattgtgacgatttatcatcaaatgttctttaagcatgatttaactttttttatatctgcaaaaaaaattaaataaaacaaatggtcaaacatatataagaaaaatcaacaatgtcatatattaaaaaccgaagatagtatataataaacataattaattaaactatacataaattaatcccaaatcattccatgtatttctctacactcacctcttcttctttgtcatattcaactcctcaattagaagaaatcatttttttccttttttttaccctccaaagaacgggagttgttactgttaaaaaaaaaacattttcctccctaagcctgcgaagtgccaaggctagcaaaatcaaaacttcgatttttggatgggatctagtagtgtgtagcaatggcgacacgggatcgtctcctgttcgaagtgcatttggccggcgagctgctcgtcggcgggggacgaaaccaagtgcttggcggtcggcggtggagcagcaaaggcagccggatctggagattccggcgacaacggcggcgctgtacggacggcgatgcctctacaaccatcccgtctgacagacaggtgagccctgtctgctcttcattcaggtactcaatttccaaggatctggcgatctgtagcatattcagaatgttttatcttcccagagaaaaaggtgtattgatcccaaaaggaatttcagataagtggttagtcagctgctgtccaagtgattaaccatgattttttggtttaaggaatgtagcactattcagcagtttaaggagagagcaaaccacggtagaaaaataaaaacattttctgaatgtttcttctccgttcatatcatttttgcttgtcagaagaagtagaacaagtagaagtgaaacctgattgtatcaacctatataacgtggaactcaacaagtcaattatataatgttcagatcctttttttttctttgtcaccaactcaccattgtggaagtataaggccattgcattgtctagtatgggtgtactggtcaaccaaaaattcacatgcttttgaaacttgatgagagatctatgctggtcagtcttgtatggttatac

SEQ ID NO: 58695 - DNA, 11841 bp, Oryza sativa
caattagaaacacacatgcttttgaaacttgatgagaaatctatggccctgaaccaaatctctagaattttcttacttctttggttgtcttcgctgcatggtcaatcttgtataattatacaaaagcaaattgaaagaaaaacaaaacctctaattcaataggttgacgccaaaaatttgatctaagtttcagaaaaattctacatacgtgtggaattggtttatgtaaaccacagtgcaattctagcatgtggctcagtgactgccttagtttgtgctccgcttcagattatatagttcctctccagtctcagttcttgtcaacctattgtcgagagatcttcaaaaatattagattgcataattacagatggagacatttttgtctgcaattctgagtgatcttgccactagatccttatctttcctgatcaacaagtgctcaaaaccgacatcaccaaccatggaggagaaactgcaacggctccttcttcgggtccagatcatcttggaggaggcagaggaccgacatatcgcaaaccaagccatgctgcagcaactgaacatactgaggaaggagatgtacagagggtattacatcctggacaaattcagataccatgaccgtgaagaagaaaataccaaagatcaccaagtgagtaactctttcgcaccatccaagttcaatcctgccaagcgcattcggttctgcaggacaagtggccagagtttacaacagcagctgcagcaagttcttgccagccttgaagccaccattgaagataccagtgaatttttcatgttcctgaacagttatccacgcttgaaccgtcagccatatagcacgcacttggtcttagacaagtgcttgtttaatcgccagatggagatggagcacatcatgaacttcctgcttaaagacaatacaagtagtaatcaaaatccaggtgtcttgccaatcatcggtccaagcaatgttgggaagagcacgctgattgagcatgcctgcaatgatgaaagggtgcgtaaccacttctttcaaattgtgtgtttcagtgttgatgatcttgaagatgcaaacatggtgactcttcgaaattgtggtgtaatcaagcatcaaaaccatgcaactggtggagaaaggatactaatcatagtcgaactaatcagagacatcaatgagggggcatggagaagattgtactcagcttccaaaacttgtgccgcaaatggcagtaaaattatagtcgcaagccgatctgatagtatttcaagctttggaacaacacatgctctgagagtaaaattctttactcaagaagcttattggtactttttcaaggtgcgtacatttggaagcatggatgcagcggagcacccaaagctggaatcaatagccgtggatatggccatggaattgaatgggtgcttcatgggttcaaatgtttacagtgtacttcttagagaaaatttcaatgataagttttggagcatggccctggcaagaatcagagaattcaggaagctgaatctcttactctgcggtacaagtaattttgacgatccttggcagggtgttggacctgcatacgttaggagggtaaacaaaatttgctccggaaatcatgtgattcatgaggactataaagtatgttctattcagaacatgattcattgtcacacaaactctgctcacagtgaagatgatgttcccatggtgagtttgcaaaattttctcttcggaagtgttaaaccgcaaggaaaattcaatgttctcgcatggaggtctcaccttccacctcactacaactacattttcaactgtgaggtacggaggtcacatcatttgatctccaggaagaagagatctcagaagctttccacctgaccatctcagatgctgatgcaggggagcgttgccatgttgggccaaagcaaaatgagcattgtcattacagagtgcatgcatgatagtctctgattgcaagcacatgattggttcataggaaattatctgataattgtataggaaattgtcttgcctactccctctgttcaaaacaagacaactggatttgaacatgcagagggagtatgtgtggtataactagtttgtaaataattgtataggaaattatctgatactctcttttttttttgaaaaaaatgtcacatagaattaaatgattataatacatttgtctatgccaagttaattaaatccctacaagttaatagtgatgaaatcgaaattgcaaataaggagtttatgttttacacttttgttctggttattacagtaggccatgctaagactttgttcttaaaattaacatccccattttggaagcgttctcctttcacaaaattttcacgagtgaaggtgcctctgcctcctggaattaggttggagggacttttggtttaagcaatctctcaagtctctaaaaaataaaactgatattgactaactagcctattcaatcatgtccatatttttttctggttgcatactattcctgaaaacgatagcgttcacaatttttcaatcccataaataatggatgcattttcattggtcttctagtcaaacaagttggcataaaaaacacgttaccaaactacaacacttggcattacatgattcctctcaacctccttatctatccattgagtagtatctgcaaagtcttgatggggaaaagaaaaattggtttcattcccagaatgaatactctcttgtctgcaatcctaggagagcttgcaggtagatccttctccttcttgatagacagatgctactccaaactgccattgctgtccaacgaggagaagattcagagactcgaaaggatgctgcaccggctcgctgctgccatcgaagaggccgatgggaggagaatcttgaaccatggaatgcttcgacatatcaacattctgagacaagacatgtacagagggtactacattcttgactccttcagattccctgaagcccacgaggaggagatcatgagcgaaaacaatgacaaagtgagttactctttagctctgtctaaattcaactctgccaagcgtgctcgaatccctattggtactagacggcatggagatagaggagagcttgagcaggttattgacaacctagagatcgccatggctgacatggttgagttttttctgcttttgaacaactacccttccattcatcgtcagccatacaacagttacctgttcatggacaagtgcatgtttgggcgtcaaatggagatggagcatatcatcaatttcttgttgcgtcctgaacctccaaacacgctaagtgttgataaccttggtgtcctgccgatcattggtccagccaaagttgggaagagcacacttgtcaagcatgtttgcggcgatgagagggtgtgcaaccacttctctcgcatcctttttcttactgagggcgattttagagaggaaaaatcattgcttacactaagggattcaggagagataaggcatatgcacacatcatcatcggtttcaagtggaggagaaagattgttagtcatcattgagttagctgaggatgttgctgatgataaatggacaatgatgtgcgcttctttgcgaagttgcatttcagctggaagtaaaatcataatcacaagccggttagagaagatcgcaaagcttggaacaacacaacctctacgtctgaagtttttgtcgcgagaagcttactggtacttctttaaggtgctcgcattcggaagctcagatcctaaagaacaccctgagttagcatctgtatcaatgatgatgttcaatgtctactttgatcatgaattgtacaagaatttcactggaccattcatggacctaaatatcatggccagcttgatccaagctacattttatgagggcaactggctcagcctccatgcacacaccaggagttattttctgcttaggagaggtttaggtgatgattttgagttgaagacgaagtgcgtgcctattcccaagaaaaatacagttgtgcaacagtattgtgtaatttccgactattgccgagtaggggttgctcatgaagaagatcagaaggttcccaaaattgacatgcaagatgtcttgtcagggagagttgcacctgatgggagatttgatgttgtgctatggagatctcacctgccgccatattacagctacatatatagctgtgagatccatgagtacaggcctgtattagctacctgcaagatggaactccggcaaaagaggaaaaaaattagattgaactagatggttttccatatgtataaatgataaagagtctgtcctattttatcactgaattcagctgtatgattaacactagattcatctttttatgctgtctcttgtaaacttatcctacaagctctattagttgctgtcttattgtttcctcatgtgaatctgtccttgataagcaggtctgttgaaggaacaggatcagccgcagttgtagttttgactgcaacttttaacttcagcagtcaccatgatccaatcattcaatactcaaccaagatcaagaggctatttcttttttcattcctttgattagtttgcaggttaagtaggcgatatgtatgaaaacatttatacatggggtaaggataattacttaattacctagttatgctcgtttgtgtcaaattggattttagattctagttcagagaaaaactagcctctactaatttcatgctgaaagagtgccctacttatatcaaattatatttatatgagtgggggagcccctcacctcataggctagtttttggggtggaaaagaccctttatgatcctacattaaacaacagtcaaatagtttttttatatagagtcttatatgaatgaattttcaaaattgtaattactaaataattaacttggaagttcagaatgaattgatttaagtgtggtaaataactataataaatactactccagtattcaagaaaggcgagaggagagatgggctgttgatctagagccattggttacatgttgggtggttggatgtagggactgctaaagttgcagtcacaactgcaactgcagtcgatcctggtgaacagatgctcactgctcatttccgatgcacataatctctcatattttttgagtgaacaatctctcatattcaactcttgagaaaaaaatatccacgaattgagttgttacacatttttaagtccatacatctgtttacatatgaaatgtttttatttgtgcgattgactacatcaaaagtccattattctttttcacacattgcatcccgaaattcaaataactacaactagatcatataaattaaaactaataatcatcccatgtattcttttctcttcttagcattcctcttatttcatctcctatatcttctcacataatttctcaacttctgtaacaatatgggtcacacaccttctctatgatatgattttggctcggcatccatcaatagtatatatggggctaattatcaaaggtaaatgtttcagcgataaatcaaaccatatcctaactacaggcaaataattttttttatattttcagataatgggatctatactgtccattatccaaaaaaaatgttattttctttctttccttcattctgagtttatgactaacttaccaaaggctgccgaaattaaagcttcaattttggatgtacctgtggtgatactactgtgcctccaagctccctgatttggcagtgatcgacgtcgtccgccacgaagggagaaggaagcgagcatcgccggtggtggtgcagcaaaggaagtcgacattgatacagtggtggtgccggcctgatctggagacatcagtggcaacggtggctcgggtacttccgacaattggcagcatggatggtgatgcctcctctcctcccatgtctgctcttgatccaggtacttaattttcaaggatctgtagcctattctgaatattttatttcccagagaagtatattacaaaaagaaatttcagagatgtggctagctagtcagctgccgtacaagtggttaatcataattctattgtccaggaaacgtagctattcagctgtttaaggagataacaaccatggtatgaaaacaatttatgaatttttcctctctgttcatgtcgttttctttagtctttcaggtcagacaagtagaagtcaaaacttaactctaaattaacaaagagcaaagagttgaatttggccctgcaaaaaaaagaaggcttgaattttgtattgaggccttggaggcattgtccttagcaatgatacattttattgatatggactggtccacaaaatctgctatggtgcatcgtgaagtctatggactggtcaacaaaaaatacacgtggttgtgaagtctatggtgctaaacaaaatctgtagaattccctttactgctttcattgtctctgctatgtggtcagacttgttatgctaaagcagactgcagagaaaaatatagaaacttgaattttaaggagatgtggagtttctggagtatgtggctgccctaattctcactctgttttatcatatcctctaaaagttctgtgattacatagtttctctctggtctcagtccttgtcgacctgttgagtgatttacaaaatttcagattacatagttacatatggagacatttttgtctgcagttttgagtgatcttgccactagatctatatctttcctgatcaacaagtgcatgaaacagacagagtcagccatggaggagagactacggtggctgctgctccgggttcggatcatcgtggaggaggcagatgaacggatcatcacaaaccaagtcatgctgcaacaactgaacatactaaggaaggagatgtacagagggtatttcaccctcgacatattcagatgccatggatacaaaggtgacaatactaaagatcaccaggtgagtaactctttcgcactatccaagttcaatcctgccaagcgtgttcggctgagcagggtcagtggccacagtgtacaaaagcagttgcagcaagttcttggcagccttgaagttgccattgaagatacaagtgaatttgtcatgttcttgaacaattgtccacgtctatgccgccagccatatagcatgcacttgcttttagacaattgcttgttcagtcgccaattggagagggagcacatcatgaacttcctgctcaaagagaatactcccggagctgaaaatctaggcatcctgccgatcatcggtccagagaacgttgggaagagcaccctgattgagcatgcctgtgatgatgaaagggtgcgtaaccacttctctcaaattgtgtgtttcaatgacaatgatcttgaagatgcaaacatggtgactcttagaaatcgtggtgaaatcaagcatcaaaaccatgccactgatggagaaaggatactaataattattgaactaatcagagacatcgatgagggcgcgtggagaagattgtactcagcttacaaaaattgtgttgcaaacggcagtaaaattatagtcgcgagccgatctgataagatagcgaactttggaacgacaaaggctcttagagtgaccttacttactcaagaagcttattggtactttttcaagttgcgcacatttggaagcacagatgcagcggagcacccaaagatggcatccatagcaatggatatagccattgaattgaatgggtgcttcatgggttcaagtatctacactctacttttgagagcaaatttcaacgctcagtattggagcatggctcttgcaataatcagaaaattcagaaagctgaatctcttactctatggtgcatgtttttttgatggtccttggcagagggttgaaccggcatatgttaggagggtaaacaaaatttgtcctgagtatcttgtgcttcttgatgactataaaatatgttctggtcaaaacaacatagttcattgtcacacaaactgtgctgacaatgaagatgaagttcccaatggttagtttgcacgattttctcttcggaagggtacctcgaggtaaatttaaggttctagcttttagatcccaccttccacctcacaacaactatatgctccattgtaaggtacagaggtcatatcatatggtcaccagaaacaagagatctatgaagtttttacatgaccatcttaggagctgatgtataatgtaattatgtcgaactgtaatctgaatctgagcatttgttgaaatgctttcacctactgtctgagcggctgcgccatttgtagtccaagctcatgtgtatgtgctattttaagaggttgttgaactcaagtcgtcagaatctattaacattctgtatttgaagtttgatcatgtcaccatgcgtgaggcacaaagacacttgtccagaagtcaatgataattgacagcaactaatatattgatcctgtgtttactgtttctgaacattcattgcttgttgcagcttgcaacatacggaaagcatcctaatacaaacactccatggcattatgatcacactaattacaccagcttcagttagaggttcagtactagcatcagcactaactctcaacaaaaaaaaagaaagaaaagaagatatttctgactagcttcttcaaccctgtccagagggaaaagtgtactgatcccagagagaggaatttcagagaagtgattaaccataattctactgtttaaggataacatttgctgatctcgttttctccgttcatgccattttctctactgttccagacagacaagtagaagccaagacttaaatctaaataaaagaaatagcaataaacttgaaatttgtcctggcaggaaaagaaaaagagaaacaagactggatttgtgtattggggcctttttggcatcatcctgaggaatggatacgttggattgattattagcaataacagcggtagtgacaagaagttcagatcctttctttttctgtcaataacagtggtagaagtagatggtactgactgatgaactgaatctgtacaattctttttgttgctttcattgtctgcgccatgtggtcagtcttgtacagtcatgttaacgctaactgtagagaaaaacagacacttgaattcaaaacagttcactctgaaaaatatattccaagtacgcatggaacactgtttgtgtaaaccacagcacaatgcattttcctggagctacttgagtatgtggttgcctaatttctactctgcttcaccagatcctctaaattttcagtctacatagcttctgtcaggtcccagctcttgttgatccgttgagttatgtacaaaacttcagattacacactttacatatggagacatttttaactgtgtttctgagtgattttgccagtaaatccatatctttcctgatcaacaagtgctcaaagccgacagcatcaaacatggaggagagactgcaacggctgctgctgaggatccggattatcatggaggaggcaaaggaccggctaatcacaaaccaaggcatgctgctgcaactgaacatactgaggaaggagatgtacagagggtattactttttttttttgaaaatagagggaacaaagtacaacccctaggggtaaaaaaaggagaaactgtacaaaactgagaaggcctatacacaatttgatagaaaatcccgtagcctccttgctcccgccatggtccaagttcttgcctcctcttttatttttgccataagactaggggccgcagtttccttgtgttcgaaaacccgccgatttctttccttctagatctcccaaactattaaaagaattagggtccgaaggccttttttgggcacctcctttgtattggctagcatttcccaccaattttggacactctggcatggagcccagtggcacgagtccagttgctggtaagccacccaggcggcagtcaggctccagatccttctagtatatctacaatggacaagaaggtggcttgctgactcacttgtcacgcgacagagggggcacgtcccgttgtttggccatcctctagctgctagccggtctgaagtccacaccctgttttggatcacaagccacgcgtagaatttacattttggtggggcccaggctctccaaattaaggcgttgaagttggtgccagtggttcccaggcattgcgctttgtatgtcgacgaggctgagtattctccatggtttgaaagcttccaggtgatttgatcgggctcgctttgattgagaataatgtactgggttgcttcccatagggagacgagctggctaatcaggtccacagtgggaggaatggtgccgctgaggtccaggtcatcgatccaagagccgttctcaatgccttccctcagtgtttttcctcttttttggatatcgcataggctagtggcatggcgtcttttggtctctgtccctccaaccaggcagagtcccaaaatcgaattgtgttgccatccccgatcgttattttagtggccgtagcaaaaagccttttatcagtttcatcacacggtgtttcgaggcctacccatggcttagtgggatcttttcattcatgccagagccatctcagatgaagggcccttctgaacttttccaagtttagaactccgagccccccttgcgcggttgggaggcatgtcctctcccaattgatcttatgtctcccgtcccttgccaaaggagccttcttctcttcgcatcgagttggcctagagcttctttggttaccttgagtgcagtgagaaggtagatgggttgcgctgtcagcaccgatttaaccaaggttgaccgtcctgctggtcccatgtttttccccctccatccagccgttcgctttgcaatcttgtcaaaaagtggttgaatatccgccttcctcatcctccctaggactagcggcagacctaggtattttatcgggaagtgtgctcgcacagctggtacaccgtcaagaatggtgtcgaggtctatgttttgacatctgattactgccacctgagatttctgcatatttgtgaccagcccagccgcatgcctgaagcgtgtaagtatgtcagtgaaggtctggacatccttcctgacaggattgatgaagaccactgcattgtcggcgtacatggagattcttaggcgggctgctcttccccgtagctttgtgatggcattaagctccgttgcttttgaaagcagccattgtaggggatcaatcgccaggataaagaggagcggtgatagcgggtcgccttgccttagacctctgccatgctatattttgccccccgggattccattgaggagcacttgtgaggtggaggtggaaagaatagatgagacccagtctctccatttctgtgggaagccataatgctgaagcatagctagcaagtagtcccatcgcactgagtcgaactctttgggtatgtcgagcagagggtattacacccttgacagattcagataccatgcccatgaacaagacaatagcaaagataacaaggtgagtaactctttctcaaaatccaagttcaatcctgccaagcgtgttcggttcttctgggtcagtggccatagtttacaagagcagttgcagaaaattgatctaagagatagatttggggatttcaacagtaacattgatctagtcctaaagggcaaatataaatgtatacaagaggtgcgaaaaatactaaactacccctaatatcttaacagttggcagtatagaagtcacccttgaagatgtgagtgtgtttgtcatgttgttg

SEQ ID NO: 58696 - DNA, 16519 bp, Oryza sativa
gagggaggtgagtcagggggaggcggcggtgagccaccgccgcgtggggacgagcgccggtttgggggtgccgagcagcgcggcggtatggttaccgggatggtggatcggagtcggactgggccacgcgagcggcgggcgggggtagccgggtagggcgcggcgcgcagcggcgtttcgatttgggaattgccaattccactctctccgactgttaataatctgttcgacctcgaagcagccgtttgccgtatgtactccctcggtcatggaataaatcaacttctgaaatttaaactttttcttaaaataaatcaacgaatatagaattgaatgtagcacattctaatacaataaatctaaacaaagatatatctagattcgtacactagaatgtttcttattgtttttattttctagacagatagagtactaccttcttagagcatccccaggagatccttcatccggtcctccatccgatatatggcatatgcgagatgaaaatggacctccaacagatacggcattgagtccgccaaatatggacgatgcgccaaagcgagtagatttcggccaaatatagcgattctctctcctcacgccatatctcaacgcccacatctcccgcccacattcggactcccatcgcgacctctcctccatcgtcgtcgtcgccggccgcaagctactgacgccgagtcgccgcaagccgcaagctgtcgccgccgcttacgagcctgtcggccgcctgtgctgctcgtcgtggagtgtggagaggagggtgtaggcgtggagagggagaggagtaccagatctggaaggagccgtgcggccgccgcctgccgccgtcgccttgcgtgttgtcgccgccttccaccgtcgccctacgtgttgtcgccgcctttcgttgttgccctgcgcgcggccgccgcctacctcctctgcccctgcgcctgcccgccgctgactgcctcctccccgcccatccagggccctcgcccgccagcccgcctccgcgaccattgactgcctcctccctgtccatttgcgccctcgcccagacgtcgatcgtcgccccttgcccgcccgccaaccctcggccgcacgcccgccaccgtccctcgccaactcgcccgccgtcgcgagtagagaagagtagtagtagtagagaagaggaaataggaaataggaatagagtaaaaggaaaagagtagtagtagtagagaagaggaaataggaaataggaatagagtaaaaggaaataggaaataggaatattttttgctgtgtttttatgtacattttattttattgatgatgctacgaatatataaaaaaatgtttccctcaattcaaatatatcaattaaaaaactatcaattaaaaatatatccgttaaaatttactcgtttcaaaatattatcgtgataaataacaccgttaaaattaagttagttggaaatatatcccttaaaatacaaatgtaaagttagttggaaagatattcctaaaatataggataatgggatattctttttttggatgatactccatatggacatttgcaggaccaaatatagatgagctgctggggatgttcttatctatctcgattcataaatcgaaaatatttatttcttcgatacctctttgtcgatgagagatacctgtaaaccgaatagtatgggtattggggtacgttggtacgaaaatctacacgattcgacatcaagcaaataagaagacatggattatactgttttggaccactcgtaagttaatagtcataatccagtttatatgagattgatatggaaatccatagattataagagagaacaactgatcccaaagttaccgacgagatccttgtcgagatggcttcgacgaaattcctagcgagtagacttcaagttctctgtattgctgctttggtcgtgggttggctagtgctatgattcgatgccttggacccctcaggaggtgtctacttataccgtgaatctccttagtctccaagtataacttggagatcccggaccctacacgatatagtataatcctaactttcttcaagtagaactctgtcacgttatttgcctatgaggtttatttccataatgtcttgtcgattttcatattatatgcagaagtctatcgcacatacgaagatatgccgtatccgtatattatataagccgtaggatagaagatataccttatccgtagccataacactttaacgcgcctatccatcaatactaatttgctattaataaaatgcattttgttcttttattctctcctttaatttttgcgttggaatgctaggagtaacttatttgtgagaaaaagggagttcccataagccactaagattaattggatccgtacgattgtaagacagttttaaaaagtgccatcaactattaaattatttagaaccataatagtattacaatttcatagctcatttcaaaatatactagtgctacttattctccggacgcatttgtttcagaccaaattgcctccgtcttcttctttcatctctttctctgttcccccatctctctcctttcatggaaatacagcggcggtgaactcattctggcatcgaaccactggttctcgtctagtaggtggttgagggcgatgcagactttatacctctatttttatcaaatcctcatgaaattattccctaattttatctactcttaatgctattattccttacttacacaaaggccgagtttagttccaaaccttttcttcaaactttcaacttttccatcatatcaaaacttttctatacacacaaatttttaacttttccgtcacatcatttcaattttaaccaaacttccaatttcggcgtgaacaacacacccaaaatctgatgaatcaattactaaaaatgaacttatttttgaaataaatgggaagagccaaaagtgaaattatgatggaacggctggagtagctagcagacacaatagatcataaatatgggtccaaagtgcacacactctctctccttgaattagctactagtactctctccagccaaaatataacaatttaatactgggttgatcgcaatctaatactacgtatctaaatggtttagtaatatgaaagaatatggataaacccctatctaaattcgtaggactatattatatctagtcggactagtttgtcatatttgacaagaagtactaataccggtggagacttaccaaaagtttatagagtacgagaaaagcagatagtaaggggttttactacctattttatcattgtggagacggatagtaaaggatgtaataactccacttggcaagaagcaattataaaacattaaactcttttctcttttcaactgagagtgtatttagttcttttgggtgtaaagtttttgaagtatacggacacacatttgaagtattaaacgtagactaataacaaaataaattacagattccttctgtaaaccgcgagacaaatttattaagcctaattaatctatgattagcaaatgtttaatgtagcattatattgttaaatcatagcataattaggctcaaaagattcgtctcgtaatttacatgcaaactgtgcaattgtttttttttctcatatttaatgccccatacatgtgaccaaacatttgatgtgatgtttttggttaaaatttttgcctgaccactgttctacatatggatcgtaattttctgtcaacacattatgagagctagaaataactgtaacttgatttgtcttatcttaaaactcgaatattagagaagtacctaatatcaagtaattagaaggggtgagacttcgaacccagatcgtttagcccaccaccttatggagctagccgaaaaatccatgagcgattctctgatttgtcttatcttactactcactaaatgaattatacagtgaggaaagccttaaatccgacaatgccactacatatcatggccatctctctcctctgaaccctagaatccaacaatacaaccgtggttgtgtttagttcacactgaaatttgaaagtttggttgaaattgatacgatgtgatagaaaagttgtgtgtgtatgaaaggtttgatgtgatgaaaagttggaagtttggaaaaaaaaactttggaattaaacagggcctgtggctgtgtttagatccaaagtttggatccaaattttagtccttttccatcacattaacctgtcatacacacacaactttttagtcacatcatctctaatttaaactaaaatccaaactttgtgctggactaaacacaacacagcctttgtatcaccgggagcggagccctgcggcatgcattggccaagtggtggtggcgcaggccgctggcgttggcctttgtacagcgagacgcaggcacgcagccacacgcccacacccccacgctcgtggtggttttgaccggtcaggcggtcaaataatccattgcgatcacccagtctctctctccgtcgtcgtttctccctctctatcgcctaccggtctctccgtttcacacaatcacatcgctctaccgacttgctagtgttactccagctctgtttcacaaaccagcagagtgagagacggagacaaaccgacggaatagttgggatctaattaagcaggaggtttcctgttacgtaatcatactggttctactcccagattaattggtgatcagtactcagttggtgagcaagcatggcaccacctaggatgctagtggtacaatcacccgtgcacggcaatgcgcggcgatctgtgcgtgatctgctgcggtttgcccggatcaatcagaagcgctaccgctgccaagacccaattgatcatctcacatcgttttcttcccctctgcattatggtgaatgaatcacaccaaacctaatttgctacagcagaggaaaagaaaagagaaataaaaaaaaggaagcacaattaacaccggtatctacgtacagcagggagaaaacgatggcgctgtgagagtacagcgattacatatgtaccacctcacctaacaagctactacttacgtagtagtaagatctaatcatctaagtagcattacagcaaacaagacatcacagtagtgacagtactatgtgctaggagcaaatgctttgcttgatgcttccaagcaatcgtgcctgtacattgcaatgcagcttctcacctgcttgcttggaagcaatccctgcatctgatcaccgactgttcacgcagctaactgatgctgagtgctgccgctgctgcttgtgtcgtcctcggacaggaagcaatgcagccttgccgccggagcaggggaaggagaaggcggcggctccagctccaggcagagcatctcggactggagcacggcgcagtagtggccgaacgtctccggcgacacgttcaggtcgaagccgacgccgaagaggaagtcgacctcgaggtagttcatctccgggaggctgacgccgccgaccttggcgaagtaggcgttgttgtagcatctgcagtgcacgcatcttcttcagatcagacatcttgtttgcagaaacaagctaaagcttttactgttagtggtagtaggctaccgaacatatgtgcagctaacgtcaaactcaaaccagatgatataccatgggccaaaaaggcacaccaatcgagttattttctagattattatcaactgggcaattaagtggtacggttaatatcaactgggtaattatttcagaaacaagaagatttggggttagatgagatgctcctggcaggagggagttggggctaatgagcatcagcaagagggcaagttgacactgccccatcctaggctagctagctagacatcacaacttggcaatgaattaaattccaaaaagagaaaaaaggtggtgagagggaaaagggtggagaaaagaaatgaaaatcctatctttatgtctttgggtccccagtgtatgtgtggtttggatggaaggaacagtggaaccaccatggtttctttgttggacaagcataatttcgctgcccacacacacatatccccacagaacagataacactttggtgcgttcagtgtgaggccgtgagataatatatcaaatttctgcactgcagcgtgttcttctcatgaacagttcgatgaagttttttttttaacttttttcaattgggctgtgcttgttaggacttagggaagggtttattggtttctgatgtttaaagaatccactgtgctgatgcttcctagttcctacatggtggtgtttggtgtattcctgaaaaaaaaaaggttcctacgtggtactgaattccaaattttgatgacgatattatctcatcagaaggttctttatccataattcaccaagattgcgtactattgctcacacaacagtccaaatttggggttggcatgatggtattaactcttaactcccaacaaatacttggttgacagtgatttgaacaggcacaaatgaagcaggataagaattgcacaataatgtttggtccaagaagatcagcagctagactgaatcgtccttattaagcctaacaaacgtaattaggccgaaaaccaagctatctacacaaaaaaaaagtaattgttcaaagaataggccaattggcgtatttctgaatgaattgggaaattcagagtgatctacctagcatgttggatcaaaattcataaagaaaaacagagcattctgtttctgccatgttctggtccgggcaccgactggactactgtagccaagaacagcaacaccgcaaagaacccagaaactcgattcgatcatacggctatcgcatcaattattgcgtgaccacgagtggccgagtgcgaggcgaactcacatgtcgtccatgaacttgacggcggcgagcacggcggtgatgaggaggcggtgcacgctgtacgagtccacggagaacgcgcacgcgcgccggcggcggcggaggaggcggtcgaggtagatgtaggcgaccacgtagcacgccgggctgcaccccgcgaaccgcgcgatgcgcgccatgtacgcgcgcaccgtgatgtcgggcttcgtcgtcgcccggaacgccgacgccgccggagctcccgccaccgccagctccagctccgccgccgccgcgtcgttccgctcggtcacgcgctccaggagcgcggcgaggacgcccaccacccgcggcatgtccgccaggtcctcctcctccgccatgatcgatcggagaggatcactggactcgcgtggcgagttcttgcagctggtggagaggggagtggacctgaacctggtggatggctgaagtgttcgtcatataaaatggagggaatgcgactgcagcgcgcacaaatttctactactcgcaacggcactaccatccaagtagttttgtgaattgtgattaaatcgagcattttttcccagcattgggatctcaatccaatggttcaattcatctcacacctccgtacattgcatttggaaatattcgttgtatttttttgacttggttggtagcagtatatggctggctgttgatcagttaggtactctaggtagtatctttggtgaagtaaagagaccagaatccattctttactgtcaatagttgcatcctaggctgttctacttggcacattctgtcacaagtgtcaaaatgataagaggtgtgacgttggaagagctcgaaaaatgcacggcaagcgagctaagatctggctgcgagaggaaggagtaatgttcttcttacttctgcatatttgattccagccagtgaaagagtacagtttttcatcgtttcgtgttaattactcgaagaaagataatcatactcaggattgatcagccaaggacgtgctagtcacatattgacgacgttcttcagacggaaatgctgatcacgtatgcttggttaaaaggtcaaacgacaagtgtgcaccacaatacgcccttaagctataaacttctttttttcagattcgacacctataaactcatcctgatgtgcaaaaatcattaatagtttgttcttagcatttttctctactctatggtcgtagtagaagagaatattctcatgtcgctagatgcttggtatcttctgcctcgaagtaaattaatcagtaattatgcgctgctatgcactctggagtctagagcctgcttcgttttagtaatcgttaggattaaaccaaacatttttcgtgttcctgttaactttctcgccaactaatgagagaaccagtagaaggtctcgatcacattctaacttctaacgtcctaatctgaataatagtgcataagaccaggacataatttgattactcagaaccacaatttgctgcctgaactgagttccgttcagaaaagaaataaatgggccattattccattaataaagcctgaataaagtgagcactagatcgttcatatttacctcgctgttaatttttcacctatagctttagcagtgagctcgtgaaggaatctggccattagtttagtgctaatactgcatcttgatctgaatcaagcgaagtgactgcaactgcaaccaccaccacccctcgtgcagtccctctagtgagtgacccccacatgccctaattcgcactgtcatgagcaatctgcaatcagtcagatgaactgatcaggcaggtggttgggagggagatcatggagggcgacttcttggcggcttcgtggcagatgaggggagtaagtaatagtttgagacgaggtgaggagacgacgacgaacctctcgtgggagggtcgtctcttcaggatcaggatcgccgtcttcagacgtagacacggcggtgatcggcggcgctcaggcggacggatggaggagacgacgagacgtccggcgtccggggaagaatcggcgaggggcgctcgctgcatcccggggccctcggcgccagcggtgggccggccttcaatgtttccatacgagaattgggccctttgctgggccgggttgggccttttggccgagatgcaacatgcgaatcagactgtctataattgagggatgtaaaatggactttctttttttcttttttctttataaagtgttgccttgaattactttctgatattcacaatgtggtactacaattttatggtttgtaaaaacaaacgcgtttcttcagtaaggaaatcttctatcaaaagaacaagaaatgtctgttaaacttaaatctttttttaagggaaaacggcacgagattgtgccttttcattaaatatagcgggggaacttgtgccttttcattaaatataggggggaaaaatacagccctagagcaagaaaaagtaaatttctgttaaatcctcaataacaacaacgcatttactcattgtatatgtactagaaaataaaatgagccttgtacttggcggccattaggcgaatttacaactttcttaactgagccaagttgaactgaaaagaaggtatatctatgtacgccatgcgattttgtctaaggaatcaattgccaaatgcatctaccctgtctggaacagacacaactatagcatctaaaaagcactacaagcaagtaatgcattcattcaggatgtaatgctcatgagattgttgatgttctttcacaatcatgtgtcttgaaaggcataggtattgatcaatgacttgtactcttcattctcctcgcaccgtctacttctaagtacattcatcaacctgtctgcgctttctgcatcgtttttctccttgaaattcgcaaggaggctctcaacattggtgggtcttggtctccatttgcttggacttgcaactgcagtggctttctccaaacatgacagtgcttcagatgattgaccgtccttcaggtatgctgtgccaaggatttcccaggtgtttggttttggatttccacctttctcaacaaatctgttcagagtttgctcagccttggtaacaaagccttctctggcataccacgctaataaaatgttcatagtcttaggatcaaaactggaactcttggatgcccattcctcgtaaagaagttcagctccctcaatatctcctagcctaacaagggcagatagtacctcctggtaacccaggttatgaattgtggggaaagttgctttgtaccaattccaaacgcggtagacttcttccttcttgccgaggtggctatagagtgtcatgagataatgaaaacattttttctcccgtcctgtcgttctcttttcagcttctttcagggattcttccgccttctcagagttccccaacttaatatgcatactagcaagagttgtgtaagtagtccagtttgcaacaacagtctcatcgcgaatcatctggttaaagacttgttccattgcatcagcatcttgcatagccgcacaactctttatccaaatgttgtaagtgcagacatcaaaagcaacgtttctttccatcatctcatcaataagtatggacactttctcagcctcttcagcatccacataaaaattcatcaacacattaaaaggtaatgtatcagttgcaaatcccttttttctcatctgctcaaatgtgctttctgttttctctttcatcatagcttgggcataaacattgagaagagaaccatatgtccgcttgtctttcaatggatcaggaagctcctcgaagtattcttcagcatgtgaaacaccacgtacttttgcaatcagatccaactggattgccatatcactagatgagagtgaaaatctatctctgcgctctgtcatccaatcatacacctaccatgttcaagaaaagacctgatgagactaatacgactattaaatttgtaaggttggtcataaaaaaataccaaaaacaataagataacaagaagagaagacttccattctagaaaaataccaataagtaccatgattttctaccctcagaggtacaaagtatatgcacccaactaccttttcatgactatccagggattatattgaactgatgcattagtggagttattactgtccagggattgtattgaacttatgcattagtagagttactatccagggattgtattgaactgatgaattattagagttactatccagggattatattgaattgatgcattattagagtaagcacaaaactcaacaattctatatttacatatctgcaagatatgctttcatcactgaattcataattggtgatgatcagtggtaaatctactcaaaatactaccctagaagatcttaaaacacggacgaattccaactttgacccaaccttaactactagccttgtttcctaacttgcatttttcacacggcatttactagcattacttctacattaaacttcagactaagcagtgctgcaactaccaaatggcaactatctatgtactcctatagtcctatgcaacgttgtgcccatcagatagaaaattccccattttacgtctttagctaagctatgtgtatggaatgatattacaaacatcatcctgctataactcgacctaaagtacaatgaaaattcccaacattgtcggatctcttattaactaacccccccccccccccaaaaaaaaaaaaaacttagttaagaaaaaaaaagggggtaaattagtagtagatgtgcatacctggagcgcgaggttgaagcggcggaacttgcgcagctccctcgcgatgcggcagagctcccacttgtcgagacggcgctcgccctcatcccaggcccccagcgtgcgccccaccggccggccgccgtgccccaccgcgatgcgccggtacaggctgctccaccgcagcgcggctctccgctcgtagtccagcgcaccgtagctgtgcaccttcgccacctgcttccccgccgccgcggccgccgacgacgacgacgatggcgacgggttcgaggaggaggacgcgcacctcaccgtcgcggcccccgtcccagcgccgctctgcctgagaggggagggcctcgccggggccagggtggaggagccgaggatgtggagcagcatggctggcgtcgccggtggtggtggtggcggcggcagcggggagcgcgcgggtggaggtgcggcaaggaggggctctctgctcgggaggggataaaaggagggggtgggagtggagcgggtgcgttgagattcgtgcgcgcgaatccgcgggagtcggggcctacccctcgctgcctccgcatcttcccgcgcggatttgtattggtgggccgcgatccattattatatgggctgactacggcccatttggtctccatagactactagtgttagactatcggtcaattataattacagtttcctatctgaaaaagaaagctcgttccactcaaacaaaaaaaatggttacaggaagattataattacacgtcaattataattacacgtcctgattattggtttggataggatgagagtgatttctgattaggacgcaggagccaaaactgggctagggagcaactgtaacaaaatattgccaaattttgggagccaagcacaaagggaaaaaaaaaagatttacataaatgagatgctggatccggaatgaactatggagcaaacttgaacgaactcatgctaaaattttatcatcaagacgaacatatgccaaaaatggagaattatgtcatactccctcctttatgtatagagtgattttacagtcatgaggaggtaacgggggttactaaatttggtacatctctatagtactataagatactaaatttgcattaaaagatattggtacctcttaatacctcccaatgaccgtaaaattcctctttttctagataattgtcaatttgtcatactccctctcttaccaacaaactaagcaacattttgttgggatttgctaaccatcaccgaattaccgaacattttgtacttactaaatatatagtttcagcttttctttttaaagaaattattcatgcacatctaaaacaacccttgtcaaaggtagttgtcatttcgtggtccttgcgtcctaccacatcgtcttggctctatttgaaagtgcgttgaaaggcagagtagcagatgaaaaattggtggagtagcgaacatcagtgagcttagatgttagactttttgcctagctacgatgagcaaggaaaagattgctaggagagactcaaaagcaaggaaagtcttgtccaatttgcctaaagtcataccgagcaaggaaaccaaacatgaccgaggaaccacaacaagccaagcagtaacttcaaattttgggagattgttgacgagagcgtcaccgaaatcacacgcgatgttgctattttgaaccaagtttatgtacaactgtacataccattcatcaatgatatcaccaatctcaaatttcttgttcaagatgacctgccatcaagacaccatggtgctcaattgtaaaaagaagtgagcaaaccccaacactgattgcaacacaaacatgaactcctaataacttccatctttctttcctttttcattttacccataaggagattacctcttttccatacagccatgttgagttatataccttctccaaaagccatatgctacaaacaagcacaagtctactccaaaagcacagctagaagtgttagctgaacacacaatttttgccaacttggcagacgcacattgcctagtaaaccagggcgacgacgataagagcatgaacaaaccgcagaacgccccatcagtggccggtaaataaagggaaccatgatccagggaaactaaagtaaactacagctacttcctgttcctaagttgcttgttaactggaactggaactagggctgcttaaggcgcccctctcctccggcattcccagcctctgaggtggagctgtgggctactgagctcagttgagatggctggcaaagaagctcggcctctgggtgccgagcattaagaggaacatccagcaacaggtcttgatcagaatcagtgttggcatactgaggaggaaccagcatggatagtttatccgggggtaacatgaataagttaagtgctctgtcactgcaggctaaatctttgccattgcctggtttcggcataaacgacgcttggcactttagacccatagcatcaccatatttagaaactcttttaggactcctcatggttcctcttagttctgtatgcacaaaaagaaagaatagataaaaataataaagttagaaggtttctccatttcacttacattaagctaaggacgaaataggaaatgaatatataggatttgttttttttccaaatataagtaacagtatatgcaggtcagaagctgctgacctacggagctttggaagtgggtgtcatgaggccttttcagaggattcatggtggactttgtaaggcgatttgaagcactggtctttactcttgtttcttcactgtcttttccctgtacaaagggaaacaactatcaaaatgtgcaaccaaggttttgaagatcatatattcaggttagacatgttctaaaaatacatataacgataattgaactgagcaagaaaaagatacataagctggatacctccatatgtagggaaactaaaggtgagtttgcattctccagagtatcctgattttcagtatggagattagccctccaaaatagacatcccaaacaaaaacttccttagattggtccacaacaattctcaatataaactaatactcaatataaacttccgtgctaataaggatgtaaaataccttctagcattatctgatgtttgcaccagaaacttctttggctgttcagttataacattttggttgcttgttgccttgctttcactatatacaaatgagaccgaccctgagtaagattcactagtaatatatgacttattatcagcaggaatagagcttgcttctgattcttcctccagtgattttgaatttggtctgagaagcatacttccatatcccatctcaaaggaatccacaggagttgcactatggtaaattagatcctcctctgaggatcctgaaaggtaaagtagctgctcttcatgcattatggaattaagatcctttgcaagtttttccatttgtgaaggcttaggccgagtgacacaactccttctctttgatggcacaagtgattcccaagcatgtgattgtgctgaagctgaattggcaagatatcagataataaaattattaatatatcaaacaaagttgtaagagaacagctaaaaaacaattctttagttacatacggaacctcgagaatggaaactaatgcttatggttggtggagtaatatcccttttctgagggcctttattgtgcttcatcatactaacatgtagtatagaaacacatatattattaatgatgtttcatatgtactggattactggtctttactaaagcatgattttcaccatattataggcttgatgctatctgaacacaatgcatggacaaatttcttaatgatataacaatcagcataagttattatgaattgataatgctggactaaagaataaaccaacactgaagaggggttgccaaaaaaaaggttccgatagctttattgtgtccaacgaaaagaaaaaatcacatatgcattataagagggtagcactgcatgagcattacattggagacaaatgttaagcaatgtacttctgacatcaatctcaaagctcaagttcaattccttaaacattatttgtttgaactgaaccaaatcatatactatatggtacacatcaagaatggaaagaacaaaaaatgttttaacagaaacacaccagggaattggagatcactcaccagtcatttcacttgcatcagcagtgccatagggggcacaactctctgagtatgatagtgctgatccagaaccagatcgattacttaggtcaggatctcccatcttacggaagttttgatcagaaaatggtccattctccattgtgatgtggcttggatttttcttcagttgcttctgttccttcagcttcaatgttggaggtttcagcttgctagctctaggttcctcagcatcaatatcatcccgagcatgcattggtgtgtaattcgtcagcgaacccttagttctccatcttgagccacatgcattgcagagcactggcttatctggtggcccatttctccagagaggagtacctgttccatcatttcccataagtaacagtacaaaattgatttgcagtaatatgtgtggtatacaagtatagagtttattagtagagtgtccataaggaattcttatcacaaatttagaagaatcatgcttgtgaagctacaggataggatggcatcagggaagggaacttagaagaataatttgtcagtgacagtgagtgattactgattagtcacatacatactcaaattgcatctttcagacgttatttttaatatttagcacaaccatgtag

SEQ ID NO: 58697 - DNA, 31246 bp, Oryza sativa
cctcttcttcttcttttttttccccttttcttcccctccaccgacgccgcattccgccgccgcgccgccgctgccgtgccccgagccccacgacgccgctgccgtgccccggcgcctcgccgccgccgtgccccggcgcctcgccgccgccgcgccgcacctcgccgccgtgtctccaccgccgtcgccgccggtccggtaagccctccctcctcccttcgtcgctggtagccgcgccgcgccgtgagagagggagagaagagagaaaacagagaagagagagagagagaaaagagaatggaggagagaggttagagtgggccccacgtgattagtaaatagtaatcctccccttgatctttattagttaagtcccttacatgtggggtccctatgattaaaatctatgaaaattcacttatatatgttgtgtccatggcaggccggtcccacaggttagtcaatgtaaattatggaataaaaataaatgagttaggaacagtactgtttcgcaattattcaaatttgaatatttaaactagcataactctctcattttaacttggatttgagtgaaacttgaacctaaattcatataaattcataagctttccaatggtatataattcactatttgataaaatatatttataaatattaaataattaatatcaagatgatgcataatagttaacttaaaaatgtgctaataaataaaattgatattgtaccgtaaagtagatgtcaaataattgtccttaacacgcttcctcactataaaacctatgtaaactagttaggagcattgtttcaaattaattaaagcataggaaatactagtgccatttattaatatatgtcaatatataattatactcatgacgtccaaattgtatagcctcatactttgtgagtaaaagttgaacacatgtagatgagtctttaaattgtttatgagaaataatagcagagcttgtatgattaaatcaccaatatgaaattaattaacgacattccctatacagtagtatatgtttaggttggaaatcgacccttaagttgttagacagtaactcactcataaatccacttaaaatcacatgtactatatagcttaaagtaaatagcagctatttaaataaattattcaatattaagatattgtgcactcacatatactgtacagtccattatagctatacgttgtagtattaaatcgcttgattgcatatattaaaattaaagaggatatatgacaaacatgtatggtggataaatactaattataaaccttgacctaatataacacaagttcaattgtagattaggattattcattgtaaaattatgtgatgggataatctgtaactataatatgattaacctaaacaactttaacatacaaagcatggataattattaaccttttataatttattgtgacaagtaaaatatgttcataattaaagtaaagcctccatcaactaaataataatacaaatgattcattatttgattgatcctaaatccatctaacaacagaacctctaatatataaccgtcctatttagatatatgcatatatagccataatccttcgatagctatttgatagactaaaccaccgattagccaaatatatatatgtatccaataaatgctatgttggttaactcctaaatagaccatgatgacaatagaaagattaagaaactttagcccttagcatgattggaatccattagcaaacacgaatataacattttgttgtgcacatttgattgttgtttgaatattggtttttctcgcttattatagaaattgtgtatcagttagtcgtgaggcaacgtctgcagcctccaggaagtgaaggttgatcaagaattatatcaagaataaggactatcctgagcagacaagtcattactattccttgaacatgttgataccaattgcaaaattattttgtttacaaataaaaattgcatgcaatgataaacatcctacttgcgattatgccatgccttgattattgtttacccccttattccttcgtaaccatgtttacgtatgagtccctagtcaattatgacaattgcttagaaatgctattttagaatcatgcatactcatatttatcaaatgttatatgcttgggcaattacctttgggaaggtaattgagatgcggcatgtggagacatgagcgccacattgccctgatgttgatgacatgatttgtggaaggagaaataaaattaaacaactgttttcggctggggcggacggaggatttgggtggtatctggaaaatgctagcaccgtccccggtcaattaaggaccgagccatgaagttaagcttgaaacgacccccgtacaaccgcacttctcgtatgggtatagacctagcagaatagatagctgagcggaggcagtatccatgcatagtggtttcttgatgtgtgaggcaggggctctacggtggggcagccattggtagaaccgcgaggcgggtgtctacagtggtgtcaccatcagtaggactgccatgtgagaatttaaacataattataacttaatgcatgtgtgagtctttccttcccgggtgcgccagaactcctctcactgctagaaaccgtgtacgcctagagtgcatgaggatgtaaagttcatggagcgggtactgccaatgcgaggttgtcgaaaagttttgccgtgacacatctcatgtgttgggacgaggctcatgtgttgggaagtcgcggagtgcgggtaaagtgtacatccactgcagtgtgagtaaaccaaatctattcgagtagccgtgctcgcggttattgagcaccgggacgtgtattacacttggctagactctaaattcttaacttgtgtaggatgggttattgcatgatgattttatgctgatggagccacttcctaagaggagggaaggtggacgttctcagaaaaccatgacgactcaatggcgggaagctatcattgggatcacaatggatgctggatagaaccgtcgttgtttaatgtgaacactggtaataaaacttgatcagtctatgctaggtattaagcttgtgaaaagaattgtaaaactagctttatgcaaaagaacctgaggccattccttgaaataccctctatcatatgcattgttgttgtggtggcttgctgagtactgttggtactcacccttgctatttatatatcttttaggagagtgttgaagagaagcccttgtcggtacgcttgcgtaaccaacaagatgatcggagtgcggtcttgttctaggtcttgttccccagtcgactgcctgtggcatgttaaccgggcccttatattatttttttgtcttccgctgttgttctctgatagttgttggcctacctggccctaatgtaagtatttaactcttttagcttgaattcattcgtgatatgttgtgatccaactatgtatgtgtgtaccaactactgatccagggattggtacggataaacacagaagatttccgatttccaaaaatcgggggtctacattagagctcttgctacatttcctccaaaatccacatgcaatgtgccattccataggaatttcataggatttagaaagtttcgatcctttaaatcaaagggccaaacatgaaaatttcctataggagttatatcctatgaaattcctatataaatcctttgattcaaagggggcccttagcctttcaaggttttagtcttgtaatttttattgctctattcaaagaaacaatatgcatgcatatttgtcttgtgctattcgttttaaaaaaattccatgttccacgatggatgaagtttctacgagtagatgcttggcatttgacatctcttaaccacaatatggcagtgttggagatgaagactatggttggtttgttgaggctttacaccacacttttgtgaatgaagttttatagcttgataggagtaagcgcgagcaacatgattttttttttctaaatgtaattctctaagtgctaagcctcgggtactgttcttttcggcttatcgattagtatgcattatcttggacacgcttcataagttgttaaacaatacgatttatttgcaagcattcttcttattatttatttgaaaatgttttaaaaccaacttcttaattttctaatactggccttaaataattatcataaactcagtttcaaccacaatccattatatatatcaaatggaacaccaaggaccacattttagtgagaaaatagaatattttccactttaaaacttgtcgccttcaaatactagcactttttttttgttacgaggggtcctaaaatgacgagttgcgacatgaaagcatgaaaatgtacatctcttttttatatatatccatgcgacgctgaattgctgaaacaaggagattcgaattgcagagctcctggattttgtctcttgtgccaatcaacttctgaagaacaaggctgtcagaatagggatagtaggtaggagtaggatcgtttttatcataactgtatcgaattgtagaatcggattttaggatcatgatcatatcaggttaaagtacatattttcacatataatttgttagacattatattaaaaaccgaagcccataacattgatttttgataaatttaattttttgaaaacttgaatagacttattaacattattttcaattaaatgaaacttaaataatatatacatatcgtaaaaccaggatcctatataagattctaacgatcccgtaaaatcgtgtggaactcgcactaatttaaaatagtatgaaaagtaggatacatggtaagatcattatcttaacagcttgccgaagaaaagagagggacgataatctctttatctagcagtgactttcggactggctatattatttggtcgtccaaacgttgttagtatacatgacaacgctggattgctggaagcaattaatcgccttgttgcagaggattcaccaagcagccgttcaacctgctttccatctcaaccgtccaaaaccaagtctttatttggtaatcagggaaatggaaaggaaaaggagcaccgaaagtcaatggaagctctagcctgcagtgtactgagcgttgcggttgaattgaattgagcttagcttgcaaacctctataattgtctgctccgtcatgcctactacgtggtggtcacatggaggctcagataataatatcaacttcaaaaatgagtaagcagcagcattatatatgtatacagtatacccagatgttcatgttcctacctactagtagtactgatcaatcagccaaacaacaactaccagatacatgtagcagctcattctccagttctatacagttgataattcataagtggaaaggtttgagctattggagaacaacatcatgtgtgatgattcctatgctcgtttcagcttccatccatccatcaaaactcaacgatggctgtgtttagttcagcgcaaagtttagattttggttgaaattagagatgatgtgactgaaaagttacatgtgtatgacatattgatgtgatggaaaatgactgaagtttggatccaaactttggatctaaacacagccatgaagtacagtatatggctggctggctgctgtatggcctccagcccttcctttccatttattcctcgtttgcaattcattccgtctggccgtttgggtgctaaacccagcagtagcatggcaaattctggccaagggacagagcaacagaaactaacagggaattggttattgcaggacgcatccctctccctctattcccaaatgagttcctcctgtccatgtgggcgcgatggaatgataggtgctacgcgaaagcgaggcacttgcttacgagggccgtaatgattagcgggttagcatgcactcgaacggcgaaacacgcagttcctcactcgctcgcggccaggtatttttggagcggcgtgctagccgtagcctcccgtttctttctttccaatttttttttgctgggtttgcatgatggatcatggcggaaagatgggtacggattgcttcctctcgctctctctttttttgcctgtggtgtcttgctgcctgtactatctgctgtgcctgttacttttgaccactttaatttacgcacgcactgtcaccacacagtggccaggagtatctagggaggtatatagggagggccgggggagactggctttacagtgtgagcaatctttcccttggaatacaatcattttgatcaaaatctgacgaagaacttgctaattctatcctggcatgtgtgtttctcaactttctctccgtcaggtgtctggctgattactgatatgggcgaattcgagaggacagttatccagcttgaggatgtttcagaatttcagaatatcaagtggcagtttaccaacgttgctacttcccccctttcacaatgtaagtcattttagtattttccacattcatattgatgtgtctagattcattcgcatcaatatgaacgtggaaaatgctaaaatgacttacattgtgaaacggaaggagtatctgtaagtgggtctagattcattcgcatcaatataaatgtgaaaaatgataaaatgacttacattgtgaaacggagggagtatctgtaagtgggtcgggtcggagaggtgacaggagtgacaccgacggcgaaggcggctatctccctcgtcgactcgtcgtccctccacctcgcgcgctctcgctgcctcggccacttgacgaagagaaggggtcaatcgcagatcacaccgtgcagtatataactgatttccgtttacccactggaggagataagcgatcgattggatcggtaggtcaccagcaaatcagcgatgaagtcactccatgaggcgaggcgtatgtgctgcatgacacatcggcacggagtggttgctgtgggtgatgcaactctttttaggttttactcgtgtcatcaatttcattttccgttcggggaggtatgcatgcgtgttccggagaagacgcatgatatgcataaagacgtcgctgttcactgttttgtagtagtttgtaccgtcttctgcttcgtctgtactctgtatatattggagctcaaaatattcccgggctctgaatacaccaagctgcggcctgcgagcactgcagactcatgctacattgtattaggatttgaaaatacaagataaagaagtaatcaaactgggtgtttggtctagtggtatgattctcgcttcgggtgcgagaggtcgcgagttcgattctcgcaacaccccctcgatcagtgatcatggtgttttttgctgttgtcgcattgctttcattaattcggtcagtttgtgaggcccaaagcacacaaccatttcgataaggctctgccgactggccactgtcccaagtggaccatccgacactgattaaacctgcaagaagtggtgggtgctaaactgataatctaatgcactgctaactctgcaacatgtcgatactagtacttcgttttgcacctttggcgttttcactttcacttttacaccgattccgtctgctcttcttgaacggggtggtccagtcaatggtaattggtaaatctaagcattcaggaaaggattaccgcccttagttagaagttggaacaccttctcgccagcagtttcgtctgcttgcttacaggaaacgggccggattctggtggaggcatgcgtgaagccatacagaatcggtctgttcagggcatcgttgatctgccttgacaaagctttgatttccacgccatcttgttcccatcagcatctggaacacggaacagccacagcccacaagttacgagcatgaaaggttaggttagtctgtttaattttcttccagaatccgatggtttggtagcttcaggttgaccgtttcacctccagtagcattctcttttggattggccattgtgtatacacagggataaaaaagaaggttacgaactgcctcagtaaatactttactccctttggaaaccagggttcaactatgtaaggccctctagtgccaattcagtctaccgaaatgtcttacaaactataccattcaaaacttgtaaataacacgaagtgtagtctatacacatgaatcagaaagcatcacgtggaagctataagtgggggcaaagaagacgaatatactgtttcaacatttgaaatcaaaactacacacatttatcctcgaactcctagaaaatatgtggaaccttgctagctagaactcgctctcgtctttcgatataaccatgtgggaaccatcctgcttttcccttgcattcgccttctgcccaaccattggttgatatctgtgttcggacaagaccacattagattactgacagctcaattatgatatgttagctgccaggaacttgtatttagaaacatcggaacaatatcggcaactcaattgaagattacaaaacatggacagcagaggtatattaccttccggacaataacaatgtctccagctgacaagttaagctcagactcactttcagccttgaaggaatcaagggcctgcatcataacgaccaaacaatttatgtaagaagcataacatcggtaaattcatgttcatttggcagatggtgcaatagattttgcatgaaaagaatgccagacctctcctaggaagaaatctacagatgtcactgaatcatcgacagaggaggatgcaaacatgccattgacttcgtcataagatggtggtggctgtgccatgtaattttctgctgatggggtcggaggtgcttcaatcttttgacgctctgataccatctaaaccaatcaaaaaataatcattaacttgatgaagataggacttctgcacacttgacagtgtgtgggctgtgtcaacaggccatgttttaaaaaaaatgtaaatagtgctggagtatacatacttcttgttccaggtggtcaaggatctccagaactctctgatggtaggctctttcggcttcaaccttcagagcaagactgattagcagctatatataattttcagataaatgcaatagcatgatgcaccagaaaatgtaacgttaacgggtatagctcatggttaccatcgcaataaggcgctgtaatgtcaatctttgttgctgagcctcaacggcagccattgctgcaacagcttccttccctaatcctaccatgcttgacttaagttcttcaagtttgtattcagcagcttccagctttgttatcacatctccattcggagctgactctcttactctgttttgccgtcttgaaacttcaacagcctaggaaagcgaacagaaaaaaataagctaaacagttcagtttaaaccaaaaggtcaatgcacagaaaaggaacacaaattacttatgttttggaatgactcaactaatcacatgatctgagaagatagtaggatcttagataacaaagtctgcgtgcaactgaaggcaacttggcaatgtcactggtattattgctttgcaacttgcaagtgaccatattttagagtttcaagttatggagattctatagataaataaggtcgacaagatctggccgtacacataatatagtgtgatgctttccaaaatattgtgatgttgagaaattttgggatagtcctggttctcagagaattcatagcatttttcctttcccaataacagtttctccactatgcatctgtaagccttgcggtacaaggaattaggaatgtgtggaagtagaatcataaaatacacaaactatttttttaattgtatagcttaggttgctcgtcaatggatattgtttcaaatatgctgtaagtacatctgagagcaatatcctgggatgttatataaccttgaagagacttaagtaaaagttatacactacttcacctgggcttcagcttcttgcctcattcggtcatatctttgggctagatgtctcgcatcttctaaaggcgcacccatgaccattgctcgcagtggctctgccacctacaatccaacaatctcttactgaagttatgcgttctattcacatttatcaataccataagaatggacctcattgttctgcacatagtaacaactagttgcacaggtaaactactagtatgctaatcatacatgtcataaggtaaaaaatgtcgatcaacatgaagtcatgaacagacctgtgtaccaaatgctctcaacatgttcccacgttccttttccatcagagaacgagccttcccatagtacatagcagccttggataaagtgttatcacttgtacatgtgtttccagtgccatatttctggctatcgtcggacaatttatttcctataaatttaggttgcaactaatcaacatacagtaatgtaaacactgagtaattaatattgtgtcaagctaaaattattctgataagctaatatatagttggagaaacatacctatgtcaacttgtttagatccagtgactatgtatccctccacaccccggacaatgtccctttgaaaatgctggccaaaagatgccaatgtttatcaaaataatctaggtagaaaggaaagagatactgtttctctaataaatttgtcttgctcatactttagcagcacgagttgataagtaaagtttttccagcctctggtgtagattaacttctgattcatctgtaaacgcattttctgaatttccataggcagctccaaatggcttaaacacgccctgcaatggtgtagacaggtacaatgttacatggttcataccaagattaaaaagagctgacttttcgatgcagttaaataccaagaaaatatcccacaacatataaagataatgcagtatatattccatgtgaaggcagatatgtagctggcatttaacagccctagagtttccagttactttgcaaatcgcagacattagtaataacaactcctaacattggaacatccgttttcaaagactatatattccaggcaaaactcatagcaaggaaatagtagtataggcctacagtacgaaaccagaacacctgaatagataccagatattgttccctactttgttgtgtagactgctaatcttagctgtcttcctaaggcagtgtaactcctttcggccaaccctcctatgtttgtgcaagatggatgaaaataatcaaggcggtattactcaaaacagcaaattcgggtaggtcatgtttacatggttctatatttcgaacaggaatcacgagcaacgcttttaaatagaaaagccacaggttgctaatagcttaaccagattgatcaaccctgtcgtaaaatcataacctgatgtttctcatctcagggattgcaaacacgcgcatcgcggtcccaaccctcacaattgtttttttcgagagcaaaagcttggacctccccctcacaattcatttcaccactcgccagcatgaatgaaaatcaacctgagacgcctaaccatagacgagtacggtagcctctcaaaacccatcagcatagacatcaaatcaaacttatatagagaccggatcgaacaagacagacacctgagagggatcgacatcgacccaccccggttgcgcaatcacaaactcggatcgatcgagaaccgtactaacacaggagttcaaagagatcgagggggatgggagagcgtcacctggcgggagacctgctccttgagcctggaggcctgcttccacagcgcctccatggcgccccgtctccgcctctccggacgcaaaaagccgcggcgcgctgaccgggagaggggaggacggccgggcctgccgcgtcggtagcctctccccgttttccccttttttccccctcctttttcttcgtttggttctcaggctggacgacgacgacgaggggttggggaaggacggctcgctagtcgctcctccgatgttagtttctttctcgtggtggttggcttggctcgcgcacggccgacggtggcgcacgcacgaaccgcgtcctcttccgcctccctggcctataaacggcgctgtcgtcgcgggcccaccagtcggtggaggtggcgggacgagccctacgctgacgcggctgggcgtcatggctgcgttgaggacgacgtcccccggtgtggcactgtggcccgttccaaagaggaaaagaagtactcgtgtggcccattgaccgatactctatgtggcgaaagataccattgaccaataatgggccagatatttgcgaactggacctcaccacagctagaaggaaaggaaaagcgagaaaggaagggttaggtataaaacgggcctaccacctccacggagcacactttcgaaaggaaaaagtacacataaggtcccttatcttgttgctgagttataaaatcgccctaaaccggaaaatcagacatatgacatctctcaacttataaaaccggatcactttatatccttaggcagtattgactctggttgactgcaattttatccgatgtggcagctgagtcaatgtgggacccacatgttagtgaaacacaactttttcttcccctttcccctctcttccctcatctctttccaatgcgtgagtggtgccggtggttgcggcggagagagctcacgctgcgggagaggaaagggttgcggcggcaggtgcatgccgtcgtcgacgcggcatgttcgtgggaggcgacgcacggtaagcctgtggagcaagagcctaggtatagtagcaggaggagcccaaggggaagcggaggagggaaaggggaggatagaggaagttcgtcatcatcatcgccgacaaggtgggggtgatggtggtgcatgtggtggaaaaggtcacgggcggaggaagccttgaccggcgacgtggtgtgcccgctaccgacaccctgctccacaccacttactcctgtggcgcgagctctctctgtcgcgaccaccgatacaggagtgtcgtggtgtactgcttggcgaggaacatgtaggaggaggcggtaggcgacgaagagagagaagcggggaggctggtggtgagcgatggagagggaggaggcggggccggtgaactcgcctgctctgcccggcgccgaatggcgaggagaagagaaaacaagaagaaagaaaggagaggagaaaatgggaatgaggatgacatgtgggtctcacaagtgtcccatcatttatttattagttttctagtgtaaatgatatgtgggtcccatggttttcattctttttctcgtattgaattgttacgtaagcgccatgtcaatgtcacataggatgaaaactagtcaaaggagccacgtagacgctacgtcagccaaaaccggaggataataccgctgagggacgtagtttatattagttttgtaagtttggggatgtgttgtacctgaatttgctgtttaaggatgattttgcaattcagtgataagatgaggggctttttgctttccgaaagtctttgtttcctggcccaggcctctctctgagcaatcaatccggataggcacgaaaatctttgtcatctcgcgcgctttgccagcaggcagtagaacacttgcattggctaaaacagatcaggattctattgaaagacagagggtatgtctagattgtagtcaaaataaaccttaccaaattttaaaaatattaaaattttggtaagatggcaatattactaaaatttattgtcaaaattttggcagaatttcttatatatttatcaaatttagtaacaaactaaacatagttttttttgacaactttataaaaagaatgatatggttgaaaatggcatcaatctgaacagcccaaaatcaagaggaaagttctgatcgtttcaacgaggaagagcccaaaatcaagaggaaagttctgatcgtttcaacgaggaagaggacaaaagcaggcttttcccccaataatctgggagtaaaagcaggcttttctcccaagatgcagatcagatcgcaccaataattagcgcgcgaatattcctatcgtcccgcgccgtgaaagcgtcgccgcagcctcctgcaagctgtggcgccagccagccaggcatcagcagcgccgcctcgggtcggactcggacgtgagatcgcctcggcaccgttgcagctggccagccagctaccaccgacggcctaccagatcgatcccctccgaaatcgcggtcgcgtcgccgtcatcccgctcacgtacgccgccgccgtatcgctgtcgccggcaataaagcgcggggccggcgcttgcccatgccctctccgaaagggcccggtgatacagcgatgcctgcatccgcatggcacgcgcggcaactacccactccctccggctaccacatacgatccgtgccaatctctcgtcgcactacagtcagcggcggcgttcgttaattacttcgttttcctggagcgaaaacgttttccgtggcgcaggttgcagcccttgtggctgtcgctcggggtattcggaaattggagcccttttcatgcatcgcttctgaaaaaccgataaataaaacgatgccgggggatgtggccatcgtgtgcgtataatggactggtggcgacgtgcaagtaaaacgacggcttgactttctgactttatccaatggcgtgtgattattgttaatcaccctcctgagtcctgaccaagaggtaatcgtggtactacatgcagtactagcgctactgttgccaagaagttttcagtgcagaggcaaatacggatcgattggattattctttagccgggtggacgaaccgagtgatttgtcaaggcgctcaaggtgcctttttaacccaataaaaaaatctgtactttctgatcttcaattaagatatggatcggagtaagttggatcaacagcaatgtgaacggatcgtgccgtatctccatgcttgcggcccggcactgctggacggctggtaagatgcacgcagattatctacttatctgatgatgccaggaggatgcgatctccacgcccatgacgccagccgagaaaagtgcatacggccaaggccgcccttttcgcgctggtctcgaatgaacaactcggatgatgagaaacccctgcgcgttttcttattgtttccgctgtgcaggttgccggggctgatctgacctctccgcaaatattaatccgtgtctccatcgaatggggaattatagaacttgaagtgtgatgcgcagcgacagtgacatgtacccagctatacctgcaatcgacctgtggcgggtgtacacgccatttcgtttttcactttcttcatgcacactgtggcaaatctcacgttgttgctacatcgattaccaattagttaaagaagaaaactagtgaaatttagacagacttttgcaaaatttgatcgaactgtttttctatttgtaccggcttgataagtttgatataataaccatgataatcaaactactacgttaaatttgtcaaccctgttcttccttcctagcgaccttcttcttgttgaatggtcgcatatgtagatttagccccccaaatctagcggatctatgccagagaggagggtacatatcctaataaaatttcggtaattgaggtcacccgtgacatcaaatggaaaggaatttcgggggatcagttgggggttagattattaggatgcaagcaaagcaataataggggaccatagcattgttcaagaatcgtacgccttttgaatttggatttgttattatcagcaaaaacggccttacttttcaatttcccaactgttgcagctgccattggagcacttggcacttgcagtgttccgatgtgcagcgcaaagtattctaaactgcacgatctaggaatgcgctgtcgccatgttcttgcgtagctgagtatttattcataggaatggcagggtgcgtactgtttttcttaaataaataaataacagtaaaggtacagaagaattggacaattttgtagagcacatgtacagcaaggggaaaaatattttgatctcgcagaaatatcctctcgtttgtttaaaaacgttcatccaaacggttatgaaaatttttgacaacactcacacaacatatctatacaactccacaaaatcttaggttcaaactcatctcatactccgacatatatatatatatatataaaaagataaattcagcgtatgaataataggctgaatttaaacttaatttttagtggaccgatggatatctctatactctacattgtcaattttcttttagaatttttcacaactatttacatcaagtttgaaagaaaaaggtatacgaggggacatccccttgagggattagaatccactccccttgcaaggttgctaagcctgcgaccatacatatgtatcatgtatccattttaattgtacttaattcggttagagattgagaattttagaatatgcaaatgtttttatcagcagaattccatagataaaaatatggcatttatgttcatgcatataactttaaggtatgggaagtcctggccttagcttgaaaagccaattgttataaagtttacatcacaaatacctgcatgaatgaatcctaaaggtaagacaccaacaaactttccgttggaggtaggccatgaggaccttcggccaacttgctaaaacaacaacagtaacaagtgaaggagcttggggaaggggcatacgacgaagcctaggccatggagcaaggccacaccacgaagcgaagcaccgggtggcgaaacccctagtggcaaagcgggttcattaggtggtgaagcaagttcggctaggatatgctaatactaggagaagcctaataaacaacctaggaggaccctgataaggtccatgggccggctggttgggccaaaagataaatgttacccttataaacatccccgccagagggacaaccatgtaaattcactagcatacaaaaaccctaggttgtaaacgcattaatagatcccaatggttttttaatagaggatccgatttttcaattaatatatttttactgttttccttttcctaccgctccgagtgaagcctacctttcaacaaaaatgtttgtcattcaacaacagttttgatgaaatgacattgttcgggaattaatcctatcactaaatctctgccttgatggtggcgttgccggtgctctccagtggcgatggccctagtggtgacaccaagagcggttgctgtttgtgatagtgctttctagtgttctattgtggacgggcaattgctctaggcgcggtggttgttagatcgttggtttccttgtccagatctagttacgtggattggaggtgattgcagcaaggaggggctttggcaggacagcgatgagctcagtggtgatgctagcggcaaccagggagggaggaaggcgaggagcagacgaagggctcgctggaggtgccagaaatggttagggagcaatgttttatctagggccaaagtaccattggattggagatgtttgtgcccggatctattcgtgcaacgtgaagtggcattggatggaactcttcttctttgtcccccttagatggtgtgagcgagcaaatgcactagcgttctagagctgttgagtccaatgaatgaatccggtagttagtaggggcaaggcgacagaggaatcgagatcaaagcatcgattatgagaggttgtaggagatcgagatgtttctcaagatcatctcaatgcgattttgtgaagtggtactcctcgctcttttgcaactgggcccataccgaacttagtgtgctaccttgtatagtacgtgcatataagatttaattggagtgttgttaaaaaaatgtcattctattaagccataggacacaacatgtgcaaatgtcccctattaaataatgtctcttgaatttagatccactccaacaaacaaactcacaaacatatgattaatactattcggttcggtggtacaaaatcagcaacatgggccttgttcatgcatatatgatgcgataaaagaaaagttcagcgttgatcggctcgtatttcttcttcttcccttcgctataggacacgttattttcatataaattatgaatgaagtctgaaggttgaaggatagaacttacatattactaacaagtggttaggtcccgttcttttttccaaccagagttggatgaagattaagattttcgtggcacgcttttcaaactactaacggtacgtttcgtgcgaaacatttctatatgaaagttgctctaaaatatcgtattaatctatttttcaagtttgtaataattaaaactcaatcaatcatacgttaataccacctcgttttgcgtaaaaaaaacttaatcttcatcttcatctttatctttaggagaaaagaacaacatctaaaccatgtcgatgtggaaagtttgtgaagaaatcatatttttgaaagtgttaactgaagaatgcaaattgcagaagagggatcaagttggagccttggaagacgatgtccttgttggtgatcatgaccttggagcgcccatgcggccatgtctgacctctgatcaccatcaacagcccatttcatgcccatcatggcatgatccacgaccacaatcctggaacgtctaatcaaattgatcattaagccgcacaaggcttgaactttcttcagtccattcaaccgaaaggtgagataatgcgacgtgggaatggtaatgcgtgacttcttctctacagaagttcagaggaaactggcgatcacagcaactcagctttacaaattcatcatcctctctcagttgcacttgttgcacaagacagagttatcaattaatattgtgtgcactaactcctgggatgtaatttatttcttaagatattgtgtacactaactataataaaacattttgcattacctggctatgtggcatgatccttgcaaattattgacaaaagcatgcgttgagaaaaaaaaaatctcagcacgagctcgtcgtgacgtgagtacggcaccaggtgtgaaaggtaacatttttactgtcagctgtcaatactactgtaaacacactgttactgcacgtggaaacgagcttaattggacagatttagctcgggtgaagatgatcagaccttgatagaatcagcgcatgtggtcccgaaaacgagtgcgcttttccttttcaacatttttttctcgatatgaaagcatgatggagcctgattttttcttatttattggatatataattgatctcgacagaacgacctttttgcccgcttctcctgcaatatttattcgccatattgtgccgaagaaacgatttactagacagtaacttgtcctacaaaatgtgctagttgttcttttcttagtacagagaaaaagtattgcttagagcaccagatgcacatacaacatggagttgattagtcctggcaataattaaggttacttctctcacaagccctgatcactaccatgtagtatagtcatctcccaatcagcacgaacacgattcataagactttcacaaatcagggttaggttgatttgcaggggacaccgccttttcagctttattttcctttcacctcggcctaaaaccggccgtgccactgccgccgcccaatatataaacacatctactctctcgtgcactacaactaccactcgtccactcctaataacctaccactctacttctccttgcaacatcgtcgttagtcctctaacccaaggcattgacctgagcttgttgtgcgcttctgccttatctgcatcccctcccggccgagacgcgaccatctttctttcccgcttcgttagctgtctctgccgatcgatcggactggacggggagacatgaaggtgcagtgcgacgtgtgcgcggccgaggccgcctcggtcttctgctgcgccgacgaggccgcgctgtgcgacgcgtgcgaccgccgcgtccacagcgcgaacaagctcgccgggaagcaccgccgattctccctcctccaaccgttggcgtcgtcgtcgtccgcccagaagccaccgctctgcgacatctgtcaggtatgcacgcggcgagaggctgctgctctttttcctcgggttgcttctgttgcttgctgcaactctgaagcgtgtggactctcgtcacttcaggagaagagggggttcttgttctgcaaggaggacagggcgatcctgtgccgggagtgcgacgtcacggtgcacaccacgagcgagctgacgaggcggcacggccggttcctcctcaccggcgtgcgcctctcgtcggcgccgatggactcccccgcgccgtcggaggaagaggaggaggaagcaggggaggactacagctgcagccccagcagcgtcgccggcaccgccgcggggagcgcgagcgacgggagcagcatctccgagtacctcaccaagacgctgcccggttggcacgtcgaggacttcctcgtcgacgaggccaccgccgcctcctcctcctcagacgggctatttcaggtcagttcatccactgttaacgatccaaactttccatggcaacgaaaacctgaatacgtattcagtccggttcatgcatgaaaccctgaaaaaccaatccacacacgttcttgtgagcaccatgaacgaagcacaggcaaagcacggcgcgccaaactctgttcaggccctgccggccgtcgtgggcacataagccaatctgttcacaatatcgtgagcggacaaattttaccatgcaggtagtttgtagtcatgctcacacagctagcaataacaaaaaatatatgtaattgctggaccagggtgtcaggataatatcctgtggagaccacaaaaataaaatactaagcgataaatccatgagggtggattttaaactttgaaggggacgttcactcattgtttgtatgtcgctcaaatagttataaaaaaatttgagaagatgtactaatatgtgatatatcacttcataaacatacaagttaaaattcaatttatatatattgtaacgaaaaaaataaatttaattgtatttatacgttaactagctagctgtagtttaatatattttttcgttatgagatatataaattgaatttgaattcacatgtttatgaagtgatatgccacaagcaacaaaaagatattttcttaagagtttagaataatttcccgtaaacctgcatatcatattcatcctcccctcacgagcagattgttccctgctttccctatttgaaaatttcccgtactctgtctgcatgttcaaaacagtaaggtcgctagaagcttgtgcttggactcatgtggcaattggcatttcgctgctttccttcgtgcagggtgggctgctggctcagatcggtggggtgccggacggttacgcggcgtgggccggccgggagcagctgcacagtggcgtcgctgtcgccgccgacgagcgggccagccgcgagcggtgggtgccgcagatgaacgcggagtggggcgccggcagcaagcgacccagggcgtcgcctccctgcttgtactggtgaaaaaaaaacgtgcgcttatcagccacagccagtacgaaatgtacgatgcttgtgtaccagtgtactgaggtagtagcgttagaagattaggaatttagtagtggatgttgattttgagcttaacgcgtgtcttggatgaatccctgactcctgaatgtttggggaattaatgtgagtggtagtgtcctctttgggcggcaaagaattatacgccccttgcgaacatgtcgaactgtacggtctgccatttaatctgcacgttcacccctctgcatcttctgtactgcaaatcagattttgtgactcttccattaggttatgaagttttcaggatgttgcagcgcaagctgaacgtgcggcgatcaccgttactgagcaagcattcgtatctgtttaagcgacccgtcaacagaagtgcttcactaaggagcttttcatattgtagccaaaataaatctaaccaaattttagtaagttgacaatattactaaaattttgatcggatttcttatgaatttacaaagtttttttaaaaaatatatgcacatttttaacaactttaaaaaattagtatggtttgaaatgatcaatctaaacatcccctaaattttgagtagatggtaataatcacttccagttagcagcaagctcaagactgaaagcttaagcactcggcatcacgagcggatcgactttgggctacgctaatcacaccctgttggaaaaagtgcatgtgaggtccctcatcttgtcattgaatttcaaaatgatccctcaaccaaaaaaactatcatccctcgactgacaaaacatggtcactctgggtctttaggcggcattgactttggttctgtcctagtcagcgtaggacccacgcggaccccacatatcagtgacacctcaccttcttcttccccttaccacctctcccccatcatcacggcgcgagcagcggccggcgcgtgcgactgtcgccgtctcgtcccatcccactgtcgcgtcactctttcctcctcttcggctccctcctcttccccctccggtccacctctttctctctctttctcttcccctccatcgtcgggcaccattgccgcccccctgtgtcgtcatcgttggcggtagggatgagctacttcggtagctactccacctacctcgaaaccatcttctccgtcgtgctcccgccgctcgactcgattgcctgactaatttctgccattgttttcatgcagtcagagctcgtcatcccatcggcgctaacaacgttgttctacgtctccaacatcgtctaatttgccaaggtcatcatcttgagacgctgttgtagtcaatgggcatcgacgggaagcggacgtactacatcctcaccgtagtacaaaaaacggaccggcccagcggttgaaccgagaaaaacggaaccatcactctcaccaggtcagtttgttttaaggaccgcacatgcaatggaaccggtgcaaaccggatgaaccggatggtttttgaggaaaaacggcggccctggctattttgaaccgccggttcgtgaagcagatggctagattctaaggcccacttggattgttgcggcccaattatcttttatttgcctaaaatgaggaaaaagtgcatcacatagggatcaatccctggttgatggaatagaagcgcatcaaccacaccaccaagctaagttggtaaccttgtttacgtcggattatgtatgataaatatactttccggttcaacaatcgaatcggtcgacccagcggtccaaccagtgacctagtgaaccaggagctcaagcggttcggtgcccggttcggttttgtctacgatttgttagtgagtgcagctaactgctaattttcagtggatggatgtgagccatgttgatggatttatggagttttttttacatatagagatcgattagtggtgttgcatttttttttgccttaaacgttacttactgtctttcttcgagtttgcctgctttttgccaccatatctcctccatctttcaaccaggagactcaagactagaggcaaaagaaccgcagtatcgacctcttccactctccacagtctgcacctaccttcgccgactcaatcaccatcgccggaggaaaaattcccggaaccctaatccagttgccactcacttggctcctaaattcatcgcacacatcgccaatcctaccaaattgaaggtaaaaatgaattatccatgcaaggtacttcatttcccctctccggccccaatgattctgctatcagaatgccaccggtgctccctcctgctgccacctctgttcgggtgccaccggaccacacggtgcgttgttgcctcacaatttcccgtgcccatccaccgccacctcgagctccgccatagtcccctcgaactcctaggctgccgtgcccctgcttgaactcgccgaagcgccgccgcctgcttctaccccatgcacgaacggaggaaagagggagatgagggatcagggttggccgctgacatgtagggcacacgtgggtccaatgctgactcagcctccacgtcggacaaaactatggtcaataccgcctaaggactcagagtgacctagttttataagttgaaggatgtcatatatctgttttttgggttgagggacgattttataattcgacgacaagatgagggacattgatgtactttttcccactctgtttgatccatttgaggggaagaggggccaaggttgcaaaatgaacggaacccaattgcccaaagactgctcgttatcccatagaacgctctgttatgggctcagtggtgatgggccgttcgctgaaatatggtgggctcaaagatgatgtctccatttatttctcttttgcgtgtacaacaacatacaacaacatggtaaagaactgatttttattttttttgcgaggagtgaagaacatggtggatatgcaagcagcaaacgaggtaactctttttttactgtgcatcctacagatctttttaacatcacggagctcactccgtggtccaagaaagagcatcaattacatttcccccattgttcatcgttcatctcattgaaacgaagtcataaacagtcccgcctacagaaatgtttccttttggacactgtcccgcctacagaaatgtctcggccaagtttcctcatcaccccagtggaccccacgcgtcagcgtgctccagtccactcgattcaaaacttccctccatatctggcaaccatgcgcgtcatccggtgttggcgatgttgcagaggggaggaacccttcgtgaccaatccgggatggctttccaaatcgtgatcgcactggcacagtgccaccagaaaacgagcaactcattgccaatggatgaatggagtagtatgttaatacgagtagtagtacccgctatctttggcgtttaattcgaggctaatgctgccgttcgtgtcacatcagcgaccggattcatctgctgatcctgtcgtcttcctcgtaccctctctgctgctccttcctcttccctttgtcgcctacgcgaacctggtgcgaggtgccccgttgagaaaaaaattgggttcgaatttttctctggttcgcttgtgattttgtgggggctaaagaatcaatccttcggggctcggagcgatggacgtggaccagctgatcctgttcgtctttgtgtgctgtttgtcctcgaggtttgctggtgagctctgtgatattcaagtcatgtttgtttcccgtgctgtttcttggacatcgccgtcgtgtttgccctccgagtgttgttcttaggtttgattgattgaactacggtcggtgatttgttttctctatgttttgacagatgcgtatgatccggtagatccgaatgggaacatcataatcaactgggattttcagagcatcgagaacgtctacacggtgcgcatgcctgctagtgagtttagtactgccgttaatttttcactgtttgggatcatcccagtagtagatatgcagtcgaataaaagattcagaatttcagacgtaccatcgttgcaactatcctttttatctcgattctaacttttccccattatttcctccggtgaaacttatcattagtacagccgaaatacgatattctgacaaaaaaaatttgacgttcgcaaccgccaacaccacgaatcaatcgatatatcctgtgcttatgcaggtcatggtgagcgtccacaatcaccagctgtaccgccacatcgagcagcccgggtggcggctgagctggaggtgggctggcaacgagatcatctggggcatgacgggcgcggaggcgacggagcagggcgactgccaccggatccgtggcgccacccggccgcattgctgcgagaagcaaccggtcatcgtggacctgccccccggcacgccgtacaacaaccaggtctccagctgctgccggggcggcgtgctgtcgtcgctcacgcagaacaaccggacgtccaccgcggcgttccagatggtggtcggcggcttcaggcgcgccacgtaccacgacggcgacaggggccccgcgctgccgtcacgcttcggcgtcggagtgcccgggtactcctgcagcaacgccaccaaggtgaacgcgaccaggtcaccgatcggcaggcaccggcacgtccagtctctgcgtaaggcttctcccctttctttcttatcgcggcgcgtgcgttgagcgggagttctgagcgattcttgctgccgcgcgcgcgggcgccgtgtgcagtgacatggcaggtcacctgcacgtactcgcagttcatggaggccgcgtcgccgacgtgctgcgtctccctctcgtcgttctacaacagcacgatcgtgccgtgtccgcgttgcagctgcggctgcccacgatcccccacggcgccgcaatgcatcaggcaaaaccccccgcgcaccctcgtttcccacaccgcttaaatcctgtgctatatatcccactcactcatctgcatttttggttggtttaattttccagcgagggcgagaagccggagctgccggccggcgacggtgaggcggtcgcgccggtcttccggtgcaccgaccacatgtgcccagtccgggtgcactggcacgtgaagatcagctaccgtgagtactggagggtgaaggtgacgatcaccaactacaaccaggtcaagaactacagcgactggaacctggtggtgcagcacccgaacctccggagcctgacgcagctgttcagcttcaactaccagcctctcatcgagtacggcaccctgagtaggtatcactcactttagcatgatctccgttcgaattggatgaacagagtgaaccacagaagttgttgtttgattttgcagacgacacggggatgttctgggggatccagtactacaacgagatgatgctgcaggacggtaatgtgcagacggagatgatactgaagaaggacaagagcgacttcaccttctccggtggatgggcgttcccgaggagggtgtacttcgacggccacgagtgcgtcatgccaccgccggatcagtaccccttgctgcccaacggaggcccggactcgcgcgtctcggcggcgcaattgatcgccagctcgtgcttgttgttgccattcattttccttatcatgtaaaatattatttcgccatcgtaattgttcgagtaggaaagagaaatacaggtgcaatcgtgcaaacttgcagagcctaaactttgtgtaaaattactaagggctggggtctaaaggactgggctgaattctatgtatgtgtgtatataccgttttgggaggaattccgtaaagactttcccttcccaggcctcgtttagatgaagcccggtaaataacaatttgtattttttttgaactccctatctatttgtcgacaaattcttgggccaaaatcacccagatttttttttgcctttggattagcatccaaaggacagggaaaaaaggtcataaacatattttttctgtccggacaaaatcaaaagacaacatgggctgtaaatcaagcccacatagaaaatacaaaaaaaaaatttaaatcccatgattcaaagtgagcagcccaaaaacacaggacaactttataacagcccaaaaataacaaaaaaaaaccattacaaggggacttgcaaaccaaaaaggtcacaaaaagacaaaaaaaaggcagagatcacacagatcacgctacttcacacaaaaggaaatccacagatcaatcaggagaaatcgagcacgccatggacagctacgagaaagagaaaaagaaaaagaagcagattctaaccaagaacatggaggtcaagaagatcaaatcaacaacaaataatctcccaggtaagttccactttacctttttgttgttgatttcaccggatatgccatacagtatcaaaatcaaacaaaaacaactcagatttgaaaactcttagggaaattgcatgaaattttggattcctttacatcaagcagtactgagtagggaaacatgacttttgattcaaaaagatccttctaataagctataagtttcatattgaaataaggggaaacatagggcaccagaagaacatacatcatacagtgcacatatctctaacttttgcatcccaaaacatattctgttgatcacaactagtatgtccttcaatgaacatgatccctgtaccgccaaaatgaggagcaaaaagaacaaattttactacacttccagcaacaaaagaacccaagatttatgaatgctcagaggataagaataatttctctgctaacaaaacttaccttcacccacgttgacatcaatttcctgtacaacagttcaaaaaaaacaaatgattgatttcctagatagcaagcacagcagaagacaattcaaaaaaggaacacaaaacaaaatataaggaacaaatatttcatttactgaccattgctgtcatcccacaatccaagcagctccaaggcccttgctcccagaatcaacacatgcaagagcaacaaaagccaaaacaaagttgctaaaaagtacacatataacccagtcaatatcacacagagaacaatagaccaaaaaaatgaaaatgtcatgtggacacatctaaaaattatagataagaatatcttgcacatctgaaattagagacaaaaattcctcaacagttgctatctcagataacttgtgagataacgggcaccacactaaacctaaaaattccatgctaagcaatggaagtaaactagagacagtatgtcaagcttctatcaaggaagaagcctcaggtcaatctatattctaccaagagaaatagagataacagaaaaaaaaacagtacaaaactaggcctacattactaactagcaaaaaaaaaatatatcaggcacatatctaagaaaataaagatgcctagggttccccaaactacaagtctctgataaaaccaatatcaataattaacaatctaactaccaatagtcagttacagtgcgaaataataaaaattacaactgtaactaaggtatatttccactgtaagtggtgtgagttgcactgtaagtgtgttttaggactgcatgaaacctaaaatattgacttcatctgttaaatcaaagattcaaaactgaaaatacaatttgaaaactaaactaaatccccagatgaaagaagtgggcatcaaataccataactaaatcaaaaaagatacaaggtttaagatcagccattcaaatgcctcaagagatatattttttgtgggtaatttcctaatagaaaacatatattgaagctgacatccacataaatgcaaccaataaaaaaacatggagctatacatccataaatttttctgcaagaaaaagtttgacgatcatagaatttacctggctagttctccttttctgttttaatgaaaggaataagtagacacataagagttatgtcccgggcagcacttgttaagcaaaaacaaagcagaatctatgcaagacaaagaaagaaagttaatgttggttgcatacattaacagacaacataaatgaagcggcctcacacttgcaatggcacaagaaggcaagctaatttcagtaaaaacatctaattaattcaaaaatggatgataaccctacactgcattgactggaaaaaaaatctacaacataaggggaagcaatacaaactcactattgtttttatgaaactaaaagtacacatattctaacttatgcatgcacaactgacaaaaaagagtccctagggttcccaaactacaagtgtcctagttttcacacaaatcagtaatatacccaaggtcaatcaattacaaaatctaactaccaacagtcagttacagtgagagataacagaaattacaactgtaacttaggtatatttccactgtaactggactgtaaatggtgacgagttgtactgtaagtatgttttaagttagaattactgtaatttcagactgcatgaaatccaaaaatatttaagttaggtagtcagattacctagaacatataaaactaacatgctttttaaatatttctattacatgcaccaaccatacttgatttaaattacatgcaggggctgatagaacaaagtctcaagtaacaggaaatacaactgaagaattaagaagaaagaagacagttgaaggttagaaaatcatgcttacctattattgtgcatcatatctgatcttcatagaaaatttcatctagcacaaatttatgtatgtaaaaaattagtcatgaagcatgacaaaaattacagtgataattaaccaaaaaattagaactgtatattcagttacagtgagaaataacaaaaattacaactgtaactgcagtgcatatggactgtaactggactatgactggaatcatgcataactttgtccaaaaatccaatactcatgcaacaacatcaacattattccctactataacatgatctaaatcatattataaattacctaaatgatggcctatcttcaaccagaaaatcatgtctactatcaatgaaattgagaactgaaatactatttcaaaacttaacaaaattacataagattagaacagtcagttataattgcaaatgtaactgaggtatagttccactgtaacttcactgagttgtactgtaattatgttttaagttagaattattgtaattacattttgtaatgcttttatttacattttgcaggaacaatctcagctgtagaatcaactaaggacatcaagttggacaccaagaaaaaagaaccactacagatgaaaagtacataaacaactataaatagatactatattgttcccaattaactcaaaatagaaatcaaactattttgacctattgaacaaattatattaatgaacctttcatacttaccaaacataacactgtagtttctcatgaaaacttcaattttctccagttgcaggtcatgaagaagtacaagatgaaaaaagaagaagccaagaatcagataagagcaatattatggcaaaacatattaaagaaaccaaaagtcagaccactgaagttgttccaggtcagaatggcattgttattactatattcatgcaaatctttcaagatactat

SEQ ID NO: 58698 - DNA, 13292 bp, Oryza sativa
  unsure (1)..(13292): unsure at all n locations
ggcagtacgagagctcatcgtggctcaagaaagctctagggtttgtcagcttcaagataggacaatgttgctataagccagtgtttcatttcatgctctactgcgtgcggtgcatgatgcgatggccaaccatttgctgcccatgctatgtggtgtgctctccgctctgcaactgggtgttcaaattgcagcctagttggcagttgctcccaggcccttgttgggtgatatactccgccctctacaagttgtttggcctgcagtacattcaacaggtgctgacagacatgttgggcattagcactgcaagctccattcagctgcccattgaggtgaagagtaccgtgattgatgccctcgttgggatcctcatgcccaggcccaaccatgacagtgtcgtgttgtccagtggatcaacatcgctagccaagaatggcttgcaggacaagttcataaggcagtacgcttcgacaagttaccatggcggtagcgctagtaccattatccccgaatcaaagggcaatcaagccagcatcatcttgacctggcacgctgcgacaggttgctacgacaaagactatgagcaaaggaagaagatgaaggctactacagaatcgccgctacagcacaggcagtatcgtgttgtggccaccgctctatccaagtactgcatgtacttggtagcttatgtgcctcagctgctgcccgggcagcagtcctacacaacatctgtctacaacgattttgtgcgctcgccgtcctacatcttgcagagtggtacccagctgaaagatgagctctgcgaggcggtggtggaagatgaactgaggtggaaggtgctagctgatttctgggtcgagatgttgctctacctcgcgccttctgacaatgtcacggctcacatcgagcaactcgcacaaggtggagagttcatcacccatctctgggctctcctcttccacgccggcatcctgtaccggccgtacaaggaggaggaggagccagctgcagccgggacagtgtgacgaataaccacttaattattaattatcttgtgtttagcagtttgtttccatactttttatgtttgtagatgcatgcaagatgctgatttgcctgcgggaatcccaaaaatattgcaaaaaggaaacggataattaagcaagtttgtagtctcttctgtccactctagcactagcactgaacactgatgagatgtagggatgaatcgtgctgcgtgtcgcccgcggagagggggtggcggacgctccgcgcgggagaccgacttttccgttttttttttctttttctgtgttttccgtttctgttcggttggctgttttttttttctgttcaaattggttttccctttttttttctcttctgtttttttcggttttttagatgtatgaatacaaattttgtattcgtacatatacaaagtttgtatacatgatgcaatttcttgttttttttatttttttaatacgtatatatataaagtttgtatatatcgtacacaaagttcgtatacatcgtatacaaagtttgtatatgtcctaaataaactttgtatacatcgcatataaactttgtatatatgtatatatttttatgcattaaaaaatatttataaatatatatacacacgtgtatatatatatatatatatatatatatatatatatatatatatatatatgtatgtatgtatgtatgtatgtatacgtatgcatatgtagtatatgcataagtatagtagatacagagaagagactagagggggggggcgaactgaccgtgcgcgtgccggggcgcgcggctgattgcgtatcagcgccacccatatatgtctactccaatccatcaaaaatctcacggatggtcgcctggtcggttttctcccacgatgatcagtttgttggagcacacacacacgccactgaaataattgcatgccaaagcagagtaacatcagagaagctcccggtttcagtttgcccctcctccacagccacatcatgggccttttactgttacaagcccatatgtatgtattgattgtttgcaaactcggcccaactagacgggccgcacattcctcaaattgccgttccggcccaactagaccgtgctgttggacaacatatggcaccggcaacaaagcgtttccgggagttttgaattatactagaaaaattacccgtgtattgctatggaaagctaaaattataataaacaattgagtagagttcaattttcatgatccaagtgctttaagaaaatatttttcatgttgcgtgcgaacacaatctcgtgtcaatgtctagacaccaggtttttttttcaaaacaatctatttcacattacaacgggtaaattattttatttgtacaagaccgtggcacaaaaaaattgaatacggacgtactgttacatacagacatgaccttagtggtgcgcaatcatttctcgcaaattgtgttcttcactcgagctgatcttgaagatgaaagcattgtggatattagagatggcggtgtaatcaaacatcgaaacggtacctcggatataggaaggttgttggttattgttgaactagatattcagaaggactagataagaatattggtaagggtttattgcaaagattattatacttaacttacaaagctcgcattcctcgcaacagtaaaatcataatcacaagccgatcagacaagattgcgaggttaggaaccacaccacctctcagattacagctccttccaaaagaagcttactggtacttcttcaaggtgtgcacatttgggagcatggatgcttcagagcatcctgaaattgcatccgtagccatggagctagcaatggagtctgaaaggagcttcatggttgccaatgtctttggtagattactgaggtcgaataccaacacgctttactggagattggttcttgcatccctaagagagttcaagaagaagattcgagttgttctgttaggaggtgctgatcagcctcaaggaagatttgatgcacttggatggaaatcccagatagcacctaactatagctacacgtatagctgtgagatacagaggccaatgtgtattgttagtagataaaccttgtgtgtttgcattttaaatttctgttatgcatgcgcgcgagctccggtttgtggaagccgtgcgaatagctgtcatgccgcgagaatagctcggcgtggcgctagcaacggggagtgcgcgcgtactgcggatccgtggggatggacacgatcaatccgcgacgtgggaacgtttctgaagcccatgtttctttctgttgcatacctatcccctgtattgctctgttcttcattttcggatcagctacagtgcgtttgcaaagtgttcgtccaggtgttcgcgtgtgttccactcgccgattcgttgggattttcctgacatgtatggtcgccaggaagaagaaaatgcagaggaatggcggctgaatggctgaccatcttaggaatttatctgatgcactctagtattgttacatgtaggaattgtgtctttatatgtaacctctaatatgtaaaactttttccgataaccaaagaaaatactccaggcctctacatcccaagtatacatagttgttctcttgtggtggagcctattcatccgagttaaggaattaggtatggtgctcacgtttaaggctattttttttaaagtagtaagtaaagtacccattgacagcaatgcgtctgtgataactttatcaattgtaatatatgttggcccaatatctgaaggtgcttatattgatatggtttgcgtgtgtacatgcatttgtaagcatcggcatttgaactgtactttttattaaaaaaaaaagtataacatatatagctagagctaatattcattttgcatcacattcaaagtgagttttttattatgaatggttattataattgttattttctggaaaaataatattatggttgttttaatgtattctagtactttctcttgatgataaaagaaacttgacataaaatgagtgtcaaagagaaaaaggcacaaacggactacttcctgcatcttaaaataaatcaatctaacataaaatgggagtttacttagtacatgaatatagacagatgtctatctgcattcattattatataggtatttccattctattttaggctcgcttattttgggattgggacggaaggagtagtagagaaagatgggaagcacactgtattgaagtgctagaagatatgattgaggtgagatcttgtagtggtaaaaagtaaattgcagtattggaagaatacacataaagtttagagtcaaaatgttgaacttttaaaaatctatagcgtttcaattctggaactgagaatatttatcttgtttttttctgaatgaaaccagcacaagattgtgcttattcattaaatatagcaggagaaaaatacagcccctaaggaaaaaaggaaagcaagaaccgggaaaagctgtacactattcaaagcgcggaatagttgaggtttgaggttgcggcctccttgtgctcatatatccaccagtttcgctccatccaaatttcccaaacaatgagaatatttatcttgtgaattacacatagcaagaaacaaatgtatttgtttaaaagaatcaagaaacaaacgtacaaaagatattttcagtaataaaattttttaaaaataaaacatgtaggtatgatgtgaccactggcatgactagtctattttggtcaaaaagcttgcaagagaaacatataaagtcaattgaccgacctacattgttgtttctagaaagcgcaacaaaaaactgcacatgaaaatcaaaattacccatccagtagttgactgattcctatacatggaaatcaactttccatataactaactgcattccaagtcattcttccaaatctggctacattaagacggctaattatttcatttaatttgtggcagtcatctgcgcaggggtatacaagactattacactacagcttcgttattcttggattaagataaaaattttaactcggtttgagttagtgcttccgaaattactaaacaatctagacattgcttgataatattagataaatttattttcaaatttaaatttattaatacttaattaattatgtgctaatagttttttttcattttatgtctggagtttgaacgggacaaattaggggcgtgttcggtaatcattcctttacgctgcagtgcttgtgttgtgcggctgcagctgcagaaaataccagccgaataggtcctaagacaccaaaatccagccctgcctaattggattgggcttatcaacacgccaggccttacacggcccattacattgtttggaatgcgtgaactctacttttttttaaaaaaaagaaagaaaaatgatgacaaacaattaattcacttctagcaggagcgtacattttttttaaaaataaacacaatgcaaacatagatgcttaagtgcatctccattctaagcatgatgatcgtacttctgaaaatggtaaaggaaaaatacaatcatccatggtcgtcgtggttttggcattcaccatggacaagagcaccctaaaatattaaatgtgagaggaaacgctattaataatattgttgtgtggtggaattatatatgttgtccataagtgcatttttagttggtactggtagaaagtagaagcggggccagacatgggtcaacttaggcttgagcctcaggcttgactcgaaaaactccatataaatcctttagaaattatatagacatttcaaaaatatataatctctaactaaagttgtcatatttagtcttacaaatattttttgggctccacaaagaccataagtaatactccatatttttatttttttacaaaagagacttatagtgaagaaaatagaaaagtaattaatgggccattcaatctttatcatccatccaaacatctaatccaatacctaaaaacccatcagatctttcaccaaaagatacccaacgcccatctaatccaaccgcacgtacgagagcactaattaacaagttttttttagcatgatcaataattggggtcatcacaacacaatgcacctagccatcaatacatgatggaacatctaaaggtaacacactccaattagacaaatcacattagccccatatcatggaattaattaaaaggcatggcactttgtttttactagtactaaactagaagctactactaccaaaaatgggaggtatgttggtgccaggtggaagacaggtgggcccccaccaacccctgcaaagggcaagcagacatgatgggcctcgaaagcgtagctccatgccagtttgtgggccaggcctcttcttcttcttcttcttcttcttcttcttctccattcgccggcaaaaagaagagaaggcgacttgcaatttcagctccaatccgaaatggagatggccaatcaagaaggttgtggtgggcccagcatgtggcccaaaaggcctaccaagattaagaaaagaagttgtaaaagaaaggaaggaaaaatgaaagagaaagagcttgttcactttgatgaaaaaaaaccttaccgaattttggtattaacttcctttcaaaaaaaaattttggtattaacaaaaaaaccttaccaacttgctaaaattttgacatgatttcttatatagttaccaaaatttggcagcaaactaaatgtagccacttttttggcaactttatcaaaatttggtaaggttgaaaatgacatcaaaatgaaaaggcccgaaatttactcaacagcaaggctaataaagaaaagaagagatttggtttctagagagagaaagagaaagatgtctccatgatctttgctctagatttctgtgtaatatgatctctcttttttaaaagggcaagggtgttggaaaatactagtgattcttttatttcctttttcttgcacttatcaagcagcctgccacgctgacctgagaactaccggaaaacaagtgttgtcaaaattgattgcttcctgcactaaatccatagagactttttaaggtccaacagtactttacggtactaaatcttggtcgttggatctggtccgatccaacggctggtagtgtttggtaccgcgaggtaccaaatatgtccctattgcggtacctctcgcgtagaagagaggtggaagagcaaaaatgtaactttgtgtgcgatagatgggaggaatagacgggcggaaccaattttgtcacattttacatcctcttctgcgttgccgtcgcgtttctcttccccccgccgccgatgtgttcctcttccgccccaccgccgccgtgttcttcttccgctgccgccatgttcctcctccggcgccgcgacttcgatctgggcccttgcgccgaagcgagatcgattgcggcgtgcagggttgtcccctctcttctctgggattcgtggtcctccgccagtcactgcctggattgatgccatcaacgccgccgccgctaccgccgcctagacgccaactccgccgctgccgggatcgaccgccgccgcctcctcctggacgtcaactcggccgccgctgggaacaacgacttggacgccaccaccgccgggaacgacaacttgaacgccgcatccacccttgctcatcttttttctcccgctcctacccatcccagattcaacggttagatatcgatgtgttttggtaccgagcagtaccagtaccgaccggtacaacctgctggactgtaaagacgctcaaatctataacttaaacatcgcgatcagagtctacttagtgagtggacaaacctgttgtcgcagacatatggccacatatataggtggcctttttatttttctctctttttctctattaccttaaaagagggagttttatatgtatccgctacctttccctatccacacgacgcacaacaataatattagattatattagattgtatgggacatgttttgttgtttcatagcaattcataggtagactaattaaatgaaaattaatatttattttttatatggcgcctgccacctggtgagggggagaaggcatgtgttgctttctttttttttttggttttgtctgaactgatgagactataatactcttcatttctatcactggaaatggggagcaatgctctcctagtttaaaaaatatatttttttaagataatggaaatgagttacatatctaacctctgtaagatagggacataaccatagtattcagttttctaataacttgtatagaaagtatttacatgaaaattgctgcgcaactataactatgcagactatatatgcatgcacttccggaaaaaagaacaaatatatgattgatacccatgtatacataatgcatatggtgaaaccgtgaggagtcaaagtactgtcaaacatcagtttctcaaattcctctgaaactgttgagccatctgaatacagaaagagggagagagaaaggacacacagtactaccactgataagggaaaacaaaacagtagattaacgaataagcactgctgatgcaacttctgcaatcatcatgtccagggagctaaaacgaccttactacccttgccactattggccgccatatatcaatcaatccttttctctcttttgtggaagaagaagaagaagattaagatgctggtgttgagtcgtgtggcttttgctactgatcagattgttcagttcggaattcagataagaaactcatctcaggatcagacaaacaatgggtgggtgccagttcagaaagagagaatatatacggcagcaagtcagcaaccatatgcagaaaagagcagcatgctaatgtctttacaggatgcgcataaaatcactctttttcagttcttttctagcctagtaaagattttatgccttggggacagatgagattattattgagatcagaacatcatgctaaggatctcatcttcttctttgagcatccgaaatataagtctaaataagctagattccatattttaggactagcacaaagcttagactatatattcctaggatttcacttctccatgccaagtaaaaagcacataatatatacctcaataatacatctaaaaaaaatatacctatccaacatagtaggatttttctgggcattttacaattctcccatatcagtccagatgttaaccattttttctcttgaattccttcatttcaagctacatgtgcatatataggggaattaatctccctgagttaattttgaagatagtattttgtagtaaaataaatattaagtaataagatatgactatgttcatggcatgatgcagagtttgagatatttttactccattatttatttttgaatgaaccgatatcggcatgtctatttcattaaatatagtaggaaaagaaaaagacatttacaggtgtaaatagaaaaaacatggttacactgtaatatttgccaaaggactaagatatatagaaaggtgactttaccattctttaaaaaagtatcaagatgtatcatattttctagcgtaaaatttagtgcttttggatactaggtaactcgaggttgtaaaatttaggtttctcaataaagaaccgtaaaatttatcaagatagaaactagtcgctttgcgccagccatgcatctttttactccattatttaggatgtcaattattaatagctaagggaatttcactacttgtgtgatgcattcgatctctccattaacaagatggatgtggacctttgatgcctatgcaaacaccatgattgagtgtgtccatcaagtagctagtcggttagctaggtcaatatcttcaagttaaacacgtacaaatcgatctatctagcttcatctctttctttctcttccacagtgtcaaagacaatgtgtcggcatggcagacagctaccgtccgacttgaaagccatatatattactaattgctttcttcttacttaattattctatcctaattaaagtaaagatcgagataataaacagattaaaactattgtcgagatggattatattccctccttgggtaatactattaacatgaaagagaaagagataattaacgatggagatatatatacatacggatacacttgagcatcaacaatataatgcaagttcatgggcaactactacatatatagctgactaataagagcaagttcaatactatagccaactactagctccaattcatctatagccaatctaatagctcattcatacaatagttatatactacactattaatacctagtcccacatgtcatagacacactgcgtcttggagtccgtgctacagctggctataaatctgtagcccgctgctcttttctctcctgatttatcttcttaaaatatgtttgcagctggcttatagcctgctattgtacctgctctaatagtttaaattatttggttttggaggagtgtgtgtttagctttcgttttcccgggacttttgctgcaacagattgcaagggcccccatgcttgaggctgacacgacggctgcaattggccaaattcgagtgtctctctcatggcgcacgcttattagctttgcattgttgcccactaattaattaatctgatccattacatgagtaaaaccaaattacaacttgtgttcaatttatccaagtcgatcgatcattgattaattaacggcttgttcgatcttcatcgatccattttaaatccgctagttgctaattattaataagtttcatatgcttaatatacttttacttagtgcgtgctttttgtttatttgtcttatatatacggagagagttcaagtcgttttcctcattgaagctattttgtatcaacttaaagttttttgtacattctaaatacaaagacatggaatgtaactgatcatcttttaatttaattcttacctaaaagtatctcaatcatcgtaggatacacacaacccccatttgatggaggcactcaacctaattaaaaacaaatcaagatgtatatatatactagaaactaatccatcaatctaccccccatcaagccctaattaacttgtcacttaattgccgttaccgatcaatcaatcatacaaataaatccatcgtccatgcattgcaatgtattgcatccatatatctcgattgcgagtggctagctcgacgataaagttaattaactggtcgacgccatggcatggcccagcaggtctctcgatcaagatgttgaaatggaagttgaagggcaccatgaacacaataaataaaaatccccaatttgagatgctgaaagagacttcataattagcggtaactatgatagcggcacactatgtccatcgccgtagtttgtttttgacttttcagtgccctattcattaccgtcactatatactagtacgatttaatgatattcccggtgataagaataataaataaattgcatatgattgttaatatatactccctctgtcccataaaaaaaccaacctaatactggatgtgacatattttaatactacgaatctagacatacctctgtccaaattcgttgaactataatatgtcgcattcagtcctagatttttttttggacagagggagtatatgtcaattaacttatatgggaagctcgttgttttcatggatttccaccaaccaaactatttggtgagaaaatgatcattcctaacctcttaacataaatgtgtaagggttcgttttccttccttcctaccttcacctctagtggagatgacgtaatgccaaacatcggtgccttagggttcaaaatgaagagcaagagttagggatcatacataggtgcagattgatatatagtgagattgtatgataatggcactattgaagctatcgacgaggaagctaatagttggtaggctctacaagatctataagaatgagtggttttgaagcgacacctaatggtgccaacagctagacattgctaaataagatgacgaaagggagctagtaaatggaagatgcatgtttgtccgcaatgagagggccaacaccaatagtaattttgtcgaaaatgttcgagtggtttctaggagaggatatatataggtggtcgtggctagaagtaggagagggaatggctagaattgtatagggatggagtggcgggcttgaaccattcgataacacaaattcaatgccccaaaatttaatatagttctttgagaaaatcaaatagctgtaacataaaatccgatatatatatatattttttggtgcacgattaattgatcagttgtcgcagttttggcactattggaaactccaagtagaatggcatagctcacctccttattaaatgcatattactgtgcacaaacatgtggtttaattgtgcaaatcataacacacaccacctgcaacatgctgatggtcaagattctatttcatgtctcagatgattgtgcagttgcacaagtacaacacacctgttgctctgatggccctactaaaactcttgacactgttttgctacatgcatgtaaaacaaacagctgcaagattttaaaattagcttggaacattccatttccactagaacttcgtttacacaaaaggaggaaaaaaaacagaggaacatttcactaaagcatgcaaagacaaccaagatcacaccattaacacaaataattaagccaaactatatttataaaagtccattggtatattccactgatgtaagtatgaacacatcattaattacaccctcacaaaaaaacagcgaaattacacaaggctcccctcgacaaccctgtgccgtcggatgcgtgatctacggtagaattagcatcaaagctaaaactcccttgggttctacgaaaaattggaggtccccgggggcgccttgttccaggcgccaaccgcgcccgtcccgtagccgtcggccagccgcttgatccaccagagtcgttggccccaaggcccggccagtgccgcaacgccggcgccgaaccggctcgcacgcgccccaccttcgtgggnnaaatgacggcgcccccccgcgccgcgccacgtttgtggccgtgcccgaacagcgcccgcgccatgcgcgccgccggggggccgccgccgccgatgccgtagacgaagtggaagccgaacggctcgaacaggttcgggatggacgggatgcccattcacggcgc

SEQ ID NO: 58699 - DNA, 4352 bp, Oryza sativa
gtgaacccaaaccaacgcgcatgcctacacaggcttggggggctctctatcccgatacggcaagttaaccgttccgttcaacaaccgcgaacggaacacggtggacggagagacgcgcacgtaccggtcgcgcgcgcgcaaagatacaaacgcgtccctttctctctcgcgcgcgcaccacggaaaattgagcggcgcgtttacgggagagaacggcgcgccgagactcggttcgcacttggcatgtacgtaccaccggccggtcagcgtcacccatctgctgctcggccgcgtggttgttagcccatgcgcgcgccgccacgcctacgcggttactcccgatcgccaattaaaccacaggtttctcttacgtgatggtcgagctaggtggaattagatggatatatatccggccggccgtacgcatgcgtgcatgcaccgttggatcactgtacgtacagtgtacacacactgtgccacgtttcgattctgtattcctgcgcgtacgtacgtacgctcccacgttggtgtggccattattgattcttcacgatcgaacagtggcaggaaaggtacgtactactttcttcgcggtcgctgtagtatgattgtctgcgcgcgaccgtggaaactgaaaggcgtacgttccgcgatcgcgaaacatagaagatcagggaaaagcggcggcggcgcgcactcgatcggttggttggctgtttaagcaaagtgaatccctcgatcgatcgatcgcttcttcttctgctcgtacagcccccaaatcgttttcatgacagcgagcgacgcccgaacctgcccaataccggccatctccagcaatttttttttctctcttttggccctttcgatctctctctctctccccctcgcgtctcgccgtgattgggtttggacatggacaactactaactcctcttgtccttttgtttgctccaaaggttccctcgccgtctcgcgcacgtacatgcgagatcaccaatgagccatccatgcaacagggccactaacgacgcggctgtatgagagagtgaatcttgttggaatgaaaaaaaaaaagcgagaaaggcgttgggggcagttaacgctccacaaactccagagctgagggtgacagccataatagagacgatccaggtgatggctttacacgtgttagcttattttcccgaaggaaagagcattgaacagctatctaaccagggcccccttttatttgaaaactcagcacctgtaccttgtagatgaattcacgagttttctttatgttaaaaaagaggggcccgtgtttagttaaccaatggcatgtcacggtagatgtgttcattttgtacttgtgtactagtaattaatccccctgttgtttgatcccacgtgagtactttggctgttatatatgtcacttagcaggagtagtagtacagcaactagcagtattctctgtcttccagcgaattgcatgcatggctaaaatgattacagcagacgttttgccatcacgagttcacgacatatgattactcccactcccactcccacaaccatctctctgcgccagcgctatcacgtagccaacgccgctgcatggcaaaagttgattgctccctgtgcctgacaatgagatgggcaaagaggtacgagccggcccattggttggtgttacgttccctcgtcattgatcccttaggcccatagaattgtggaacctagagtgatttccatgggaacatcgcctctgggtttcaagtttccgcactaacaataatttcccctcgcccaagaaattagaacacgcaagtcacctgaaagtctgatagtaatatggccctgtctattttgcacttggtattgacagcattttggaatatattcattttcaaataagttcaattaagattcatatatttcagatggagatagttagtttacagggactgttttatcttaggtgatgcattgtgcaaactgcgaataattagatagaagagtgcgaggacgaacttaatgggctatatggcgtttggaactgaaaacctttttccgctgggctgtcacggaaggaataatggaacttacaggctgtccctggatgatgacatctatgggctatagcttaggctttttgacgtcgtttgtgccgtgataagtctattttgcgtcctgcaactcttgctcctagctgaatcgcatccctcaactacaaaactggatataacgcatccttttatttaaaaatcggtgtaaattgcctccttaggtggtttggaaggtggttttatctgacgtggtagctttgacctagttgactggctaactcaactgtggaccccacctgtcaatgatatactccatcctatcctctcccctctgtctttcctcttcctcctctctcacctcacatcagaatgcagggaggagctcgtcggccatgctgtgcgggggccgtgggtgggggggggaggtgttgccacttttgccagctagttgttctcgtggggaggagctcaccagccgcgacatgcacaagggggagggggtccccagccagtcgagtgcgcggggggaggggtcgacaaccatggcgagtccaggggaggggttgccggttgcagcgcgtgcaagaggaggggtcaccggccgcgccgcgcacgtgggaaggagctcactggcctcatgaaaggtggaaagtcatacatgttttttccatgtttcactgacatgtagggcccactgtaatatggtttttcatatctcacagacatgtgggccctacatgcaaaaaccacttttcaaaccatagaaggagtttatttgcaccggttttagaagataggggatgcgttacaccgggttttgtggtcgagggatgtgcttcaatcaagagcaagagattagggagtagtaataaacttattcctttgtgccgtgtgttgcacacaccgcacaacagctgacctaaataaaaggctttatgggccagccattttagcgtcgaataggcccaaatatcggtcatgggcccaacaaaagcagacccccaagaaacttacagaaaaaccttctcctgttgcctttcaatcattccccaatcaaaaaaagggtaagtttaccatcctttataaagtagaaaatatggtacctctagtactaatactatgtatcttaaggtataaggtataaaaaattttagtataaaatttaggtacctcaagatactttctcaaggattgtaaaattcctcgtcgaaaaaacattatacatgcagcaggagtcatctcctttgtgttcagattttccattgaaaaaaaaatcacgaatattagggatggacctaatatcaaataattaggagtgaggtttcgaacccaggttgtctagcccatcaccttgtggagctagccggaaagcggaaaacccttagacgtttctcgtttaaattttccattgacgagcgattaaatttacgtttttttgcgggtaattaaatttacgttttgccatatgcaggtttcaggtaataccattgtataagctattttgtcttaaaatacggcatggcaatcaatttcctcatggtgattatctataaaatgttatcttttttttgggggggggggggggggcaatcttgttgtgggaatttgtcaatagtaatttccaaacaatattaacacgcatttgtttaagagcaatttcgtcataatgttcacataattgtcaagcaaaattttcaagagtacattgatactcatttttcttccgattatcaatgtataaatgtggacaatcaatactatttctgctacatcacatgaggaattgggctagtggagtagaatcggtagaaccatgatgacgatagaataaggggataaaatgacatgtacattagcatttactggaactttcacagtttcactcgtcgatggcatgcaaaatgcaaattagacaattgccaaggggaattttttgatgtaaaagaggcccttttgctctccaaggagtcattataatgtttacccggggcttggaacgctcaaactatcttgatctcttctgaaaatcctgcgtgacgaacttaaaattcttactggtagttacttgaatgtagcacatgttcctagatcgtcagttgctttggcacatggtacctggtcgatcgtgggccaaaactcaggaaaagaagcacggatggacgggatggtactggtaggagggggcctgtggagaccattggcagatcgggttcatccatccatacgcttttccggaaaaaaacctcgtgacacccccgaaccaagcatggccgcgacgccaaccccaacccccggtcactg

SEQ ID NO: 58700 - DNA, 1842 bp, Oryza sativa
cccactcctgcacgttgcaggagaaatagacccaatgttctgcaatccccaactgacgccgttccttgtaaagctccccactgcggacaagtgagtggaagttccgattgactgatgcaatggagccataatctgaacgagagcaacgggcgaggcaactgattgagttatctcgaccgatagaacttattagggtacttgaatccgaaaaaccctgatcattgctgccttgacaatccagctgctcacactcatggttcctggcagatttaggtcgtttggtcagtactgctactgcagcaacactatcaggttcaatcctcggagtacttgatatgcgcttactcctcgttatctcaaggaggtggtaggtcatgtatgctaatctggattcttgatcacaggagcttggcaaagaccttgagatcaagcaagattgaccctccaacattctgtgagaattttcagtgatgtctctcagaagagagaacctatacacaagaatccaggccttctgtattcattgtgaacctgcaagagatcataaattaatatcattctactgtgtggaaaaattgatgatcacatttgtatacataactcaatttgcaagatattgtgaagagcttcaccaaggtcagtcgaatgagatctatataattaaaatttacaatccaagaacaagacaaattaaatttcacaaaaactgattaataatgaaggcttggccaaacgattaatgaaacatcatttttgtgaataaatagaacatggcattcattaaatcaaacctaggtcttaacttaacgcatgaaactgataaaccacagaaaatgcccaaagctactccacggtaccacttcagcacagatctttcggaactaaaatgtgaaccactgcaaccaatcatttttaggagttgccattaatcattgaggatagcgattaaagatatagaaattgaagttgaacaaagtggtgctctcattgggtcctaaatggttcgtatacttcttgtacgggttactttatcatcaaaccaaatcaagttccagggcaaatcaacttatctgtgtaattagcttttttttctgtctcgcgatgtatcccttcctagatgaacaagggctggcggttctaactaagcaattataaaataaataaaattaacatgatgcctaacaggtcgcggagaacaaaaatcctatcgtgcagcaacagtatgcctgaggaaaattaatgttgctccatataattctccatggttgaaagttcgacggcaaatctgacgcctaagatgctttagtcccaaaactccacccctccaagtaagctacaattagtgccatcaaaccggtattaaccacggattgctcatccgactgatttgacctaaattctccaagtcgcccattatacaagaacaaaggatgaacaattcaaccgaaacaaaccatgtaaattaggtgagatgagaagcgaggacaaacgtagataagacaatacgccagctacctggcaatcaatctcgcctcaaaaccaaccgtgcccccgccccgcgcgcggcgacaaaatctcgcccaccggccgccgccgacacggcaggcgcccagcgacggcgacgagtgcacggcacccccccgggcggcggggatcgggagagaaacggacgcgcgcggcggagaagccgcttgcgggaggaaccgcgcggaggcggaggctgcggcggcgcggttacgggagcacgcggaggcggaggcggaggcggaggagcggagagggagggtggggagaggtggaagaggaggaggatgcgcggttacgggggcggagagggtgggg

SEQ ID NO: 58701 - DNA, 3093 bp, Oryza sativa
acgagaaggcccagctcatcgacgagatcgccaagtcgtcggagctccaggcgcacggcgtcgacttcctcaacgtcgtggtggacaacggccgcgcgggcctcatgacgcagatcgtgcgggagttcgagaacgccttcaactcgctcccggcaccgaggtggccaccgtcacctccgtcgtgcagctcgagtcgcaggacctcgcgcagatcgcgcagcaggtgcagaatctcaccggcgcgaagaacgtccgggtcaagacccgcatcgacccggagctcatcgccggcttcaccatccagtacggccgcgacgggtccagcctcatcgacatgagcgtccggaagcagatcgaggagatcacctccgagttcgagatgcccgcagtaaccctcgacgtctgatcggcatccaccaccctcccggcggcgctgccttggcccttaggtcctctcctcctgttgtctcttactcttgtgcaagtgcaacatacattgctctcatgtgattgttgaatgtttggtaagcattactgctgaaataatacatagctggattccaaaatttgcactgtttgattatcttggcctgcatattttttttagcagaatttgtagagtagcgtgtgttgcgttcactagctccatgtctcggcctcatgggggaagttttcaatagatttgctctgccaagttcagagtagaactgtagaagattgtcttgtgcgatggagcagagaaaacaatcattgaaagtagttcataagtgtgagggcattagggcaaagtggcgaaggaatttggcttttgtgatcacatgaggctgctcttataatctgcaaacctgtcaatctaatatgcaaatgcagtttaattagtgacagactgttcatccttttgcagctccattgtcacagggaatctcgaaggcttgtcaagaatgctggtcctcatccccttcagaactgaagatataatggaggaggctcaaatacatatgacgatcacgacaacattcttttctgcatttcttttcattttttggccggagccaatgtaattctcttttctttcgttgcccttgtaatttgcttcaaatactaaactatagcgaggctgctcctccattatgtacctgccgatagagtttgcagatatgtatagaaagtgccattgttttcatctgataaacgagatcaatatatcatgtggtgttccgttttatgcgtgccctgaacttttgcttcaatgtaagtcaggtaatatgccataaaacgttatactacctccgtactagtaaaggaagttgttttggacagcgacacggtctccaaaacacaactttgacttcttgtttctataaaaatatttatttaaaaattgatacatgtatacttttatgaaagtatttttcaagacaaatctattcatataatttttacattttcaaactcaataacttgagagttatttatgatttatattcctaaggtttgacataaacattgttctaaacgactttacgagtacggagggagcacaagcaaacaaaaaattaatttataagtaaaactttttttatctgtgttatttgtggtttaaaagcattgttgaaaactaaaatatgatgaaaaaaaccctctcaaaatcaactctaaaattaagctttaaattcaagttttgcagcgtcttataagtgtaccaggtttgctgctgagatttcttcgttttgctgcaaccttagccatgaccatggcatgtggcaagtgttactagggattagggttcatctttctgattgagcgctgaatcccgaccttcgacggtatgacagtttttgccaaatttcgatagattatgatcaaatttctaccaaatttactgttttaaattttaattttcgaaaaccattcaaaatttcacttggaatgtgcttccgtcccacgtcaaaagttcaggggcaggatctgctgaggtgcttgctcattaagttagtattttaattaatacctgtagttagcatttgtaatcaccaaggatccgtggcgcaatggtagcgcgtctgactccagatcagaaggttgcgtgttcgattcacgtcgggttcaaatccccgatccaaacggatctccttttttcttttcatttttgcctcatttttctggtaactgttcaatcctcaccgtccaactcacactaatcgtacgaagccgataatctgagccgtccaaaatcgcactaatccatccatctcctccccccctatcccctcggcctcctctccccccacccgcgccgcgcccctccctcccgacggcagttgccgccactcgccggcggccaaccctatccaatgcaaacctaaggggcctctccttttgacctaacccgatgctcgcctaccctaccacatcgagcccgtggccgccgcgccaccacggcgccgccgctgcccccgccgcgcggcggcacatggcggctgcggcagccaggggaaagaggcggggcgcgggtgccgcggcggcggaaggggcggacgaggccgccgaggcggcggacctggtgcggttcttcctccggaggacgagcggcggcaaggagcggctcgtggccgtgcttgaccgccacgtgaaggtggtccgcaccgagcactgcttcctcctcttcgaggagctcggccgccgcgacggctggctccagtgtctcgaggtgagcatggcgaagtgccccaatgcccgagtagtgaaaaaccctgtttctccttacgccctttaggtttctacagtaacaacgcctttctactgaaagtgagagacttttaccatggtttacatttcgtgtcacatataatctttgcctatgagcccaactcaaatcacaattgactagcagtatgcctgcttttgtgtactaatcccctgattgctatcataagtgccattttagggtgttgatgtggatcaacaagagatgaattttgaagttcctgtaagttggacatatctactggttccttactgctcttctattttgctaggttttcagatggatgcagaaacaaaggtggtatgttgctgataacggcatatatt

SEQ ID NO: 58702 - DNA, 13444 bp, Oryza sativa
ttcccgtgccaacgtttgattgtctgtcttatatgaaattttttttataaatagtattttcattattgttagatgataaaacatgattaatactttatgcgtgacttatctttttaattttttttcataatttttttaaataagacgaacgatcaaacgttggacatgaaaatcagggtttgtctttttttttaggacgaagggagtacgtatgttgctttttgtcttgtactacctataaaacatagcacgagaccttggcctgggtcagcttgcctgaatcgggagaccctgaaacaccccacccctgtgaccaagcagcaacaatgtgcaccgcaggtcccttcactcacatcagttggtgcttgtcggaaattaaagaatcctggccaacgctagaacagcgagcgctacgaacccgcaaagcacaaacgctccgggccaacggtcgaattaggcgtgcatgattcaaaccccccccccccccccccaaaaaaaatcatatcaaattaaagcagaactaattaagcgtgtcacgcgctgtttggtccgtctcgcctccagtagctgcgtacggcgggggagaagctacagcgagctacgtggagtagcttgattgccctaggagccgcacgaggaggggcgcacatgacgaagcgttggacattggcgaggaccttgtcgcggcggggtttattccgcggtactactgtctggccattcgcacggcacgttaggtgcgctccccacgcgcgcgcgtcgattagccggagccacgagggccgacacacatcaaccccccctactactacgcgaccgcggcgtttacggcgagcaaccagatgagatgaccaaatcgcgcgcgccgcgcaacgcagcgacgggccggcttgcgcacaccgcagccatgcccgcccgctgtctcagggggatatatgcaaggcgaactgcttagcaaaaggccagggaagggaagagctagcgcgcgctagctcgatcggggaacagagtaacatgcgtgccgttgtgcgtccgtccattagacgaacaccgaaggcgtgtccttttgcggaaagcgagcaaccgcttttgcattgtgatgcaccgctcgccgggctggctggttaagatttgaagaagagctagcagggtcatgtgccggcatgaggggcgagccaagtaaaagccaacatgataaccccatcgatctgtatagatagaaacgagcccaagttgcgttttgttagtttcgggcacccacagctagccctggctgtgctgcgtgctctgaaaattttactcccactactccacacaagtgtaaactcctctttggatgattggagcatctgtgtacgtattaagcctgtagtttaaactccaaagtgggttcaggtgtccacttaaacgtagaataacaaacacccacccatcgtcggagcctgtttctagacatacagatgcgatccgtccacgcataaagaaagaagctagggggaagataacaagagagcggaatcgaaagggaggggaaaaaaaaagaagaccagcagcagtagtacgtggtcccgatcgatcgaacaccggagatggcgggacgcatccaatgatcgatccaacgcgggagaagcgatcgagcggctaagctaagctggggcgtgtgcggagaagcgagcgacggatgactagagcgtcgcatgcagcgctacagactggagggggtggcccgatctccgcttgctggcacgtaaatggagcccataactttcacgccaaacttcgcggattcgatcggtccccccggctggccggaaaccacatatggatatgcatcggagtgcctcgcatgggcagcaggacaggtttgccttggtgcgtggtaaatctcaagcctaaccagtaactgcccgcgtaaaactatacagagtatacaggtgagctagcagataacatctgcagaattcagtttccagatgatggataaacatgtctacagaattcaatgttctataagaagaaaagaattaatttgactctcgggttactcctaccattgattagctttctctcatcagtactacataagttgtggaatcgctagtggatcataatgggatatttttttttaaaaaaaaaagaggtcgagaaaagcgacagcattttagaattctcttgtttggatgaaaagagccgtgggataacgaaagaaaatcgtcgtccacgctcatcatatttctatgacaaaactgagaatggacatattgcataaggagaatcatctgcttgacttcttcgctaaaaatacttttttttatgcatgtatcatggaatcataatattgtatggtgaataatcagcatcaagcttgcatggttctgtagttaattttatttcatcagtatcttgtaaatgattggtacagccaacaactagaccgaaatatttttttctacaaattgtaaccttggatggaagtatccatcacatcaaatattattacgtatgcggcaagagtagattttaaactctcgaggggatgttcccccgttgtttgcatgtaacttaaaaataagttattaaaattaaaaaaagtaagaagatgtattaatatgtgatatatcactccacaaacatataaaataaaattcaatttctaaatgatgtaacaaaaaatatgactgtgaatatatgtttgtcgacgtttgatgtcgcgattccggtatttacatagtatggggatcgttagtactagaatatacgcgagactgaggtaaaagaggcggagacgaggatttttatacaggttcgggcccctgaattgtcaggtaatagccctacatcctgttggccaaagccgatcgttgctcttattcattataatcacaccagtacaatatttggggtagcctatctaactgttgttgacatggcggtctgaaggtctgactcgtagtcgacaacaaggtagtcttcctcctcgagttcgtgcccagcgagatcagagacatcgctagatccctacggccggcctctgtaggtaccggatagggtcgatccaggcatatctatgatgtcgatatccggcggcttgtcttggcgtatgttggcttgtatgttgtggcttctgttgttccgtgcatgttgattctctcccctctcctcctagggggtcttgtatttatacccataggtgttcccttgtccaagtagaactagggagaccaatatgaatacaatccgagtagtctttgtcgtttctatgtagaactctggttgtccttccttatccggaactcctcctatatccgaaggttgtttccgtataagacatggtatgtggtgggtcctgccgagatttagtcaactactattaggtatgtggtatccataaccctgacaatgttataactagctgtagtttaatttgattttttgttacgagatgtacaaattgaatttaaatttacatgtttgtggagtgatatatcacatattaataagtcttctttttttttcataatcatttaagtgacgtacaaataatgagaggatatccctcgagagtacaaataatgagagaacatccctcgagattttagaatagttatccgtatgtggcatgattagtacgtgtatcattggctcccatcggatggcccattaagtcaaagaaaaaaccaaattttaaattttcaaacttgattttgagatattttcaacatagtttcttttttagcattggtttttaagtcaccaagaacacatatataaaagttttacctataaatttatttttatttcctaataaactgttttggcttattagaaaataagcgaaacgatggggcccattgttacagctagctggtaaattaagcttcacatgttgttcgagcatccaaagagatgtagctgtgttcctgcacctcccagaatcatttctgcaggaatcacgataagtcgatagctacgttctaactatttgcttgtggtgatatacggcagctaagctcttgatatgtattttaaaatggtcggcaataaattttatgtaattatttgttcagtgcttttactatagctactggcgaaaatgacatacgtgctgcaagtttcagaaaattaaataaaaaatgaactggagatcagagactataaatcttattgtttaatatatttttctgttgtaaaaagaaggaaagaacatatagtaaaaacataagtttaatttcattccactatctttattctacttaccgttgaaactgggtgcaacactgccaagataggcttttcaggcttcagacttcagctgatgggtttgtgcacattctgcattgcttacaattatggacgtggcttgcgcataggcgaacggcacggaccatgcaaattaaatggcatgcatgctcttcgcgcaccagcatgaatacacattctggctgaagtgtctattctctaggaccggagtatagtaggccacggtaataaattaactctctcccgttttctgaaaataaagttatatgcatgaacaatttaattacctttcaccagcatcataaaatttggtagagctcaagtggtaatggaagcagtacttgtttaattaggttcatgacaactttatccatgcccatcatttgcctacttggatatatgcaaggtccacttttataatgccctcaagggcatcatcaatcattatcacctcgagttaacatggatcacgctgcacaatcacagcaacaccgagggcaggaggtcgtgcgccacctggatgcgcaggagagactatagctagattccacagcaacacatgacgcacatatatacccatctatcctccttccaaagcttgctttggttatgatcaataacttatgattagggtatagaactactactactggtactaataaccgaatacctgtactgctggagtagtagtttgaagtggacaaatggtagcgccgcccggattaatgatgggctggctggcaaccagaatgtgctgctccaaacctccaaccatcaaagggcaacgctaaattactactttactcggtgtagatcaacttcctgagttgtaaattgtactatctcacggcttagtttaagtcactcttgcgtataatataagatacaccatacatgtgggatagcttgctgcatctgggtaagcttccaagctagatgcagctcggtaccatttccttgcaagtacgaatcttaacgcaggcacgacagattgaaacaaggacaaggggaaaatggcgcaagcatcccaaccacccttgtctgaccaccgagttacctgaaacactcatgcttgtttttattatacagctgcattttcattatatttacgtttcgtacatttttcagcgtttgttatccaaagaaggcataattttacttggaaaaaacgcgaaagtcgttttactctttatgatgtatatacccgttctttacgtatcaatagtaattagttatggaaaaaaataatagcaatgatagctactcctatgtgatacaccgtaaaccaacaaactagttcaaatgcaacctacacaaattgataaaaaaaggaaactaaccatgaatagtaaatttgtactatttagtgaataaattgttttcctttcttcctatgtggatcgaatttggaattgatttttttctcagcacaatagataagtgatgtattcaacacaatcattttctatatatttttaattatttgagacgtaaaaaagggaacatacccataaaggaaaaatggtagttccaaaagtaggttgtgttttaatatactcacatgttgcaaagacatagctagtcccatcatttttatagtagctgattatgagccataatatttattagcgacttaaaaagtaaatttaaattaagggtaaagttaacctttaaaatttaaattttgcctgcagcttgtaagttgagcaaacgatggatcgtaatgtggtacttaattattgatgttggtatgaaagtataatatagtattaaacttaagactgtaaaaactcttattttttttgtgtgcacgcctatacagattgctcaacagatccaacttcataatttggtagtagtagttaagctatacccacacggagaggagtaaaaaccaaactaggctgtgttattccctcattttcctaacccacctctctctcgtttttcacgtgcacgcttttcaaaccgctaaacggtgtgatttataaaaaactttctatatgaaagttgtttaaaaaaaatcatattaatccattttcaaaaaaattagttaatacttaattaattatgcaataaaacgaacttcgttttgcgtgccggggaggaggggttcccaaccctctcctccgaacacagcctaagagcaagtacaatagcagctataagccagctataaccacacatcgagaagaaaagataagagagaggagaaagcgggctacagatttatagccggctgcaacacggacttcaagacgttatgtgtgtatgagaggggagaccggatattaacggtgtagtatatttttatagttaactattgtataaatgggttattagattagctatagttgtttaaagctaataatttgttttactattaaacttgctgtaaggaaacagaaaaaccgatcgactagctggcggggttgattggccgcgtggttttcttccaccgcgcgcgcgagcacgatgcatggatggtgcatcgtgtggtggtattacctggctggcacgagagaggaaatttcggatggaggttgggactttgggagggggccgcgccggggttttggtgggggatccgcgataagcgtccgccatgttctgtagcaacgccaccgcctcctcccgtcgcgtggggggtggaccccacgccacagctggttcggtgtattcttgtctcgtacggttcttttgcctgccgcctcccccgttctctccttccttctccgtcccggcccgtctctctgtaaatctgtaatctctacgtctctgactctgcccatggcgtgattaaccttttacccacgtaacaacagtaattaattggtcgatcgatcgatcgtctgatctgcaagttccttctacgtctccaccatggagagagagagagtgagagagagagggggggggggggaggtccatagcttgttgaaggtcactttttccccaaataagtctgagatacggtttgtgagattatataatcagtttattgtggatatgcagagtattatatgtaatcagtttggcaggtggagtatattggagtcttaatcaagatcgtagaaaattaggaagtatcgataggccctttttctgcatgcgcacgcaataattcggcagacaataactctcatcaaatgtaggaatagtattaacatgcgtgcctattagataatggtacagtataagatcgagtcataacagcaccacaacaccgaacattatctctttagttagatactctcagttcatattataaagcgttttgatcttttcttacttatattttgttaagtttaattaaatttaattaaatctcttcagtgatgacgctggctgagtaatgtatttacctctttccctgcaaaaaaaatttgattaaatttataaaaaaaagcaacatctcaaattagttttagtaaatctaacattgtatatatcttgattatatgtttattttgtgttaaaaaatatgtcgggacccaaggtcacggacaagattggggatagacgggaaaacatccttttcccgtctatcctgagaaatgagcccgaataccaaatgaacacacactaagtgacaagacttttagtattccgagatatcttgcctgctacacgctttttgtctactttatatagttcacagctttacatgtgagattacaattgcgccctttgttgggcccacataaaattacaatcatgcccttgctatatcagctaacactaagggcattttggtacattatggaggtcattatagtcttttggtgccagctggatgaagtggttgagtggtcctcgggaatattctcttggcatctttgttgtccaaattgccttcttcatgatcaagagtcttttccaccaccatgggtcttctcctcgaccgagggtcttttccaccaccatggatcttttccatagcaaatagtcttttccagctcgaccaccctttccgacttatccggtagctgacctgttgttaactcaggaaatactcaaaacggataatgagatttagtgacaagaatgtactcgaacggtattttccgactcgaatagtattttccaattcgaacagcgttttaccgttaccctgttcgaatgaccatttgccactcggagactattctaactcaatctcttcctctacagtgttttgggctgaatatagaggagcggtggtgaccccctgctacaacaagcccctcacgggtaagggcgatgtgtgttttcggccgaaaccgtgttcgaatcaaaagctgggggagaaccgccgtcctcctattcggtcgaaaaaacactgggacataaaaatttgaagttcgaaggtggttattcttgttaatcattatgcatttatttgtttgttatatatatatatattatttattttgtgtatacatattctttatgtattgaatatgcacatttattatgatgcttgaatgtgtgccacatgtcagctttgtattggatggttggaaggtgaagcgccgcttcggggttcacgcccgctcacaaccgcgaccccccaccccccagacctatataatgtccgcaggggtcgctttcagccggctactgtgccgtcctatacttgactcgaatctgtctttgctcgaaaaacactctttccagttgaagacatctttttctcttgactacccttcttcgtgatgggaaaagacaagcagaaaacaaataagaagggcaaataaaaaaaggtcgaaaaacccgagagaagtgggattgtcttgggcccttcggccatcaaagacaagcatttgaatgaccttgttcaaaatggggtcgtttcgaaccggaaatttttggtttgacctgttggcgagtctgatccttctcccaagcctggatatacactagttttcgaaggtatctttgaggctggcttcagatttccgtgcagcccctttctgatcgaagtgttaaagatattcaaactcgagttcccacaacttacccccaatgtgcttgtgcgcgtgggaatcttcgaatggatgattcggagttgtggtgggaatcctcgtgccgaggattttgcatatttccacagcatccgccgctacaccaagcaaaattcgaagttcggttgtctcaacttctccccccattcgaagcatggatgcccttggccagccgtacttgccattcgaattaaatgggggaacaaatggcagtctaggtggttttaccatcagatccctgccaaccttcttgctgacaaagagtgtcctttcactttctcttgcaagatcgctaaggttatagtcgaaccgccagcggctcttacagcggattttctttctattcgctctcgaatggaagaacttgtctcaaagttcagcgttcgagacttggtggaagaatttgtttgccttggcattcagccactcacagccgagtggactattctcttaggacaagtgccaagagaagccgcttcgactttgcctccctttgaggttgatccgaatagtaagttttcattttctctttcggtcgaacacattcatgttatttattaagttcgaacattttccttcgaatgttttgtacttacattatgttttttttgtttgctatagctgttattcctacagacattgtccacccttgtcggaaatatcttagtccttataccaaagatgagcacgcaaagtaccaatccttgcaaaatggtttaaggatgaatcgagtgatgtccgcccttggactcgatattcctgctcgagttcatcctgagattgtccctgactcgggcaagaaaaagaaaaagaagaaagctgcgaggaaaatgtcttctgatgaagacgatattgaagttgaggaaaacgaagaaaatacagataacgacggtaatgatgggaatgaagagcatgtggagaatgaggaaaatgaagggaataaatccggcgaaggtagcttgagcagtgatgatgactcgagtgacagctcaagcgatgactcgaattcatcgtcagatgaggaaattgcctcggtcgtccctcctgcccaagctgctccaagtgttttgaagaggaaaattagtcctagcggttcccttcagattgttgtcgacagtgatgatgagattgacaaagacaacactctagttgacatttgtgccataaacgtcactccccttcgagctgacgccagccttgccacgcctgctaatgctatcgcccctttggatgtgcttgcatcggttgcaacggtggttgagaaaaatgtcgaagctgatctggtttgagcaactgattcgagcaatcttccccatggtggtgacaagtctcccactattgaacttcaaacttcggttcaaatagctcaagacttagagagtgggaagaaaattgttgaagaaactgttcaacctgaccaagtagaggagaaggatgccgaaatacattcccctccctttctatcaactccttccccccagataatccaagatgttctcggtggatttagtgagcgatgcacgaaaaatggtcgatggctaatgggactacctaatttctccgatttgggggaaaatagccatctcggttcaaatttttgcataaattacctgaaatatcgccacccgctcggttctgttggggatgagctcaagaaaatactcatcactcccgaactggagaaggaatttgtcgaggaaaacgatcttatgtcttcctgggctgcacttgatgtctctgccgctcaggtattcttttcctattttactcgaaccgattgttttattacttcatttctatgttgctcatagttcttttgctttttgttttttagacttcgaccatcgcctggcttcaatgtggtgtttccatgaaagcactcacagcaatatgtgtccggcggaagaaatcgctcgaacgcatagctaaacttgagaaagacagagaatttctccgccatgaagtcgagcgtgtctcagatgagaaacaggttgctgccgatcttgttcgaaaacttagcagcgacaaaaagggtttaatcgacgagaaaaggtctttcatcgaagagaataaaaaacttcatgcccacataaagattctcgaacagtcggtggctgatcaccaagaagtttctcgggaaagagccatttctgcagataagcttaaggagcaacttgctgcttcagaaaaagagaacaagcagctcgaactggctcgtctgaaccaagaagagaagaattcctccctcttgaaagaactcgaagattgccgttcgaagcttttggagagttgcaagatggttcaagacgctgtgcaaaaacttggagctaatgtaagccttccggccgacaatagtacattgtctgttcttgccaattgggtcgaagaatcatcgactggtttggttgatggtattgagcccttcgcctctcgttgttcaaagatctccgccgaggctttatcggctagtcttctttcgaacggatgtgaccatttctctggtttaaaggaatccatcaccgacttacttggcgatgagtcaaaatttgctcaacaccgtgcggcaattcgatctgtcgtcaaagcttttcaagtttggtattggaaaaatagaggctatgaagatacccttgcttctctctgggcatcgttggcttcgagctcacacaccacacaatcctcttcgagccagccagacgacggtggtgatgctcacatatctgattcgcaggtgtgaagtttttagggtgaactaactgggaaaacactatatgtgtttgaaagtactattattttgcttgatcgaacctattatggtcgaaaacttatttgtgtatattctaaatatgcttgggtatcactagctattttctctgtatgcctgtgcttcaccatcatttcgtttttgtcggggatgcaggtttatttgaaccgaaaagttgtggttcgacgcaacaaatgtcgttcaactcgaaatgggaagcacatagcatttcgaacacacgaggagttgctttttcctcaagcaactaattgtgatgatgaagagaagaaaatatattacgatgacacttgtattttttcttttaaatttttccaatggcaaagagaacatcaagatggcagtttgcgcgacttcgttgtcgagtttagaaaacgacgttcgaataatgctttgagtagcattgatttttggcaaacttttagaccatctgagcgtcaacttagaatatggaaaaggcgctactcaattgtcccttacacgggaatgccttatcctctcaatgtcatttttccttcttcttttcctttttaaatagggaatcagatgtaatttgtcatgttatcttcaataaaacttcttccgaatacttttctgattcaagataactaaggtagagaattgttcgaaaagttccaaacttctcacctttcgaagtagtgacgaggtcgaaaccacgctttacctcgtcgcgtgaattttccacttttcgctcgaatcggataagtgtttgagcgttttatcattaagttttcggacgaaggtaaaatctgttcgaaaaccgccatcctccttaccttttgaagaagtgacgaggtcgaaatcacgctttaccttgtcgcgtggattttccactttttgctcgaatcggacaagagtgttcgagcgttttatcgttaggttttcggacgaaggtaaaatctgttcgaaaaccgccgtcctccttacctttcaaagaagtgacgaggtcgaaaacacgctttacctcgtcgcgtggattttccacttttcgctcgaatcagataagagtgttcgagcattttatcgttaggttttcggacgaaggtaaaatctgttcgaaaacccgccgtcctccttacctttcaaagaagtgacgaggtcgaaaacatgctttacctcgtcgtgtggattttccactttttgctcgaatcggataagagtgttcgagcgttttatcgttaggttttcggacgaaggttaaatcttggcgcgtaggatttactcaattgttatcgagtttagcttttctccgaagcatgcggagtgttttctcgattttctatcgagtttgattttcctctctgaagcgtgcggagtatttactctttttgctatcgagtttgattttcctctccgaagcgtgtggagtgttttc

SEQ ID NO: 58703 - DNA, 17497 bp, Oryza sativa
  unsure (1)..(17497): unsure at all n locations
cccttattttagagatgaagggagcagtacaatctaaagtggattattggcaatttggcacgaaagggggaaagaccggatcggagggggcatggcgccgccgcctggcttgcaagatgaagcccgtcgtgcagcgctgcggacactggacagtgctccacgcctcgattcacgggcgcgcgcgcgcgtggcctctactccgtcgaccgggcacacccacagcatcatcgatgatcgataaaacagtgcccggacgtttccccgctgttacactaccgcacgcccccggtcacgtaaccctgctgcactcgcagagtcgcagggcaccggcacgccacagcccacacccatactccgcccctgctgccagcctagctactctcacgcgttgcccgccccgtccaggctgctacacccacaccacccgcccgcggcctcgcccgcgcgtgcatgtgccgcgcgcgcgcgaggcgtccaaactacgtcttctcgcgtaaaagaaccgagacacgcatgaggcctgaggcgcgcggtggcgcacagctcgtgcgagcgcgttggggctttgcgggctatcctagatcggtgccgcctgatcgatgcccacggtctcgttggtgactatgtaagacaactagacgtgtctagaaaagcgagcttagctcctctcgccggccgagccaatctggccacgccttgctccacaactcgccggaccgaccaagcgcaaacggccggactgattgagctcgcaaacgtcagacgagcgctgcaccactacggacgtacgcgcacactagctttaggatatgatcggtgcgaaactgcatgctattcatttcattcctagagaaggatggatggaactagaagcgctatgtataaatctatattataatgtattcgtagatgaaattctagctaaaactactgctgcccagcttgcgattctcggcaccgtagtgctgattggtggatcgagcacgcaaacaatttctcggcatcgcgctgctattattgaatccgtctgacgtttcagacatgcgtacgtgtacgtggtgtactccgtgttggtttatgctcaactgaatatctttctttaaccaaacctgttatcgcagtgacgtcgacgtggttgaattatagctatacggccggttcttaattaactactctgtcatatttaccttgaggtcgtatggaattttgctggggaaatattcatatacaaggtgcttgaattggaagacacaatataaaagttcgagacaatacaagtccttccaataaacttattaattaagtactcttcaccaaatcacgcacatgatgacatgaaggcatccaactgaagcatttcctccaacctttttctatcattcctttggaagttccaatacgttttccctccatgtccctctcaatctaactaaaggatcattttcctttcagcttcctccaatttcctagtggagcacccaataacctcttttctctgatccatatgtgctaattttattgatgtgtaccactaatacccaacaaagcagcattttctcgttcatatgcactttttcctacctcttacattgcatatcaaacttatgagcacaggcacttttgctgttatagtgcatcatttgtggttcttttgcacttttaaaaagaaaagagttagcacctagatgtggtgcggtggtggtatgctctgctcaatcacatccatttctgcaccatatagaagatatttcctagcttagctagatatacatttataggcatgctaatgttgttatgtcgttctcactccacaggatgcatgtttacaaagaaaaaagttcgcacctataggtggttcattaatttccatgcagtacttaatttataggattattaactattgtttgtatattttaaccaacaaagatcatttccatctagctttctaaagaaagcccagtactgtaagtgtgtaacttactttttattcattcgacgcactgaggcaaaaagatagttttgggaaactattttaacagctcgagtggatgtccacccgtttattacatgtcatctaaatggttatgaaaaaattgaaaaaatatgaataagatagatcaatatgtaatgtatcaatccataaacatgcaagttaaaattcaacttctacagattgtaacaaaaataacaaataaaactcaaattactatatgtatatttacagttaaatttgttatttttgttacagcttgtagaagttgaattttaacttgcatgtttgtggagtgatatattacatattgatctatcttgccaattttttttgaaaatttttcgtagccatttagttgacatgcaataaatgggtggacatccactcgagctattagaatccatccccgctagtttttgtaaataaaggaaagacgccaaaaattgaacagaaagagggaaaagaaacggcgcaattaagccacaatatacaccgatatctcctagtagtatcaattgagctaattaagttcctctctaccaaatgaaatatagtaagcagtaagtactattgtgcacttgaagacactgatgatgaccacagctgtgatggcggttttccctttccggttgttcactccacgaaatatgcactacccgtggtggccacgcgcctgtctaatctttttatgccagtggccgcagcacattcttcagattaataaaaagaatgcgtcaagatcgaatcttaaaattttctttttttctgcctcccacccagagttggctatagcttgctagctagagccccaatgcaagccgatcttgcatgctaagtaaggactaaggagtaatatgctagtaaggagtaatatttgctatgcttgtcccttgttcccggcgcttgcaatgcccaaaagctcagagccaccgtgtgtgctagctgtgcgtgtggtgcttgctttgttcaattcattcttccttaatcgtgaatccgcactatctttagatcgaaatgaatgctactacgtaattaatctaacatataaccggggtggagtgtaaaccacgcgtgtatcacgcacagatcggtgttctgtgatcggatctttcgttatgcatcatcatcagcatgcatgtgcatgttcggtttgtgcatttgtaaactgttattttaaacgtcaacaaacatttgtttatttttctttcaatattttacagtacttcattcgtactactaacaacttaataatacacagcacatattgatatatacatataatggggtgatcattgtgtagtttggagatgagatagaatgacttagactatccctctttttgaatggaataatcatatcatctatttggtatgagcgtgtagtggtcctgcattttttaggaatcggatggtatgtggggtgatcctacgttattaagggatcgaccgggtgcggcccacatgttagtgagagagaggggtggattggattagtccaccacttaggtgtgatcatatggaatattttcttttggggaccatctcatcccacccatgctcaaacaaaacacctacaaacaccctgacggtccagcatgatccatcaaatccatcgaactaggtgtgtatcgcatgataacataatatagagatacaaccaggcccacatgttagtgagaaagaagggtgggttggattagtccaccacttcttgaggtgtgttcgtagggaatattttcttttggggaccatctcatcccacccatcctcaaacaaaatacccttgcaatccaacacgacccatcccatccatcgaaccaagtatgtatcgcgtgataacataatgtagagatgcagcctaacccacatgttagtgagagagagagggggacggattggattagttcaccactacttaaggtgtgtttgtaaggaatattttcttttggggaccatctcatctcacccaccctcaaacaccctgacggtccagcacgatccaccccatctatcgaaccatgtgagtattgtgtgatgacataatacggagttgcagccagccgtgaggcacatatgctttgtacacgacgagacgatggttaggggatcaaacgagacggacggcgagaaacgcattgtcactgtcacatcgtcgtccgggtctatctcaaagtggtcccggtccacgtcggcatccgatccacaagtcagcgaggggcgcgtggccggcacacgccgagcgatctgggccctccatttcgccaaccctagcggcctcacccgagtcacccctataaatgccggtggccgaggcgtgtggccgccacactgcgatccccatccatcttctccgcacacgctacactcctctcgatcgatcttctcctcccgtctcgatcagctgattcgcccagcctccggtagcttgcttgtgcttcgtatccatggatcctcaccacagctcccacgtccatgccggagccgccactcctaactgcacgtgcaggttgcccaaggaggaggatctagccgccgccgtcgtcgtcgtcgacgtcgaggcggctcctcactacacgtcgttgaaggcggccgaggccgacgtcgtcccgagaggagtcggcggcggcggcggcggtggcgaaggggacggtggcgaggaggtgaactacatggcccgcgcgcagtggctccgcgccgcggtcctcggcgccaacgacgggctcgtctccgtggcgtccctcatgatcggcatcggcgccgtgaacgaaaacaacaaggccatgctcgtgtccgggctggccgggctcgtggccggcgcgtgcagcatggccatcggcgagttcgtgtccgtgtacgcgcagtacgacatcgaggtgacgcagatcgagcgcgacggcgacatcgacggcgccgatgccgcggccgcgagggagaaactgccgagcccgacgcaggccgcgttcgcgtcggcgctggcgttcgcgatcggcggcctcctgccgttgctgacgagcgggttcatcaagccgtggggccccagggtcggcgtcgtgtgcgccgcgagcagcgtcgggctggccggcttcggcgccgcgggcgggtacctcggcggcgccaacatggtgaggtccggcactagggtcctcctcggcggctggctcgccatgctcatcacctacgccgtgctccggctgttcgcgacgatctttcacggcatgaacatctcgtcgtcggcgtgatgatgcgtgtgacgcagaaatcgatctatctggagatgaaaaagaaaataatcaaggggttgtgctagctagctgtttaattaactactcttggtttgccagtagtactgtacctagtggctgattattaactagcgaatccctggataccgaactgggaataatcagggggtgtaagtgtaatggttgttgtgaatttgtgatgaggcaagaccaggcaaatggtctcaaatgagaatattggtgttaattattgtataccgattcccttctcactttgcctcccgtttgtttttgatttgtctgtgtctctgtgacagttcagaaactagctgatgctcttggttgcgaatatccaggtgtgccactggcacgttgaattgtttttggttgattggccagcaaatgccaaagaatgcgttgaaggtgcagccgggattgccaatggtcaaaggaacttgtaccaatggaaaagaacagtttagaacacagaaaacaagaacagtgcacagattgtcatatgccccctcagagagtccagtaaaaggcccagttcatcttgggcctatttatgccacgaaagcccatcttcataaggaatataggccttcttcttccacactaaagttcagatttctttatatagaattaaagttacagacttgcgaaacttacactacagaaaattacttttgaggtgtaaaaaaacaagcactcgaccgatccaacgaaaatatctggtgatcacagatctgatgatctgttagcctcgagatattctgcacctgatttctcgatcttatagcatagaaaattatcaatccagtgacccggttgcacaaatggaaggtagaataatataagaaaaaggacgatacagctggaacgttgacaaaagaaagataaacacggttgctttcactacaaattaaaatggtataatactactccactaccaataaaagttccgctacaaccgtacgcaatattcagatcttagcaaattgaactggagagcatttctcaaagaagaaaaccaaaaagcctaactgaaagtctgaaattcaactggaatggatctctcgacgaaagatttcattttcttttggagtcctgaaagccaaaagagagaggccgctggttttgcgagccatgagcccatgaaggctacgcttcccacgggatcgtctgattcgtctccctcctctcgtcggttcttcccaacctctcccaacttctttttctggattcttgtggccgccacgcgccaccgcggtttttgtaccaactggggtacgaacgagagacgacctcgcgcgcgcggcgcgaaagtcgcatgtgccaacggcatcgtgccggcctcttccaccggatccctctttttctctatctctcgtggcggccacacgcctcttgctaatttaagccccccaacttgcacgtcggattcgtcgcgatcccccggacagatcgcgttgtcgcatggcggccacgcgcccaccgggtagtttattcccatcgcgacgaatatttcggccatgtttccatctcggagcacgtaatccgggatgctttaggtgaactgctccacgcctccacgtaccaactaccacgccaacgccaaagccaacgccaaagctcaccgtggtgtgtggtggccctttcttgatgaaagtcgtctgctccctgtacagcagataataatatgctcgcggttttggcgcgccttatgtttaaaaagttttatctttgaagaacagataataatatgtttgaggtcgtggctggcgtgaggtttatggaaacattatgtttactcttggtcggcttatttttatatataagttgggacagctggattcttatgatatatctagattagtcgtcggtttgcttgttacatgtataatagtttaaggctcgtgagtcgtgatgtcctcgagcttagctcatgtgggcgtggctaaggctccaaatgagctaggatgagcatatatatgcaaaagttcatgagcttggttgtgtgatgcaaataaactataagattaggtacaaaactagtatttatctgcataataaaatagtatgtaggagtgtaaaatatctttcatagcatttttcttgtttgctaattttaaaatttaaattgtggttttcctcctttttatcatggattttttttctattggatacagatattatctcattaacaagctttcagccaagctcagatttcaaatatgttgagcttgagcttgcttggaagcttgaagttcatagtaggcttggcttaagttttgcgctgagcttgatcctaacaattgggctcactcaagctcggctcgttaacaacattcatcacatgaccaggcattataaatatataatagtttcaatcttttcttgacgtccataacacggtagttttctttactccaagttgagttaaaattattcctttaagttctttaggattaatcagggagatggattctaatagctcgagtggatgtccatccgtttattgcatgtcaactaaatggctatggaaaattttcaaaaaaaattggcaagatagatcaatatgtaatatatcactctacaaacatgcaagttaaaattcaacttctacaagttgtaacaaaaataacaaatttaactgtaaatatacatatagtaatttgagttttgattgttatttttgttacaatctgtagaagttgaattttaacttgcatgtttgtggattgatatattacatattgatctatcttattcatatttttttaatttttttcataaccatttagatgacatgcaataaacgggtggacatccactcgagctgttaaaatagtttcccgattaataagtggtgaagtgaatgtaactcaacttgttttgttccttatggtggaacccattacccacccaagttcaagtcctaaacttgacacaggtgtttgtatttacggctaattattctttcagtgataggcgatacacccatcaacagcgagatgtccgtggtaattttatcaattttaagatatagcaatccactttttggatgtgcttataggggtaggatgtacgtgtgtgtgcgcattcatagggataagggtgcgagcgttgtgagcgactgcgttgtattgtatttctttaaaaaaaatccttactaagtgggtgttgcaaaatgtggaattagtgattttctggaaaatgaatgtggccttacagactttgtggctagctcattcaaccatccacgattccaccgtgtgcaagagttatttattttgtcagaaaggtaagagcaagctgttgaactttcggttggacgctctgaagtctgaactggtcagtgcgtgctggaatagccatacggtgcaatgctccgggtggacttctagtctaccccaataaaatggactaaactgggcatatgaagaaagagttggacaaacataactgaaagagagttggggttatgtacgtatgcaaaactgtgttctgctgcctgctggtgtggatatttcgccaattggatacgaggcttgctacagatcaagctgatctttttccctattcatagacatggatgtgcaaaagcattgtcactaattactgttctggcttggatatcaagatattgtatgtcttgatattacagaatccgtatggttttttttttaagaaatggcaggagctctgccaatcaaataaaatgaggataagagagtaccaaggccggcccctttagatcacaccagtatatgttcatttacagttgttatccagaagccataggaatcagataagggattgttgtcaatatgcagaattgctaaattaagaatgtaataagaattggagcgctaactgtatattactcttagctttatccaaagaatactggatgtattgtaccatctaataccccctaaacaacacccatatgcataactaaaaaccagaaaacaacaaccacttggatatctttgcaatcttttgtgcttcttgcgggggaattaatgggcctgtaatatcataaaccatattttatttctgagagtacataatattattatccatgacaatggcgcttgtaagttcattaatatccattacataaaaacaaaagggtaagttcaagtggaataatctctccaactgtaacacaaagaaaaagagagatactcctagatgagttttcagttcaggctatttgattccctctgtcttccttgtgctcacacacctagtactacacgatgcaatgctcttttacaacaaatattcttgtggttgccacgtgcctcgccagtaatttagaggctaagattctagctatgcatcgaaccattcaagccttcccgtgtcagccacgcgctcgggattaatataatgctaatatgtccatcacatgagctggatacatctaacttggccatcctccttttagcacccatttgcactaattagtccatccttgacttggaaaatttgtggtctttccatagccaaatgacaaagaggtgacaaaggattaggtgagagtttacctagcttgtgccatgattataaatagctatgagcccctagatatgttctgcccataccattaccatagacgcaggtctttctcaggaagtgaagagagcagcagagttgcatatcttgcagggtttatcaggtaagctctatataggtggcttcttctcttctgagctcttcatttttatttgattttccttttgctagtgtcatttttctgcttctagaaaatggagaatactcatgaatgtcattctgctcctgtttcaatacaagtccttgacctgttctctaactaataaggagctaggaagctttgatctgcagaagattttccggcactatacggcatgttgttgatcatctgacaatgttgccacaatttcatgaagttctctctgtaacctttgtttctttcccaatctaacaaaatctcggccggcaatcttcagtcagcccggcgaaaacacgattccatagagtttatcttgcggttgaatttccaaaactgaagaatttaatgccgatctttcagatatgatcagtatttcaaccatcggtatatgaaatcagaatgcgctaatcatcagtataagctgaaatggaaccaataatgcatcttactcatgtgcatttccttgtctgttataaaagttatgccctttacagctttactaatgtctaatgcatgaaatagcagaaattttctaacacctggtgctactgtaatgcagtttgcggcgtaaaaggagcagtgtgtagcaattaactgaaactcaaatcgtcgaccgctaattaactgaggtattcagacaaagaataacaggcatcatgcaacggtggacgcgcaacgggatgctgaacttctcgcagccggcgtcgtcgtcgccgttcggattctacgacgccggccacggggcgtcgagcagcggcggcagccggtcgcacggctgcaggagccagaacaaggaccagcgcaacctggagaagaacctgaccaaggtgaggaaggagtggatgaaggtgaaggaggagatgggctacgcgaggctcctcagcgagcacctcagcgagacggtgacggagaccgaccggaaggtggctgccatgctcgaggagctcgaccggacggacaagtacatgcaggatatactgtcgtcccagcagaaatagtagtgacccatgacatcagatattcagatgcgtattttgatggatttctatgtatttacctagcagctagctagatcgtcagcttcttttctgggcatttttgccattgtggtattcggttttttagcagatcgatgtcccggtacagggtatatataaatcatatgttaccgatatgttctgaaatgtcgttaaaattcttcagcttcgcctccctctatacatgccacttccttggttagttggtttgcttgatgagtcatctcatccgattacccattacgtaagataaaagctagcagcatatatatgccattaatctgcacaaggagcaagtatttgaaacgcaggaatttttccggccagttcttctgaaaaaacaaaacaaatatatatagctaggttcttgtaaaaaatatttataaaaaaaaactgaagttattgcgtttcaaagagaacgaggtaaccatcgcgttggatcaagttcctcatgtattttcggagcgattagctttcattagatttaatggcacgcattgtgcgtgctgatcgaacagtacaacctgtactacacacacagtactacgtggtagcagtacaagaggactctataagtggaagcatggcaaaggcgacggactaactttgacccgaccaacaaatccccaattagcaaacaagggaaacgttagccctttctcttcttctctttaccgtgcaagctaagtccaggaaagtgaaagctcagggtgtcgattacatcatagctgacgatttctggggggtggtacgtagtagctagctactcctagctggctacccctctctcctagcaaaaggcaaatttatctactccgtatgtacaattgtcaaacgtacgaggagacagcaaaaatatatatattgtgtgtatgagtgcgtgtcgccattagtctaatgggtgcgacttgattagtgattacccacttgggaaggcctcccctgcattatgccattaacaaaatcaactcgacgacgtcaaaaccaggcgactcaccccggcctaggacggagacgatacggtgggcgccgtgcctgacctgacgcgcctcgttccctctcccgccgtattcaaatgcaaatggcagcacgggctgggctccatgtacatgtgatgtgagcatagtttattttttgatgctccctccttgttgatgcagagataatgagtatctcgtgcgtgtttctccggaaaggtaatttaatcccgatttggccttggatgggccagagatccacgtacttggatgttggctcccgctttattttcttttcctttttaaacactaattacgtttttttttgagaagggttttaaacactaattacgtaagctggaccccgggtgtttctttcagaagtaagctgggccaggtgtgcttagtctctggcaggtcaggtccatctctaccccagcacacgcttgctgttggcacggacggcccaaaatgctgtaactctactcccgggacaaaagcccccaaaacatcgaaatgggctgagaagcccatttttccaatccgacgagtgacaccacatctgacttctgaggaataagttcactttagatcccttaatttgtcgtctagtctgaaattcatccctggatcgtaaaaccaaatatgacgcgtccctcaactagcaaaatcagtgcaaataagatcccaaggtggtttggacgacgatttcagttgacgtgacgcatacatagctggtttgacttggtctttgtcctacatggcggtgatgtggcattggaagcaaaatataaatttcatttttataaaaaatgtgaggcccacatgtcattgggtcccatcctcctctcaatctccatggacggcggcgccgaacatgggcaacgcccgctcatccccgacaagtagaggatagcggcggtggcatcctgccccacccccaccacgaggggaggagcggcaggacgagggatcacctggcgacgtggaggcggtggtggcatcgatgaggagggcacaaaatctgctggtcgtcgtccgccttgacctcgccgaacgtgccatccccattcaacctccctgcacccctcgtgtcgtcctcgacctccacttccttcccccgcccgctctcgagcaatctcggtgggctgaccagatcaaaggcaacagtggtggtgagttggggtccgtagcggtaacatcagcgaggagggagtggtggttgagggggagacaatcatcgtccgcttcagcctcgctgaccgctctatccttagctagcctccccgcactctttccctcccccctggcgtcatcctcgacctccacttccctcacctgctcgttctcaagcagtctcggtgggcggaccagatcaagacggcggtggctgcgagttaggggcagcgatggtgacatcgacattgacgaggagggagtggtggaggggggagacaggcaaagaggttggggacaagggagagagattggtcggagggaagggtcaaggaagggtggaggctagcggcagaacacgtggcgtcgtctcgtcgatccgggaagcggcgacgacgacgcccatggcgagttccattgattatgaccaaaggagcaaggtctccatctcctccctttcaacccacggtgataagaggagaggggagaagaaggcgccgccgtccatggagaagaggagggtgagacccactgacatgtgggttccgctattctgttttaaatgccacgttaccgttacgtaggacgaggatcaagtcaaactagtcacgcaggtgccacgttcgtcgaaactgccatccaaaccaccgagacaaatgaatggatctaaagtaaacttattccgacttttaagcatcgttcatggtagactatttcacgtctaaaaataatcataagagagcgatatataaaccggtttgctgctgcgaattcagttgccaaaatcaaaagggaaaattgtaaccatcacgagagattctgaaacatggatcttgtggtgctgcagcctcagcatgcagatgtacgttgtcaaccggacggtatctcaaccggtataatctgtatattcttgccgtgagcgtcacccgttaaaagttcccatcgaactgagatacgtggcttctccggtatctaccaggcttaatttctctcgcttcaggtagagctgccaactacgtggcctgatagcaggccatcaaaatgtcggacgaatgcatccggtggcacgcgtacgccgtaaaaaaagtggcaactatagtagtactattttgccaagcgaaaacacgcgaaattgggtgaaaaagaccgagaaactggcagtgggcgcgagtgggtcactggctcactgcgcgcggggcgcggacacgttggacgggtggagccgtgagatgctctgtgtggtgacatccgaagcgtccaaacctgtgtacatgggccatggcccatggggctcgtggtcgaaaatgcagagacgtgtctgctttgcctgcacttttttatgctgctctgttttacttactgctccatcgctgctgattacctgtgcgtgaattgcagtacaacatgtcagtttacaatcgagttgtattctcatagtttcatgttttttcttggatataaagacgttctaggatgacatagcattttagtgcagtcataacctcgaaattacaacatacagtactaaattgaggacaagagaaaatattttttttttatttcacagtctggcttggctattggaaatatcatacagtgtcttcactggaataatgttatttcgcataatcattcgaacaggtagccaggtaggactggaaattctggaaagaaaaaaaaagaaaagggaaaaaggagtagttaggcgggcagtctccggaaatgaggcgccaatccaaaacgtgagacgggaaacgatcctcgcagccccgcggctgacattatcctcctcaccatcatcgccaccatccgcagcagcagcagcagcagctcgcgcgcataaagccctccacgacatccgcacgctcccgcggcgcgcgcaggcggcaggctaaggcaaaaggcgaagggagggagagctagagctagcgctcgcggcagaggcaaaggacgagaaaagccggccacctccgcccgccgacagccatggcagcaaccgaggcgccagtgctgcgggccgccgggcccgcgcgccggccggccgtctccgccgggtccgcctcgcgcctcctcctcggccaccgccccttccccgcgccgtcgcccgcctcgtcccgctcccgctacgcctcggcggtggcggctggcgtccgcccgcgcccgcgcccgcgcccgcgcaggccgcgcctatcggtcgtcgccatggccggcaatggtgagcgagccacagtctggcgttacttgctgtgtttgttccagttctttttttttttgaccctggacgtggggatgatggtctgcagtgtaaagtgtgcactgacggtgttcgatgaaatgggccaaaaggattatctttcgttctttctcagagttgaagatgattatcacgcagtattatagaatttaggagtgttctattggatagtgtattagttgatcttttgctactactagttttgcaaaagagaaggttgaggcagcatgctggcgaccgtgcttaggattgttgatgggctgctgctttgttagataaaccattgatgaagttgcttctaactaaagagtaattggtttagaagctcttctggagctcataactactcatggcattgatttctgtaaatggttgttgtagtactagaatatcttcccaatagaacaaactgagaagcaaggaatagagagatgcgaggatatggctccataaacatctaaaatagaatatacacatagctatgtaattaaatgaatgtcctctccatgtttgtgtagttagcaaaaagaatatggtcgatggcattttgctcttacacaatagacttgtatgcatgtaacttatcttgtcgatgcaacatattgaataaatgctttactttcttttaattgctgtcttttacgcatctcctaatgaatattgtgcagaagtgagtttctattttgcagtaaagtttgtcattaagttaattacataagatctggaagccaagtctcttggattccttttcacttttcattttgtagattcacagttttcaaccaaaataaattacattgctttcttcaacctatcgattacattaatattgacatattttacttttgtatacagatcggcaagtgcctttgatggattaccgcaatattggtatcatggcacatatagatgcaggaaagacaacaactacagaacgtgttttgtactacacaggaaggaacttttttaatggtgaggtccacgagggaacagctacgnnnnnnnnnnnnnnnnnnnnnnnnnnnnnnnnnnnnnnnnnnnnnnnnnnnnnnnnnnnnnnnnnnnnnnaacaaacatagannnnnnnnnnnnnnnnnnnnnnnnnnnnnnnnnnnnnntcttgaggttgagcgtgctctcagggtgttggatggagctatatgtctatttgacagtgttgttggggtagaaccacaatctgaaaccgtgtggcgccaagctgataaatatggggttccgagaatatgttttgtaggggttttaaaannnnnnnnnnnnnnnnnnnnnnnnnnnnnntttagaactagagacatgataatcgcaaatttaggtgcgaagcctttggtaatacagttgcccattggttcagaggacaatttccaaggagttatcgatctagtcaagatgaaggttattgtatggacaggagaggaacttggtgcaaaattttcttatcaggatatacctgctgatctccaagagatggctgatgactacaaagctcagatgatggaaactattgtagagttggatgatgatgttatggagacttatctagaaggtggcgaaatagacgaggaaactgtcaagagattgatccgaaagggaacaatatctgccagctttgttcctgttctatgtggttcggcctttaaaacaaagggtgtccaacccctgcttgatgctgttgttgattacttgccatcaccacttggcctaccaccaatgaagggcactgatccagaggaccctgaactgatccttgaaagaaagcctagtgatgatgagccattttctgggttagctttcaagatcatgactgacccatttgtgggatcattgacatttgttcgcatatactctgggaagctggttgctggttcatatgttctcaatgcaaacaaagataagaaggaaagaatcggaaggcttctagagatgcatgcgaacagtaaggaagatataacagttgctgtggcaggtgacatagtagctcttgctggtctcaaagatacaattactggtgaaactcttagtgacccagataagcctgttgtgcttgaacgcatggaatttcctgatcctgtcat

SEQ ID NO: 58704 - DNA, 3594 bp, Oryza sativa
gggtgcgtcccgggtctcgccgacgcctacgagtctgcctgtgccgggaagacgccggtgcaagctgagtagtgaccggacttgggggagaacaatggaggtgtgtatgtgtgtgtgtctcacttccattggataacttcattctactgatcaactatagcagggatggcagattcaattcatggtcattttagtgtaggtttcttgcagttgacaaggaggtggatgtgtataacaaccttgagaactgttcagttgtggttgaacaatgttcagtgggttttcatataaaatctgtgagcattacgtctcctatggtactcattttctttgttacaggcttacactctagctggcttctggcatgatcagcgatcacgatgtcctgatgtgcatcttccaattccaagttgaacgagagaaagtgaagaaccatctgagcaaagatataactagataaattgcgggactagggaagaacactctacataaggagatggaaaaggttgatctggttctcagcaaatcatcagaatgaggagtgttcctctacggcatagaacaagttgcggctgaagctttagaagaggttatttttcaagctgttcaactggataggcagaggctttcctatcgtatactagcatgtttcttggattgcatgcctactgttgcaaagcaaaaacttaggcaacccaagattagaaaaagcactactccatatacttcattcacccgtttctaaatatttgacaccgttgatttttttttaaacatgtttaaccatttatcttgttaaaaaaattaaataattattaattcttttcctatcatttgattcattgttaaatatacttttatgtagacatataatttcacatatttcacacaaattttcaaataagacaaacggttaaacatgtgctaaaaagtcaacggtgccaaatatttagaaacggagggagtaataaagagagtgaaaaaggatgccgtggagttgagtaggcccaacaaatccgggatttcatgggttacagtactttgggctaaaattgtgttccgtaggcccaagatggaactcgatcacgggccttatttcttcttcccgtgaagactgaagcccaaatctccctcaccacagggcacgataccgccgtccgttcgcggcgcgacccttcgccgccgcgccgccgcgccggcgctatgcagcgcctccaaaagcagctccttcccgccctgcgcgccgccttccctctccctgcctcccacttcagcagccgccttctctccgcctccaccgccaccttatcccccacccgcttcgtcgacgaggacgccctcgtcgccgcctgcggcctcaccggagccgaagccctcaaggcctcgaagcgtctacagaaggtaccctcaaatctagacgccgccctcaccttcctcgcctttctcgccgacttccgcctctccaaagacgacatcgccgccgcaagctcacggtacccgcggttcctccatctcaaggtggacgaaaccctaacctcccaagtagcccggctccgggatatcggcctatccactcccgagattggccgcctcattaccatcgccccctgcatcctctccaatcctcgcacgatctcccgccttgaattctacctctcctttttgggctcctaccccagggtgcactccgcccttcggaacaattcctcccttctacggcgaaacaacatcgagagtgaggtcaagcccaacattgcattcctggagcagtgcggcctaactacttgtgatattgccaagatcctcatgtctggctctaggatactcattatgcagccagagcatgtcaaggaaattgtggcgtgtgcagacaagttcggtatgccccgtgagtcagctggtttcaggtatgccctgatggctgttaccggcatcagcccagtgagggtcagcgcaaaacttgatttcttgaggatggttattggatgctcagatgcccagctacacattgcggtgtctaggtttccactaatcctgacatactcagaagttaagctgagccgctcactggaattcctgaaagcggaggttgggttggagcctcagtacattgtgctccggccagcattgctcggctatagcattcagaaacggctgatgccgcgttatcatgtcatgaaggttctgaatgaaaagggcctgctgaagaaagacactgatttttactctatggttaaaatagttgaagagagcttttttaagaagttccttctcccataccacaggtctgttccaggacttgaaaaagcttatctggctgcccgtgaagggaaaatgtttcctgaaatctaaaacagagatgctggaggtttattctgcctaggaacttgataatgttctgcattttacatcttgctcagttcttagatgatttctagcgatctgtatttgtgatttcatctgtgctttttgagacaaacatctaattttagtgcactcttgttctcattttaatgcctcgcacaccacaaggatttttgcatgcttacttaaggaatgttttagcctggagttgcgctgcaatgctgcaatttgtttgtcagccgatgcttctgtatgatttgaacagatctatagccagctcatgaatattactgtttagtgcattgacgacttcagtaattgcgccggtttgttaatctggttgtaccagagtttattggttatacccatccgtagaattatctatataggaaaccaaataagaagttgctttttcaaggtaagcagttttacagcacagaaaattttctcctgttttgggggagaaaaaagagagaaatgctggtgatatttagttgatggtcctgctttgaagaattgaagttgtggtgtcatgtactccctccgtttcataatgtaagtcattgtagcatttcacatatatatctatctagattcattatcatcaatataaatatgagaaatactagaatgacttatattgtgaaacggaggaagtacaaaatttggtagagaaatggagagttccagtatggtgttaacacaagtctacaggctacagctaaaacccagcaaggaggaggaaattgatagaatgcaatgcatagagttggctttgatagggtgtatccatgttttgaaatgctacgggatttcatagagcacgacattcaatgtttacagtttttctgatgggtcgttccgtcctactgtatatgggtgctagaatctaccacggggctgttcagattgttgctaaaataaaccctgtattgccaaaaattttaataagttggtaatattatcaatttttttttgagaataatattatcaaaattttggtagaatttctcatgtgtttatcaaagtttagcaagaaaataaatgtatgcacacctttgtcaactttaccaaaaattggcatcaatctgaatagcccattcaattttgggttaattggatccatgccactgcaaatgtggcaaatcagaaaaatgccactactattcacgttatcgggtagatgcccctgtaaatcttctaaaattagaaccatgccactccatgatt

SEQ ID NO: 58705 - DNA, 4892 bp, Oryza sativa
attccggccatactagcagtggcgggcatatgcgacggcgacggcaggagagggcaccggcaggtgtgggcgacggcgcgcggtggcctactccttgctcccccgcgcacggcggccccctccggcggtcgagacgcgggatctagcaggcgacggccaacccccacaccgatccggcggccgaccaccctccctcgcgcgggatctggcgcgcggcggcctccctcccgacggcggggtacgcagcccctctccttcctctccctccggcgtggtcctcgtcccaccagcacggtcttcaccttcatcgacaacaacgaccgagcacctagccgctcgccatgggaagttgttgatggggagagaggagagaatatgcggctaagaatgaggataagactgcatcgatacgttgactagagaggagaaaaggacgagggagaaaaggctcggtgggacccacctaagatgaagagtccaatatttccttccgcatcgcatggtcgattggaagcattttcgaatttacacggtccaaatttttaattggtaaaattgatgtttcagttctaggttattttttattctatgtctaaaaatctaataagcatgaaggggatgcattattatagatgatcagttagccatgatttttattcatgaaccttctctctcttttttttcttcagattctacctttcatcggattttttgcggtaacaatattcttcttcaactcaacaataccgattatattgaaggtactaaccatgatcctcttgtgcacaaattcataaaattcctgaatgttgtatgtaacttcagatatgtgggctgaatgcttcagatatgtggggcaacaatgctgaagctcaacctctcgcttttgacctcggacatgtgggctgttctaatccttatcttcgcttaccatgaggtctctgaacatcaattcctccctccataacctcatgccaatacttcaatcttaaaattgaaattgatattaatcaaattttgagcatttgcaggttgattggatttgcttcgttgcttttgctggcatggcagctggccttgtcatctactcatacaagccttccttcttcatctgccattgcttctgaacatgcacataagatacatacttcattcataccaaaataaatcaatttctgaccacaaacctacacataaggaattgatttattttgtgacggagggagtagcaaccagctgtgacgatgtcactactcaccactgagaactcttgcaagcaggggctccaaggaggcggagagtcggagacgatgatgaaccagcctccaataaggaggtctcgtcgttggttgctactacctcaaggtagtagtaggtaggattctgtctgctgcatctgcacacaattgtgctgtaactgaaaatgttttactatgtacagtgtgatagctggttcataggggcaaggtttggtgtgaactgtgatgatgtgtgatatttttactgtcagataagcaagatagggttaagaactagcataggtttactgcataatttaaaagtatacgtgtatcatgtctgattttactattgttttgtaatattggtcaaggcttcgtgcctgcctgacaagttgtaatgcaaaagattcagagaaatttctatggacgatctgatgtacagagtatttcaggcagtcggtttcagcactgtgccagggacaaggtaatattacactgcacaattgatacataaccactagagggaaatccagaaatgaggagacaaacaccctgaacagtaatgcacttgtcaacagaccattcctacttcacaatcatatttcattttccataaaaaatatttcctaaaagaaaaaggtcttaaattcagtatgtaacaaggactcaccatgaaaaattgtgttagcaaaatgatcattacgaagtgacatatacctagctataaagcccccaaaacaactcatataagggagcacaaagttgtccccaaactagcctcaagtcatctatcatcgatcttgacattattcagagccaacatcaacacctttctttgataggaattcctttgcctccaagatatcctgcaaattaagtaaatacaactgagaatagactaataatttctttgaagcagaatggaagtgtgaattatctcaatatcagttgggttgtttcctttgaatcatgcaacggcaattgcgaagattttcatgttaccatagtgcaaactgcatactttaaaaatattcatttacatcacataataataccttgaacacccatttctcatatcaacagagaataaaggggggagatagagtaggaagtcgaaaattttcactggtatatactaactaacatcttcaagtcatagaagtcctagtttcaaactaattaagatcatcataggcccatgcacagaaattttaggctcatggatctagaacaactaacctgctgtagtagtacagcttcttgcgggcaagttgggaagaacataagcccaaatccaaccataaaaaggccatagcatccaagtgccactaccaagtagatgggaagctacaataacaaaaagtcataaataaagcccttatccttaatcatcttgcactacaatcatcaaggaaattgagatgaaaattgatagcactgaccaaccaagtataacttcgaggaacagtcgcggtttcaagaagggcaatccaaatagctgagactgccaccagcatagcaattatcttgaatatgtgcttcatttgggaaaccaagtgttttctgccaagataaaccaaatgagaacggcaaataaaatgtgcccgaatgttacagtctcaaaagatgaattgcaagcataattgcactagcaattcagtatgctagcactaaggcagacccatggcgagtaggaagtccagcagacttagcacaagcatgaaggggcggatccaacttgggacacggggattcagttgaacccctaaactttttggggaacaaacaaactgttacttgtattaaggttaaggctctgaaattaagagaagatattcttccagatctagaagagaagctagggttaacggacgcaagcaaattccagacaaaagtactcccggtgggagagagagataaatcggaaagaggatgtggatgctcaccaggatcccctcccctcccgcgccctgctctgctcgccaatggagatcggcgcccctcccctgttcagccgcgagatggcgcaaggagcggaggcggcgacgacgagacgggagattttgttttacgccaagggaagggggagataacggagtgctccaccttttatctcaaaattttcactttaaaattctttacgataactggtaaaccacttgccagcagtactcacgacgataaacttcttggatccctggcaactaactgtcgctctatacaccagcaccacaccatcgttactccactctgccttcgtatgcgcagccatacactttaaatctcgacatgtattttctcttccctcattgttatacatgttattgtcatggtcgtcgttaaggatgggattgttgggcttacagggctcggggaggcaggagccaacccaacagaaagcgaagatgctagatttggactcctccttactatatccgacgattccccaattgtcgaaggaaaaaagaaaaatgagagagagagttagtgtgcagagtgattgcagagtcactgatttggaggtggagcgatggtggagtcaccggacttggagtttgatggatagaatgaggtggtccaaattgtaacaaaaatgtaaagttcgtttttgtgtagataaaaagaatgtttaaaggatgatatcacatcaaaacttttaaggatacatgtacaaattgtaatttatttatttttctctagcacaattaaatatgagttatctattagcaatagtctcgtgctatggcaagcccactataatttgtctccacggtatgattggagatatattgaaatattatgtgaattatgtgggatgatgattaaacatgcttgtattaaaattaataaattataaaattatagataatatagcatgcttacatgatgtttaagatgtaataattgttagtggatgatgatgttatgcttttgttagtaaccctctgttaagtgctataaatagactattttaccgatatgaattgttgaaagatgaataaaaatttttactcttttaatcaacgtaaataatttagcgtaaagagcaaactacaaattagtgtaaactaatggaaagagtaaaagttttagtgaacttttaataatttgtaggggtaaaatgattttattacaacactttacataggaatgctaacgaaaactcaataatgatggcatttctaaggcaaaaacgcttgtacttagaaagttaagtttatcgatgacatttattagattttctctaaaataattagattgtgcttctcaagcgcatgaaatgcttagcagacgcaatggatttggaggtggttccggttggaaaccggatcctctgagggacgtccgaccatgctgattcgttcgatcggcatcggacgggagcgatggaacacaggaacgaacaagctaagctgtcgcggcccacgtaagaaaaatcggcccacgaagaggcttgactgccgtccgcccgtctccactctcgacacagccggagcgccgctggaaggggaagagaaggcaagcgctgccagtcgagctccggtgtgaggaggtcgcaggagtcccgggttgaagtggccttggctttgtccggatcttccctgcgctccccggcacagctcgcgcgcacggccgcatgtggtgaccaag

SEQ ID NO: 58706 - DNA, 20155 bp, Oryza sativa
tccccacgtggtagtggcgtgtgccgccccctcgtcgccttgccttttgggtgggcccccagatggacggcgcagatgctgatgaggcgtgccgagcgcccgcagcctgtgccagctgttgagtgacgtggtccctcctatgatttctgagtataaacttttttaaaatttagaacaattaaggaccatttggaatgaatttgctggttccacaatcagaccaagtttagttctaaactttatgttcaaacttttaactttttcatcatattaaaatttttctacacataaactttagtttttccgtcacatcgttaccatttcaaccaaactttcatttttgacatgaactaaacacaccctcactgtggaaatgaaggctgctctgtatttcgatttcgacgaattttttttatttgagttagtccatttaagtttgattaataccactccgtgtgattgattctttagcaaagtataaacgaatcgttttttttaaaaaaaacgtacggaatagtacgagatgtacgcatgcctgagtattcctggctttctacgttgtctctagagtccacagttccactctccactgtatttgtactcccaaacaacgtgtcaatttcattgcacgacatgttccgtactagtatcactgtgtatccaaatccaatcatcatatggcaaaaagagctaaccgattagacaattcccgtgtttcttaggcctcctttaatggttgagctagtgtactagctcatatgcttgtccacctcatataaaagatagcaacaagtctaactctctaataaattgtctcatagcacattgtttaaaatgttttggtttcacaattcctctcgcattttctttaggagcttagctcttgaagaagagttagtgcattctctctccttatcttctctctcttccacatcatacaaaagctgatgtggaaatttatgagctagctgactcatccttgttggaggaggccttatgctacctgtcaaacatatttttgccaatatatcgttccctggatataaaaaatcagctcccggcgcagaagaacggagcgctggcttctgcttgattacggttgtgtttagttccgtacaaagtttagattttggttgaaattagagatgatgtgactgaaaagttatgtgtgtatgacatgttgatgtgatgaaaaagcactgaagtttggattcaaactttagatctaaacacagcctaccgagagggaatggaaggaaaaaaagaccaagccaggaaagacttccgctgctctccaagactcggcacgctagctagctcttcgttccccctcgtttgctctgtacgaggcagcagctgaggtgagcgtcacatgccgctgaactcttctttttctcggtcatatggactcatgatgcggaagaccaacacgcgccgcacaaaaacagaagcgacgacgcatcacgcatactcctatagcctaggaaaacatggtccctttgttgttaggcctaacatgggtgctagtagtaagattttacgggagacggcgtgttttagcatgggtgcagcaactgtgcaagtcctaatcaccagtttgtgcttgtgcactcgactttttttgctgatgaccacgtctacgagagtccgggctatagctgtaatcagggagcgaaacggggaaagtgaaaggaaaaggggggcgaaaagagattcgccccacgcgcaggcaggcagcagctgcattgttgctgttggttgggaaaggtacaccggtcggcgccggatggctctgcttgcaaggacacgtgttgctgctacagggagagagacctttgatcatcctcggctcatcgccctttcctctccagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccgcgcggtttggcgcggttaccgcgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttctttttttttaaatttttaaatttggacgaattttattaaaccgtaccgcgcggtacgggtaaccgtacccccgcggtacgggcggtaaccgcgcggttaccggcggtttttcacaccctgttcctctctcgcctttgttaggccgaatgggcttctttctctctgggatttggacggtgcagaaaacggcagcccttttgggaaagctagtcctctctctttttcatcaggatgaaagtagtcgtactagtgtttagggggtgtttaagaactagagactaaactttagtccatatatccctaggagagggacttatgcttttgtgagatgggctaaagtttagcccctctctcccaaacacccccctactgtttaaccttctcaagtaaaatttctttattggagcacatatgctaacgggagtgatgctctgtttaattctgtaagagcaggtacaatagcaagctataagccaactgcaaacatattttaaggagataaatcaggagagagaagagcagcgggctacagatttgtagtcagctgtagcacggaccccaagacgcagtgtgtctatgataggtgggactatgtattaatagtatagtatgtaactattgtatgaatgagctattagattggctatagatgaattggagctagtagttggctatactattgaacttgctataagagcaggatcaataataccgcccgttgctggctataaaattcaccatgtcatttaataggctatatagtatatagatgtagcttgcgttttcttccttgggcaggccaaaagctgcatgcacaaaccgattgctgttcaatcaccatttatcctgaacagctagtacccaatcactatgcgtaagcaagggtatggccaattacagtaaattcacctagtcttggaggctacgtgcagccggcgttaatatagtcgcccgcttaagttctctgtccttgattccctccgccaactcagctttttgccatgatggatatattatagcctgcttaattctcctattgtacttgctctatgagcttaagttcctgtgccgagagatcaccagattagagcaaggctaatggtatagcccgctgctggctaatagcctactcctaaagccaactataagtacaataacttgttcattggatgactacatcttataatcaagtaattaattataacatgcacatgtcaatgtgtaggatcaagagtgaattatatctctgtagccatttgtgttgtgacatgaattttattcatcaaacactaccactaccatataaaccaagttctatgtagtatggaaactacaagcactaatagataactcaaataccatagcaactaactagattaacccataatattattatcccaggcagggaccggaccgtcgctgcctttggagcttctctcgcttcgtctacgtcagggacgcggggtgccatgctgctgcacctagctctagcgctccaggcagggccgcccggcatgcgtgcacctgctgtttgacaaggacgacgtctccgtgcccaccgcttcccggcctgggagcacgccgctgcacctggccgcccacgtcggtagcctgacagcatccagagatggcgcgctggagggaagcggagatcgagcgagcgccgaggagacagagatcgcgcgccgcatatgcgtcgatggggaagcagagggagcgttgcgggatcggctgtggtgtgcgccccacaaaccgcgttttttatcgccagggccggctgcaatcgagcggtagcgcgtcgagaaaagtgtatcgcccgacgacaaattagtcatccgcttccttctctctcatctattctctcttccctccacataggaataagatgatgtggcatatttttgcagcccgcatagccagcttattgcacctgctcttagcagggctgttatgattagaaggttttcttatattctgagaacttttaattgactctgctgctccgtgaatccctttggagaagcaggtggccattgattcgccagcacagcttgaaagttgacaagaatcatggctcgagtccttccctgtgacgtatttaaaaccttcgctttcccgggtagctggctggggaagacggccacctggctattttctggttgccacagccatttgcacccgtgaaaataaaagctaaattcaacgcatttaatctttcttggtcaatggtcagatatcatttttatttctttttttttcatttttggatagagatctttgcatttcagacatgaaaatttttatgcgtgcaaaagtcccaaacactatacaccatataaagacctatgaagttacaccatacaaggacctaggaagattttctagaagataaagaagatatcgataataaagagtcttattgcaggggataaaaaggataagatatttatttatttatattttatccgggaagtgttcgtgcacgtttcttcatgtcaaatactcaaatacaatacttgatcaatgcatgtacgcttcttgatgcatcatgtatatgcgtgccaggtagctagatgaaagctgaaaattgttttattatattaattattatcatgttaatttgtgcacgtacgtctagctctgcaccttatataattcaaatcgattttgctatatatttgtcgacaaatttttcccccaaaatttgacagatgtaattacagtacaatcgtagtgtaattacactgtaacttgcatgtaattacactgtaactatagtgtaacttgtatgtaactttcaaaaatctctccgttacatgttatttcggtaaaatggaggtcgtgggaacaaattctttcacatatgtgtgtgctatgatttgttttctttctcaccaaaacaaatcttgtaatagatccaacgattcaaaattatgtgaaacttacatataagttacactgtagttacatgcaagttacagtgtaattacatataagttacagtgtaattacactacgattgtactataattacatctatcaaatttttggagaaaaatttgtcgacaaatgtataggtagtcccatcatgggactaatcaacctgcatttatacacatggaccaaacaaatctttgttggctgtgtgtaaatctttatggtttgtatagctaatggcagatatttggtgtactatgtacatttacaacgtgtcgtgccctacgcgtacaaatttaactacaaaaattatcctacttgtttatatctcagtgcaccattcttagcctaacgatctgatgcagtgaggtgctcccgatcgagtggtacttgaccacgtcctcgaagcatccaatggatggcggcgatggcggaggtggcgccgtcgccggcgccttctgcatgtggccaggatcgcattctcctacggttgccgccgctgtcgacgtgtcgctgaccgcttgcgtgacattgacaatgtcgtcgtcgtcgtcgtcctcttccaccggcgacggacacgggtagaagtccttgctctcgacgagctgcattgtcacgcgcccgccccggcggcgcgcgcggatgtactcgtgacgccgcctggcgccggcgggcgcttcggtgaccacgagcctcccgtctttggtgcacgtccgcctcatcgcgccccggagcgacgggagcggcggcggcagccggcgcatcatcccccggcgcccgtacgccacccagcacccgtcctcgccgtcgtggacgtcctcctcctcatcatcatcactgcagccgttgcactgatcccccttgcagctcgtcgtcgtctcctggtgaaccgcgacgatcgtccgcgtcacgacgcggccgcggccgtagcccgcggcatcggcgacgaggagggatcggaggccgaggctgtcacggtcacgggcacggcaaggcaatctctgcgcgggcatcgatcggatcggtgtatctggctcggccgatcgatctcggcgcgagccccgggttgacgcggaatttatacgtgggggcggaggaggaggaggacgcgtttactttactctccgagatggcaggaagaggacagtcgcggcgcccgtgatgccgacctaattaataggccaccggcccgatcgaccgagcagtcgtcatcgatccaccgcttcctgatctggttttatttgattacgctgcgttggagcttatcttatccgtccattcggttgttagatattgctgcggaacggatagaggcggatcggacggctgtgaagcctgtgcttgcacgtactccctccgtccaaaaaatctcaacctagaactgtgatgggacataatctagcatgtctagataagttgtactagattatatccctttatatctagatacgttgtactaggttatgttccatcacagttctaggttgagattttttgggatgaagggagtagttggcaagattggtatacggcgcatggtgagaaaggtaaggctgatctttagtatttagctatggcctatatacttatgcttttaattataggccttgctaacttccgctatatatgcattggattgcttcagcccatagctaacttccggctcagaatagtatatgggcctgagctagagtgaggcattttttttggcaaaatttgctacagtacactcaaaaaacgtgtaattggctgggagacactgcaaaaacgagacacggcaaatggacactacaaaaattatgtaattggctataggacaccagagaatattttataatatccgaatcaaaaaaggcgggaaatttttcaaaatggcaagattgcccctggctccatcttcctccacctgaaatcacacacaaaaaaatagcagggagcagccgcggcgcgaggttgtcgacggcgagggagcgggtagcggcgaccgcgcgccaggagcggccgacggcacggaggcggacgcggtcagggagggagcgcgaggccggcggcgtggagtgcgagcaggaggcggccactgtcgtcaccgtggtttgagcggccatcgccgcagcccaaagcgccgatgcctcgccctgccgttcctcctctgccgcccaaccataccacagccaccacgtgtgagcgtcgccgccgtcgaccaatccatggacagagctccacttttctccacacaaaaccgatcctctctctctctctcatgccgtgtcaagccagccgccagtcgatctccttcctcggagcctcaccagccataacctctcaccattagcctcgcctcgccgagtagaaccatttcatccatttcccctttccctttgccaccactttgaaccatccacccaacctctctctcttcccgattcacggccttgcactcgtcgttccggccatttccctcactccctcgacctactaccaccctcccttgttgtgccgcactcgggaacatactccgccgccagcgtcgtcgtctcccggccaccggagcaccagcgcccttctctacctcctctcggttccctggaaagaggcagagaagaagatgacgggaggaagaagaagagaaagaaaaataaaaaggagtagagaaggattgagaaaaacaaaaagaaaaaaaattgaagggtagaaccatacttacacggttctttctctctccaattttttcggatataataaaataatcccgtaggtgtccagcagctaattaccagtttttcgtggtgtcttatagcaaatacacgtttttgtggtgcctcacagctaattacacattttttgaatgttagcaaattttgctttttttttttaagataggttggatttggatcggtctctgtcaatctcaactctacagaaagcagttgctgcgaagtgtgacaagcgtctaggtattcagttcagttcagtcaatcacagctaccatttcagaattcagacacaaacatttcatcgcaagagaatggacgggtactctataaaaatgtggaaacacgagttggtagaccgacgtttcaccctgctactgagaaggcaacgatcatcaaaaagacccgagcttgtgccacaactcgacagttgtccgaaaccaccgacctaatcatggcactgtcaaattcagagacgatcaaatcaaatcaaggcgtcagaaacacaaagcatcttccattaacctccctcttcttcatccacaacgaaacttgctcgccacagcacacaacgttagcttgtcgttggcggtggatcaccaaatatctcgagtcttagtctctctcacagccctggtatcctctgtgaactgatgctcaaaccagtacatgaacaaaggtactctatttctttgcactttttctatcatagttatttaccacttgtctgaaaagttacactttcatcttgttttcttcttgtagagtatgcatctaccattctaatctactcatacaccggcatgaatgcaaattgattacatatgtagtggagctttcaactctcacttagtaggcccatgactccactactgctagtagcagagaaaaaagctgtttcagagaggattgtgcataacagcataaacaataattggccatttggcatatatctcaggcacactaagcaagcatgtttgccactaacagacctgcagatttgcaagatagagacaaacatcacgcagcattgcagcatcaatatttactgccaaatcattggggaatgtaaagaaaaagaattataccagggaaaaaggggagaaatggttagtggagtagagcacctaagatgcacacccaatcatcagttaatgaggcagaattcagtgtaatgcaaactgcaaaactcttttctgaaggctcagaggtaacggatcagattccaacttgcataatagacaacaggggtgatgattttcagttgaaaacgaatgagatgttgatctcctgggtagataaagacaagttgtggtgtcttgatgcagactattataattatagtaggagtaccaattagcagtattcagaataccagctaattaggtaggttggtgtcatcccccgtatcaattcgagcatagaaattatccattacttctggtaaccttctttatgtgattacttttatctcagctgcgtgagtgcatgtagcatatattaacattttaattgtcacatccattgataagaatataccatcaccgaatttgttttcaatgctgattaacatactagtcaggaaccggagataagattgagcttgagggggtttggaaactgacccctacaccctccattaaaaaaacaaaattctgattacgaatctaaatatatatcgtgtctaaattcgtagctaaaaattattattatttatgatgatgtgagtatatatgtaagttagtatttgccacgagaattctacaaactttgcttgcactgcatccttctatcattgcttgcggtggcgaaagcaagtagtacggaatctagagccccactatatgacacttcggtggtctttgccactaaaaaacagctcctttctacctgaaaccgtggaaatctttgcagtggctcgttctaattcaaagttgagcgtgacaatttgttccatagtaccaattattttttcaggtattcgtgcactattgctttgatttctttttttctttatatattataaaaataagagcaatgcaggtacatgcttttattcttgttgcttatgaaactaatagtagtacttggcatttagccaaaagaaaagggaatagtacttggctgagacaacatcagtatagaaattaattggagagcgacatgtataagattcagttccattatttcgggaagaccttgtaaatcatttgtgatatatacaaaaattgccggagtctttgctgtcctccaatcataattataccattttttgattgcatcatacgatagaacaaagaaacccaaccactgcatatgtatgccgttttgtccgtgtgttcagctgtgcggttaccacgtcgtgtcttccctttttgcttgaaatttcaggtttgtcatagttggtgtagcctggacttttttcagatttcactcctgtaaatgtatgcatatgcacataagcaaaatcgtgtttcctagttcagccgaggaccaaatcaccaaaagatacagtagtaagcctgacaaatgcagccttaacaaagattcagctgtcagatgctttgcctgccaggaaatgtttagcagctgacctcgaataattgggtgcttccttcgtttggttatccctgtctgtggattgttacctgagattctgagaatatacaaaccatatgcaagtctcatgcaactatcagatgctgtatggatgggaattctactattttctaattgtgttagttgatccgtaagtcaaaggagaattctaatttctaatcgtattggttagcaagtcagagtattagccaaccttctcagactagctaatcacaaactcatgacctctaatggggtgcaggtgccagtttatcaccggaaagtgcaaacagtaattaccctgcttgagaaccagagacatttagatgaagagacgtgtcaagatttttcagaaaaaaagagttgcgtctggtgctccacattttcacaacaactgtcatgtgacaacgaccatcgtttaaagaaaaagctccgtgcttccgtctccgaccatttcaacctccaaggataatcttttactatctgtattaaatccatttactatctgtattaaatccattcatgtgctaccctttcaaaactcaggaagaggagtcattttgacgtcaacagaagaagaaagaattaagattaactttttttttcctgactggagatgtaaataacgtgcaaaactcatccaagctgctaaaaatatgcatcatgcgtgtgtgtttgttcagaatcaaaccaatcttttgtaccagtacaaccacttccagcgaagccagcagctagagtagcaatgtatgcgcatgagctcagccgcagcagcagtggcgcaggagaaaaacaggggagaagacgccaacgatgaggcaggttcacgcggtcaaaccagccgtcgccgacgtgcagttccgacgattgattccatcgtctcgggcatagaattccccgcctgcttctcactttcacaggtcgcaaccatggatggctccgtctccgtctccgtgctagtggaaaaaataattgaggcttctcgttgggtgtatctgttaaattaccgaggaaggaagccccagtgtgcctgtgccccctcctcgtctttcgtctcttctctccttccttcctccccttctcttcctctcctcccaccgagtcgccgccctctcgctttcaacccccacacggaagcaagaattgttcatcaaaacccgatctttggcgtggccccgtggatttcttgcgatctgtttggtgctatggatttctgatccggggtttcttggatcttggggagtaggaggtggggggcggcgatctggccgggagatggccggcgggaaggagccgatcgaggtcaagttccggctttttgatggtacggacatcggcccgagcaagtacgacccctccaccaccgtctccgcgctcaaggagttcatcctcgctcggtggccgcaaggtgagaggcagaagattcctgcatcaattcgataagagtacacggattttttttttcttttttgccctgatctgctgcatctttgattcggtgaaagcacacgatggcttgtgataattcttgatcccatgtagtttcttggatcatgtatattgctttgtgttgcgccgtcttatttttgcgtggtgtttatgtggggcgtttttttttctccttttcctaccctctctttcctatggttttgctcgtgtcagatgcgtagacgactgttaattggtaatctgttcttctctgaatggatacggtgaccaactgagtagcgcgtaactagttcttttcccccttagctttctagaactggatatgccagataaatacatcgtcaatcgacaattccccttctcagtgtatgtttatcatccatgaaaaatcccgaccacacgaattcggatattgccagaataatatttctgctagtttgtggcagaaaaccccccaaaaaacacatttcaggcaatgatttggatcacaaataagtgcgatgaagggccaaacaagaaagagggtagtcttcctatgtcctataaagagtaaagacacaaagaagacggcacaatgccatgttaataacagtattatgccttttgtatacctatttgctttcctacattatctgaaggtagttctgctagcactatagaacttagcacatctttggtcctttgcgtcaatatgattgctgggccattcacaagtaaacggtaaggatgaactctggacaccgactgtggtgctaatgtatcatttttttgggtggtgaaaccatcaggacggatgtgacgatttcaaccacagctgtatttctattaacactatggaacacataaatgatttggttgtttgtacacttaagcataatgatcagcaagggccacatttgtcatgtggcacattgaagttactgacaaccaccagaatcttttgcatagtgcaaccttttgtctggctgatgttttgccaaaaaagatgctgctgtataaatggatgtccgtttacattaattgggaccaccggagaaagatttggtgtgtagaatggaaaatctaataactgaggaaatggataggccaacaattgtaaaaaaaaaaaaccatctgactatcacactcagacaggagttcttttcttgatgtgcaatgcttgggtgaggtgctccttcctgagtaaactagagcatgtaaaattgaatcctttgatcctttcccagttgaatcagtgtctgcaagcaagatattcctcctgcagtacttttaccttcattgaacacacactgcattacaaactcgaaggctggaaatggtgcaatttcttttttgagatactattgattacaaatgagaattaacgttttctggatgtcctcagattgacctgcattctgaagttctctttgtaattttgtaaagattcaatttcttcataatccatacttgttatccttatattccaaatttattttattaaagggattgttctttatctttttatggcagataaggaaataactccaaaaactgtcaatgacctgaagctcattaatgccggacggatattggagaataaccggacacttgctgagtcccgtgttccagtaggagaggttccaggaggtgtaattacaatgcatgtggtagtacgccctccacaacccgacaaaaacagtggtattgccgccaattttgtttcttttttttcacattgtttttctggctgcactgatggcctatttcgcttctccgttgacacaaaactctattaaattcaacgaatgaaattatgctacagctgggtatcattctaagactgtagtgtcctgtcctccaaagatgaacatgtatagggatagtatctgtaatctgaatacagtgtcccacaagaagagcccagccctttttccaatagcggtttgttccttgttttattttgtgtagggtttaattgatcaaggtatattgtttggtcaattacttgcatggaaattgtagagcagctgagctggtgtttcctaagttgatagaggcatgaaatgaatatttcgagttcttttcgcaaattaacacgcttttatgatggataggtctatggtagtcttgtggcataagaaactgtattaacttttttgatagcttcagtttagatttgttacatgttagaagatttaaataggacagtttggcgccgttacttctatagattgaaatgggtgttgggttggttctcaaccatgtttacactttgcacataaaactacagcctacagattcacaaaacctttttgtttatagacatctggctagaaaataactacttattctaatgaactaaagtattttaaaactacgattctgcaactatttttggttttgactctcatggaactataattctgttgtttatatggtagtatttggctaattaaatgcttaaagctttcatctagaccaatttgacacctctatatacacatctataatgtgttgttggtttctcctttccagagaagcagcttgcgaattcccccaagcagaacagatgtgggtgtaccatactgtgatacgccgcctgcctgatgatgatgtacaatgtctcgctctaggattttgtatctgctttcctgtgttcgcagctcttgtgaattcattttgacatccaattttagagccattcaaatcctagaaatatacatactttaacacccgtcaaatatgcttgggagctggaactgaaggtttctggaggatgcgtcatggtgatcttaatgttgtaacgagtgtgcagaagacagggattggatgctttctgttgtataaattgtaatgtgaaaacgaaaaaaattctctcctttttcttttttctcttgccacattgacattttatcgattctttttagcactggtgtttgtcatgtaaaaccagaatattgtactcatatatgtaagctgaaaaaaggggtgttttattctgttacgtggacggaaaaaggaaagaaaaaaaatagaatctgtcctatagttatcccatctggaaacacttttgggccaaatttctcattatgccaaagaatcactttgctactattttcaacccaattattttttggcaaagttaaaaaaaaagtagctacatttagtttgctattaaatttagttagtaagtacatataaaatcttgctaaaatttagcaaccatactaaaacttggtaagattaaaaatggtaataaagtgaacaagcctggagataccaaaaatctgagttgcaagataggaatttaacttaactttatagtgtcactgacatgtggggcctggctgcgatgtgtcgatgtgacagcaacagctttacggcccggcccaatatatctagcggcccatttaccaaatacaatagcatctctcccgcttgttacaggccgtccgattctggccgctcgcccatctctaccgttggtttccgccgcaaggctcgcgcggctcccgggctccgcctccgcgccgcttctccgcttgcgcgaacccaaccccggcgaccccgccgccgcaaaacccttccaccctctgctctctctctctccggctcggcgtcgcgcgcgccgtggaagaggccaccagtcgcgggggcgcggcctcccgtcggtgatccgacggcgctgtataagcgtgatcgcttggagcgtccggacccgtcgctggctcgtgtgcgtgtcaggggtttctccggctgtccgtgcgggtgcccgtccggtacgggatcctcggccctcctccgctgtctccgccgagggaggaggcagaccggccggtcgctgactcgctgcatcgatttttggtttggtggagttcagccttaaagacggcttacgccagatttgatctcttccaaggttagcttccgctttccccactctggactcgtaatttctgataggtttgcttgtgaacggttgaataattgagtctagtcttatccagagctttagggctcactatctgttgtgcagcgaatttattgttaattgttgcatgctgctaattaaccgttgcccttttctttgttgtaaaaggttctgcagtcgaatagtacttgcgatttcattttattgaacgagttaggcttaccagcatgccagtgtggctaatcttcagtttttcacacgtaggatttgtatgctacaaatattttcgaggatagcaacacgaatccctcaacgagtcatctgtgcatcgaattcatatagttcaaattatcgaagtactagcacaagcagtcccatgaattcaaatgaaatgctgggagctcaggaaacggtatctactgaggggaacaacagctgttctagtgttcagtccactcctgacatagagaagaagtatgtgcatcgtgtatatgatgccatagccccacatttcagctcaacacgctttgcaaaatggcctaaggttgcaggattcttgaattcgttgaggccagggtcagttatactggatgctggctgtggtaatggcaaatatctgggcttcaatcctgactgtttattcataggatgtgatataagcccaccactgattgatatatgtgctgggagagggcatgaagtgttggttgctgatgctgtcaaccttccatacagggataattttggtgatgcggcaatttcaatagcagtactgcatcatttaagtactgatgccaggcggaggaaggccattgaagagttgatccgtgttgttcggaaaggtggtctggtgctcatcactgtctgggctgtggagcaggaggacaagtcacttctcaacaagtggactcccctctgtgagaagtataatgaagagtgggttgatccgagcagccctccagtgcgtaatcaatccaatactgtgcttgaaagcatatcagagactgatgaagacacaggtgcagtgaagcaaaggaatgatgatctgaaaataagtaatgatggtttggatgataacgccgatgtaacttgcagcaattccaacattgatgagtatcacaaaacccagcaggagtactttgttccttggcatcttccatttcaccgagctgaaattggtggtgcatctgctgctgctcttgaaaatggatttgcaaaaagagatgacaagaagggtactgtggtctacaaccgctattaccatgtttttgttgaaggagaacttcaaaggtgaagcattcttactctgagctttagtataaaatgctcctctattctttctttttttcattttccccaattttttctatgaaaatgcgtgagttaagatatatcacattatatataagttcaccagaatatctccatttcatgttgttgactgatgatttgaaatttctattgtttggctttgagatattttcatacagtttagtagtttactagtatcagtttttgtgtttagctatgcaacaatggtatgatacacaatacttgcgattctaaagttttgcttttactccctccgattcatactataagtcgttttgacttttttcttaatcaaactttttttaggtttgaccaagtttatacaaaaatttagcatcatctacaacaccaaattagtttcattagatataacattgaatatattttgataatatgtttgttttgcgttaaaaatgttgctatatttttctataaacttggtcgaacttaaaaaagtttgactaagaaaaaaatcaaataacttataatatgaaattgagggagtatgtttgatctctggtcttttggttggaaatatctcctatctctggcacattgtctcattaatttcatttcaggttagttgctggtataaacaatgcagttgttgttgaccaattctatgacaaatcaaactggtgcatcgttcttgagaagctttgaacatgcagctaaaagtgccggggagaaactcatctggagcctgtgcccttgtatctttgtaaggactgccagttgtaggcgagcacggttttgcgctccaaatgtacgaggcctgacacaaaaaaactgcattattgaatttagcatgtcataattctctattcacttgttggtgaagatcacttttgcccgttgtcatcgcgggaatcttcaggttgatcttttcaggattgcccaattagggtcatccggatttgcagaagtttgtacttatgttctcatcgaactggtgaattttgcaggtttgcttgtctctctcttatgagagtatgatgtactgttgtctgatgtatacgctaattggacatttccgccagctttcacgcttttcctgtgtacgcaatacgcccgtaagcgtgttacagacatgttatttccgagtggcaaaattgcatcgtcaggatgcatcacctgcgcaataacgtcttaccaggttgataaactgatccatgaacgtcttaccaagttgataaactgatccatgtacaaagaaaggtaagctatcagaacatgcgcacgagatgcgaacaacaatgagaagcgatacttcagaaacctcaaggttactgacagacagaattgcaggcttgcagctatacgaaagaggagctgaacaaaaaagaaggaaaaaaaagaaacccctatgctgattttacaacacaactatgaaatctacaagactacaagcagcattagccgacgcacaaaagatctcagcattcacataaagaaaactgcgttatgagccaatcaatcgctcgtatctccaaagatactgctatagacagttttagagataaattaattgcattctccgtgctgtcaggcaacgcagagtatgagcttgtaagaactaactgaccgccccatcacgcagcaacttgccaaacgcttaaatttggcttgcttgaagtgtcagttccagaattgtttgcggactccacatctggcttgcttgcagagtttttgctgggtaccgtccggggtttcttgtcagtgttgccaaatgcctccaaagcatccaagaagaactttttatttggaacaataccctgtgagttcatccgtttgagcaacttctgaataagcttcttgtcgtttgctttggtgtaggccttgtaaagcaatttgtatgtggaagcactgggcacagcacctttcttaattacagaatctaacagctgatctgcttccatgggcaagccgttcatgcagtacgcatcaagcattgcgttcactgatgacaggtgtacattattttgtgagctcacaagctcatcgaatatctgtctggcccttgagacacaatcacaatatgcatacatcatgattagacattcttgtgtcacatagttcggtttgaatcccatttcagtcatcttatcaagcacacactctgctttctccctgagtctcgctttcccgtagttggttatcatggaattgaaagttgggtgtgtaggcttctcctttgatcgtagtaagctcttgaacacctgctccatcttatcgaatgcctgctttcgcccgtaagaatctatgagtatgttgaatgtgattacatctggacgacattgattgcttttcatccgtactagcacagattccatctctgtgatcatgccattcttcccgtaagcgtccatgactccattgtaggtatagatatcaggagagacagggctttcatccagatccttaaacaagatgtctagctgttttgtgtcaccagcctgagcaaaagctcttaggagaatgttatatgtcacaatatttggttggcacctatcaatagtcttcatcttttcaaaatagccgagagctttcgccaaagccttgctcttgtctcgcgaatgcaaatgtgtgccgataagagaattatacactgaagtgtccggcctacacccactgttccgcatctgagagaacagccacattgccatccgtatctggcctttccttcccatcacagatatcagcttcgaatatatgccgttatcagcaacataccacctttgtttctgcatccatctgaaaacctagcaaaatagaagagcagtaaggaaccagtagatatgtccaacttacaggaacttcaaaattcatctcttgttgatccacatcaacaccctaaaatggcacttatgatagcaatcaggggattagtacacaaaagcaggcatactgctagtcaattgtgatttgagttgggctcataggcaaagattatatgtgacacgaa

SEQ ID NO: 58707 - DNA, 19581 bp, Oryza sativa
ccacctagtaagaggctaagctaggccgggcccactaatccggatgcgtcaaccaaaccggactccgactcgagcacagcctcgccgatctggctcgaccaagccgcggaattccggaagcgactcgctctcgtcggctcgtcgcacgcgcgagcccactttgccggccaccgggatggcgccgccgcggccctcgccggcggcgaggctgctgagggagtacggtgagtgctctcctctcgctctcggcctcgcgaagcctctccaaatcagggctctgctgcggtggtgggagggtttttgggatctgatgcgtcgggggcactactctcgcttgcagggtgggacctgttgctcggatcgattgccgcgttctacgccgtcatggtgccctacaccaaggtggaagagagcttcaacgtgcaggttccggttccggctccctctccgttgagcatccgagtggctggattacattgtagtcgtgctttgtgtgcaattacagtagggattttctgttgtttgctcaagtagtagtgtgtgtccttattctctgttgctgttcagttactagacacgggattcaggatgattgctgataatttgctaatgttcattttggttgcaactggttgctagatgatattggtgtgcacatgtgaattgtaggatagtatgacttaacaacaatcagcttatgtgaattcatttacattttctgcagacacgcagaatccatgctgaatattgatgaatcgggtatctttgccgtagacatccaagatgcaccctttctatatttggtagttcatacatcatatatattatatcatgagcgttgaaaagctgaagttgctcaagttccagtgtcacctatgcaatgttaaagaagtagaggaaaatttgcaggataattatgagtttcaactttcaacccttcatgtctaaaaactaatgctttatgtttgataacttcccttaggctctgcgtgataatcaatttgaatgaaatttgctttgggaaattgtttcattctctactgctcatttatctttcctttgcctggtattgaatcttttacttgctaattcttgcctttttccgtttagtttggtaaattttttttacctattccacagtgtatgtttgcacttttactgtaatgccattacaatgtttaggctaacactttgctcatgtatgttctaggccatgcatgacattctctaccacaactatcatattgagaaggtaatcatttctgctagtctatcaatacaacatgcttgatgcttatttaatttctttcttcaatttgctgcagtatgatcatttagaatttcctggtgttgtccctcggtcatttataggtaatactatgttcacttgaagccttgatctgtgcactatgctacaatttttccgctaatgaccattgcttggctcaagcataatgaaatggcaagtagatggtcaaggtcagatggcattaccagtttaccacaatatactcctactagatatgcctgtagtgtctatatatggtatgactggccttgcagattttgtaatctggacatgacgcagatcattaacaccgtttactacatatattcttcaggagcattggttgtatctgttatctcatcgcctgcagtcttcgtaatgcatttatgtcatgttccaaaggtttatggtcttctagcaggtgctgtcaataacttagcacatgtcttcttgcatgttgtatctgtttttgttgccatattgatgttcttctattttgcccttttagttcggatagtgttgggtagtattatcctgatgactttgagacttctccgagttcaggtattccttttcacttcttgttctgtttaaaagggtttattgcaagtatgcactgtttctcagttctcctacctacccccaatattctgaaaacgctgtttccctgaaaaggggtaaacctcaatccttttacctgtataaccttctcctggccttgaagtgcagcaactcatagaatggccaccattttttttaaaaaaaaggaaccttgcttatcaaatttggtttttgttttgatgcgtctgtgaatttgccaagggcctaagatgcatggtcgtcttgcctgtggcatacctgctgcagtatgctagccttgtttgaatcttctttttttggcttggtttggaccatataccttacgatacctttcactctgtgccatttatattccatacaaatctggatagaagagaacttaatttttgtttctactatctcatgcacaaacttctaagtgctgtatatcatcaagatatccctttgggttatgtgtttatgtcaaactgttctatgcccatcttgagtaacatttgttttctataatttgcactgaatcgtcccgtgagcacgagtctgttattctgtccttggacaccataacgtttttctcagttcatttctgatatacaggtaaaaaggaagtttggtcatcatgctgaagcattctatctgatactaactgctacccagtttcacttattgttctactcaaccaggccccttccgaatgtcttagctttagcttttggtgaggacattgtttaaatcaaacacaagtctgttcgagtgttactgatttttgtgacactattggcagtagcattaatcatatgtggggtttgtgtaataatcgtgcaactcattgtttctttctgtctcgcagttaacttgacatactatttttggttcaagggaaaccatcgacgcacattacaggccctggtatgctaattttttaacacttttaccttactttcacaccattttgtttgcatgctgctgttttcacatttttgtatacactgcagaaagcaagaatttatttcaattcgagttgcatatattgttgaattcaaaatttgacatcctgcactgcacacaataactccaaagaatctgagttctggacatgacattctaaagttgcaagtttcaacatgaaactgagaaattctttctttactcttcgttcagttcaatttcttgttgatttactaaattgagaaatgattctcagttatttatttgcagaccaataaagattacaaattggttttatagcattgaaagatcctcagttccgctttatccttctgaagtaattctccatattgcttgcagattgtcgcagcagttatttttaggtgtgacatgattttgcttcttggtacaataggacttgcacttttgctggtgagtttcacctacaaaacctgaatttctcttggcagttgcacagtcatttcatactcttttatgtagtgaaatctttgaggaagcaagggtccaaagtttatattactcattttttgtaggctatgcacaaatagctcttatctcgtacactaggtacaaataccaattgtcaatactctctattacttcccaactttgtgtttgttcaaattcaatgcaaagtaactttgtcatagaatcataagggcttcatggttcaaccagattttgcggttttgtgctttcatcatttgtgtctctgtagtgaattagtaaacttgtttgaaggaccatgaggggactgtggttaattatctctataagttatttttattgaggcatggctaataatctctaagtgagtaacttggtatgtcaccaggctattaaaatgatagcactcacttatactatcatatatcaagttgttatatctatttggactttgtatgtattcttctgcttactttatctgggaaagttggggctgaggtgcaatttgactatgctgtgacagagcaggtctatttctctattggaagcaatcaaatgttgtgtaagcactgccattatatgcattggtatgttgctttctactttcttgaactttctccaatagtctaacagaagtctgtgcaaatctgcaagaaacatttctcactatgaataatgttcttaggcttcactgtactggttgactctatactgtggcggcgaatcctgtggccagaatttgaggttttgtggtttaattcagttctgaaccggagttcagagtggggtgtatcctttttctatttgtgtgcatgtgccaaactgcagtttccttttttttttataataattctagttaatactttcagtgcacaatgaaacaccgtttttttcctctttagccagaattttattcttttttcctagcaaatatatgcatgtgttctctctttcactaagtcacttcacggagacattttcatatgcactcctttctctttagccagaattttattcttttttactaccaaatatatatgcatcagttctctctttcactaagtcacttcacagagacatttcatatgagaatatgcaaagcacatatcttttgtattaagattgggaagattgaagtttcattttcatatgcactgaacatgatgttaatctctattagtcacatgaatacaaaaaaggatgcaacatatatacacttcttgttcaagacttatcctcttcttctttttagattcatgtggtgaaatctatgtattatctcctgaaacttatgcgaagctcccagccctgttatccatgactaccataaactttagacacattccatccattggtacttcacctcagcacttccacgctccatgctggtagcatatcctctttgcatggtgagataagaaacttccatacaagaaattgtgctacttacgtggctaaaaagtgcatgtgccttttgcttgaacaagtatataacttattccatgccttcttatcatgtatttaatatgcatgaaacatgatgcttagctagtaatagttgattggcttcccatctctacatgtactttatatcaaaactgttacttcatactatttgattgagtcaactaattatatttttatgatgtatcttttctgatggtggtactatcaatgcattattggttattgttttttttatttgattttttattggaagtaagaaatgtatctcatgaagccttttcagtgacaggtcggtgctcttcttgacagaaggatagtgccatacatacttccagtcttctcatttgttgtgctttattcaaagcttccacataaggtatctctacatctcttgatactagttccatccttatatttggccattcttgtacatgatgactgatgttgtgtttcaggagcttcgcttcattatggcttcgattcccatgcttaatgtgtctgcttcactagcagcaagcagaatgtgagcatacccaatcttctgtcatatctagttcctactccctctatttcacaatgtaagtcattctagcatttcccatattcatattaatgttaatgaatctagacatatatacctatctagattcattaacaccaatataaatgtgggaaatgctagaatgacttacattgtgaaacagaggaagtactattttatcaatttactgatccaagctaggaatgctagcttcattatcagaactccttttatttcatacccttcgtattgaatggcgtttcctctctttctttgctttgcgatttcgacccgtgaatatatgtttgtctatcttcagatataataacagaaagaaaactgggtggaagttactttatgttctcatgattggtggctttctttccaggtacaataatttaaccatggttatattgtaaaatattaatatggtatctttttcaagtagcacaatatatgctactgttggaaactcacatataattatatagtctaggatactctggtgtaactttcatggcatcctacaataattatcctggtggatatgctctaaaggctctacatgaagcaggtgagacctacataagttatgtggaatacgtgaaattatgatagttttcttctgttaacaaaactgcaagggcttggctgaaccgcaagcagcacattacaaattgaacagctagtagtgtctcatctagtggtgtctactgttttagcgattatggggtatgttgacaataatatctttattgatggcacatactattggttgcttctcttttaccagattctgtaatgaaggacaaaattgttcacattgatgccttcactgcaatgagtggagtttcacgtttctgtgaaagtgaatatccttggaggtatcctctgtagtgttttatctttgttagtatcttttatcatgccatttatgagcatctcaaaatctgttcactggcagatattctaaggaggaaaaaatttccatcgaggaatatcaggaaagaaatttcacatatctgctgaagtaagtttacttacttcctccgtttcacaatgtaagactttctagcattgcccatattcatttagatgttaatgaatctagacatatgtatgtatttagattcattaacatccatatgtacgtgggcaatactagaaagtcttacattgtgaaacggagggagtatttgctaaaataccttatgcacttatttttgttactatctggatatttaaagattgaagcggacttttgcaagcaccactgagaagtggggcctacatatatggggagttcacctaatgttggaaaagtccttgtattacctccatgtttgtttgagtagaagcaaattaccgaacaactcttgttaccatgcatgaataaatataatcaaaggcacaactggtactcatttcacgctgtaatgcttttcttatttcttattgttgtaccaaacagtgaacaccgccatatcagtggctacaagtgcttgtttgccgtggatggattctccagagcgaaaattcaacctcgaatcccactactctcactggtacgctatcattctttacagagtagctatctaccttatcggcatgcagattacatactccagccaaatgccagcattgccatcctatttctggttctgtcaaacattaaactcacggtggtgattgaatactggctctggtcgctaacctcagcatttactgcaggtgaaagagccaaaagtgtttgcacatgggaatacgagagaccctgatattctttcgctgaattggcccggttgcccttgaggtgaggatactgatcggatctctaccacaggaccactaactgccaattgtgaagatgcccagcctgtgtaaatcactggatcaatcgagccccttcccaaaccccagctcggaagatactacaccttgccacctttgggctattcaaggctcacactttagcgcaaaaaactcgcgtttttatgttgaaaccatgtgcttcggtttctgacctagttgctcgtatctggtggccaaaaggaggggaaaaaaaactgaggaataggagagaccataacaatcttgtgctctagcaagttgctccatttcatacacaagtaccatgtatcctatcttacattacgtcaacccacttgctgtatagcgtgactcttggccgatgacatctccgtcgcaccattttccacgcattggccccaggcacggagcaaagcccgttggctgtaaaatcatgcgagatctctgctgaagaaagaaaaaaaatgatttgttgcaatgatggatctgtcatggggatgatgggtctcgagttcttattaccggcattagaattataggagtctcattaaacttttcattaaaatatattgtcatatggagtattcattagaagaaagggtataggcttatctactttattaagtcccttctagtccttcctagatccgcccatgattcgctgaaccagtgattcaatgtgtagccgtcgacaagcttgcttggaattaagttcacaatttcgatcgaatttaccgtctcattgtggctcgcattttcaagttttcaaccgcaagcccttgcaaacggccggcgagctaggcggtggccggcggagcgagacgtctcggcggtggtgtcgccgtcgtcgtcagttcgtcgcttgggacgacggaatggaagtcgtcgtctagattgattaggacgggggagatgtcatgggctggccgctcatgggacaaccgaaagtaaagcatcagcaccagtaccagtacactactctactcgccagttgccagggtcaaggaaccgggaccccaccggcttcgattcctcaatcctcaggcctgttatcattattcattctcatcatctcatggtcggtcgcctcgccattagttacgacgagcacatcgtccctctcctcccgtttttatttctcgagctaattcagggagagagagagagagagagagagagagagagagagagcagcctcagcctccatccaatcgctactggccggggtgaacccaactcccgaatttggtacttgcaattctctactaataataacaaatggtggcatccgactcactggcgagagcgagatgagatcgagtccctaaccaccacccaaaaaagaaaaaaaaaaacgcacacacacacacacgaggaaacatgggttaactgaactcctccccctcccccccggttgctttacgctttacgtggtgatttatgtacgattgattatacttgttttagttccggctcggttcacatgacgtggaaccaacacagaaaaaacgcaaccaacccaacccaagcgggcggccgggggcagcaacagcgcccgcgagaaggcacgtcgcgtacggggcgcgcgggcgcatttgatgcggtggtggtggtgcgtgtgcgcgttgggagggagtcaggtgaggtgcgggggatgtacacatctgcccagtgtgcgcgtcagatccaaacccagacgagacgagggcgagccgcgaccgcgaggcgacggagacaaaagaaaaacaggagaggcgacgccgcgtcggccacatggagcggggacgcgatgagcacacgggacgacgcttggctgcgctgctttgcttggctggctctctcgcccatggagcgagcaaagccaacccaacccacagcaaaactgagtgagggagacctaatctggttgagatggtactatatccatccaatccaagtatctaattaccatcttatgaatcagcaccgtctcatcgtggggcccaccggcttccagggagcaaaacttttcttcctcttcttctgtttccttatttttgcatctttgtaaacttgccaacacaaagagatttttggggtgcgtcatgtgtatatatgcattcggtggcctcattgcgtactaattaagaaaatggtcaccggttcccgttttcgttttcagttggcctcatttgtgtgaggcgatagatcagagagccagtcggcgacgttgaacgtgttgatggtaacacgcacgcacgcacccctttgacccccatcaagaacatcacaagaacaggtgcttccatgtcaaggtaccgcgctttgactgatggccacctaactgggagccaatagcaacaactaaataaagcaggtacaatagcaactataaatcagctataaatatattttaaagagataaaagaagagagagaagagctgcgggctgtagatatatagccagctgtagcacggactccaatacgtaatgtatgtatgacatgttggaccaactattaatagtgtagtaagcaactattatatgaattgatattatattaattataaatgatttggagttagtagttggctatactattaaacttgctcttactggcggtcattgcaattagcaaagtgtgaattgaattaacatctgaaacttcgattgcaacttgtagctttcccgggtcgtttgtgaataactcggagcataggaacagtggagcttgaatgcaagaccggggataataccatatgatgcatacatatcaaaacaagctctttggaagagtaatcactaaaataaattcctttgtcatttcaaaccttactaatactttgctaatggcaagatttagcgttgccaagaattttggcaagaaaaaaaaacagtttatttcagtgactaatcttcgtataatatattcgtagcaacatgttaggtttcaatgtttcatctaagtttccatgaagcttctcccccttcctatctctctcagtatggaaaacgatttgttatccaaaaagtataatatatatttttactacaagggcaactctcgaaaaatgacttagattcccgcggtcggtctttcccgcggtcggtcttgctagcccttctcctctagtgtcctcagctcctcgccagcgtcctgagagggaggggacttgatttttaaagaacggcttgttttaacttgacgctaagttttccccatagtaattggttattgtgtatgcatgggaaatgagtttgctctaatcctcctttgccgataatattgggtttactatcctcgttagtcactataaaaaaaaccatctttacatatatcctctatttatttttacaaatagtctgaaatccttaaaattggagaccgggccggccgctccaagccacaacacccttatccctttgcctccctctctccgccctcctcactcccctctccccctgagctaataatcaaagtcatatgctcccttctcctcctaggcaccactgccgacgtgcacccctgtcatcgcctcgatgtatgtgtccccattgtcacctctttcctcatgcacagctacgctaccaccaccacagccactgcatcagccaacaaagaggccagggccaccaaatctgatgacactggctctcctggtagtgggttcggttgggcgatgttggacgacgatgagccaaagtcgggcgcaggcggggaggatcgacgaggaggaggagcaagactgtggtaggactcaggaccgtcaaatatagtggtagaggttcttactagcgagtgttgtggcggcagtagtcctcggttacttggcgacgacgactatggcccagggaggtcaaaaatggcatatcggggacgtggatggctgcttcatgggcatctagcgtgagcttgttgaggagtgcgggttgctgacccgagtggcgcggccccggtgggttgatgacggtcgttggtcctgggcgtggtgacaaacgcaactcagtgacggcgatgacgatgacgaccgtaactacatgttcttaggggatttgtttctctttttcccccaaaaaaaatgagaaaatctattctataccactgagtttgttcgagttcaacgatttgctatcgatattatctctttctataatatactggcaactttatcaattgttctacgatataccattaggctgagccttctttttaaaaataaccaaaatgacctaatagacatacaaggttaacaattaatttatctcattagaaatttcataaaaatatgaaaacttttatgtggcctccttacataacatggaaattcgtatagaagtttcaagttttttacatttcttttttataaaaaaaatataatttatttgttatatgccatataaaatattttttattattatttttaatacaagtcatctttcataaactacataagatatttttgtgctattatctcttttataagaagatttttctctcatatacgacataaaaatatttttttacgaaaattaaatataccagaaaagactcgaaacttgtatacaaacttccatgttgtgtacgaaggccacataaaaattttcatatttttatgaaacttctattgagataaatcaattgttaattttctatctctaagagtactttgggtatttttaaaaataaggcctagcccaatgacatattatagaacaattgataaagtcgtcaatatattatatattatagaaagaaacaatgtcgatggcatatcattaaactcaaacaaactcggtggtatagaatggattctctcaagaaaaatcatctctgcatgctattggcttaaccttgttgcttgtgaaaattgattttcataggtagttggcttaggctgcgttcgaacctgaaggttcccaacctctctatctcattttccatgcgcacgcttttcaaactaataaaccgtgtgttttttacaaaaagtttctatacgaaaattgattaaaaaatcaaattaatctatttttggaaaaaaaattagctaatacttaattaatcacgcgctaatggactgctccgtttttcgtgcggagggatggtttcccaacccattctatcgaacgtagccttaatctatccacctatgaaaatttgattttcatagatagttgaaccccacctatgaagatcgttgatttttacatgcctttgatcataggtggtgcgctcggccatctaaaaaacttattctgaccgcctgggatgtgtgatttcgttgcagcgtgtagcaccaatataggtatgttgctaatataacttactgaacctaatttattatattttatgatttagaaaaatactcctgacctattcctagtagtattggctcataaaataaatttaactttgtaaatttcaatccccgttacaatatacaagaatctcaatagtacaataacttcaccgtgtttcctttctagacgtaaattcaacatatctcgttttaatacgaaaaagttgagcaatttgatggtgacaatgttagatgcctgctggagcataaatctggactagatcgatagctagatagccgaaccacgaaaattgaagaatgtggtcatgatgtgagcatacattaacaaggccaaccaaccaacacctatacctcttggaacaactcaactcctagtagttattaatttccagacaacggcaaatcaagccagcaaccagcgagttttgaccagataccactctgtacgtcgccgttctgtgcacaccagaaacaataacaataataatctattaattttgcgctgtactctctgcaggttaataatacttatcgttttttataagggcacggtctctaaagaacaactttaaccattattttttattataatatgtataaaagtgttaacaaatacatgattttattaaagtactttttaaaactaatctatacatgtaatcaccatatttgaaagacaaatattttagaaatgatttataatcaaagattcgagtttaacctcactcttgtttaaaacgataactattatgagtccggaggaagtatacgtagtaccgcgggtaaaataaatgtaaattgtacacttagatcttcttccattccgagataaatgcgagctggattaattccctctgcaacaacaacagcaaatttccttgctaattctgaagagagtgacactgcacgggaagctcagctcttccgggcttcaggcacacgcaggaaacggattggtctccctgtcaacgaaagctccgagttcccaacttatacgcaaggaaatgagaaccctgctttccacagcttgaaagttctcatcaggctttgcaggctcaaacaaactcaggggatatttagtaggaagcaacctgtggttggcaccttctcctgctatttttgccacacttttacacttatcaagaacaatttgcagaagtaaaaattgaataaaatgtaccatccccattatttcctacttattgctttgattatcaacattctccaatacaaatgtttatgaagctactattagaaatataaccatataaaaatatttttcatgacagatctacctatatcatttattcatttttctcaagctaaatcctaatatctctgtattcacgagcataaaaattaccattgaattcgcagacgctcgcgtcgccctcccctgggatggcacgggaggcgatgaacccggccgcctctttcctcccactcctccccctccgcctcgccgccgcccgagcggccgccggcaaagccggccggccgcaaggacggcggcggcggggcctctctcaccgacctcgcttcgcttcgggcgagcaaggaagcgtccacgacggggcggcggtgaccgccagatccaggccgctccggccagatctggcggggtggcggctagcggcagggagggcggcggcaaaggcaggggcgtgcggcgccgggcggtggtggttgaaggcggcggggatggcgatggcggtagggatggcgtcagccgagggcgcgaaggtggcagcggtggtccttgtgcggcgacggcggcggtgtcccccagatccgctcctctcggccggatctggagggtggccagtggtggtggtcggcgacggcggtcgaatcgcgacggctggcgacggcagtgggcgacggcggcggcggtggtggtcgcggcagttggcggcggcggcggcatcggctgacgatgccggcggaggacttggcggcagcgtggcggagggcgacagcgaaacggccgctggcagtgtcggcggcgattcgtgaagccggtggctggcgtcggtggcagcggcgactgcggctgacttgcggcggccgtgactgtggaggcggtggtgacgttggcagatgagggttgctggcggcggcaagtggaggcggggaaggagtcggctgcgaggtgaggatggcgacggcgaggtggctgggcgtcgatagcagcggctgctgtggtggtggctgcgactgcggtcaccggaggtatggcggcctcggatggctagctgagggcgtgggagacggccgtatttggccggtgcggcatcgtttggtggaggggtcagagaccggcttggcgcagagaggcgcaaccgatggcagcgaaggccggctcggcgcgagaggcgcgattggcggagatggaggctggcttggcgcgagaggcgcagctgatggagggaggctggattggcgcgagaggcgcgtccggtggaggaggcgacctaggtgtgaggaggagctgccggtgggtgtagcgcggtcttaggcgcacgaaggctggccggccggggacgccggtgcaggggtcccacatgttggcagagtttgtgtggtggtggagcatcggtgcatcagccgtggatttgcaggtggtgagtggcgggtgaaaactcagttcggccttggccggactgacaacgatggttcattctccctcctgagtgcgttgtcgtgctgtctcagccctcaaggatgattgtcgggcgaaagcccagtcttggctcctttgagtctcgacggacggcggcggcggtttttccttcacttctcttcttgaagacgtcgttttggcatcccctaggaggcgatctcgtctgtgtccctttgttggtctagtggcggtcggtcacgcttagcggcggccggtccggtgctagccttctcctgggcttgtgtgttggcgatgtcggagtgtgggtgatggtatagtttttttcctttttcctggttacgaccctccagggttgtaatcttgtaattttttttcttctctatcaataaaacttcgcatcgtctcgtgcgattggttaaaaaaatatctctgtgttcattaactattcaaatttttaggttgactgcacgtatttaggacacaatctatttcagaaccgatgtaattactgtggacgaagtgagcttaaaaaaaatcagtagaaatggacagtaacagtttaattatgagctgggtaggaccgtaggagagagagagggcgaggaaagcaaagtgcgagtttggtggtattttcctcgcatcgcatggcatgcgttcgttcggacggggtgacgaggtgagttggcaccactgcctcgtcctccccctgttttgatacctccatttcttatcccctccaaaagagaaaaacaaataatacaatcctatctatcaccaaggaaaggagcatgctttgctaggtcaacaagagtatactacatatatgcaccaaatattctctctctctatctctctttcctgtctgtcaccgtctcttctttggttcttctatctgaaattctgaatgaatatcttgccttagctgagctaacctaaatcatacccacaaagatgggtacaatgaacagtcacatgggtgatgaatgatgaatcccctggtttatctgccgggtcttgcgaggttgtctacgggcttaattaaccccgccttcgagataaggtggggaattcattaggaaagtaaaaatggtacgaaaaaggtctatttgtgtttttgactttaaaaagatgtgactcagccctgaggcttaatctagcatttttagaaaaaatgaaaatgttgaattctagtattgtttctgagattttgttcaggtgcatctggattgatttgtggctgaaatggggtatcctgatgccattttgtttgcaactaattttgtttggtataacatgcaaagtttagcagcaggctgacctgtgccaactaactagtagcacaagtgtgttaactgagagatgacctttttttagtggggacgcagcaagataatgccagcatgaggcgacctccatgctttaccgtttcctacttttcttgagttgttataagaattttttttggctaatttctgatgcaacctttgtctcgattgtgtcatcactggatttaagtatcgcctggctgttccgatgtgaaaaaatgcgtcagctgagctactattcttggagcttagctagcacttgtcgatgctcttaagcgatgacgatgtggttattattgacctagtgtgatatggccatatctttgctccttttgcatttaattggagataatggatgggataagatgagataaatgggcgaaagattctaaaagaatatatgtaagtgaatgaattctaaggcattgtttaatttggaatggatatttcttttttaatccctgaatttgtgtggcaaagttcaatctcttgtgacctaaaatgtggcataattaaattagggagcaatataagcatgttgggtggcatattggcatagttttaggttatttaaaacataccagaatgaggagataaaatgcatgtttttattatgtgccgtttcattgctaaatgagaattgcccaaaaacctgaatggaatttcttttgcatagattggaatcccgtgcaattaattttacaaacaaatcaaacatgcggtgtgagacatgtgcaggttgggatttggagtgctattgttatctttatcctaccatagctgcttccaccaaaccaatgtagtagtacgctaagccgttgaaaaaagaattcctatatattcaaggggaaaagcctgaaaaatgatgctggcatgctgcggccaggagggagctgttccttttgtgtttactatttagtccctggaataatgttgggtctcatattctatattatattctagagcaccctcaatttctatcttattcccgtctcctgaaaaaaaatatacatctatttatcatataactatgaaaattgtcacaataaaagtgacttcgtaaaaagtaaatgcaggtgctcacatatgtatatagggttattgttacattaattttttttgttaattgcattcccatgtattactggaatcgaaacaaataggctatttggcgcttttgcatacttcctaccggcacacatccaaccgttcatcattatgtttttatgtggcgctatgaatcactttacgtctattaataccacatttaaatatacatgaatacattttcccgcgctttatattacatggttttataaatcggtacataccgcacctattccatcaatagatgaatgatttagaaggcatgacaaatatgatacatttcttcgataataaaaatcaatctaaacaattattatacattgtattgtgcttgttaggaacgtcgttttaacacatcaaaacaatcttttatgcatcaacctcaacattcaaccacccctctattgagcttgtgttgggtgctctacacaaacattgttgttttttttttcgtaaggggcgaaatgcaaaggtcgtaaggaaaaagattcttccaatggcaccagaaatggagggctttaaagttaatcaaattgactaattagtgctagatatgtcctgcacttctccttagtcatacccaagcaacaataatgaaatgggattgaaaccacccataatgaaaggctgaaagaaactagaggagaaaagaagtgctggcctttgctgttgtatagcccccctctccttttcctaccttgcccagttcctagttgcttctctctccctcattaataaaaagaaatttacaagcttctaaactatattttcttttggattcctccccaatggctttcacccaaagactcacccggcctttgtaaaatctcctcccttccgtctgcattccttcctccattatttctccatccctttcccctctcctcctctcctctaccttctctctaaaagactggatacagaacaaaaaaaagggaaaaaacagaaagaaaggaaagaaagaagaacacctaccaagcaagtcttggtctttgagttcatgggctgtggaattgttcccaggaatcccctctggctctgaaaagattcacaccgagcaacagttctttgatttttttccccctttgttttgctgaagaattgcttgtacagaactgcttctttcctgtttccgcttggttttccggtgtttattttgttggaattttcttgggccctttcttcttcgcttgtggaggcgaggggagaagagaggcatgggaaagcaaggaccttgccgtcattgcggagtcaccagtgagctctttttttctttctttcataaagttagatttttccttctgcagttctttgtttccttgttttagttctgattccccctagctagtttattttttaggtgatgttttctcccaattatgcatctgggaagagtcttagataaaatcgcaaaaatcttcagaatccgtcgggctgggattcctaatcctttttccctgtggttccctctgtttgttctctgatgattattagctgaaattcattgaaccatcagaagctgtcaggagaactttgtggatatggttgaggtctcggtgtcctttgggtgtaaaattctggacaccaggaacagattatttgattcagatagacacatctagacttgtttgaccatggcagatgtatgctgttagataatttgacagataatgcaataagatgcagttaacagtctattgttcaagataaaaagaaccacctgcttttgccaatcagacattcagagtttcatagaagctgcaactgcagaaatgcttgctgttaggacagtactaaagtgaagatctttgctgtgctgtctagtttgcacaggctgggtcttctctttgcttaaatctcagcagcattataagttctggagttcttagctcttcctagaacagctgcttaattgaaatgatcatctgcatttagtatgcctcaccttttagattagcaaatgaacaactacatggttgtgctaaatattaaaaataacgtctgaaagatgcaatttgagtatgtatgtgactaatcagtaatcactcactgtcactgacaaattatt

SEQ ID NO: 58708 - DNA, 16640 bp, Oryza sativa
tgtacatcccccgcacctcacatgactccctcccaaggcgcacacgcaccaccacctctgcatcaaatgcgcccgcgcgccccgtacgcgacgtgccttctcgcgggcgctgttgctgcccccgccgcccgcttgggttgggttggttgcgttttttctgtgttggttccacgtcatgtgacccgagccggaactaaaacaagtataatcaatcgtacataaatccccccgtaaagcgtaaagcatccggggggagggggaggagttcagttaacccatgtttcctcgtgtgtgtgtgtgcgcgtttttttttttcttttttgggtggtggttagggactcgatctcatctcgctctcgccagtgagtcggatgccaccatttgttattattagtagagaattgcaagtaccaaattcgggagttgggttcaccccggccagtagcgattggatggaggctgaggctgctctctctctctctctctctctctctctctctctcccctgaattagctcgagaaataaaaacgggaggagagggactatgtgctcgtcgtaactaatggcgaggcgaccgtccatgagatgatgagaatgaataatgataacaggcttgaggattgaggaatcgaagccggtggggtcccggttccttgaccctggcaactggcgagtagagtagtgtactggtactggtgctgatgctttactttcggttgtcccatgagcggccagcccatgacatctcccccgtcctaatcaatctagacgacgacttccattccgtcgtcccaagcgacgaactgacgacgacggcgacaccaccgccgagacgtctcgctccgccggccaccgcctagctcgccggccgtttgcaagggcttgcggttgaaaacttgaaaatgcgagccacaatgagacggtaaattcgatcgaaattgtgaacttaattccaagcaagcttgtcgacggctacacattgaatcactggttcagcgaatcatgggcggatctaggaaggactagaagggacttaataaagtagataagcctataccctttcttctaatgaatactccatatgacaatatattttaatgaaaagtttaatgagactcctataattctaatgccggtaataagaactcgagacccatcatccccatgacagatccatcattgcaacaaatcattttttttctttcttcagcagagatctcgcatgattttacagccaacgggctttgctccgtgcctggggccaatgcgtggaaaatggtgcgacggagatgtcatcggccaagagtcacgctatacagcaagtgggttgacgtaatgtaagataggatacatggtacttgtgtatgaaatggagcaacttgctagagcacaagattgttatggtctctcctattcctcagttttttttcccctccttttggccaccagatacgagcaactaggtcagaaaccgaagcacatggtttcaacataaaaacgcgagttttttgcgctaaagtgtgagccttgaatagcccaaaggtggcaaggtgtagtatcttccgagctggggtttgggaaggggctcgattgatccagtgatttacacaggctgggcatcttcacaattggcagttagtggtcctgtggtagagatccgatcagtatcctcacctcaagggcaaccgggccaattcagcgaaagaatatcagggtctctcgtattcccatgtgcaaacacttttggctctttcacctgcagtaaatgctgaggttagcgaccagagccagtattcaatcaccaccgtgagtttaatgtttgacagaaccagaaataggatggcaatgctggcatttggctggagtatgtaatctgcatgccgataaggtagatagctactctgtaaagaatgatagcgtaccagtgagagtagtgggattcgaggttgaattttcgctctggagaatccatccacggcaaacaagcacttgtagccactgatatggcggtgttcactgtttggtacaacaataagaaataagaaaagcattacagcgtgaaatgagtaccagttgtgcctttgattatatttattcatgcatggtaacaagagttgttcggtaatttgcttctactcaaacaaacatggaggtaatacaaggacttttccaacattaggtgaactccccatatatgtaggccccacttctcagtggtgcttgcaaaagtccgcttcattctttaaatatccagatagtaccaaaaataagtgcataaggtattgaagcaaatactcctccggtttctcaatgtaagactttctagtattgcccacgtacatatggatgttaatgaatctaaatacatacatatgtctagattcattaacatctaaatgaatatgggcaatgctagaaagtcttacattgtgaaacggaggaagtaagtaaacttacttcagcagatatgtgaaatttctttcctgatattcctcgatggaaattttttcctccttagaatatctgccagtgaacagattttgagatgctcataaatggcatgataaaagatactaacaaagataaaacactacagaggatacctccaaggatattcactttcacagaaacgtgaaactccactcattgcagtgaaggcatcaatgtgaacaattttgtccttcattacagaatctggtaaaagagaagcaaccaatagtatgtgccatcaataaagatattattgtcaacataccccataatcgctaaaacagtagacaccactagatgagacactactagctgttcaatttgtaatgtgctgcttgcggttcagccaagcccttgcagttttgttaacagaagaaaactatcataatttcacgtattccacataacttatgtaggtctcacctgcttcatgtagagcctttagagcatatccaccaggataattattgtaggatgccatgaaagttacaccagagtatcctagactatataattatatgtgagtttccaacagtagcatatattgtgctacttgaaaaaggataccatattaatattttacaatataaccatggttaaattattgtacctggaaagaaagccaccaatcatgagaacataaagtaacttccacccagttttctttctgttattatatctgaagatagacaaacatatattcacgggtcgaaatcgcaaagcaaagaaagagaggaaacgccattcaatacgaagggtatgaaataaaaggagttctgataatgaagctagcattcctagcttggatcagtaaattgataaaatagtacttcctctgtttcacaatgtaagtcattctagcatttcccacatttatattggtgttaatgaatctagataggtatatatgtctagattcattaacattaatatgaatatgggaaatgctagaatgacttacattgtgaaatagagggagtaggaactagatatgacagaagattggttatgctcacattctgcttgctgctagtgaagcagacacattaagcatgggaatcgaagccataatgaagcgaagctcctgaaacacaacatcagtcatcatgtacaagaatggccaaatataaggatggaactagtatcaagagatgtagagataccttatgtggaagctttgaataaagcacaacaaatgagaagactggaagtatgtatggcactatccttctgtcaagaagagcaccgacctgtcactgaaaaggcttcatgagatacatttcttacttccaataaaaaatcaaataaaaaaaacaataaccaataatgcattgatagtaccaccatcagaaaagatacatcataaaaatataattagttgactcaatcaaatagtatgaagtaacagttttgatataaagtacatgtagagatgggaagccaatcaactattactagctaagcatcatgtttcatgcatattaaatacatgataagaaggcatggaataagttatatacttgttcaagcaaaaggcacatgcactttttagccacgtaagtagcacaatttcttgtatggaagtttcttatctcaccatgcaaagaggatatgctaccagcatggagcgtggaagtgctgaggtgaagtaccaatggatggaatgtgtctaaagtttatggtagtcatggataacagggctgggagcttcgcataagtttcaggagataatacatagatttcaccacatgaatctaaaaagaagaagaggataagtcttgaccaagaagtgtatatatgttgcatccttttttgtattcatgtgactaatagagattaacatcatgttcagtgcatatgaaaatgaaacttcaatcttcccaatcttaatcgaaagatatgtgctttgcatattctcatatgaaatgtctctgtgaagtgacttagtgaaagagagaactgatgcatatatatttggtagtaaaaagaataaaattctggctaaagagaaaggagtgcatatgaaaatgtctccgtgaagtgacttagtgaaagagagaacacatgcatatatttgctaggaaaaaagaataaaattctggctaaagaggaaaaaaacggtgtttcattgtgcacttgaaggtttaacttgaaatattattaaaaaaaaaaggaaactgcagtttggcacatgcacacaaatagaaaaaggattcaccccactctgaactccggttcagaactgaattaacccacaaaccttaaattctggccgcagtattctccgccacagtatagagtcaaccagtacagtgaaggctaagaacatattcatagtaagaaatgtttcttgcagatttgcacagacttctgttagactattggagaaagttcaagagagtagaaagcttcataccaatgcatataatggcagtgctccctcagcattggatggcttccaatagagaaatagacctgctctgtcacagcatagtcaaattgcacctcagccccaactttcccagataaagtaagcagaagaatacatacaaagtccaaatagatataacaacttgatatatgatagtataagtgagtgtatcattttaatagcctggtgacataccaagttactcacttagagattattagccatgcctcaataaaaataacttatagagataattaaccacagtccctcatggtccttcaagcaagtttactaattcactacagagacacaaatgatgagagccaaaaccggaaatcgggttgaaccatgaacccttatgattctatgacaaagatactttgcattgaatttgaacaaacacaaagttgggaagtaatagagagtattgacaattggtatttgtacctagtgtacgagataagagctatttgtgcatagcctacaaaaatgagtaatataaactttggacccttgcttcctcaaagattcactacataaaagagtatgaaatgactgtgcaactgccaagagaaatttaggttttgtaggtgaaactcaccagcaaaagtgcaagtcctattgtaccaagaagcaaaatcatgtcacacctaaaaataactgctgcgacaatctgcaagcaatatggagaattacttcagaaggaaaaagcggaactgaggatctttcaatgctataaaaccaatttgtaatctttattggtctgcaaattaataactgagaatcctttctcaatttagtaaatccaaagaaattgaactgaacgaatagtcaagaaagaacctctcagtttcatggtcaaactctgcagcctacgatgtcatgtccggaactcagattctgtcgagttattgtgtgcagtgcaggatgtcaaattttgaattcaacagtatatggaactcgaattgaaataaattcttgctttctgcagtgtatacaaaaatgtgaaaacagcagcatgcaaacaaaatggtgtgaaagtaaggtaaaagtgttaaaaaattagcataccagggcctgtaatgtgcgtcgatggtttcccttgaaccagaaatagtatgtcaagttaactgcgagacagaaagaaacaatgagttgcacgattattacacaaaccccacatatgattaatgctactgccaatagtgtcacaaaaatcagtaacactcgaacagacttgtgtttgatttaaacaatgtcctcaccaaaagctaaagctaagacattcggaaggggcctggttgagtagaacaataagtgaaactgggtagcagttagtatcagatagaatgcttcagcatgatgaccaaacttcctttttacctgtatatcagaaatgaactgagaaaaacgttatggtgtccaaggacagaataacagactcgtgctcacgggacgattcagtgcaaattatagaaaacaaatgttactcaagatgggcatagaacagtttgacataaacacataacccaaagggatatcttgatgatatacagcacttagaagtttgtgcatgagatatgaaaaacaaaaattaagttctcttctatccatatttgaatggaatataaatggcacaaagtgaaaggtatcgttaggtatatggcccaaaccaagccataaaaagaagattcaaacaaggctagcatactgcagcatgtatgccacaggcaagacgaccatgccattctttttaaggggaggcgccccttttttttggggggccccctatataaaaaaaaaaatttttctacagacgcatcaaaacaaaaaccaaatttgataagcaaggttccttttttttaaaaaaaatggtggccattctatgagttgctgcacttcaaggccaggagaaggttatacaggtaaaaggattgaggtttaccccttttcagggaaacagcgttttcagaatattggtagtacctaggagaactgagaaacagtgcatacttgcaataaacccttttaaacagaacaagaagtgaaaaggaatacctgaactcggagaagtctcaaagtcatcaggataatactacccaacactatccgaactaaaagggcaaaatagaagaacatcaatatggcaacaaaaacagatacaacatgcaagaagacatgtgctaagttattgacagcacctgctagaagaccataaacctttggaacatgacataaatgcattacgaagactgcaggcgatgagataacagatacaaccaatgctcctgaagaatatatgtagtaaacggtgttaatgatctgcgtcatgtccagattacaaaatctgcaaggccagtcataccatatatagacactacaggcatatctagtaggagtatattgtggtaaactggtaatgccatctgaccttgaccatctacttgccatttcattatgcttgagccaagcaatggtcattagcggaaaaattgtagcatagtgcacagatcaaggcttcaagtgaacatagtattacctataaatgaccgagggacaacaccaggaaattctaaatgatcatactgcagcaaattgaagaaagaaattaaataagcatcaagcatgttgtattgatagactagcagaaatgattaccttctcaatatgatagttgtggtagagaatgtcatgcatggcctagaacatacatgagcaaagtgttagcctaaacattgtaatggcattacagtaaaagtgcaaacatacactgtggaataggtaaaaaaaatttaccaaactaaacggaaaaaggcaagaattagcaagtaaaagattcaataccaggcaaaggaaagataaatgagcagtagagaatgaaacaatttcccaaagcaaatttcattcaaattgattatcacgcagagcctaagggaagttatcaaacataaagcattagtttttagacatgaagggttgaaagttgaaactcataattatcctgcaaattttcctctacttctttaacattgcataggtgacactggaacttgagcaacttcagcttttcaacgctcatgatataatatatatgatgtatgaactaccaaatatagaaagggtgcatcttggatgtctacggcaaagatacccgattcatcaatattcagcatggattctgcgtgtctgcagaaaatgtaaatgaattcacataagctgattgttgttaagtcatactatcctacaattcacatgtgcacaccaatatcatctagcaaccagttgcaaccaaaatgaacattagcaaattatcagcaatcatcctgaatcccgtgtctagtaactgaacagcaacagagaataaggacacacactactacttgagcaaacaacagaaaatccctactgtaattgcacacaaagcacgactacaatgtaatccagccactcggatgctcaacggagagggagccggaaccggaacctgcacgttgaagctctcttccaccttggtgtagggcaccatgacggcgtagaacgcggcaatcgatccgagcaacaggtcccaccctgcaagcgagagtagtgcccccgacgcatcagatcccaaaaaccctcccaccaccgcagcagagccctgatttggagaggcttcgcgaggccgagagcgagaggagagcactcaccgtactccctcagcagcctcgccgccggcgagggccgcggcggcgccatcccggtggccggcaaagtgggctcgcgcgtgcgacgagccgacgagagcgagtcgcttccggaattccgcggcttggtcgagccagatcggcgaggctgtgctcgagtcggagtccggtttggttgacgcatccggattagtgggcccggcctagcttagcctcttactaggtggcttagatgggccaggccatgatggactaggcctcacgagtggcactcagctagttgggccctaaggcccaaatacctgatgcttgaatttattcatcagtgttaggccctctttggcacaactccagctccagctccacccctcctggagctggagctcagccaaacactttcagctccaccaaaactgggagtggagttgggtggagctctctcacaaaatgtactagagttgtggagctgagtttaggcagctccacaactccactccagactcaactcctggagttatatttaggagttggagttgtaccaaacaggcccttactattacaagaccatatcagcagaccacgatgacgaataagggcccgttgaccagtcggttgggccgaatggctcgcaagcccatcgtcttgtgcaaacccgctgaaagcagtagtcaaatgacgtggtgagatcgtattgggcactggcctcctaaatcgctgagaagccggctaatctagcacctttaagatatcttatatttgccacctgatgaaaaatgcttagtggtttagcacgatatctcgtgctgccctgcaacgctttaagtaaagcctttgcaaattgagtaattgacaaacaaaagtgacgagtatttcttactgcatatattttctggaagcaacaaaatgcttgtctgggcatttgcgatgcatgtcctctttaagatgggcagcacaaatggccaaatggccaaaaaagaaaaaaaatctggaaattaaataaacttgctacaacataattaatcgtcttgcatattgcaagtgttcaactgaaaacgcgcggtaggtgcgcctatcattagcctgtctgaaaacgtgtgtttcttccagcagagacggatgcagtgtcagtcagacagtcaccacacactgtcatcagacagagaggagacaacatgtgaagaaggcgagtttgtccgagagctcacgttcgttttaagcgctgtggaggtgcagttccacaatcattagcggctatggcagcaagcatgatgggcgagtacgagtacgagtggaaggacgaccgctagctttgtgccttccctgattcgtcagggtgttgctcgtaccatacagtaccactttgcgactgtgcatgtatggccgacagacaggcaaggtgtgcatatgcatatgcctctcgctttcggtgcccttgcatgcatcgcagttcgcagcagccatgtccaagggcttttaagcaggcaggcatgatccaaattgccagactagactagcagtagtgttcactgtgcttggtacttcgtcaggtatatgtaggagcatgcatgtctccacattcatattaagatcgactgaatattatgcaacttgatcagctgattgatactaggaaataacatgcaggtgagtgagacttgagagttctaattaagcttcctactacattttcattcataattagactgaatatcatgcaacgtgttgatcgatcggctagctgattgaccaggaaattaaatagcatccataagagttctaaaagctttcctagtacattttcattttacatcgatccctgcttcttcgatttcccaattgccaccatcagatcagagaacaataatccatcaccgatccatgtacataagcatgcgttcgtcagaaggaggtgaaggcgcagctggcggtgtggtcgccggcggcgccggtggtggcgtcgtcgctgcagggggtgtgggtgtggcggccctcgtaggtggtgatcaccatgcggcaatcctccgacagccgctccacccgcttcttcacgcggcagttgttgtgggtgcacctgtagtagctcctgcatttgcatgcacaatttgcacacaaacagtacacacgcgcacaccaacacagattaagtacggactggtcagcaagctgagagagagagcgattcattgtatgcatgctacagagaaactgcaatcacaaacaaatgaagaagagcgtcagcagcggatgctgctagctgatctgaaatggcactactggcctggtgacatgcctgcatgctcaaactgatgagcactactagtgctgtcacgtactcagcaagagttcatcatgaatattgtacgatgaaatgggcaaggttaattataaacaaaaaaaaaaggggggagacaattttaattgacatgaaccctttttttgctaatatattattagaaaaaaattgtgttacacaaataagaaaaacatttaatgtgtacgcaatttccgcatgtcatgatcaccgactcgtaactgatcatgcatacatctgaatactaattaagtttcatacggggtataatagctaataatgagctcaaatttgggctcaatactcaaatatatggaaggacaaatactgcatgcatcctctctttcagaaaatgaggctaataagagctccaccatttcctgaaagagaggatgcatgcatcatttgtacattgagaaaatggggctaataagacccttagggcatgtaaatccaaaagaaactagactagaagtcaagcacaccggcaccaattctcacaacagaactccccatatatctcttaataagtactgtgaactgctatagataaaatcaaaatccttgcaatttatttactaggaaatattgttttcgcctagagcaattcatagctaggaaacatggagagttataacttctaagggcatgaactattgtctatataattttttcatgttatatcttagacgatatacaaattaataactcatacagtagtataagaaatactttagttctatagatagcatatatgaaatgtgtaaatagtataaagttttctattaatcaggccgtctggtaatcaacaaacaattttttttttcctctctactttctcttgccttaacatcataaaagttcctactaccatgcaggagtagcgcattctctcctaaacgatgacattttagttacaccattactaatgtgtgggggccaaatccttcggtcatcctagcaaaaaataatgctatagtggctctgtttaacccgaacacccacatcccgcgccttgccccacctcaaccatcgaattacagacatgaatggtgtaactcacagttttgaccaagacatgcatactttgacccccccccccccctcttttttttttgctaggatcactactataaaaaggattttttcgtgcggaggtcttgcccgtctgcacctaggtgtctgcgaaaataaatattttcccgaaaataaatatcatcgatgactttgttcaactattatgaaaatatgatactatttccccatcccaaaaaaactctatgtttagtccataacccctgctttcgaaagtgcttgctttcccttcgagggtgtcctcgaatcgggctagatctcgttccagtgttatccccctaggacaaatgtttttcaaaatgacccgaaaaaatgccaattccttaggcacataccaatacaataaaaaatgctagaatatccttcaccttagaaaactacaatgtatttatcccgtactttagcaaactccgatgcatttattgctccaaaatgaagtctttgtaggacaaacgagatgggctaaaatgtggtcttttttgaatggtagcggtaataaatctaataatatgacttttgatgtataaacataataatatagaaattattattgttcaaactttgaacatgatatgaatgtatccgttattaataaacggagggagtggtattttagactgttagttttcatttttatgtttgaacgtgacgcaggagctctgctattcaattactatgagttttcactgaatatacgctgttttcgttggacttatgtgcttgcttgcatatcaattttatcactcaaactatacctaaaaccataggattgcagagatatactacaggaagaaatcatgcacaagctgctaacaggggcttccccttcttacgggtactaagtatctctgaagaaaaatattgcaatctgaaaatgtgtgcaccatttgtcccggtgcatccatatgcacacaggtggatgtgcaagcgcctgtcctagcgctgcagatcaaaaatcatgataggttttactagtgccataaagatgacgcatgatcagaacttagaccaagcagaaaagagaatagtagcggctttattttttttttcttttcaaaatcggcttttctgaatcaggtggcagtctctggttcggtaggtacccgtgccaaaacatagggttaaactcaggtgttcagggatactaataattagcatagggattcgatgctctagatatctcgtttttttttctttagtagaaatatatgcatcatactgtggcatgcatggtgcattattattgcatggtatactctttcagcaaagttcaccagctcatgctgatgcttatagtgtatatatgaaacacacatgacatatgcaaatatgaactttgagaatggccacatggagtttcgatcactgacaggggtggatccattgtgggtagtggggggacttaagtcccttctgccccactggatcatcgttgataaaagggaagatgaaaggagaaaaatagggagaaaatgaaaaataggaggattgaagaagtaataaggaaatgagtccccccttaaatcttgttttggatccgtctctgatttcactgatatctatgatatatcgacgtattacacttaggaattttttttcctgaagagaccgtattttgtagtgttcccatattttcaataccataaactactcgttacttatcttcggtcaacaaatgcaacatgatgcataaagttcaggcttcttgtcaacaagaattaatggatgccatatatagtatacaaatgttagctagattcacttggcacgactaattactgtaaaataagtcccaataaattaaatgggtagttaaattttggaatattttctggttctttgtcattataaggatgccttccatcttctagtccaaatcaaatgtgccagaaatgggcgcgtgtttgttaatcagatcagcttacatgcatgcaattcagtccaaaactgttgtgtaaaacatataatactccaaagatatatgcatggcaaattaaatcgaccgtttacttctgaacaattaaacatatatctatttgatgttttatcgatactattcaaagcataagatgatcgatgtgtcacaaattaaggtggacaatttctataactacagaccggttctttttcctctaaaaaatttctgtgtagatgcaatgccagcatatatatccctaagcaatattccagcaccgtaccatcatctatccacgaaccctctattatcatgttgtgttttgaatgaagaaattttgcggaaaatatgtgtggagaatatgggtaccggcctaccgggtacccacacggcctccatattctactagagataggaggtgggccacatccatatattatgtaatagattaggaaactgatgccgtgtctggctaggtttcttctttgtaaccctggccccccaacctatataaggcgggcagagagccctgccttctccaaggggcatgaacacagggattcacaccagatcatcagattaatactacacatagcgggtaaaatcctaaaataggagtagggtaccttttatcgagagggcctgaacctatccaaattcttgtctccgcatccattcactgttaggtctcgtgcgctatccctttatattgccgaattctagtttcgacaatatgtgggaaaagtaccgaatcctcaccatcattagattgtaggaatggttggagagattcctatgaaatctttccttttcttcatttttctagtgtctaaacatgaactcaaacatcatgtttggaattatttggaaaaaaaaaagaaccaaaggagttgagctcaagatcctcgttttcaaaatttatatgcattcccactctctctctctctctctctccctcccccctctttttttgagatggattctaatcactcaggtggatgtccatccgtttattgcatgttaaataaataattatgaaaaaaattgataaaatagattaatataaaatatatcactctacgaacatgaaagtttaaattcaatttctacaagttataacaaaaataacaaatcaaaccatgaatatacgtctaataattagagttaaatatgtcatttttattataacttgtagaagttgaatttaaacttgcatgttggtggagtgacatattacatatatcaatctatcatgtcaatttttttttgaaaatttttatattcatttagttaacatgaaacagatgggtggatatccacttaagttattaaaattgttttcccccttttcatctattaaaaaaatattcctttatggttcctctagtgcatttggacatttctcttgcataattcctgtaggaatctgcagtgtacacacacatacacacatgtaacatcatagcaagagtaggctaggtgcaaactgatccttaattagtcgtcaactaatctacaaaaatctgcattcactctttcttcttttaaagggtgaattcgcactcatgtaatcaagttattagatttgtgaaagctcttttatttgatctataaagattaacaaagaagcaattctccatttaatattatagctattgtgaagcatgtaattcaactatagttgcacaaccatattgccacaaaactagttaaacctcaccccagataaactatataatatatatgtgattcaagataggcaaattaatacttaaaataggaattgtcgctgttctccctctcttcgatcttgtgttaggggccgcattcgcgagtgtgtgagtgtggtggtgtacatatttaacggtgtgcactggtatgcatcttccatgtaaccgggaaaaaaagataggcaatggatcgattctgatcccgctgatcttgtttcgagcatattagctatggaggcagctatggtagacttctgttaattatattagcagctgtggaagaacctctaggggttgcatatctctcaatttatgtattatgtttcgtgtatatatataccttgggtggaggctgttcttgacaaccttctggccatacttcctccacttgtagccgtcgtccagcacatccacatcgctcctggtctggaagcagaacctcggctccctcatcttcctcctcaccttcatcttccccttctccgtccccttccacctgcccatcagtcaatctggcctattattacctcatcaaaccctaatcaacaggaggctacaacctcaattcaaggtgttagctaggacgaggtgatcgatcatcgtactcaccatgaattaggcccatggcaagtggttgcggtggcagctgcagcaatctcgctatccactctcgccgccgccgccgatgtgtccgcctgatcgatcgatcgagatccaagattgtaagcaacaagtaattaaagaacggcataccatgaccaaattgagatcgattgaaggctaattgatcacctcggcggagcccaagtgcgcgaaaccggcgggcttgtcgtcgtcgcaggcggcggcgccgcagccggagtcgaggcagaacgggatccccgggagcagcgggtacaggcagccatggtccgacgagaacatcacgccatggttcgtcccggtggcggcggcgtggtcgtggaccagctgcggcagctgggg

SEQ ID NO: 58709 - DNA, 9612 bp, Oryza sativa
ccggtcttgctcgatcagacccctctccttgagaagtttcaccacgagatggcggggcaccagcctcctctcgaggctgtacatgagcagcaccgaccgccgcgcgacgtactgcggctgcagcccgacctcgtcgatcaagaactccgcgttgcggcgcagcctctcctcggacgcgaccaggatccgcggcgccttgctcacggccaggttcacctcctcctgcgaccacccgaggctctccttcaggacggcgaccttggcgtcgatcttgtcctggccgatgcagccggcggtggagagcgcgtgccggaacatctgggagcccggggccacgccgagctggatggcacgccgcacggcgtccttgacgtaatccgggtgcatggtgacaagccgcggcgcggccacgagcagcttggaaatatcacgagcacttagcccgcattccttgaggaaggagacgttgggctcgaccaccttctcgaggtcggaggtgaggagccagtagttccagtcgctggcctggagaagcctctccgatgagccgaagagggggagccagaaccgcaccttggagacgaagctgcggcagaggaagtagcggccggtgatctgggcgaggcgggcgatctgggagggggagaggccgacggcgcggagctccgagcagatgggtgcaagggagcggtcgatgcgggcgcacaggatgcgcgggttggaggcaacaatggccgcgacctccttgggggagaggccgaagtcggcgaggaaggcgaggacggcgtcggggttggagcgggacttgaggtgggcgatgctcttggacgccttgtgggcctgtggctgggtgagattgcagttggagatgaggtattcctcgacagagaagtggttgtcgggcgcggtggtggtggtggtggtggcggaggcggcttcgggcgcggcgcgggagaggagctgcaggcggaggcggcagcgggtggggaggtggacggcggcgaggggagtggaggcgaggaggaggagaggcatgggagcgaggagcatggccgctcccatggccggggaggggagacgtggcggggagagagtgggtgatttttttgaccgaggttgtgtaatccgcagcttgggaggcgcagctccgcaggcgctcgcggtcgcggaggggatgagacgatgagcctagtactccctccacgcccacaaaacaagtcgttctgggctcttagtccgttttcacaaaacaagtcgtcgttcctcagtggggtatagtttggacgcgtatgcccctgatgcgagagccgagtgacgagcggcgaggcaagaaacgaggcgacgtgattaatgccgccttaagctgaatggacgtgattaatggcacacgcacgtcgctcgcacacgctcgccgctcgcacacgcgcgtctctcttccttgccgcccggctgccgagcgccatgatggagtacgtcgagtcgctagagtacgtcaaggcgccggactccgtcgacgcgctggacactgttgacgagggcccaaacgagcaccatgcaaaatcagcaaaaaaaacaagcccaccaggaatcgaacctaggcactaagccttcaaacctcactgcactagctatttgagttctgtttgtttctcaaatgaatgcacccgcaccctcatttaataagggaaaacatgaaagaatagccctgattaatcactccttggtaaccacaattttgttttaaacgacttgttttgtcggtatggagggagtacgctgtacgcccaaacctgtcctgttctttgggccgtaggctccgccctttgcttgtagcggtcgcccatcaacggcctaattggagtccagccaatttgtccggctgttacgctggcttgcggcccgtgcggtcacgatcatttttgcaaaattcagctgtagaatttggtttgcatttggatgttagaaacgtagcagcagtgataattatgttggtttccgcatgtttgattcagcatagaattattgtaatttaaattattagaagtaaactgaaataaacaagtaaattattactccctccgtctcaaaatatatcaacttttacttggataagatgtaccttatatcttatatccagattcatagtactagaatacgtctcatccaaccaaaaattgctatattttaagacggagggaatatgatagattattataatccataagtcagattagtataaacttattatattatagattattggagacatataggacattttttagccacccaacaaaaaatcactacccctatatatctctaataataaaacaaacaaacaactcacaacttattttatatcaacttattataatctagcttacagtaatatgatttaatattctagattataataacattaatctgaaacaaacgtcatcattgtgcactctctggattaacttttcacattctggaagattagtgttgccattgccagcgttaagtgacagtcacagtcgcacagtagcaatggcagcgttgagctttgaattataagttctatgaccacaaatgcatatttcctcgacttcgcttttttttttctcacacacatttgcattttttttaggtccctagcacgaatctcaataaaaatacaattgtcaaaaaattgcaatatctctaacaaaaaatcttgcgatagatgtataacaatttcagtgtttatttgtaggaaaaatactataattgcgttgacatatttttagtggattacagttgattttcatggcgtttgatttgtttaccgtgcaagatacgattcttcagtgcaaactatggaatatatagtgtaaatgcatattgaaaattataattatttttaagaaaagattatatcaacataaatatagtcggtccaaaaaaaatctggcgtttatattgttgtgtatcttcacttttgcactagatcaatttgaaaacttccttccaataacttataaatagatatgagaaagatatttaagtcatgcttgacatagcttcagattttattatacataagaaacacaacggggtgtcagacggtccaagaacatatgcgatattccgtgcagatacgaggagctttttttaaaaagaaaatcccaacaggcgtaaaactctccgaggagccgaaaaaaatcaaaaaaggaggaaatccgtaacattacaactgttaatggctagttatatccacggtaaatctaaagtttgtatgttaaattatagtggtttaaaattttaaaaaacacctaaaataaaaacgaaataacttatccaaatattatatatcgacgtgattatagctttatcgatgatttatcaagtatttgtgatgttaagaatactcaatttaaaaaatcttggatcgggagatgcgtcaaaagagagcctcaatgtttgatatcaatttcaaaatcttcctggcggcccttctttccttatttattttttttagaaaaaaagaaaacaagcttcctggccgccgaacgcatgcagacgtgccctttgaggctggcgtgttcggaaccccttctcccaaccctctcgctagttctctgcgcttatgtttttcaaactgctaaacggtatgtttttttgcaaaaagtttatatgaaaattgtttaaaaaaattaaattaatctattttttttaaaaaaatagctaatacttaattaatcacgcgctaatagactgctccgttttttgtgcggagagaacgagttcccatcctggagatgcaaacacaacctgagacttaatcgagtgcgtgcttatttacttcgctaggctacgacgaaatcacgaaaacccacctactcaatgtatgataatcgaattaacaatcttcatggccaccgaacacatgcaaacgtgcccaatgagacttttgatcaagtgcttacgtgccccaccagggtacaacgaaatacggatgtgtgtctgctcaaggtcaatttccgcgttgattagtcagttcgttaacaacatcgactactctataattaagttaatgattgggtaaagacgcaggaaacggatgcgcatgtctgggaaggactagttcaagatgtcgtcgtcagtcagtcaatttcaaaatcttcctggctatacatttttttagtggctggtccaaaggctggacaacgtcgccacagcagcatgcatacatacatacaactacagcacaaacaaaacacgcagcgagaggcccgacaatcaactcacgccatttttaacatttttcacgccgcggctgctggagaacgattcgctagttccgtgggacaataggtgggctgcagggcggtatatagaatagtcatcagtcgtcagattcatgcatgggtgcgttgcgtttcctataaatacatttggccagatggccatctgcaaatcagcagcttacggcactagttagctactgtgcaagaaccaaacagttaatcgcatacagaatctcaattagctctgtgtttcttacccttggattggcgattgaattgtgtgcgttcggcgatgggaacagccaagttacctgcattgctttggttactagcaggcgtggtgttagcacttgcagttaaccccgctcatggcgccaagactcgccactacgatttcttcgtaagtgatctacttgaattctagcgtgttcactgatggatgccgatgtacaggcatgaatgcacgaaatgagttttgagttttaaccatgcgtgatgccccccctgcagattacggagaccaactacacgaggctctgccacgagaagagcatcctcaccgtgaacgggcagttccccggcccgaccatctacgcgcgcaagggcgacctcgtcatcgtcaacgtccacaacaacgggaacaaaaacatcaccatccactggtaaaccacatccgttttgccacctgctgcagagaagaagagcattatccttggctcgaaacttacggtgttctcgatgattttactgtggcgcaggcacggcgtggaccagccacggaacccgtggtcggacgggccggagttcatcacgcagtgcccgatccggccgggcggcaacttcacctaccaggtgatcctgtccgaggaggagggcacactgtggtggcacgcgcacagtgacttcgaccgcgccaccgtccacggcgccatcgtcatccaccccaagcgcggcaccaccttccccttcaagaagccagacaaggagatacccgtcatccttggtatacacaagccacaacaaactaatcttgttaatttgataatgttccattgcgcaatgcaatgcttcgtacgtgttttgatcttaaccatctctatgatgttctgcaggtgagtggtggaatgacgacatagagcacgtgctcgacaaggcgcagctcctcggcggagacgtggatccgtccaacgccaacaccatcaacgcccagcctggggacatgttcccctgctccagggacgacacgttcaaagtggccgtgcagcagggcaacacgtacctgcttaggatcatcaacgctggactcaccaacgacatgttcttcgccatcgcggggcaccgcctcaccgtggtcgggatcgacgcccgctacaccaagccgctcacagtcgactacatcatgatcgcgcctggccagaccatggacgtgctcctcgaggccaaacgcaccttgggatccaacagccggtattacatggccgcgagaacgtttatcacgttaccgctcgacactatccctttcaacaatagcactgccacggctatcgtggagtacacggacagcgtcaccgcgaggccggtcgggccaccggaattccccgtccagctgccggccatcaaggatgagaacgcggcgatggcgttcgtcacgcagctcagatcattaggcaaccaggaacacccggtgcacgtaccgacacatgtcgatgagcacatgctcatcgacattgacatcaacgttcttccctgcgaccccaccaacatggcagagaagtgcaaagaaggaccccaaggcaaccggttcgcggcgagcctcaacaatgttagcttccagagcccggctatcgacgtcctcgacgcctactactatagctctggccacggcgtgtacgaggaggacttccccaacaagccgacagccttcgtcgacccgcccgtcaacaacggcagtgggcccttgatgacgaagcgtggcaccaaggtgaaggtgctggagtacggcactgtggtagaggtggtgtttcatgacttgtccagcgagaaccaccctatgcatctgcatggcttcgccttctacgtcgtgggacgagggaacggcaccttcgacgagagcagggacccggcgacctacaacctcgttgacccgccgttccagaacacggtctctgtgcccaggtccggctgggccgcaatccgcttccgagcagacaatccaggtgagagttattcagatttcggattatggtctttgatattggtctttatgtacagtttttaatatttttttcgtgtttattttgattgttcaggtgtgtggttcatgcattgccattttgatcgccacgtggtgtgggggatggacactgtgttcatcgtgaaggacggcaagacaccgcaggctcagatgctgcctcgtcctccaaacatgcctcagtgctaatgaccgtggttcaaggaaaataacaagagcatgcatcacaagcaagcggaaatttgtttattttgttgattgatttagtggtttatattttttccttgtttcgatgaaaaggaagaacgcattctgtcttgacttgtaattgttagtcatttcgttctgtcatgtaagtttgggattttatgaatataactaaataatgtttatgtagtggatcgttattatgacgtctttctttataaacacacacatccttgctatcttatctatgacattgtgttacagtactgttttagtttttcgcaaggtggtgtccttcccttcgcttagggtaggatgaaaagctcgtagctcattagctcgctcggctcggatcgttgtatttttgtaatgagtcgagccaacgttttagctcgttagttataagaaaaaaggacaagaaaaaggcccatcttctgtaccctttttttagaactttttctatcgtagttggagttgtctccagtacgttccccaatcccctcgatctattgctgctctctctcctctagttgtctctagccggtcacacactccacccgttgctccaccatgcctgtgcctcaccttcaccggtggccatcgtcttcataggccagctggccgcccgtagaagcaggagctcgtcgagcactcaacactatccacagcacacacctaaccacatttctcctgctccaactttgttgtgatttgtgaccttgccggtgtgccatatgccgccaccttggcaaggcaaatagataactccccatctcctttcgttgcattgccggcatcacctcccatccgcgtgtgttcattcgtcgcccgaggagtacgtcgctccgacgaggtccagccagcaccgccgcgccatagccatgtggccctcctcctgctcgatttgttggtcgtcgtggagtccactgctccgacgaggtctggccggcgctgctatgtggtgctccttcttgactcgtcggccatggagtccgtcgttcgctcgcccttccagatccagctcagctctgggcatgcgtcgtccaaatctagctcgcgagctaaacgagctggctcaagcttacaattgacccgagccgagacagacttttagctcgttaggatagcgagccgagccgagccagctcgttatcttaacgagctagagcgagccgagccgagccagctcgatatccacccctaccttcgcttagtctcacaaggttttttgtttttaactagtcactacctcttgtactataattgctaaaccaagtgagaagaaaataatgacacaattgaacaatcttactatcaaatagctactccatcatttttaatatatcacaccgttgactttttaagacacgtttgaccatttattttattagaaaaaatgtataattatcatttattttgtttgtgcttgatttatcacaggtcctgtaagtattatgtacaaaattatatattcgaagaaaaaaaatacgacgaacgaccaaacgtttgtcaaaagtcaatggcatcatgtattaaaaaacatagatggtacattataagtacatttctatttttaagacaacttcttaatattttgtttgtcttgaaataaaaaaaagcctatgcttctaccactttattgtgagctacatagctccgaaagcatatcctagaactagcgaacgcttagttatgttaaagattcggtcaaaaattaaaaattttgcatatcaatgtgagttatttctcaaatgcttagtttagaaaacaaaataaattatacatgtggattttcctaaaaagtattatcataacatatcacacatctattagattttacacttttattctaatgtgaaattgattgtcgaaattttttaaaaaactgaacagccttttcccttaaaccttaaatatctacccactccgttccaaaacataaacatttttaggattcaaattttgtatataggagggtaatccaaacaattgaaaattcaaaatttgactactgagataactatttcccttatctttaatatttactaaacaaccttaaaataccgatacacatgatgaatctcttggccaatccagtctcaaatcttccttttaaaatacatcatacgatactttatcttttgcattgctattttgttcgaaaaaaagttaaacacaatgtaattatttaattcaaaaaaaataaatataatgtataacagataaaaacatcaaccaattgtatttgcaatttgattttggtattttggaacattcatgcttattttggacatttggattgaatatttctttccactatgcccacttatgaggttgctacaaaagctagaatgccataagcaaatattatctgtccaaagtctcttggcgaaattttcgaaaaactgaaaaacctaacataaaatctttatgacaccttgaaaattgtagccaatttatttcttacgtagtaaaggactttgtaattatttttaagataagttaaaacggctcattactgtaatgggatggtttcattgagtctaattgaaattattgtgtttatgtataaagacaaatactgttgatgggtacatgacgtgatttcataggaagaattcttgttgtccacctccttcgacatgaaaatttgatgacatcaattattaaaatttgtattcatcaaatattatgtcacgtggattgctgtaccagtgctttaaaatgggttgaatatgagagggaaagaaacaccatgctcctgtttattttatttggactatattatacagccctccctatatcctaaaatatatccgcactaatattttagggtgaactattatattttagaatgaaggaattacttttactcaaaaaaag

SEQ ID NO: 58710 - DNA, 12979 bp, Oryza sativa
ttacaacactttacataggaatgctaacgaaaactcaataatgatggcatttctaaggcaaaaacgcttgtacttagaaagttaagtttatcgatgacatttattagattttctctaaaataattagattgtgcttctcaagcgcatgaaatgcttagcagacgcaatggatttggaggtggttccggttggaaaccggatcctctgagggacgtccgaccatgctgattcgttcgatcggcatcggacgggagcgatggaacacaggaacgaacaagctaagctgtcgcggcccacgtaagaaaaatcggcccacgaagaggcttgactgccgtccgcccgtctccactctcgacacagccggagcgccgctggaaggggaagagaaggcaagcgctgccagtcgagctccggtgtgaggaggtcgcaggagtcccgggttgaagtggccttggctttgtccggatcttccctgcgctccccggcagagctcgcgcgcacggccgcatgtggtgaccaaggcgaaggttccgaaagcttgtgttctcgacgctgctggccctcggattatattggggcgctggagatgcaggtgtgctccatggcaaagctcacgaaggcgctccctccgtggcactcccgccgccggcgccgtcggcggcggcaatgttgtcatctccagttccaagcaaggaaaggactcgtatatgtatctgtgcatctcttttttagggtattactgtgttaatgagcaaatcgatggtgaaaagcatccataaccagttaacaatgctagtgttcctttttaattagtttagtcatgaatgatttttgtttaacggcaagctcgtggcttctgcagcaaaagcaagaacgagagtattcacacgcttcttttagacgtatgttcccgaatgaaatcgaccgggctgatttttgccggcggtaggcgccgctctagcatgtccgttaaccgatcctttcgcgcaatctggtctggcatgtggcgtaccaactaccaagtcagtagccagtagacaggtcacgaagtactgaagtactccctccatcccacgaaaaaccaacctacgtcccacgaaaaaccaacctagtactataatgtaacacattctaatactacgaattagacatatatctgtttagatttattgtactagatatgtcacttttttttcggactgagggagtagaaagaaaggcacacataaatagcccgccagcttgcgcttagttatagtgctcgctccaaccactttatggaatagataaaaatagaatttcaaaaagattagatctatacacttaaatcatctgttactaccaacgagaatatacaccctaagctcttcccgtgcaaaaaatcacacaagggcatggtgacaataccataagcttaacaaatgaacaaaagaattatcacatgaacatgaaacaattctcttagggcgtgaattcactctactcgaaagtcgcagcatcatttactgtccaagcttgctccatatgcctttccgtgctgttaggcacttcaatttgccaaacacaaaaccagacttttgagggttcccgtctacaagagagttctcgtatatttccttgcactcttgtacaacctaagaacgaggaatgaacagtgaacacgtaattatcaattaaaaaattctgactaacagtttttctaatcactttcaaaaggcataatttgaccactggaataggtctaatttgcactgtttcgcacaaaattgaaccgcacatgcatatgatgtgaaaaatgttatgttcttacctctttggcttccttccttggaatgccttccctcattcccacaagcttctcaacaacctcaggctacataacgtagatatcaagttcagcacatcaacagaaatgaatgcactactaaaccactaatttctggcaaaatcgagtagcttgttgaaaaaattaccgggcaatctggttgatgttccagaatatttgtataaatgagagtaaaactatccagactctcagctgaagcaagctcccttagatcagccagaatccgcactctggtttcaactttctggagcacaaaatcatagagtggttaaagttacagaaccaacaaataagcatttgtgaagaaaagtctaggattacagatgttcgatgctaaaattgtaaaatccagtttaattatacaatagcacaaaatacatggtatcgtgggtagcttggactttgaatgaaagccacatgaatggaagttgcaagtatacttactgtcacattaatgtgttctctgaaaaaatccataagcacttcttcatcaagcctcatcctttcgattgtttcttcttttatatggcctttctggaggtgcaaagggaatacatattatcaatttgaaataaattaccagccagcagctgcataagataagtagacatgtagtgtgaaatgatgggtgtaattggtaaaaagattgtctgacccagcaacagctcagtacagaatgatttatgaaacattttccaattcatatttttgttaacagtcatttttgtacagagaaccacaactggccaagtatacaactattcagtactaagggcagttctgcaaacctgagtaaggagatgatcaacgtataccacaattgtttgctccaggcaagcctccacaaatcttcgaaatgatctttcttcaatatatctagaaaaaatagacccggaagtcttcaaatcaagtatagaaagaaacatgactaactattatcaggaataagtgaccgtttacatgccacaaggaacacaaatgatctacaaaaggttaagaatagaacttatataacaaagaaaaaaaagtaaaaagtgtacgtaaaaattgcattggagctacctatgtttatatactttttgagaattctcacttgcatttggaaaattatcaatttacacattttcactatttggcaaacaatgtatgaaaatggttcatgcttgagatttggggttgagatttttcacgtcgtggcacacaatttgataggatgagattttctcaaaatgtgtagagtatcatatattcataatgaagacataggcaaataaaataaacataagtcagcatttcttagggaatgtatccttccgttccataccacttatattcaattatatgagaacttactgtttgacatccccaaaataatcagcaaatgttgcgacaagatattctgtaaccattccttccatccaatctgaataaataaaaagaatcaatgttagaaaagagagagagagagagactcacgaaaaaaaacacttgtgcacactacccattaaggttaaacactcaggaacacactgtaaacaagaaaagactagtacataaaatatataaacagtgttgtatatgatccttggtacatcaaaatctaatatatcagtttcaccaaatcacacatcggtgatggctatacttggtcctaagcacaaatttaattgtgtaagcatacatgttagaaaattctgggtgcctttctgggcttgtcgataagactctcacaagggaacaggagtcgctggtgctttcaattccaaatctaatcaagaacatgacacaaacaacagaagaaatgacagtttggaactaatattgcaaaagaattacctttttggtaaactttcactagtagatcctgtacacctgggtcttcaaaaataacgctgacagtttgaaggactgcctcctgttgaaataaccaaaattctagttaacaattaccttttatagtctaaagatgtagctaaatcaaataaaattgctcgaaagaaagccaaacttggctagttctcaggacattcctggaaagttgagttcattggtgcccaataccagttgtcagataatactggataaaattggctagaaattagcatcaactaccttgaactaaccagctccgtgctcacttaactattcaagtattgagctggcttttctacagtcttggaaaatattatgctggattcactaggtggtgctgaaagagtgtttctgacaagtgtcaacctccctgcttttgtcagtgtttcagtttctgtataatccaagcatctctaaccaggaattttggcctcaagatcatgaagtgcacagtcagatgtgtaacatgcacagagttagccaatactttctagaagcaaagtaaatcacaacttgcccataagagaaactacaaactttattgaacactagctatgcccgagctttgctaccgataaaaatatattataatattacctaaaataaaatgtcttacctatcattttgctatagggaatattcaccttattttgactttatatgtgactatccatttagattaaattgatttttaatactaagaaattcaaggggtaatttgcaaaactacaatgggagtaggtggggtggcagattcactgccagtctaaccatcaccactaccttcttttaaagtactatagagtatagatataaattacttaaaagatgccttatctataggtaatgacaatatatgcaattaaggcatccttgtatagtaaaccctgggcacctcaagaaacacttacgcagtggtcagcacatgaggtttcatttcttaaacctaagcaaatgaatcatacacatgtactacatccgtcccaaaataattgtaattctaggttgtttagcataaattaaggtttgagaaaaaaggctattataccctcactaaatggtgtataggtaagaattggagggtagttgagagtagaatagggagaaatttaaatgagaagcaattgatgagataattagtactctattgtgacaattattttgggacaaatttgtatcctagaaatataattattatgggacggaggtagtaacagttatgtcttatgcttgtaagatgtagaacaaaccttggcaacctcaagaaatcctttgcaggtatcttcaaaattaacctgtaaaacagaaattttgctttgccgtgaagagctttaaaatgcttaagtgtgtaactgcaaaggacaaactgcagaaaaacacatctttaacctatgtcaatgccaaagtctctatgtattctacatttctacaacctgtaatatgcttggctctcagcagatatttatccacccagtttgctcaatcaattcaaactatggactcatcaacagcaaaactgattccaggcgaagtcacaataggcaaaaagggaatgtgtgtatttcggacgcatctgcatttatgtaggttgtaggataccacaatagaggcatgattttacaagttttggtcaacgaagtaggaaatattttacctccagttttagttcattttatatccatgcacaaagaccaaggaactttagtttttttttacgtagattgcctctattcattacccatctctctaaaagtactgacaaaaggctatcaataggactgtttggtcaaaatgtagcctagaaaacacagaacttcaattgcaaaccaatgcttcctaaaatgtcctttagactggagatccatccctccctttctctctgctgagaagttagaagtagctgacagaatggaatctaaggagcaatattagtgactcattcgcacctgctcagcatagttttgtggaagcgcttccaatgtactgctacttagctctgatgaaagttcgtagcaacgcaggttgttgttaatctgctcaacaaattttatgtcaaatgatatgaaattaaagtagcagggaactcacatgcagtccttaatcgagaaaaatttacataccaatgcacatagagattccaagccaacatcagaagctggttcctcaagtctttgcctctcagctgcttgaaaatcaagcatgacctatattataaaggaaacaaagaagatgaatttggcatctttcagtaattcatgtcaacagcaaagcgtaacaaaaccatgtaaagaacatcatcatgaagggttaactgtgtaaatacctgtataactgcaagagcaatacgatacagcatgacatctgtgctattttctgtaacaatctgcacttgctcagtcaatattctgaacaaatccacagctgcaggtgtatatagtttcccatcctctgtactttttggtggttgtgttttgtcagcctccaaaatgttactgtaccatttctacaggagcaaacgagtgaagttacacaaataataatgattaagttcaaaatgaattcaacagatcaaaaggagtaccttagttgttgcttgcatacgttcgacatacatattcatgaggggatccaatgcaccactttctgaacaaacttgggcaagagactcgtccacaccaagaccgataagattttcttggtatttcacaacccaacctgttacctacagtgaccattcatttaatgattttgcaatatacgagaaagcaaaccaaacaagtgatattcatgaatcaaggaaaacaaaatgctgacaatgcttgcggttttcacatttcatcttgtggaaagtaaatttagcagaataaaacgatggcatttgaattcatataccttaagaatatttatatttggaatatcatttgctctatcactgagaagtcttagcatctggatgaacctttcagtatacaggtttaccatgagctggaaaatttcatatctgtatagaaacaaaaaaaaacatgagactgaaagaagttagtgggatatgaagaaacagctaggtatctttctgcaaatcaccatttctaaggagtaagtatagcccccatgtcccaaaagaaatagcaattgatgatatatcaaaatgaaatgagaaaaagcaaagtatcatattcttcatccgataagtttcattaagcaatacataatttgtgtatgagctgatgtatttaaagttagaacatgacaaattatgtcacgttcccatctattggattaggatggcatatagtgtggcccatcataggagataatctgtatctttgtattgctacagtaaacagatcctcagttcttgtgtacacagaataaatggttgtgaagatcttctaaggataagtatttcatataataattatcaacatacctaggaggaaaacatggtgcaacatagtcatagatatcaccaagctcatctccaatctgaattgcattaggaatagaagaatgacccatatcagttagataattcagttaatcaagataagtgtgtcctacagaaatagcagctattctttgccaggttgcaaattgaagaacaagaagggttaagatgtactaatggaatactaattgctactaataactaaaagaaagaaaagaaacaatgtcaatcgatacttcaccgagtcataaacaacagtactgtgggttccatcgcgtatcaaccacatcagccattttcttttcaatttgttagacaatatcaagttgagaacaatggatagaacaagcattggccacgaagctagagcaccaagacaatctaaggagtctagaattcttcatatgcgtttgtattatagcaagtgcaaaaacaacagagtacttactgccttagcttcctccaaagcttccatcaaatcttctgagaaaacaagctgtgcaataaaaaaaatcagctacttgctgctaactgcatggactgtgatgaccacacaataaaatcttaagtccaggatatatttaagcactacctcggtgagcagtttgtcgaagcgagcctcaacagccttcctgatatactcatagcatttgtccttgtagccctttccctggacctttgatttatcttgagtgcttcttggggtagatgttgctcctccacctttcctgctacagttgggcaaggatgagtcagaactatgagcagtcagtataataaataaaatggtttaataattactatttgagtggttctcacattggttgttggttgataatagatatctagagataatttgaataaaacaacagttatacaagtcatcatgacaatagtaaagcaattcatgcagaccatagcagacaaccaagttagttacacccatagtcccgtacaatagcttgaatttgttgatctggtagccagtctctggtattaaagatattatatatgaaaagcatgatgtaaaaactttaatgccacctttacaggtgcgcagatgcacagatgctgatatggacaagaagtgcgttagtactcatatcttcagtacagttatatcagcatgaaagtaaagggacatgacaaattttgtatcctaggatacattatttctttgatcctctgaaacatgaaagatataatatcaatatatcatactacctagcacctactggaagtacagaaacatgtgtgaagcaaagaaaggaagaagcatactttgcagttctacgctggtttgctattgtcgccatagcacctgcaccctcagcctcagctgcttcttctgcaacttgttgatctaggatctcttgcatttcaacaaccctaacataagaatgaatttaaggattatgtgcaagatatataagtgcccattacctagaaactaaataagaaaaaagaatcaagccaattttctaaatctcaaatgatcagcttgtatttatgtattatttccctaataaatcaataaatagtctttcattcaacaagtgaactgaaagggaggaagccagggggaataattgctccacagaagaaattgatgggcaacaagtatcaaactatgagctggtccaaacattcagctttcacaattgactgtacaaaatgatcaaagtagatattaaatagttcatgcataccttattgctcgaactaacgtctgagggctgcacaaagaaaaaagatagtgagtttaatacaggagcatttgtagcagatatgcgttaaatagaaaggcagtgcaattcatataaaaacaataagacaattcattcatttaccatgttaaatagcaaagacaaagtgaatcgtaataaaaggcagtacctatcttttgaaagtctgaaaaagttagtgacatggccccacaatgctttctcaaatgtttcccatgaacgatcaacatcttcaaagtactctctgtggagaagacaataatcaagcaaattatagatatatacttcattgcactacaaactagaagaaagattaaaatcccttgttaaccctaacagtatttgctatcatactgtaatatgtagagaagatcatttctgcatttcttccttaagagtcattgagccattatataccttgttctattttggatcttctacagtcgtttcataatatagtagaatcaacataggatcataagtctgattttcttcagataattttctgattgcagtagtattacttctgctcagaatgctttacattattctaacgagaaagacaatggggacgttaaagggtgggggcgtgggggggggggaggaggcaggtatgcattgaataatcattaatattagctagtttcaggggagaaacaccacctcaatcgaccaacttcttccttgtgagatgcagcagcagctaaagcaaaacgtctctttccatcaagagctgttaatctctaatttcaacaaataagatcaaacagcaaagtcaggcaagtaggatataactatgatcaattcctgatttaaaaaaagagctataatatcaatcatggtattgatcagtgatccaaagagggaaaaatagaacctcataagtgcgaattaactctttatcatcacttagcgagtcgcgtgctgcagctgcttcaacagaaatagacatcatacctcccacatcctaataggcattgacaatcaacatgtcagatgaaattttcgtgctcgataacttggttagcttaatgtattgataagaacgttagtaaaaaacaagcaagtacaaccttaatacagttgttattgctaaagtaaggtcagcacacctttaaagttgtgttcaggttatttcttgcgttgctaagaagcttaatcttgtcgtggttctcaattaatgtttgacactcctggcacaacctgccagacatttatgataaacaggactgagaaatgaggagaaacatataacctcaaggaagtgatctagcatatcaatcatgcaagagcataagaaaatgtagagataaaaatattttagcttacttgtctatatctatgaagttctcgcgtagtttgtttattgtttcctgagatagtgcaagagcattgatgccagcatgggcttgctcaacctataagtgataaaatatgcacatacagaaaaactataatccaacagacaaacattgaggggggaatgcaaatgatagtagcagaaaccgtaactcgagcaaagcattaacaatagcattaaaactaataagtttggcagttcatagtagatgtcaaggaatacctgctctgctaccattgtactgagctgtgcatcatttgtctgagaatttatagaagacagttagaaatccagaggtatataatatgcatatgccaatatatgctttacaaaatggtaaacatgctcataatatctcactgaagataatatgcatatgccaatatatgcattacaaaatgggtgtgagcacatacgcacatacacttagccatgttttataatttacttgcatgtctacatttaagcttgccgaacatcccagccatatctgagaactgagacaactctgcccaaacctttttaagaaatgcccaatcaagtctaacacaaacctttgcttaattagtatgttttgaaaccctttggtaagagataacaaccatcaagaatgtgaggaacaatagcattgagataaaccgtcgacataggaccaaaaaggctaaaaacaaatcctggagtacactgtacaaagctacacgcaagtgtggagtaatcaataaggagaaactaagccttgttgtgatcagcaggatgtttgaggatagatgcacgcattagatggtcaaatgtcatttagctttggaagaagtccagcaatcaattttattgtaaacgcaaggattgaaatctcttcccttgaatattcattctgatttgctataattatggtgacaaattttttcacaaaacacagttgaattttcagctttaggatggtatagagatttgtgtttgctgagcattcacgcatgcgttttacttcttttcttggcttcctttctcgaaacttgctcgtgcctcctgagccttctaacatttctgccagtctaccaaacatgcatgttgatatgaccgattgatcagtattcattattcatcattatcatgatgagaaacgaagaggatcaccagtagccactatatctattacaccgtaattacatactacttacatatcaattacatcttagttacactataattaattcctacttacatttgtatttttttgttgtatgtgactgtaaaaacaatttgactgttttttgatgaaaaatatggcaccacaattataggtatgccttaggataaaagtagcaagtgggcccactgaaaaacgtaagtaaaaggaaataatagaaaaggtctaaaccatgccatctccttgtttttttttccctggttcttctctctactatccttatctgtatactaaagtttaattttcaaaccatatgaatagtaacgaatttgcttgcacagtaactgctgatatgaacattagaccaggaatagctaatctgcatagatgctgcatataatccatcagggttcaccgagcaacacaattttttagcactttgcatctgcaacttagccaccacaaaattctgagggtagcaaagtattttcagaaaccatggaaaattttattagaattcgacggaagtctcagggacaactatatcacgggtaccggatcaggatttccgcacacctcaccacttcacaggcacagtactacaatttgtgattgcactgatcagcaacgaatttgaaccagcctaattttcaagcatttcaccgtaacaaacaaataactacctgatgctggttaatctaagtgctagaagctgagagataggatcctgccgcgacccacaccactaaattgcagccacatcacaagcgacgcatcagagctcagagcgaaaaacaaatcagttcaatgcgacaggtcactcagaaggagaatggagatgactatcagagttcgccgaatctatcaaccaaacacttcagaaattccgctacgtttggcgcgaatcgggtttcgagggagggatcacatcacctgctgccgcgcgaggtagtcggatttgatggaggcaatggaggagaggagctccgggagcgggagcagcttcgccacctcgcgcacgggcgcctccttcgcctcgatgcccagatcctccatgacagcacggccgcggccgacgccaaccgctgccccgcgcccccggcctgccgctgcagaggcgcacgaaaccgaggcggcgggtgagtgctcggcggggtgggaggaggaggaggaggagggcgcggcgcggcgaggcggggatgggagacggagatcgtgaagatggcgtggtgttttgtttcgtcggaccccggtggttgatgactagcggagcggggagaagagaagcgaacgggtgcgagtcgtgtgcgtgaccgtgtgagatctgacgggttctttcgagagaaacgttacgcgctgcagaataatattcactcatccgaaagaaatactatctactattagaagtcctttttaagagaaaatcactcaactttttttgagtaaaagtaattccttcattctaaaatataataattcaccctaaaatattagtgtggatataaattaggaatagggagggctgtgtaatatagttcaaataaaataacaggagcatggtgtt

SEQ ID NO: 58711 - DNA, 19321 bp, Oryza sativa
  unsure (1)..(19321): unsure at all n locations
tccacacccctgcatcgctcaatcaaatcacgcagatgattgagatttaaatgcacctgtcacgaaaacacgagaatgagaaaattaaataaactcgccgtacttgtcatggagcattttaggttcctctatgatttttttttttaaaaaaaacgggggttggggttggagtccccgtcaagggaggacgcggttaaccagcagagcacaagaaatgccagtttactgccgctttcgtccgcttctgcgagctcctccgctaccacgtctgcatcagattgacttcacggtttttaaaaatgcccaatcgtcctaacgatcattgggcgtgcgaaccggttttgttagttagttagctccgcctaatgaaatcactaaccaaaccgccctctcttttgtttagttagctcgcatcgatgtggtggtgccaagtagacatgggctaagcactatgccgttttgcaaattgctgctggtgctgctgagatggtggctagagaacggcactgtggttaagatcaaagcatttcactagatgtagtgggcgtctccctttactttccacccatctcctctccttttctttctctggggcttcgggtgctcgttgattgcacagtccccgggttattttagaggcgaacaaggtcacgttctagagttcgttttctgcacgcacactatgagctgtactttttggacggacatgcatggagtacatgctcctcttctctctctctacctcgcttccctgcctgctttattcttgcttcgttttggttcttttttcccttattagactccagcactttcgttttttcgaaaagaaaaagttgacggcagcagttgggtcaatatcgtttcgatggtggatattatggttatccgtcagttcgacgggcgggcaacggtcgtactcgtacactgtcaagcaatagctcaaagatcaatcgtaccctgctgcgcccttttggaaatgaacacggccgtctttgcacgtgctactgcgatgttttactcaggagatcacaaagacaactctaaactcagtttttttaaggtctaaaaattactgtataattaaagatttaagagatctttatattacctgtcatatggtgggggttcttttagccatacatgcacatcatatttatgcgcatcatgaaaccatgaatgtaccccttattctaagcaccagggtcgtaaacaatggtgcacatcaccatttcagagagaatgctacataatgtttttttctcatgattatgtgaagtataaagaaagaggagagaaatagatatcatacttattaatatatagaaatatactccctccgtttcatattataagacgttttgactttgataaaagtcaaattgtttcgagtttgattaagtttatagacaaatagtaatatttatactaacaaattagtttcatcaaatcactaattgaatatattttcataataaatttttcttggtttgaaaatattactatttttctataaacttggtcaaacttaaagcagtttgactttgactaaagtcaaaacgtattataacctgaaacgggagtagatagtagtcatttaaacaattttttgtgtcctgcaataaatagcttaaccaagcattaaaataaaacggtgcaaaagaagattccaatggtttttaaaggaattgtttgttaggtaagaactaggatgtggatctttagtttggcatataccgactatataaagaagcaattgctgtaaaagaagtgattgcacggtttggtagccaaatagggctgattgtgttgagtgagcatcaaagaggttttagcgtatgaaacaatacacatagagcagcagaggcatgtggcttttacaaagaaatcaaaacagagcagcactgtttatatatgccaagttcatctgtaagtcgcctccctgatgaatgttcacatgccaattactagaggtgggcgttcggtctacccgaaaatttcgatctcggtcttcggtttttcggtcaattcggtttttgaaaagtcaggaccgaatttcatccaaaaaaatcaagaccgataaatccggtctcggttttttcggtctcggtctcgatcagaccgaattcggaggagccgagccagagggcggagacgacgctggcgacgtcgaggcggagggcggagacgacaccggcgatgtggaggaggagggcgaaggtggcggtgcggcccgatggatccggcagtcggcggtccacgcgaccggcgaggcggcgtggaggcggagggcagagacgtcgccggcgatgtggaggcggagggcggaggtggcagcgtggcgcgatggatctggcggccagcggcccgcgcgatcggcgaggcagcgtgaaggcgaacacggcgccgacgatgtggagggcggagggcggaggtggtggcgcggcgtgatgaatccggtggcccggcgcgaccgacgaggcggcgtggaggcggagggcggagtcggcgccgacgatgtggaggcggcggcgcggcgcgacgcgatggaggcagaggaggtgtgctcacacgggatggaagggagggcggcgcgatggggatggggatggaagggagggcggcgcgatggctggatggatggggatgcagcctgtgggttgtctctagggtttagtggtgtactgggcctcctggacctattgggccacaatttgattttctcggttaattcgattaaccgagcccaataaccgaattacccgaacaaatttcggtctttgacatgttgagaccgaattactacccgaatttctcggtctcggtcttttcggttcggttctttggttcggtcttattttgcccacccctaccaattaccataatccattttttcaataggtaataatcgatggttcaattgatatcgcccaatataatttgttaccactgtcccttttttaaattgttccaggagtatgacatttggttattatttgttagattgttccagaagaaaacatcatcttctcttgaaggaattaataaccgtccaatacaaccaactaagacaaaaattaacacatttctgttttgctttatgaggcctagtggtaatgggacccactgcttactccaaaggggaaaattaaataagctaccgtgatcgcgatcgatggaaatgcattgtaatttttgcaaacccgaacgacgaagtaagcgcccatggatccatccgtctcctgattgggacataattaagaagaaaacttggttatgatacaaaacttacaaaaagggaccacttgaaaaaaaaaataacatactgatatctgatccaattctttaggctgtgctttgtacggggtttggaggagatcaaaatttgaatatcaagcacatagattttacttcatatatataaacactgctaatctcaggaacaaattagtaaacacagggaaacatgttgattcaatgataaagtcatgggtacatggctcgacttgatagagttcaatcttgatgactataaatattacatacatatgtgtgtgttttgaatagaaatttaatgagcctagagttttttggaattttcttggaatattatgcataaacgtgtacctttgggtttttaacgggcctaaagaaatttcaaaatatacgcattgtaaatattttcatccgtttctttaagaattagggagggctgatctccgtctatttaaactgtttgttccagaagctgtgagtgtggtatgtaaaagtataattaaagagcgaaaggtgatatttgtatcattgttctcctttgtttgttgtgttgtgttgcatttcttatctttggcttggcaaaatggcaaggtgcgtgccgtggtatccaccttgtttgacgtctcattgtttagtgtctcgttagatgttgaggtggtgatttgtcagcatagacgtgcagctaacagattttacttgttcgatagaataaacctagaagattacagttggtgcgattaaattagaggactcttatctcctttcacgcaaattaaatatagctactagccaacgctcacgccggccggacaagttgaccgtgtcattgaaggaaaacgtaccatatatacaaaagagaggcgaatttgatgtggatttgttttttatttgaccgtgtgatcttcaatgtatgattggaggagaattcgttaggtctacctcacttttttaagttgcgtttgccaattgtcaattttgacttttagatattgattcatagaaaaatacagcataagaaaggtaaacagcgtggattaattgggctgagttttgggtcaaagggaagaaaaattacctcagggtcaaagggtagagtttggcttgtagagactgataggtcaaaaggtatgattctactggcaaatttttgaagttttcttcagattgcaagttgggtgtacctgcttttgaaaagattatggatcttatagcagagcattgatggtttacatgttagtcctccatccatgtagtcgcaaaaaatatatatttgtgaatactccctccgtactttacgaaagtcgttaggacagcgacacggtctccaaagcacaactttgacttcttatttctataaaaatatttattgaaaagtgatatatgtatacttttatgaaagtatttttcaagacaaatctatttatataatttttatattttcaaactcgacaacttgagagttattcatgatttatatttctaagttttgacttaaacattgccctaaacgactttttttataagtacggagggagtactaaattacagaaacttaatggtaagaattaaatttcagaaactaccatgttttatgtccccacggtctcaccaatatcagaactgcttccctcattagaaagagtaatgacttgctgtcatttagtttttttctattgatatatacaaagtcataaacgttgtaccaattacaagatattcatatctttatgttgatactttattttagtcaaagagtaaacaattcgatcacgactcaaagtattcacgaccagatcgaactggacgcagtagctcattacagtagcggattaaaaaagaagtcgttaggctcactagtcaaatatatagtatgtcaaatttgttacaggacactaaaagtatgtggactttaatacgagaccacctaaagaacgtgtattttttcgtggacattgtaaaatatggtaattagctattagacacccctggattattttattatatccggtcaatatggagagaaagagcgttgaaagtaccattttgcccctaggttgttttggcttgtaaagacgactaccactggttccaactagacccagttcactccccacgcacttgatcctctttgctcgaaccctaggttttggggcaacgatgacggtgcgaaggcgacacggggtcttgacgctggcgtgggcttcatggtcggcgccgtcggcggcacgttcaccacttgtttaggggccttctgtgactccccgtgcggctgccactttgccggcgccatccatgacggcgttcccgtgtcgccacctgctgggcccgccttggcgtctatagcgccgccttttctacccactcgtgggcgaccgataggaaggacgacccactcgtctccatcgctgccacgggggccatcgtccgcttgtgccacgagccgctcgccgtgggacatatgccacactgtcgtcgacacacctaaacctagggtttggaggagaggggattgtgaaactgaacgggcaattggcctgcttcgaacgtgtctcggacgggttaaacaacattggcccaagggcaaacttgccttttatttaagtttctctctccatcttgactggatataataaaattatgcgaagggtgttcatcagctaattactacatgtttgcggtgtctcacaacaaatgccataaactcttagtgtcctatagcaaattttgtctatatagtaatcccttcatccaaaaaatagcttcagttttaacctcttagttatctctactattattataaaaattgaagatgttttcgtcaatactttggtacgtcgtctttatttgtgtttgtttttaagttcgttcgtttttggaaatacataaagagtcatataagaaatccttttaaaaacctcgcatgctaacttcggacgaaaggcggactcctaattgctatataattctcgctagaccataaaagcaacgtatagaatacgatcatcatcccaataaggatcatatcataataaggattccgaattagatatcaatactatcaaaataaaaatcccatatatactttttagaaaaaaaattaacaataatacaattaaaatagccttcacccgttgcaacgcacatgcattttttctagttctaaaataagtttttttatatgctcttatctgtcattatcgttagtccgtaaattaataaattttatttttcaataccccttagagcaagtttaatacaataatatatccaactattagcttaaaaattgaaacatcatctgtagccaacctaactcatacaatagttagttgtagatatgtactacattatttatacataatttacacatctcgcttgcatagtttattggaacccgtgctatagttagttataaatttgtaggccgagttttttctctctcctccacataaatataaacgtgatgtgacaacttgtacaacccgcttattgtactcgctcttacccacctcttatataccactcattaatattgttttttttattaatgaggatcacattggtatttctccgtcaccttatttaattttgcaccacgtagttaaagttattttgtgatggatggagtagtgtcagagtgtgttataagaacattttccaatttctaatgtgcattagtagttttttttttgcatgggtattagcactccctctgtttcatattacgagtcatctagagcaggtacaatagcaggctataagccagctataaacatattttaaagagataaaagaagagagagaagagcatcgggctacagatctgtagccagctgcatcacggactccaagacgtaatgtgtgtatgataggtgggaccaggtattaatagtatagtaagcaactattgtatgaattggctattatattggctatagatgatttggagctagtagtgggctatactattaaactttctcttataatgatgcacatctaatcaatatttttaaaaacatactatcaaaatatattttgaatttagtaaaattaatttggtgttatggatattgttaattttatttataaactaagttaaatttaaagttttactttaaaagaaattaaagtgcgttgtaatatgaaacggatgaagcggtggattagctatagcctataagtcattatgacccccgatacttacgtgcgagctaacacgcacaaaagtcaaaagtcaacacagggagtttgcacgtctcagccgttcgatcccttccgcgtgatagaataatcctatcgagcaggaagagattattagctgggcgcatctcaagtaggacaaacagtctcatcaccaccagcgacgtggcagttttggcaccaatgtcgtcgaccgatttttccccgtcctcctcccccgcgcgcgcgcgactccgacgcgtacccacgtccccgcacgtttctaatttgggcacgaacggcggccgtcgcccacatggtgatggatggatggatggcaacgtacgtcgtttccggtcgtcgacgacgtacgtacgcgtgctagctagctcgccccgatcgacaactggtgaatcgctgtactgtacatttgccagtttgccggccgctccggctgtataaatgacgaccggttcagccgcgacgacgacgacgacgggtgtcgccagcgcgacgatcgcggaagatgacaaggacgagccgtctgcgtacgcgcgcctaagtcggccaagcgcgaacggcgcggctcgctctcgcatgagacgtgccatgacggccgacgtaagtgctaacgtgtgtgggtgaccagtctccacaagccccggtaaacgtaccacgcgcgtactactacgtatcatcatatcgtgaaaccaaaccaacgcgcatggccacacaggcttggggggctctctatcccgatacggcaagttaaccgttccgttcaacaaccacgaacggaacagggtggacggagagatgggtacgtacgggtcgcgcgcgcgcaaagatacaaacgcgtccctttctctctcgcgcgcgcaccacggaaaattgagcggcgcgtttacgggagagaacggcgcgccgagactcggttcgcacttggcatgtacgtaccaccggccggtcagcgtcacccatctgctgctcggccgcgtggttgttagcccatgcgcgcgccgccacgcctacgcggttactcccgatcgccaattaaaccacaggtttctcttacgtgatggtcgagctaggtggaattagatggatatatatccggccggccgtacgcatgcgtgcatgcaccgttggatcactgtacgtacagtgtacacacactgtgccacgttcgattctgtattcctgcgcgtacgtacgtacgctcccacgttggtgtggccattattgattcttcacgatcgaacagtggcaggaaaggtacgtactactttcttcgcggtcgctgtagtatgattgtctgcgcgcgaccgtggaaactgaaaggcgtacgttccgcgatcgcgaaacatagaagatcagggaaaagcggcggcggcgcgcactcgatcggttggttggctgtttaagcaaagtgaatccctcgatcgatcgatcgcttcttcttctgctcgtacagcccccaaatcgttttcatgacagcgagcgacgcccgaacctgcccaataccggccatctccagcaatttttttttctctcttttggccctttcgatctctctctctctccccctcgcgtctcgccgtgattgggtttggacatggacaactactaactcctcttgtccttttgtttgctccaaaggttccctcgccgtctcgcgcacgtacatgcgagatcaccaatgagccatccatgcaacagggccactaacgacgcggctgtatgagagagtgaatcttgttggaatgaaaaaaaaaaagcgagaaaggcgttgggggcagttaacgctccacaaactccagagctgagggtgacagccataatagagacgatccaggtgatggctttacacgtgttagcttattttcccgaaggaaagagcattgaacagctatctaaccagggcccccttttatttgaaaactcagcacctgtaccttgtagatgaattcacgagttttctttatgttaaaaaagaggggcccgtgtttagttaaccaatggcatgtcacggtagatgtgttcattttgtacttgtgtactagtaattaatccccctgttgtttgatcccacgtgagtactttggctgttatatatgtcacttagcaggagtagtagtacagcaactagcagtattctctgtcttccagcgaattgcatgcatggctaaaatgattacagcagacgttttgccatcacgagttcacgacatatgattactcccactcccactcccacaaccatctctctgcgccagcgctatcacgtagccaacgccgctgcatggcaaaagttgattgctccctgtgcctgacaatgagatgggcaaagaggtacgagccggcccattggttggtgttacgttccctcgtcattgatcccttaggcccatagaattgtggaacctagagtgatttccatgggaacatcgcctctgggtttcaagtttccgcactaacaataatttcccctcgcccaagaaattagaacacgcaagtcacctgaaagtctgatagtaatatggccctgtctattttgcacttggtattgacagcattttggaatatattcattttcaaataagttcaattaagattcatatatttcagatggagatagttagtttacagggactgttttatcttaggtgatgcattgtgcaaactgcgaataattagatagaagagtgcgaggacgaacttaatgggctatatggcgtttggaactgaaaacctttttccgctgggctgtcacggaaggaataatggacttacaggctgtccctggatgatgacatctatgggctatagcttaagctttttgacgtcgtttgtgccgtgataagtctattttgcgtcctgcaactcttgctcctagctgaatcgcatccctcaactacaaaactggatataacgcatccttttatttaaaaatcggtgtaaattgcctccttaggtggtttggaaggtggttttatctgacgtggtagctttgacctagttgactggctaactcaactgtggaccccacctgtcaatgatctactccatcctatcctctcccctctgtctttacttcttcctcctctctcacctcacatcagaaatgcagggggaggctcgtcgggccattgctgtgcgggggaccgtggggtgggggggggnagggtgtttgccactttnttgccaggctaggttggttgctcggtgagggagggagtctctctcagcctgcgactatgcacagagggggaggggggtctcccagccagttcgagttgcgcgggggggagggggtcgacagaccatgggcgagttccagggggaggggttgccgggtgtgcagcgcggtgcaagaggaaggggttcaccgggccgcgccggcgcacgtgggaaggagctcactggcctcatgaaaggtggaaagtcatacatgttttttccatgtttcactgacatgtagggcccactgtaatatggtttttcatatctcacagacatgtgggccctacatgcaaaaaccacttttcaaaccatagaaggagtttatttgcaccggttttagaagataggggatgcgttacaccgggttttgtggtcgagggatgtgcttcaatcaagagcaagagattagggagtagtaataaacttattcctttgtgccgtgtgttgcacacaccgcacaacagctgacctaaataaaaggctttatgggccagccattttagcgtcgaataggcccaaatatcggtcatgggcccaacaaaagcagacccccaagaaacttacagaaaaaccttctcctgttgcctttcaatcattccccaatcaaaaaaagggtaagtttaccatcctttataaagtagaaaatatggtacctctagtactaatactatgtatcttaaggtataaggtataaaaaattttagtataaaatttaggtacctcaagatactttctcaaggattgtaaaattcctcgtcgaaaaaacattatacatgcagcaggagtcatctcctttgtgttcagattttccattgaaaaaaaaatcacgaatattagggatggacctaatatcaaataattaggagtgaggtttcgaacccaggttgtctagcccatcaccttgtggagctagccggaaagcggaaaacccttagacgtttctcgtttaaattttccattgacgagcgattaaatttacgtttttttgcgggtaattaaatttacgttttgccatatgcaggtttcaggtaataccattgtataagctattttgtcttaaaatacggcatggcaatcaatttcctcatggtgattatctataaaatgttatcttttttttgggggggggggggggggcaatcttgttgtgggaatttgtcaatagtaatttccaaacaatattaacacgcatttgtttaagagcaatttcgtcataatgttcacataattgtcaagcaaaattttcaagagtacattgatactcatttttcttccgattatcaatgtataaatgtggacaatcaatactatttctgctacatcacatgaggaattgggctagtggagtagaatcggtagaaccatgatgacgatagaataaggggataaaatgacatgtacattagcatttactggaactttcacagtttcactcgtcgatggcatgcaaaatgcaaattagacaattgccaaggggaattttttgatgtaaaagaggcccttttgctctccaaggagtcattataatgtttacccggggcttggaacgctcaaactatcttgatctcttctgaaaatcctgcgtgacgaacttaaaattcttactggtagttacttgaatgtagcacatgttcctagatcgtcagttgctttggcacatggtacctggtcgatcgtgggccaaaactcaggaaaagaagcacggatggacgggatggtactggtaggagggggcctgtggagaccattggcagatcgggttcatccatccatacgcttttccgggaaaaaacctcgtgacaccaccgaaccaagcatggccgcgacgccaacgccaacccccggtcactgtcgagtcccccgcctagctactcctcccggcacacgctcgcagctcgctcatggaaacgtcgatgtcgacgccgctccatatccggtaaaactctcgagcagatgctcttccgattcagtagcaagccgagttggcgtgcctctgcgtgtgatgatttgatcggtgggtcgcctgctttgcacgctgcaagtcctcctcgtcgggttcacgcatttccctagttcagatggcacatcacagtctcaacagaaccttaattgtctgattgattcctcagggcatggtggaaacagaggacatgcctcatgtacgggtcaagatgcactatgtactatgtgcagtacatgtacgggtacatattgactctcgagcagtacaattcactacacttaatccaataatatctccgtcccaaaataagtgcagccgtggaaatccgtgtccaacgtttgaccatccgtcttatttaaaaaatttatgaatttttttttaaaatagtcacacataaagtactattcatattttatcatctaataacaataaaaatagtaatcataaaatttttttcataaaagacgaacggtcaaatgttgaagatgaatagtgtaaaactgcacttattttgggacggagagagtagcatagattcagagtactactgtaccagggttgctgccatccggactcatactcatggttcagttcggcgcagagcaagtaatggacgaagtcatgcaatacgctgcagaaaaatgcagaattgaaaacgttagaggctgagacgatgttgagaacaaagagtgataaccattcttgttcttcagaacgaagtcgtttcttcaattcttctacacacccagcaccgtagaagaaagcataaataagatcattacagcaaccaatattgttacttcatcagtcctagtatgaaacagtcgtgtaattcccctgtacacgttctacgctaacacaacaccctcaagcatctcacaaaatcacactacagatcccgcaaaaaagctcgagattttcagcaaagcgggcagcgcacgagcccattctcgttgcagtcggggcagcgccggaaggtgtccagctcctcgaggaacaccttgcagctgccggagcactcctcgcacggcacgaaccggacgccgccgcagccggagcacgcgtccagcgcaatgcccttgcccgcggcggccggcggcgccatctcgcagtcgcccagcgccttggacagctccccggactcgtgcatgcggcggacctcctcggcgccacccaggtgcctgccgtccgcgaacacctgcgggaggctgcccggcgcgcccagcgcggcgtggagctcctccttgaacccggcgtgcatcgacaggtcgcgctcgtcgacgagcacgccgtagccttgtaggatggacttcgtcgcccagcagtcctcgtacgtcttgcggatgccgcggaggctggtgaggtacagcaccactttccggtcgctatcaggcggcggcggtggaagctgcggctctggctccggaggcggtgacggtgacggtggcggaggcgccatcttggcgagcttcgcgtcgatcctcttctggaacgcgctgacccgctcgcgcacgatgcccggaaacctctgtatctcgcgcttcttgacgcacacctcgtcgccagggcattcgccggcagcgggaacctcgtcgagcgccttccggaaagcggcgatgatgtctggatcgaactccggtgacccgggcgtcgactgcccccgtcgctcctcgccgcggacgtcgccctcctcatccttgtcgtccaggccttccatgagctcccacacatttatcacctccggctcgcgggccggcgtcttggccggcgccgtggtggccagcaccaattgcctctgccgcctcgccatctgctgtggcggcggcgtggtcttcgccgcgccgccgtcgtcgcgccatttcatcatctcctcgtcccggtcccgctcgaggctgagcgaacccagtgtggaggacttgagcgagacggtgtggtgcacggcggccggaccggagcggctccgcgcgtacgccgtcttgccgccccggacgccaccccggaacgcgtgcctggaccccgtgcagcccatccccgatccctccaccaaacaaccaaccaaaaatctcccgcactgccaccaatacaacccgaacgcaccactcaccggcagaggaacgactccttggatcactggaccatcacgccccgacgcggagaggagaggtcgatgtccctgcaaggccggagcaaatgcacgcgcgggaggtgggccaccgcgatgggagctcgacggcgaggtacaaagacagttgggggaggcggcggtgggcgagatctgatggcgaggccggcgaggtagctaggtgcgtgcgtgcgagcagggaaagggaaacgctttaagccgcgggggggagaaagcgagcgaggagcgtttcgggtcacgggcacgcaccggttctcgcgcgtaaatgtgcgtattaactcgcgcgtttctggtcgggggcgtggcctccgtggagcgtggagttcccggacgaacgcctcaaggtggatggaatgattgcccgctcacaattccacgtcatttaggccatgttgatttcagtttaagattattgtaatctagattattaaattaaattactctaaactgaattataataagctgtaagttgtttgtttctctggattattagagatatctaatagtagtgggtctttagccactcaataatccataaaaagctcctctagagaagattactagattatactaatctggcttatagattataataatctagcataataatctatttgtttgtttcaacttactcctaataatccagattataataattctaagctgaatcaaacatggcgttagccaggctggtgacgggattatccatttatccacgtcggttatcgagcgatcaggcctttggattagcgggtgcgcacccctgcgtagaggtttgggtcgtttttatttggagcagagtgtttggagctattccagtgttcgttcattgtcactcgtcagcaggcagcagcgcgctgagctcgtcaattcagtgtgatcagtttggtgcactgtcatgtcagcgcggtgccggaatggtgccggaatggcgtgatttctcaagggccgtcgatgatttaatactcgtgggttgacgtgaatcggcgatgatgttgcacccgaattcaggaaattttcttgggtgttctgccgtactagtatcacgtatagtactactctgtgacgttgagaacttgagatcgcgtagcattaaaacctgctacaaacatgcggcggtcgcgtttcaaccttgaactgcagatcgccgcgttcctgaacttgaattcggcacagcgggagagtgcagcgacgagcgatgcgttgcggcgggggatcacccgtcgccgttgctcctcctgtaccgcagagtaatacacatgtgtctcacttttgtactcttcttcgataagaaaacaccgcgcttgcgccggaaaactgttttaaacactcgggtggatgtccacccgttttttgcatgtcatctaaatagttatgaaaaattttcaaaaaaattaacatgataggttaatatgtaatatatcacttcacaaacatgcaagttcaaattcaacttctataaattataacaaagataacaaatttgactgtgaatatacgtacaacttgtagaagacgaatttgaacttgcatgtttgtgaagtgatatattacatattaacatatcttgtaatttttttttaaattttttttataattatttagttggtatgcaagaaacgggtggacgtccacccgagagaatagaatccatcctccgcttgcgcctgcgcgtcgtttgacgtttggaacgagagcgagccggcgtcagaaagtttgagccggacccggccaaagcttttacacagtctaacaccggcacgtcgttctcgtctactactcgtaacacgctcctcgcttcccacaacatttgaatctttgaacggctctgcacgatcggagccagtctgggttagaccagcgcaagagggatttgaatatttccaagccttttccgggcaaaggagtatttgagtagtatgtttttttagtagtatgatgcgtcggttggtggtgatcggtgactactctgccgacaggcgaggtcaggtggtggacgtgagcgagcaccggtttcctccgttcccttccagatgagaactgagaagaggagagtggtagtcttgcttggcgcgtggttggcatgtcgctcgagcactcacctgcccaggcgtccatccatccatctaccagctcggcttcttcctgctttcctagtagtcggtggtttgtccgattcctgctagccttttgtttttgcgtagtgcactgcacttcccagctacaaaaaggagtattgctgtgcgtgagcgtgactgcgtgttgccaagtcctcctgatgagaccgaggtcgaattttttactccctggtccgaaacagggtggatccggaacggacgcatgacagatatgcctaatctaccgaattggagctgatcgggacaggggatcgggattgttgctagcacagttggaccaccgaaacgggacgggggtaaacactgaagattggggtcctatcccggcaagaaaattgacatttagccactttcaaggatgggctgcgctgtaatgccattccgccaagttactttgctaaaatgccattcccacgctcgcgcaacacgctgcttcgccgttttttcaatttcattggattaacacacaaaatcacgagtgttgtgaccaatgtgcccttggtcattctttaggtcagtgagacaaaggggattgagagtgagagaaaggggatcgagatgcgtcagctcttgctcattgtggcgccctagatcgatctcgtcggcatcgccattccacccgccgccgcaatcacctctcgccctcacccagctgtagctcacggcggcgctgccatcgccattccacccatcgccgccgcctttgccgcagtcccccctctcgctgacgccgaggacagtctccggatgccgtcgtccctgacatgagataggaacaaggtggagtcgatggattgtactgcacggcgacggcggcagagtagagtggcggcggtggagcaaagcggcacaacacggcggcggagtagatcggcagatcggcgacggagtagagcgacagcgtggcggcgctggagagagcgctggattaggacggcgcttgctgcttcatttggcgcaaaacgaccccaggggcaatttggtcagcagacaactcacttacgggcttaaccggtgaaattggaaaaacgacgaagcagcgtgttgcgcgagcgtggggatggcattttagcgaagcaacttggcggaatggcattacagcgaaacccatccttaaaagtggctaaatgtcaattttctctatcccggcagatgctgaactcacactgctgtttagtgcagtggaagtagcatctacaccagtagtacgaagctgtttgtcactgacagttgattaaattacggtttttcctttttgttggttgattgatttccagtattatattaggtagattttgcaaggtctatcgcagctccaactctccaaggaatgaatgaacaatggagctatgtactccctccgttaaaaaaaaagtcaaaccctgaatttccgtgtcaacgtttgactatccgtcttatatgaattttttttataattagtattttcattgttgttagatgataaaacataattaatactttatgcgttacttatctttttaatttttttcatatttttttaaataagacgaacggtcaaatgttgaacacggaaacagggtttatttttttttgggacggagggagtactgctttgcagcagatcattaaacgagcacatgttatcaatgctggaagcctgaatccggcaactcggcccggctagtcgcggggatgtctctcatccatcatggatcaaagctgtcatgttcgcccttagctaatccggacgaattgaatgacacacaccgcctttcagttagctgcttgcctgctgaatcaggaaaagggaaaaggctgatgatgatgaggatgcaaaggtcgacgcctaaagtgaaccgagatcgagtgcaaccggaccgaagctcgtgggcgaccacttgccgctacagctcatcgcttccgttctttccagccatcccggttaatctaaggctcatcagtccatggctgctgctgcactcatggtatcgattccgaggccgtctttgccggctcgtcggatcggtatcaccatctaagctggtgatgcgttcaattatctgaaaaagctagtgatgtgtaatgtgttatactgtacatgtccggagaagctagtgtgccttcctatcactttctgggcctccccgggcacagttcggcgtcgatgtcgccatgtcggtggtgggtcacgtacggtgtcgccgacgacgtggtctgttcgtgccgagaatctcacgcaggaggatgatggtgttgccgtgttggccatggaccaatggacgacgaaacgagacgagacggtgcctgcctgggatggacatagactggagtactggacccatgaaaaccctgtttgctatttattgggcttgttattgcattagtagatgggctgcagga

SEQ ID NO: 58712 - DNA, 23676 bp, Oryza sativa
aattgttgttgtcatatgtaagggaaaacaacgtactcctatcctattctacgcgaaaataagtatgagtatattatcatttatcctcgtgcataatatagtggaaatacttaagttgtttgtctgaacaagacataacgatcatatactcttctcatatttttgttgtgcctcttctttcttggtctattgcatatttgtcctccattttctcaccatggtgtatgggtgctcgcttattacagctctatcagtaaggtttaaacgatctacgattctattatgttgttatatttatttaaattaaatattattatattccaatggtaaatatatatatgtttcaacagttaatattcgataattagtatacaagagctaattgttttagcgaacattttgtagtatttcacatatcttttaaatgttttaaatgatttttttactttatgatgatcaactgcaacattttatcacctttttttcatcatatcaggtgttttacacctagtcgttctcatgatatggcgtcttcattgggtgtagaagtagacttacataaaaaaacacaaatcccccaaaaatagatccaatagctttttgttatgtttttaaaaccataatccactcttacattattgtccaaaggttaagtttaaatagctactacctccatcacaaatataaaagtctggatgtgatacatcctactactatatacatgtccactattcatatttgtagtactggaatgtgcctcatccagaactaagttcttatattttgggattggtttgtgtgaattagagttagaactccacccttacagctgatagttaaaaacctctttgttataaaccacaaaaccaaaaaaaactcataaaagcctaaactaaaaaaagagtctataataaaatctttcggcctaagacttaggcaccattctaatctccaacttcaaactataacttttttgtttttttgttagcacacttcccatttatacgagttaacagcgtgtttttcgttaacaatacggtgcattttctaaaaaaagacattttataaaaaaacttctttataaatacaaataaattcattttcaagttttatagtaataaattaatcgtgcgctaatttctcgttttgttttccacgaccatgatgcttaaaaaaatcatttgatctccttgaacgaacgcagccttcataatacctgctggctgctgcgatcaaactacttgcaagttgcgatgatgtcaagttcatgtctgaagaaaatatcgagattctttctatgcttggtacttcgtgtgattatcaatatttgcggatttgtgaggatcaaatattttctatggtttatccagttgatcgggggcattttggtcacgggggcatttgggatctagtagcagcagttgtggattcagtacggagatgactcacctaccgaggactgccacgtcggagtgacgacggggtttggtggtccgggggagcatcttttgagggatcgtgcggtcggcggatgcggaatcgtgtcgccgacgagtcgacgggagacggtccagcttttgcacctgtcctgcaaggctgccctgcaatgtagcaatgtgtttgtagattttgctagaactcaatgtgttctggtgaagtgtatttttggacgcaaatatgcttacaccacagaggcatcaacgtgtgtgtgcatcagatcgtgtgtgcctctcaagtagtacaacgctatcttcgggagctcacgaacggctcacacatagcatgagctcagagcattcacttcacacaccattgcaaaatgcaaacgcacgttcatgtgtactttcataattagcggacatcagccccaaaactataagggcattcccaaaccaatgactaaaatggtgtccatagcattaaataagttgccacctagaacaaaaaatgacgtggcaaatgaataaatgaggaaagagaagaaaaccatgtcttgcatgagacatggtttctacacaacatccaagacatcatgtgagataagtaatattaaattgaagtatggaatagtggtgtttgcattggaagagtagtgtctggtactaatttcttgatgatgtggagtttatgaaaatcatgtctagtgttatgggttgggactgtcctaacaacactagccatttgttaccattttggacgcaaaaccaataaaaaaaacacaaaatattgaggttttgacgctggataaaagcagacttacgagtgaatttttgaattattctccagaaatcaaatttgaaaaggtaaattttatcacaatttgattgaaatttgacgaaaattcgtataatactaggggtctggatccagtgctcaatcaaaaaaggtgaaccctgctggtgagtactatagttgacatttatgttgctacctcctaaactttttccaaaaaaaactaaacgctcgttcaaaagtgtagtttaaaacgagtaattagccacacgtaaaacaataaaggtgattagcatatgattaattgaatattaattattaaaaccttgaaaataaagttatttgattttgtaaagcaacttctatatagaaagtttacacacgaaacacaccattgaacagtttaaaaaatatgctagtggaaaatgaaaaaggtagccaagccaaaacatagtttacaacgtgccctaagagtgtgttcataaaccaaacttataccaagtcaggagaaatcttttaccatactaggtaaaatgtccatgggttgcaacggaatttaaaataggaaaccccatcgtacactctaaggccccaaaatttataataaaacatttccattgtaaacaataattggcatcgtttttgtacatgtatgtcaagctacatagttgctttcaagggtccatttggtagaactccaacttctaaatttaactttagaagcggaatttggagtggagctgtggagctataatgatatgagaaatgaacaatatttgtacatctgtttataagaggagtccacctaagcatttaggtctcacatgccatcagtgataggtgatgttagattcaccaattagcattgaaatcttttaaagaattatagattaacacagttacttcatactatgtgtgaactagttataagaaaatctgaaaagttatagacataattaggaattaacacaaatataatactcagtgagcacacaaagttaaattcgatccacgctatgaatagggtgcatgcgctatttacaactaaaatttgttttcccctctctagatcaagtttgaactactcttttgtgagatcgattgatccctattgtattattatcagtcctattttttctatagtttttcatgactgtttagttggtatcttaaaaagtgaccagcatgagagagcgcatctaattgtaatggaaaaggcggtgctagaaaaaaaatgtacctcaatcttatgggaacagaatttgcaaccttcgatttcgatgaaaattcggtggcaccaaaatttcatgaattttggtacttttttattgaaattatttgaaattttaactaaatttgaataaactttgctcaaattcaacaatttttttttgagaaaatccaaaaatttcaggcgagataatgacttgccggagggtctgaaatttccgaaattttaaactaaaattgcaatcactgtatgaggctcgtaaggaaatcagaactaaggccaatgtttgccgatatattttattgtgctactccgttaagttttatatggcttatttccatacgttgtacaacatgtgtactaagtagttagaattatattgcagaacagatggattgttgtttccttgctagaaaatgggaaaatttagggaagctttaaaagtttatagcggtgaagttgtacaacctgaaacgactatgctttcaatatatatttaataaagttgtgggtttgtttatgtacatgtgtacgtatataatggtgtaagtgtgtgcaccttccatgtaatcgaaaggaaaaagaaaccttggaattctctcttctatgtgatactgtaatatgagactagtccaaagtattcaggcacgaaattaagccaccaaccacaagacgcatgctcattgagaggtggtgtggtagatgagtcagatgatggaccaactcttttcaaagttgttctcaaaaaaaaaaactcttttcaaagttgcaatgccaccaaccacaaacttcaagtgctaatactacgaatcgtggcccggtccagtccaaaaattaacatataacgatgagagagagacataacagctaattcggtctcaaaagaaaaaaaaagagggagatgcatggagaaattgacatattttaacgggtcaaatacgttagaatgttagctcaattaaagcagaacttttttttgaatatatatatatatatatatatatataatatttactactacaattttcttcttcaattctcaattcttttatatatataagaattgagaattgaagaagaaaattgtagtagtaaatattttacgccctctacctacccccttgtctctcttcaactgaagtgaaatctgaatatataactttcagcggatggatgttgaacgatatgaacattcctgactaaagcgtgcgttcgaaccggtcaatgcattcaggtagagggtgttcagagaagttgccccaaagacacaacatcaatctggacaaattgtaacatcttagtgttactgtatcgactatcgacaaaagtgttttcagttagatttgtaagtacacggcagcgcaagtctttcaaaaggatctggggagtaacttttggtgaaaccgccctcttgtatttctttgttattcgctgcccttccatcatttgatagaatcaattggttatattagcaagcagtgatgtgactagtcacatttcacaccagtctttcttcgaactatttgttgatagataaaattcattccgactatactatgcgtgtatatacaatgtaaatacgaggagtatgacttatataaacaaagttgtaatgagagatagttgatagggccttttttaggtttagaccctgtgatgaataatgaccctaccgatcatgtcatgtttggccaaagactgatattttttcctttactagaaaaaatacccgtgcgttgcaacgggtgaagtctattttaatcttattattgttatatggttcagttaagatgaaattcactgtgggagttcgcttatctctactattataaaaattaaagatattttaatcggtattttggtacgtcatcatgagtcggtttttaagtttgttcattttttgaaatacagatccatgtttgagtcagtttttaagtttgttcgcttttagaaatatagaaggaatcgcataagaaatctttttaaaaaaacttgcctgctaacttgagacgattggactcctaattgcagctcatgattttaaaaaatatatatatccaaacgagttcccacaatagatttcacgttaactaaaatatataacaataataagattaaaatagcttttaatacacggatatttttcgtgtgtgtgtataatcatgagttgcagttagaagtctgatcatttcaagttagtatatgagtttttttaaaacagaattcttatatgattccttctgtattaccaaaaatgaacgatcgtaaaaaccgaatcaaatacggatatgtatttccaaaagccaacgaacttaaaaactgattcatacacggatgatgtaccaaaataccagtaaaaatatcttcaacttttataatagtagattaatattacaagtataaagtatgaggatggtaaccttaatatatgtagtagtctataactatgtcgacgtaataccctgataattaaggtggttagcagtatgttggcgtaaagtcctaatgaagtggtcggcgactagcttctggatctcccctaatgaagtgtgattggatgtggctgatatcggcttgtggtgcattgattttggttgagttgtcatttttttctccccctcgtgactctaggaagctttgtgggggtgtcaatattgcctctcaggagcgtggggtgtcctatatttgatagttttatgttctaatcgttctactataagactgataaattatcataatacttttttcgttgtctacttactttaattacacttgtgaggataatatgtgggaccatctaagtgaataaaaatagaccatgatatcaaataatcaaagcccattttaaaagtgttaatttatcaaatctccattctactttttttaagtcggggaatccttcaaagtgtggttagtatgaattgaatcaggctttgagcgccactatatacggcaacatcagtgccgttagtgctaatcaaggcaatcaataaaagatcaggaaatgggcggtcttttggtgagtttctcctggttctagttttcctttttttttggggggggggggggggggggtagcagtagtactggctggttgagatccatcctactctgtactctctattcggcagatggagcccaatataacttgtgctacaatgtatgtacacgtgtgcaacagctatttttcctttttgaagtgattggccatggacgcgaagaaaagaaagagaaaactggtcctgaagatgactggaacatgactgtggatctgcataaagagcattaatttgattggctgcctgattaattgattaattctccagctgcatcacattgatcacgtcgtgctcaatcttgcgaattgcgatgcctaccatgcgatgcgacgcaaggatgaatgctttgctagagtggtcccgagtcctgactcctgagaccttactcatgagagcatgagcaatggtatcctcaacccgtgtcttcgcaaacgccgtccattttccgtcgccggacccctgaagggaggcgcgacccccattaaaggaacgggcgcctccactccctttttctaagcatggctcgtggtcccgtctcccctgcctcctccctttcagattccccttcttgcccctctcgcctcggcccgctgacgaggcctccatccgccggagcagagcaagacgagcccacgcgcagctacagccgtcgtcacgacctcctctgtcgatgccgcgcccgccaccgccgtatccatcccgatctggccgcggggagggggggtgggcagaaccgcccacgatggcaccagatctgccgcccccggctggcgacggcgtgaggtggaggaggacggcgacgacggagacagagcggcgaagctcgcccgccgtcggccaccccacccctcgcgccgctcgctgtcaactagcgtatcccgcgtgcggctctccgttggccaccgcgcggagacgggcggcggtggtgctggcgagagggagaggcgagcggctggcgatagagagagggagggaggcggccctccgggcgagcggtggcagcgatagggagaggaagaggcaagcagcggcggcgagagggagagggagaggagaggtgaggaaaagagaagaggagggggcggcggcggcgaaaaaagagaagaaagagactaggggtagtgaagtaaaaatatacatggagctttgtgggctgggacactcgttgtgggctggagtatctccaccaagttgcttgaaattttaaggagctcatttaggatatcctccattaagagagaagtgtctcaaagagtactctcagttagtggggatactctaggtgtgattttaggtgtgattttggttatagatgctctgagtggatctttggttttaaatgccctgagtagatctttggttgtagatgccctgagtggatcagtagagatgcgagcctgcggtgtcaacgttcacttgttcgaactacttccacagttccgcactcgctttcccggacttaatttcatcttttgccttaaaaatgggagtgggactccaatcaatagtgatcacgatctctgcaataagcagaatcaaacgataatttatcacttaccccacgagctatcacgttcaccaaagcagcctctcatgtgtgggaaccggttcccgggtttcagcagacgaacattcaacttcgaagtttttaatattggccagtcactgagtaacaggaaaaaaaaaacaaattaaattttaaattttagttcgtagccttgcaaccggtaacaacctaagcggtctctggctccactctagtaactagccagttcccatcgtctttttagggagctgcctttcatctccagaactacggtccccgagattcaatttacatcaattacacgagtatttacatccatctgcttctaatatcagagaagcatacattggaaaatatatttgattgagttccaccatagtgtacatcaatcaaactataattcctggagcatttacatcttgatcaggctgaagcaaagacggagctacttatggctccttttgaccttttcagtccatctaacctgatttctgatcttctcataattgtacaatgataacaccagccggtatggaaggtaaaaaagaagccatttcattagatatttttctatggtacaaaatgattgcaacgttataaatagctctaaataaaaaagggagacctcctcctgtgactaggcagcctattggtgttacaaatacaacagggttgaagaatcactagtacagatgtgtatacagtatgtcagttgccgaacccaaaaggtgatctcgtcctgctgccaccttcaccatactgttcgttccattttcttaattcgttcatgctcgtcgcatcatacgaaacagacgggcttacctaaatgggggaaataataatcaatgtgaacaaaatactacttgcagagaactgcgctaaaagaaaaaaaatcttaagtttgcagtttgcaataccttggcttttgcttgaatgaaatcatcaagtctaaggggtcttagacccgtattttggctacacggacctccctacagaagatgttaaagttagtgaaaatgagagaccacataatttccataattatagaattgtttaccttcttttcttcttctaaaagttcatgaactggcctatatgctgaagctatacataggttctgcagaaaaggaaattcagattgcctgctcacatggcagaaaagaaggaccagaacaattccaatttccacaggaaaaaagatattatgatcgttggtgtatgtgataccttcaaatcacttcctgaataaccttcagtggaattggcaagttcatcaaatctgaaatcagattccaagttttctttagcaagtaaaatcttgagaattttcattcggttctgtgcatctggaaggtccacgtatatcctgtagatcatgaaagtcaataaccaatgaaaatcttgctagatcaccatattactatcctggaagcaatagtgtgaatgtaaatttaccgtctaggtaaacgccgtattacagcatcatctagatcaaatggacgatttgtcgcaccaagaataaggattcgctggctctctttggaccttagaccatcccaagctgccataaattcgttccgcatccttcttgttgcttcatgctcaaatgcaccacctcttgcacctaataagctgtcaacctgttatgtcaaaactaaattatatcataccaggagaaagcacataggaggggaatataagcacttgtttgtttcatttaagtaaacatacctcatccacaaatatgataacgggagctaatcggctagcaaaggagaaaagggcctttgtcaacttctcagcatctccaaaccactgttcaaagaaaacagagcggtgaagtggtgctcagttgggaaataaacctttatctatgtgggacagtgcaggaggatgaatcttctaaagaatctcaaaatttacttatttggttccgtgaatataagatgcagagtgaaacgcaaacatcacaaatagcattttaggagagcattctaaaaaattgcatccacctactctgcctgcatttatgcataccatacattcaatcaaaacaagcttgtccactatcatcccatgccccaaccacccactaacaaaaatgactaaagagtgaggatcctttggtataatctagggacatacagagacctcatgcatatgataggattcacatcagtagcttcatttgttcatgcaaagcagcaggagacatttaacataagagaaaaggcctcaacctgtcaactacattcgtataatcaatgttttaagaaaaagcaggacccactcagttcacatgtgaactcagaagtctcaatttggcgtgtgatgttacaaaacgaagcaaatcttttgaaagcttaaattcgccatcttaaataggttgacaagttggtcccgtagatagactgcccttttatctagaattgtatatgcagactgtttcacttatcctttgatttttgatatgtctattctacatgtgtgtaaaactttaaaaagaaactgttttgcttcaccttttatcccttttggtcatgggaaacataaatctgcacagaaaagtttcagatccaaatcaaacatgtaaagtttattctatgggccaaaaatggctgaggggtcagtttcttgttttggccatcttcctgttcttttggcaaaagtcaaaaaaaatgttgacttagctggcgactagtaaaaagttgtcccacactaaagtcgtgttcaaaattgtctaaaagctaataggtaagtatggaaatttaactagttgaatgatgtttgtaatttactgggtcacaccaagtacgccatccttaagagctttactgcaacagcaacaagtcaaatcaaattacctttgatgtgagtgtagaaccagttatgctgatgaaatttgctccagcttctgttgcaagtgcctttgccaggagtgtttttcctgttccaggaggcccaaagagcaaaacacctttgcagggctgaaaaggggtccatgtcacattaaaaattcagctaactcaattcaagtatgtttaaatcccgaataagatgaatacaacaaattactagggcatccaatagtcagattaagatagctgaattctaagcaacaatttgtcaagaaccaaaggaaaatagtaagaaactagatgacaccctgtgcgttgctgcaggatattagtgcgtacagtgctgttgcaaatttgttagatatggaactgagaaaatgattaatttaacagccaaaaaaggactcatcaggttagaaagactatgggctaatctgaaccgttaaaggatgtcaaagaaaagtgatgatgtggcttcttgcagtgacttctttgtagcaataactgcactaagtgagttgcaaatgtataggaagaaaggatgatgctttcaattgcagaatatcccagtttagttttatctatttgccttgaaaggcagcatgtatttcttacgatgtttatagacattgctatacttgcatcatcaactccaccttgcatggcaaataccataagcactagcgctgaacagtcaggatataagtatgtcatttatagtatgattttaacatatttaacctaagagatcagaaataggtccaacattcaaaagagaatcaactagttgaagtccatgaaatactgataatgattccgtaaagagtctttaacaaatattttagggtcaattcaaataccaggcatttttttacaatctcattttcccctgatatagcaactggccatcggaggaccacttgagtaagagtaacatctccattctaaaaccatgtgattactacacattatggtactcaatgttgactcaaatacaaaggaacttttggaaagattatgcaaatgtaacaccattttaaagtattagtctaaaactgatgcaaggaggaaaacaatatattattccctgcaatccatcacacctcgctttctgagctcataccaaaataaagtaatttctttctagaagacaatgatgacctaaatggatgttcaagatcacatggtatatacagcagagctagtgaacagtcataataataagtttagcagaaaacgaaggcgtacccttaacaaattcccatgggagaaaagttcaggtctcctcattggaagagtaacaagctcatccagcgtcctcttaacatcctcaagtgccccaatatcatcaaatttcactccaatttcatcaggagggacaacagcagaaatgaaattgcgttcatactcgtctttagccaaattctgaagttagggaacttatgagttcggataggagtaggactatcagataaaaactatgaaggtggcagataatagagatgtggaaaaggtcaacttgcggaatatagaagctaaatacctttatattttgagagggtctcttagttttaatgccctgttccttcagcctttcaatggccacatccagacttcacaaaatgcaacaattagagtaaatacctggcaaaaggaaattggcctagtgccctagtacaataactatcatcttgaaatgaagtacctctcacgggggatgattaatctgtcacccttaatgttaggaagaactgctgatgaaagataatgacttctagcccatccaacaaccttttccgcttctgcagacaacaatacactagctggtaagggaggaacaaaataaattttaatttagcatccatagcagattagaagtggctgtaagctgttgtattttgtccttccaacttatttgcaacatacccattaatttcaaaggataattaagatatctccctatgcagccacctgactagaactctagaagtctataaccagtaacctagaataagttttcaaactttcactgattcaaaatccatattccactggttttacatgtaggagcaccaccacatgtatagactcagtaatgaaacctatgacttaattgggaattgcatagaaaaaatcacccaaaacatgaaagcagcatctaatcaaaacagttggcaggaagcccaaagaactttttaaagaaaagatctttccttctatctatttctataatgcaccagcacataacaaaagccaacaactgatatcatatgaaaattcagcacatgtctgagcagaaaatattgagtagacatactttgtcttgttaaaacaacaccatcagatttcacatgcagaagctcaacacatgatagttcatgctcttgaagtacctgtgttcatcaatcatgatttactgttagttacatgagaggaagcagtaatgctacatgacataggcagcagataactggaagcagaagcattgcatccaaaccttgtgcaattcaacaaggttatgccttgaaataataatttttctatcctcttcgatctggttattgaaaattcgtcgttgctcatcttcctgtaagtaaacagagacaaagtcacaggcggtaggccctccaagctaaagctcactagtacggatgcactaggcattgcaagtcagtgattcaattataaacgccatcatgacatcaacacatatgttacttaatcgttcattccgaataacataactttgtaaactagattagcaaatggtacaaacctcaggaagaggaacgataagactatttgtgaacagcttcgatatgccactggatcttgagtattttggtctcccccctaccaatcgctttagtgatgatggctgcatataaacatttcaaataagtgccagttgtgaaatacaaaatggaaacctttgcttaagtagttagatactgtcagaaaagggagttagttttttcaacagtgcaaatggaaaagaaaaggaggtttaatcataattcctacaactaaacaactagcatcccaatatccttaccttatggcatgctcttgatagtttatacaacaaattatgatttataaggaactaaaaagtcgtttagtttgggtaccaaaactgcgattgtgttacaagaaaaagcatgtccacaggcaggagtaaaccatgtgcaatcattcaatgacccacattctctattcaatctatagggagcactaaacgtcggtaatcgtctacagataaggtggttataagcgcatcttactgacttggcagcctgtcatgcctaagaatataaaggtggctaatagaggttattcctttacatttttaggtctcttgtactcctatatgttgcctccttgggcttattattcaatacaagctatatccataacatggcatcagagcaaagatccgaattgtagccatcaatccaacatcctcgctagtgctggcagcaactccatccaacagatccaagcattatgaatatagcttgtattggataatagccccaaggaggcaatacataggagtactagagacctaaatacgtaaaggaataacctatttatgtaaaggtagtctatattccttaacaatgcatataagctgatggttggtttgtgcaaataagctggttcatttgcaccccttttcagaaactaatgaagggttaacttcacaaatctatgcacagccatagtaaaccaagctcgtcaatgaaaacaaagtgacaaaacctatcagaatactgcactgcatcctcaaagggatgcaggaactaaacaaacaatgtttagacctgtattgttgatgtactcttacggtcttgctagcacaagggaagaagttgttttgtgattagtgattatagcaaaattgttctagaaaataaacatgaattgatttgaactaaatcccaagcaattaccagcgaagacaggcgagagagattgtggaacatcagcgccggctgtacatgtccacaacagaaataagaactaacaaaaactgttttattggttaaattcaaatgcatagaagtttgcagagcttacaggttccttatccttgtccttgggttctgcttccaatatgttctgcccacatatcattactactggtccagtaagtttgtcaaacatctcctctaccttttggataaactctctgcgatttgattttggaactgctctagatagccactgggaactgtctggaaagtagacaattgctggctgtagagatggcagaacctaaattcataatcatgtaaggcaggtaaaaattattacatggggttggccaacaacaaaatagaaatgttgggggtatgtaacaccaaaattcaatacatcgtttgataaatcacctcgcaaagtgcttcaattgcgatatgccaatcttctgactcagtatcatggtcatgaacaatgtcctgagctaagcacaaggaaacgagatgaagtcaaggcgcctgaaatttccaaatcaaatacttgaacacaaaactgttcatgaaaaaggatagaagcatacaatcaacccagtaaatggatgcctcagtattttcctccttgctagttgcatcattatcaccatcatgcagcttctctgcaagagggtcgaatatgactgcgacttgatccccattgatctcatatacctctccccgttgtccctttgataaagtcctgtaattttcaatggtagaaacattacccttgtttcacaaattcatggtaatgataagtttacacagaacagtaagagagtgtatagcttggttgctttaagaaactatgaaaaacaccacttgaaatgaagaggatcaaaaagacaaatggagaaaccagttctcctaagcaactgcagcatagggtcttttgctaatatatttcaactgatcggatttgcaaaagttccaaaatattcaaaattacagagagcaatgcctccctgaggttttagatctaccaaaaccatttttatcctgtttcacatgggaaagatatatccacccacctgccactaataaaggtataggcatttcttgagccatctttagtaggtactttccctaaaatgatcctgtatatgatacatatggtacaaatcagtgtttgcatgaagaacatcaacttcaaactacggtaaagagtagatagtggcgtaatttctaacatgtagtagaaataacaaacaaccagaagtaaagtttgtttttcaagtttcactaatacgagtggacaaaatataatataccattgtgtgcgtgcgcaagctcaacataagtaaacttactgctcactttcttatactaatccacccaaacccacaagactaaaccacaaatcaacccaccatgttcttgtgtgcaccacatgtaaagacatgaaaattacaagcagatgcatgtgggcacccacaccctgtagcatgcaatacataattatgtgcaggcatgcacatcataaactttgtaacttctaataggaacatggagcgtttccacttagagacacctaaatatgattgcaaaacttcagaaataaggagccctgtgttgctagatgttaaaatttctaaatcaggaaaactaaataaatagctaaggttttggtgccaaactacgaaacaagaaaggtaatccaaatcactgcggaattgcttatactcgatgcaagatcaaaggttgtcatgatgaaaaactatagaaagagcaaaagagccaacatctaatgatcacctctgatctgcttcaaaggcttctgaggatccaacatacttgaccctatctcctgataataggcattgaaataagtaactagttccaatttttccattgaaccataaggtagtttggaagagagaattttaacttgatttaaaatagagtactcaatgaaataccatacccctttggtaaggccttttatcttcctctgatgactcaggactttcagatgattctgatgttgtgccttcttctgcgccagcaactctctagaatcataaccaaatgaagaagcatcatcaacaagacatacaagtgaaagaaaactcagcattcggggcagatactggaaaacactaatgcattattctagcttaattttcttcaagtaagaaaggataaaagaaccagcgcataaggttatgattcaggtccatgctagaatgacaacacaaatgttttttagttgttggaagaaacacacatttttagtataaaaagttatgtttttatcacggggtattttacttatgttattgtattacttccatgagattgtttaacgttggaaacttagaatgacctattgtttgcagatattgcagggaaaaggacaccaattgatgccgcatggtttatattgaataagaaaaatcatagtttctagaaaaacagacaaaattatgaaatattttgtgagaagagaaatacaaaaacttatttctcgttatggttggaatgttggataggctaacagaatataaccttggcaaattcctcaagagtacatggaaccaattttctgaggcgatccacagacttcttcagttcttccacagatttcagagcatcctcatcgtcactttcatcggttttagcctcaccattgcttgtccaatcttcatcaccttcatcttcaatatcagattcctcgtcctctgactcatcatgttcatcctcttcgtcactttctgaatagtcatccccataatcctacaagttaggagttacattaagtttgcaaccactcttatatatttgataggtataaaggtgcagtatcttacatatggagctagaacgctgctgtccaggaccagcagcggcacctgcaactcgtgtgcgagagctcttactaatctctccctgtaaagctcagttcctgcattaaataggtctcaacacaagcatttgataacacttagtatctgcagcatgtccgctcaatacctggtaagctctggagcaatatcctccccccagaggattgcaaacgagaaccatactcagatgtgacaccattgtgccgcaggtgggacgccgtacactccctcagcagccgcctcgcattctcacttgcgatccaaaattaagtaaaaacgcaatttctcgtcgttagaaaactgatgtgactcactcaaacaaagtaccgaacaggtggtgcgcgcgtcatacttgacgtagtaagggaaattctgccacgtgaggttccccttctcccacggcacgacgcggcgcatgaactcgttgcggaacctctcccgtctggtgaggaacggcgactcccggcgcttgcaatcagtgaggaacctctcgccgctcagccactcctgctggtccctctccccgagcttcgcgtgctcctgctcgctgcatcgcccgctgctcccctccgccgccgcggcgctcctcgcctcggcgctgcccacgccgcccttcgaggagccgtagaaccggcacagccgccgccccgcgccccacggccgcggcgccacggcggcgccgaatctcctggcgaagcatccctcgccgccgcctgcgctggccgagatggcgagggagaccggcggccgcgtgaggaggcagcgcagccgcatcgcgtagtacatctcgggcggcctcgggagggggaatgggatggaatccgcagggttaggaggccgtggagccgggcatgtggtgaggaggaggaggaggagcggatggcgcgatggggagattggaatccggcgtgcgacgaagacggtggcgcaaggctgcgctgtgacggcgaggagggagacggagacgccacggcaatcttcttcggttcttcccccggctctcggcctcggctaatccgcttctcacgccgggccgctcttgccttggggagttgggagcttctggtgttgggtctctacaattttgggccgaatttgaaatgggcttctggtaagtatcagcagttcagcctgtatcatctgtatttgataaaagtctattttaattccctccaaaaattgacctaatccgattcacatctttcaacagcaaaaacctggtttatcgcctctcgaagtattaaaaccagtttaaaatttaagagtagcttggctggcgtgacagccaagtcataaaaaaataaaaaataacgtgagacacatgtaagtgactatagtctcatctttctctgagatttgcaggcactaacccgcgcaaataactttcaagccaggtgagctccacttgatacaatgatgaagctggagcacaaataagaacctcccacccctctcgtcgggacatgctttctcctgctcgttgtatcttccgcttcttcgcaaggccaccataagacactcgtcttgccgccacccattctcctcttcgagaagctagggtagccgacacagctaccacttagcttcccacgggccgcgatgtacgttgctccttccccttaagtggattactactactcccttcatcctgaataaattcattttcacccataccacacatgccattaaaaaaagtttaaaataccttcactttatcgaatcctagtgcaattatgcccctatctactttaaatacatttatttattactttcgcaaacttcaatatagttattactaagaataacttattttgaggcaaaatgggaacagcttaaagaaaacttagtttgtaacgaagggagcagcattttcttctcattgcagcaacgacaacggggttagaggaaaacgacggtggcctcgacaatgagatttggtaatttttaacaccccttaaaaataggtttcaattattttgacaccctggcccatcttcattcattcagatggtctcatatgtcatcctcacaagtgtcaattttaaagtaactagtaatcatgcacgtgcaacgcacgtctccacaaatatgtaatccgaatgcacggtactttgtaatagcccaaggagaatcataaaatatgcctatgcatgaaatcaatgtcacatgagacaaaaacaaaatataaataactacatatacatttcaaactcatgaatcatgtattatatagaaattaaaatgtcaatctagaaatattgtctaagcctacatcatatattcatgtttattacaataaactcatcccttctaaagatatcacttgaggctcctgcatatttttaggcatcgaattttttatccatacttgtcagttgtcaaaaaccgtgtttagaatttaaagagaagatcatacaaatttatactatattttgagacactatttgtggccttggagcaaacaaactttgtggccatcatgccatttagaatggactcttccaaccatgtttctgatatttgaggagaggtacactgttacaaggcagcctcaatgttagcatggtcagaagcttgacaatacctttgagagacttatgtaaataaaaaaaactacattgattataggaaattggtacaggaaatagaacttaaaaaatggcaaggtatcaataaattagcaaaaataaagaaagatcacacttgttcaataacatatattatcagatgaccctttagaaaatctaggtcctccattttccagattcagttaatccctcgaaataaaacttttccagattcagttaatccctcgaaataaaactgataagcacttgttttaagtattatatcagaaatacgccaaaatatattaatgacatggtttcacatacacatatatgttgagtttacctccatcagaatgtagaaaggaaaatggcaactccctggctgctagcacatcaaagtttcaatggtgcatgaagaaacataaagaagaatccatgtgtgtatggttatttacaacaaataattcagaaaatacacaacctgcagcatcctcaagaggcattgcacataaagctatacaggctagaatctttttcagaacatcatctaacatgagtagggatgttagagtaacaataatttatagtaatcaaatttgaaaaaattttctcatgcctcattactaacccacatgaccaacagaaaaatagaaatcccatgcaagttgtgtttgatagtgttacctgtctaaatcaggtagagagatcatgcaccgattgttgttccctcctttggttagataggaaacggatattagaaaatagaaatccatgataaaaaataccgatgataactttgtttcacatcaacactgatagcacaatctaacatattaataattcccttttatctcagtgtgatatatccaaagaagaaaaggcagaggatgttgcattgtgaatattcatatattatatatatttctaaaaaatcatgatgaaactaaaactataacaagaggtcaattcatcatgtatgttcccatgtctaaagcaatagattaccgcattttaaatcagcataactaatatcataatgctccactaaaattgtaataatacttcatttagcggagctataacatgtcagtcatagaaaagcaagaagcaaaccttgtctagaagtaatccagtaagcaaataaatgttgtgcctctctactgacacctgaatatgtcgatcactgcaggctgaaacattgtctattgacttaataaaaatgtatacacttcaaatatatctccttagtcacaccaatcttactaattccactatgcaccaatataacaattcaggtttagcaagaaaagaccaacatattgtctaataataatatgtactatcttaaggtttcatatgattaggtcagttttttatgtagcctagagcatttcaaatggagaggtccctcctctgtttctgtgattgcagcaagaatttcgtcatggaccttcagaacagcatatatattgtaacataacatttgcacaatagaagtgcaaagtatacataactgcagaactgccgaatgctacgattaatggtatgaaataccccaaaaaaaatgggcccactgttttctctgaatatttgcttgatactattctctgaagatattttttcttaggatctggatacctagttagatattcacatctcagaaatgcagaagctaatcatctctcttcttatcctctacatgtattaattacataaatatgattaaagaaaaacacatcataaggattatgcaaatttcagtacataaaaagatagcaattgtttaaagaaagtatcgctataactcaagatatgtcattagcctacagattgatgtatcagatgcatggtagccgtccatttagctactaatgaacggtcaaatgtgaaggttacggtaccggattcatccataagtcttcaacccctacccctggccttaattaatatctgcacaacaaaccaaactaaccaaaataataaatacctgtttatttgcgtgatgcaggtcgttggtgtctttcacaacctgttggtcggtcatttctttctcctcgtttcccttaccacaaggagtgccaaactggggagcagactggcctgatgacagtgttgagacagaggtgccgcattagtttgcaggaatcaaaatgttacttctagaagatcaatgatttgtatccagtgctcaaacttaactgccaaaaatgcaaatgctacaacactctcctttaagcatacctcccagtgcacgcccagtgccattgttgagctgagctgccgtcatcgcaaccgctctattcaactttatactccctgggccatgatggctgcagaattaaacaaaattaagcaaaatagaaatcaacacacctgccgagaattcctaataaaacaatcaatcaattaatatcatccaacaacaaacaagatcacctcacaataacaagctatccaatattctttttcctattataggctgtaaaacaactatgtaaactatgtaaacctgtttgttcagatgaggagtatggcccaatgaaaaccgaacttgctgctcactcctatcttgagacctatttagcatatggatggcttctccacctgatgacctaaaaatatagtaataaaaccaaggcaacaaagaattataccagatatgtattaggtaaagatgattagcaaataaatccataaggattttttaacctgctagtaaagaaggacatgaagcataggcgtgtgatgatgcccattgaaccgtgtgagacggcggtcgatgatggcagcagccccgttggcggaagtggccggattcatggcgccaaagatgaccagatggtccagatcttcttggcctcggcagctatggtgccgggcgtcgacagttgggggaagagcaagcgcggcgtaggtggcaatgtgggcaagcaccatgggaagaccctcgtggtagccattgacggaagagagatctgcaagcatgttccctgtcgacatctcaggcgccaccgccgatcctctcccgccacatgctatcaaggtcacttttgcgtggatcgaacgcaccgccgtcgctggtgtccatctctacctcccgtatacaccgtcagctcagcttgtccgcctgatttggctcgatagcggcggcttgatcctcactcgcgggcgctgttgatggggatcggctgtaaccctccaccgaaggcagcccccgcccctccaccatgagcccgagaaggcatggagggattggcgatggcgaggccgcgagggcagcggctagggaggggatggagtcacgggcgaagagag

SEQ ID NO: 58713 - DNA, 5975 bp, Oryza sativa
tatattatgggacagagggagtattaaagagcaaacgtcttgtacaagaagttaccatcactgataaaaccatagtatgaaacagttgtcccaaagtgtattagcccagactggatccactcaacagacaggatgtctagggcagtaaagccaccctgttatcaaggaacagaccttatgagaaaagctataagtgatctaataattttggacaaaattaactgaaaagccttaagggtgatgttgaaattttctcttcctgtaagaagaggtcgtgaaagattcacattgtaactttgtaagcttatagcgataggcataccttcacaattagtaatgatgctgaaattggatctttaactcccaaaacagtccaaacaagtgaattgtcagatcctgctgggattattccaactggaattgatacagcctctgctctatcacttctactgagtagaccgttgaagacctgcagaactataaatgttcagagtcgactgcaggtgcagctatcatatataagttttactaaatcccattaaactataatatataatcatcaaggacaaacctcatttacaattccatcaccacctacacacacgattcctacaaaacatttaatacattatcaattcaaccagttgaaatggttgccgtgttgacctacataaactacttggcaacatctgtgctgtttataccatcagggaatgcgctaaaatcaaatgtagatgcaagagatttagcgtgaccagcatgagtagttttaaccacttccatgtgaaaacctgcaagctacatcagatgatacaaaattaatagcgggaaataaatgatataaagtttatgtaggcacgcatgaataataaaaacagggtaacgggtaaaaaatcaccaagttgagaaatgtgaatgcatacaagcaataaaaataatccattagcaaatatctaagaggagaggaggtgatcgagtcagcacaattctctcttttttttaaaggacatctcgaaggaggcctataagttaactgcgattatacactttcgattaaaaggtgaaggaagtgcaattttagttggtctaaattgaaaagtaaatttgcaacttgacagcctgtgctgccaggagaaagggggttaaataatctcccttaaccttttgtcaataaattttacccagctttatgtccaactccgttgctgcattcacaattgaatcctttactgctaaagcatcagatggaagcccaggagttttgtagagctactaaaatagaaggaatgtatgatgtcccccacatgtctagattggtagggcaaacaacaaacataaattagtcatctgcaaatctaaccgtggatcattattttgatattttctaaacttaacacttcaggttggaactaaaaatccattaaagagaaacgtgatatgctcttcatgagttcttcactgttggaactaaaaatccattactgggatacaaaaaataccaaacattcctctttagttggcactaaagaatctccatggtcaaataatctatacattaaccatcaatatgtttggaggtatctagattgcccgtaaaagaactacatcagtagatttgcatcataagaaacattaagttgtaacaatattaagttctacagagtttaattcaaagttacacatcatagaacatgaaacaaccaataatttcgatacagaaaagaacagaggtactattctattcctcatgacatctccttgagactaaacagcgaatggtttaaagaaaagcttcaaaaagaaagtttattgccaagaagaataatagacatatacagttagtcaagctatatgttgcttactgcagagcaataagtagaagcttgcattatgagagtatcagaaggtaccttaaaaataggttctgctttgtcatggaaaactttgcatgatctaccatgcccagaccgagggttcagtataacaagtatcctcggtggagttctacatttgatgggtgggtggtcaaataaagcaccactgaggggaccatcaaggtcttgctcggtactggatgttggagggagaggtagcatgttaacatatatgttttgttcggcaaagcatgttacccatgaaatggcctcctctacagtaggggctataaaccggaggtccttccgtactctgtgtgtctttccaaacaaatacttcttagaagggtatgcatgcacaatgaaatgttggacaccagaactgtaagatacctgccaacatataaacaaatcatcaaagatagatggtcagcccaagtggaccaaatagcaatagaattatagtagtgtcttggtctgtgaaacttacagagatgacatcctcaagactgagtaaagaagaaccccatattagggctttacttgtgagtcttacatcacttatatcagctttcccatttgctgaaatttgatctcctgtaattctatttttcttgtcaaaaaagagttttccagaatagatttcataacctgagaaattagacttctcatccaccacatcatttttttgctcattattttttgctttcttggaatctttattgtcaaaaaccaagtgtttctgcctcgaagattttgatttgccttttttctctggaaatacagttggtgaagattgttgcccggctgacttttgagaacgccgactaccagaccgccgactggacttctgggatgagcttctggaagtaggattttctagatcagctacttccatctctttcttttaaagaggacttcagagcatcagtatagatcaggaatttggcatgacctcataggtgtatgatcatggcatcaatgccatgtcaaagttgctaacaactaaaaatagcctgcaccgaaaggaaaacagaacacctataagatccatctggctggtacatgtgcatcatttgttgaccaaaagcagccgttcagaaaaaatgagtacatccgagcttcatctccacagataactaagaaggtagtcacaaaaggctagcacctaaacagcttgggtctaaagaaaaaggtcctcaaaagtttgtcgtactgaaagtttgaagcatttctttagcaaataaaattctgataatatttaaatatttatatggtgatttcctatcatatgagcctgatgttcaaatatgtgcgaggaaaccttgtgacgaatctaacaaaagaacttttgctccatgtttaactgtgtgcatgcctacttgggacatatcaactactaacatttgtattcatgtgttgaatttgagccactaccctaaggactgcaatcgtcaattgttggaagctgatatgatgtgctatatcaaactactccctcagttccataataataagttaatctagtacaagatgtgacacatcctagtactacgactctggacatgctattctgggtcggaggaagtgctccagttcactgccatgctctagaagacggcattaagatgagtcatcacagaggctatggtgctacaattcacttgacttcttttatagggaaacacctggacacttatagggacacttacagcaggaacataggctaaactatttcacaaattaatcggttgagccctcaaacatagttctaaaatgcttaatagcctacagcgaaaacatataggtatataaacgctaacagcaatcagttccccgataattgcaagtaccaagtagactgtatgagcactataaaatagcatgtaccgctgaactctcaagcgtcagcaatcaaatgatgagttgcacaatacagaaaacagttattctagtgcagtacagtgagaagtgcaaagacgagcatataggtgataccagcaacagatctccagaaatacaaataataaaatgtgtttatagatgagtatagaagtctaaattgtttggttcagtaaggagaaacgcaatcacgaatatggaagtcttagcgcaggaatagcaactacgaactacgggcaccacagatctcgattagcataatttcgaatgccaaacgcccggcgcaccaatcggattgcgaaggcgaaagggagaaacacgacgagcaatccaatcagctagccaccgcccacctaacacggagattgaaacctcacgaagagagggagcaccatcaggcggatcgaagccacccaacgagacgtaccgaattcggcgcccccccactggaaacgatcggatcgggaggcggaaccagctgaggacgcggccctcggtccaccccgccgccggcagcagatcgaacgcctccggactcacgtcggccggcggcgcgagctctcgcggttgacggcggggcaagaggcgaggcggtggtggtggtaggaggaggaggacccggacgcggcggtgtggtggagccgtggaggggttgattgggtgggcgacgggtgagggagggccggggtggtggttcgatgggttttggcgtgcgcgttttcagctgaggagacgaggaagaggaggagaagaaaaaaaatggcgtggcggacacgaggcggcgctgttccggctgcgctgttgttgttgttgttgttgaggggagagaagccagtggaaagaaagggacggtgccgccgtttcctctgttctttctttgctccgctcgtttctcttctcccctccgcgcactggttttcctgtgtttggagcgctgctagtgctcgctcggttggcttttccctttgatcagctgatgatgcccattggaaacctgacgagccagcccagaaagcgagatggtggatggtgagataagatgagatgctctgttaggattactccccggccacgcctacggcggaacgaccgaactgacctacagaaaatttctcggtggacaccgacaggttgaccacttggagtatgtaggacagagcggacactggtgaaaccatagggaatttcagttgcaacaaagctgtaacgggcagtctgtgctcaaattaacccaacatttcacggttgaaatgttcagtttatgtcttggtttgatccagtccaatttggctggttcgtcttttggtagaaaaaggtggtcgtgatgaggttggcaattttggcatacgtcggttgtgttcggaggagagggttagcacgcaaaacgaaatttgttttattgcatgattaattaagtatttattgttttttaaacactttcatacagacagtttttttttcataaattacaccgtttagcagtttgaaaaacgtacgtgcggaaaacgagagaggtgggttgggaaaatgggcgaaaaacgagagaggtaggttgggaaaatgggggaaagaacacagccacggtgaaggccttaggaaaacggggacagaaaaatcatttgctttatttcccttcattattcaataaaagctcaaagttagtgaatgacctgcgactttaagctcaccgtgttcattccagtcgtcttttttatacaagtccggtggttcaaagagagtactttaattccttctagacgatgattagagataacggattccagctctccaaggtcgcaactgagggagctatatatcaaaataggatattattctttgtttgtagttgagatttcttagatttgagtaaatatttaatgagtaagaagtcgttcccaagcggagttcttgaaaagagttgatttccgaaatttatatatttggaaattcgaaacttgtttggtcatttgaatgtcttttaagccaggggaaggtgaggaagtggattaaacaaggaccaaggcggtcttcttagaattcaatggttcgtcagaccaagcacactacctggtcattacatagcttcaaacatggcaatgaccaaatttaaaatgaagaatgagtacgtcgccaaaacattactagggttagccaaagttaattttcagtgcagtatattagctttaattctaaacacaa

SEQ ID NO: 58714 - DNA, 11384 bp, Oryza sativa
cttcaccgtgccaacgtatgaaagtcttggcgtcagtacacgattgacgagaagaggaatcagtcccgtcaataagaaaacaaaacaatggtgcgtatgttttggactagcttgttgatgatggatggcaatatagccgcagctaacaaacatggcgtttgtattcagaagaaaaggaattatagtccttattatgtaagcattgagaattgcgatagtccagatttcagagttggcttgtacgtgaatacagacagatatcggatacaaaagcggtggcagtttgtagtatgtgcgtttgctttagaaaaactttaaggatccataccaacattataaattctctagtttaaaaatactccctccgtccaaaaaaaaacaatctaagagaaaatatgacccctcctagtacaatgaatctgaacaaaaggttagctctttttagaatggtgggaatatatcctataattcgcctatttatattgagtccattataattttataatattttaagatttgtcacttttatcccttcaatgcaatctaaaaaaattagactattttaccctcgtcttcttcctcattcttttcttctttcccctctctccctcatggtccatgtaaaaggagctttgacgtggcggccttctccgcgagagggtatctagacatgaggaagagagaggaaggaagaatgaagaagacaaggatgaatcaatcaaaaaatttagtggtggcatatcttaaattactgtaaaattatagtcaccttttacagatatacgaattataataacccttagaaaaaagtgaaaatctgatgttgcccgtgttgaaccttggacctttatgacctttactctactgccaaaaactaatagttcgctttacgatgaattttcgcacatgagacagatggtccattgtttaggcacgctcatcttcgccgcaggcacatatccttttctttacagaaaagaatgaataagcatgcacatactgttatgctactttactatccgttgttctttgacgcaagctgtgcaaagcaagatccattctgcacgtggttggaacagagaccacgtataaacagctcataaacaataggttagtaggagattttaattgtggacaaaaaaacatccctcagctaaccattttcgaggccagcagtcagcagaacaggcccgcaccccttgccccgttgtcagattttcagtgggtttcagtttggtccaatgcagccatgcagccatgacttgcatgtcactatgaaggaggaaacatccgaactcaaccgattcgccgctcttaattagccgcactgtatttaacataccattgcactaggacactaagtataatgcattagagttcatgcagtcttggacctgcagctccaggcatatcaaatcaacagattttcatccagaggcagcagagcacagatacaagttctagttcaagtgttcaacggggcaccctccgtatctctcgtctctagatgttcacagtcacagcgacatcaagctacaactgaacaagtggtcatattactaatcacaaagaatgctatggcctcaaagccatttgcatcaggaaaaaaaaaaacatcatctacggtcagataagccttcgtcctaacaagtaaccgtgacttctttatgttgctttgggcacctactgcacacttgtacgaattcaagtctgcaacagcaaggcctttaatttatgagtcacagctagccaaataattttggttctctttgtcggatgtctttgttttttctaatttctggtcgcctacagggtactggttcgttaggatgtcacacgcaacacctaatctaatctttggtggtaatctgcatcattttcattggtttccttcttatggctgtcaattttcgttactcgctgaccacagttctgtttttaagaagaaaaaacaccacacgatccacgctttcacaaatgcactcatgcacacggatagtgattgttgtcctgccatctgctctgttttctcgtgggttcagtgctgtgaagtgtgaaaccatagaaaaaaaaatcagtcagcaagtgaaaaatgtagcatatctcggtaaaatacatgacaaagttatatttagattatatgagtgcattgtgcaatgactctttctatgcaggaaaaaaaatgctgagcacacctttgaatactgctaagatgaattgaggtatccaacaaatcagacacttcactgttgctagctaaacacataaaggagaaaaagagagttacacacactcaaacacgacaaacacatgtagaatctagctttggcgataaagctttctggtgagcattatgtggaatgcgtattggtgaaacatcgttcgagcatttcttcaggcaaataattgatcttgtttaatcctatcctgcaatgtcaaatgcatgtgtaccgactaccgacacctatttagttggtgattattggagcagattaatttgactatgtcatcaaccaaaatgaaaccaaattgcttgtccaccaccaaccatctaaagtactactacctaatacacgcgatctacaaggaaagaatttaattactgaactactaatatacgttcactggtgctacaagatgccatgacatcacaaaattttctatctgatccaaaggcttaaactaatctaccttctcaaactacacagtacacacattcttctcctacctaccctaaaatactggtactattcacagtctacacccagaaaagttaaaacatcatcttgcggtccaatctcgatccaacggccgaagccaacgcggaggtcttctcctggagcgcgcgcaccacgtcggccatggacggcctcagcccggggctgtcgccgatgcactgcatggcgagctccgccatgacagccgcctctgcgccgtcgtgctcgcctccgagcctccggtcgacaacgtcggccaccttcccttcgctgagcatgggacctacggcggcagtgagacgccgcccggtgtcgcggcagacggcctccttccccgtcacgagctcgagcagcagcaccccgaagctgtacacgtcgctcttcttcgtggccacgccggagcggatgaggtgtgggtctacgtatcccggggagcccatgacggcgcgcgccgacggcctgcaccccaccgtggccgagaagccgacgtgggcgaagccgaagtcgcagagcttggcgttcatgttggcgtcgaggaggacgttggacgccttgatgtccccgtggatgaccgccgggtggcggctctcgtggagatactccagcgccatggccacctggaacgcaatcgccacgcgccgcgcccaggcagcaccgacgccacgccgcccgcgacctcgctgcagtggagccgttcgtggaggtcaccattcggcgcgtactcgaacaccagcacaccttcatctgtgagaagatcgagacgcaagaacgttagcacacttgatacgggcagtagtttaattcagcagcgagctttgcaaaatctggtgttgatgcgcgatgataattacctcgttcgtcgcagtagccgagcaggcggacgatgtgcgggtggcggagggagaggagcacctcgagctcctggcggaaggcgcggtgcaggcgctcgctgctgcagtggaccttgacggcgccgaggcgggaggacgagagcgacgcgaggtacaccgtgctgaacccgccgtgcccgatcacccgggacgagaacccccccgtgacggactccacgtccgcccacgcgagctgcctcgccgacgcggcggcgacgttcttgcagctcccttcctcctccacgccggccggatcggccgccacccgcgagctcattgcacctgcctccccgcgcttcctgacgtcgccgccatcgcaccggcgcacgcaggcgaagagaccacatccggtgaacattgtgctagcgcgcgcccgccccgaagtgagagatccacgagctctggagggcgacgaaacgggagagaatcgaagggtacaagtgaggcgaggcgaggcgaggagtgtgagtggagggagaataagttctccctcgttgatctgtgtagctttcagctttgttgctgttagttgtagctacgttcttggctttgccttactggataagaaggggacaggttgtgcagaggatccagatcaaagaattgctagtggctggcttccctggctcttgtgttgctaacttgctacgagtcaaatgcatacttgcaggtttatatatgccagggtggtgccttgtggctgcctttctttgcatctcgtgttattgtaagagtggaccaccactaatcattgtgcaaaaagaaaggcgattctttcagcgagggatgatgagtaaggacgtcacctgcatttgcttttctatttcttaattctgatctttttatttcctgaatttgctacgaaacgtgctctcttgaccatacttgagaactcaagatgacactgattaataaatgactactagtagcattctagtaaagtggttctactacctctatctaacgaaaactttattctacgtgttgactatgaatttgtagaaaaacgaaaaaacatagcgtggttatcggatacactttaccacaactaaaattagataagctgtagcagccacaaaagttatggtagataaattgttagccatagagtgtgataaagttgataaggaaattgagtctatgatgtatgaggcatgttattaaaaaaatgtgacaagccacaattatggaagtaaatcaaacacatacctataaattgtagtagtacaaagtatagtgtgataaagtgtgatcatgaaccaaacaccccgtagtttattttggacataggtaatactactactttcatattattggtctttcttctgaaaattactgagctaaaaaaatgcatttgtcttctaaacaatgaaacaaaataataattataataataatacagacgagccataaatttatcattttacatcctacttgctcacggaggacagtaataacctcgcagtgcacctctctaagacatgaaactacatcaacttggatgcttgaagatactaggagacaattaacacaagccatacttatttcagtggttggattgcagcagtaggagtaataacaaaccctatccaagatggttaaaccagcaggttgcgaggacaaacaccacctaccacgtgtcgtccactcgcgcaggcacgaacacctttgcaccacgcgtgctacagaagccatcagcgcgctgctcacaaggcatagtaagattccctcctgtgtgcagtctcaccgtgcactgcagcgcactcagatttgttgttacacgcgcaaggcgcgtcggcgggcgcgcgcgcgtcttcggtgtgcgcccaacctaccttcgcatttgcaacgtgccacgggacacagaaaaacaagaaaaacgcccatgaaatctacagggggccaaccagatacgcgatactacaaatttaaggcgaacacggcgagcacctgcccgcgcgcacgcgcttccggctcgttcgaccgacgttgactcacctaacgactctcctccgcgcgcgcatgctgatgcatgcatgcgccaccgccacccacccggccgtgtgctccgaatccaatctctaattcgacctctgctgatctgctctggctgttgggctccgtttatccggaaacaaatccaggcggtgcgatgatttcggctaatcaaccatgcgcgcgcgcgccagggggaccgaacagcggcgcagcgcgcggatcaccgacgcgcccggcgcctgtagacctcgcggcgggcacgcaccgccagtgtatcgcggttccgacggacacggggcccggttggcgcgatagaaaaacgcgagcccggcgccccggccccggagacggaagcttcgtgccaggagctgaatgccatcggcccacgcaacagtctttcgtacgtcgatcaaggtcctgtcgtatagtgtaagagcaagaacagtaataacgctctatttagttcctagtttcatcatatcacatcgaatgttaatttggacatatacatagagtattaaatatagacaaaaactaattaaacaaattgcgtgtaaactgcgagacgaatcttttaaacctaattgcttaatgatttgacaatgtggtgctacattaaacatttgctaatgacagattaattaggcttaataatttcgtctcacagtttacaagaagaatctgtaatttgttttcttattagtctatgtttaatacttcaaatgtatgtccgtatatccgatgtgacacgccaaaacttttcacccctggaactaaacatgcctaaatgtgtgtttcttaggaaagtactccctcagtcccatagaataagtgattttgggtggatatgacatattctgttactacgaatctggacaggggcatattcagattcgtagtaccaggatgtgatgtatccacccaaaatccattataatataggacggagggagtaaaagataacattaggaagatacacataacaaaatacatcattcgtattaattaagtattaattattttaaatttaaaaataaattaatatgcttttaaaagtaatttgtttatttttttaaaaaaaatacaccatttaaccatttgagacgtgtacgcgtgaaaaaagaggcaactttcttctctttgtgctgctgtcaaagtcagccagctaagcatatgaggctatgagcaagggacggatgtagaagtagaagtagaactagaactagcctcttgtaccataatcatctgttacttgttagttgattttatcggatactaccaatacagtttggtaagagataaaatctaatcaattttctttcctaacaagaaaaaaaagataaaattgttcttttggtgatcagtgcgaaaattaattaaattttaataggagataaaccgctgagcctcactagtatacactatgtaatgtaacggggaggtcgtaggggagaggggatgcgctgaaattcaaaacctaatcgcccgattgatatgctaaaaggggttcgtgtggctatctcactgcaagtacaggtggccgaaaaccatcgatatcggcgaccataacttgatgaagccaacatatctgcctcgactatggcgttactcaaagcggaggattcaaaaagaaaagaagaagaacaaaaggatgcatcatgcatggcaagtagacatcgacaaaataagaaggaaatttctctgggcgggaagaaaaaacatttatggggaaatgcaaggtcaactgaaaaagaatctgcaggcccaaagacctgggatggctgagagtaatagacctttagcgcttcgcatccgcattgcggcttaggtggctatggtatgaatggacggccccggagaaatcttgggtgggaacggcagtctgtgcaatcaggaagacagggagcttttttcagttgtaacaaccataacaatcagcaacggtagaaccgcttgtttctgcgactccaaatggctagagaaccaaactcctcgaaaaattgctccagacatctatgtagcctcaaaacgaaagaatagatcagtccatgatgcactacaagaaagcaactgggtcagagacatcgacatcctccatatcactcagggggatcacgtgcaacaattcgtccgtttatggactatgatcagaagaatgaacccccgactgaagaccaagataatattcgctggaatttgatagctaatggacaatactcagcaaaatctgcatataggctccaatttatgggggccacgagatctgccttcaatcaaatgatctggaaagcgtgggccctgccaaaatgcaaattcttctcctggctcgctatccaaaacaggctctggacaactgacagacttgagaaaagaggatgacaaaaccagaagatatgcccattgtgctgcataatcgacgagtcaacacttcacctgctggcacactgcagagttacaaagaaggtctagacagaaatacaaaggtggactcaaaccgacctccaaatgaacaaatggagtaattgcgactcggtagaactatggtggagccttgtggtagactctcccaacaacccccgcattcccacgcgaacgttggtcatcttggtttcttgggaaatttggtgcgagcgaaatacaagaatctttcgaaacactgcctcactgccggcttccatcctcgctaagatcaaggaggaaggtcgggcatgggtaaaagcaggagcctcgaagcttcaagagtttggaattttaggtgatatcacttaaccctcactttttacgggtttagttctttagactagccatgtacatatttctgtcgctctatatttttctccatctctatcaatatacgagggaaagcttttgccctcctttaaaaaaaaaagtagaagaaccaaaagtatcagcttcaatggcttcccaaggaggtatgtaaatcagtaattttccgcaaagcggaaaggtgatcttgtttaagaattgaattaatctaaattagacttcaatatgactctttcctaggcttatcactatctatctttcagccgaccaagaactgaaaacaattgtatattttcatttcaagtgctatatctcaattatatattacaatcgtctatgctctcatagccggttgagtgatttgtttttagagcatttatcccctataaatccctttattagaatttgcaatgagaacttaacaaaataacaaaagtctctcccgcaatcgcgcgccctcccctcaccaacaaatgttcaatattctatcccctaaatccctttttcaatttccaatgagaacataaaagatataattctttataagagatagcttaaacttaactcctaaaataacaaaactctcccgcgcaatcgcccaccctcccctccatgagatcacaggcgagaggcctattgcgagcgaacatgttcctgtaggtgtggagaccgaggactttggttttgtggatttcatctttttttttactctatccgttttttaatatataatgtcgttaactttttgatatacgtttaaccattggtcctatctaaaaatttatgtaatattatttattttattgtgacttgatttattgtcaaatgttcttttaaatatgacttaatttttttaatttatacaaaagttttgaataaaacaaatggtcaatcgtttgtcaaaagtcaacatcgttatatattaaaaacggagatattatccttatagagaaactattgtatccaactttttttttacaaaattcagaaaaattaaaattatgatccgttttgaacaaactgctgtgcattctcttagatcgcctgtgcatacaccgtccaacaaggcaatacgcctgtcgccctgtcggcgtcgcactgatcgatcgacgtctgacgaataacaaactcttgtctcgagccatcctgtcgtaatgtgtcaaccacagtatcagggactgtcacactgttgccgatccggggccagtacgacgaggagcactcttttcgcacggcaagttcgtgtcctccgtgcaaaatgcaaaagataatcgctgtctttggtccgggtgtgacacgatcggtttggtgcgatcggaaacttccactgggatgctccgtgctcggtgctcggattgcaaagctgcttgctgttcgtcaactaaccggtacaaagatgcggcaatcgcttgtttaattccagggtttgataaaaaaaaaccatagtcttatttattcgcacgtccgtatcactgtctgtgtaggaacatccctgagaaagcatggcttggaaacgaatgataaatcaatgtgttacttgaatgaaacatgctaataatactcacgcgtcaacgcgctacagatatttataggcaggtacagaagcacacagagatacgtctccggccagattatctagatacagtatcccatcggataattagtgtattcaatttgataagacgttctgactaacaaggcaaaagttttgcactgctggatgaagattattgatatgtctttgtcttgtctgaattctgtagctcaaaggggccattacaaacagagaatactgtaggcaagttgaagaaagcaaacaaaacagtgctctgtgctcgagctagacaatatatttactgtaattgtttgagagattaatatgtcagagcaactacagatcgtggtgtaagattttggacaagccaggatttaccattcggatggaccacgggatcccgatctccggcggtaaggcagtttttgggaaattttgactaaaatttgcttgaatttattgttttgaatttgaatctatcgaaaccgttcaaaacctgcctcgaaatctgctttttgtcccgtgtcgagtgtcgacactacgaaatttccccttcttcgtcggaaacgtggacctggtaaaaacttgtattctcttggatgatatttgtatgggctatactgtaatctggcgaagcccgtaaactctcacgaagcctgtaaacagtccgaacaaaagcccaggtagcccttctgaatttcttgcaataagtttattttgcttccctctgtgtcttctcatgatagaatcatctcccccaattttaaaaactggtgcaaatcaactccttcgagagtttagaaaactcctttgatagtttagaaagcagtttatgctgacatgacatgttaactgtgatactcgttgagtcagtaggtgagacccacatataagcgacctccaccacatcccatcttcttccttgtccctcttccattgatgagctgcaacgtggccagcgcctccaagtccatcctaaacctctcccgctcattgtagtacaccagccattgtggctgcccacctctaccccactcccacaaccctcgccgaatggcgaggaaggacaccgacgacagcgtgtccatagcgaactgagggccgactacaccccacccctgtcgtggtagcccattccttctcgttggacgttgagccacataacacccagcatctgcaccatcatggttggttggcctcgcagtaagtgtgggtactggggagaagaaaatgcatcctagggtttgcgtaatttgggtctcgagggtttggggttggggatggttgtgcttgcctcaagaaggatatataggttttggttgtcggtggtgggaggctgtcctcctagcctcgcgaatggcgaggttgcctaggatgttaagcaagatgttaatgcatagcctaggagtttgagcccgccggtggacaagcgaggat

SEQ ID NO: 58715 - DNA, 70493 bp, Oryza sativa
aaaatcccttgtatttaggggcagagggagtataaggctatacctctatgattttgcaccttttcaaagaaaagaatttttacaactctatgcatgtgcgctcgtttgtttcttatttttcagatactgataataaaaaagctgtaccaaattcgaccatgaatagtgttgaccgtaacaaaattcgtgggttttcttttcgcaagcgtagctcactgattaggttcattgtgatgaaagcagtctactcggattcaagtcctaaacttgacatagttgctgctcgtatttacggctaattattcattcagtcgtaggcgatatacccatcgatagttagatgctcgtggttactctgttacactactatagaaagacactataggtgctagaatagctaaaaccgacatcgatagtattttttcacacttacacgtgctcattggggggggggagcagcaaaaaccgacacctttgtgaatagataggtgccggttctatataaaaaccaacacgtaaaatattagtattggtttattcaaaagaaccagaacctataatatattataggttctggtttttaagaaccaacacctacaatcatataggtgtcagaattttaaataaacagacacctattaaaaaaattggtcggagccgactgaaccgaccaaccttatctactcccactcctagtcatccttatcatccacactgctaccccactcctgtccctcctccttcctcctctctcctcctccacactaccgccccactcccacccgtcctcaccgccgcctccccccacatgcttctgctacgctcctcctttctcccactcttactctccctgtcgagggatccaggtgatggcagcgcgaatacacgatgacagcgacgacgacggtggcacgacagcacgatgacggtggctacgcgacggcgctggcgccctcccctctgccagatccgacgaaaagggaggcgacgggctccccaagccgtccgcctcatccctgccgtcctcgtcaccgatggccacgtcatccccgttgtccatgttgtggatccacctctggacattgctcatcactgcggcgttgtcgtcgttgcctgaccccctccttggttctagctcaatgggcgctggatttggtgaccctggtacttggcgtcgacctctcctcgccgacagaggtaatgtcctcatcggcaatagcgacgatgatgatagtagcccctgtgctgcccactccgccagatctagaggcacctggcaacgccgggtagtcccttcgtcctcggctccaccgccgacatcaaaggtcagtgtcccttgtcctctccctactccatactcccctctccttcactctcctcctccttctctcgccctcctctcgccctcctctctcttgttgatcttgttgtcggcaattgtctacaggacaacaggtgggcagactcctccatggtggacaacagtcgcgagttgtctagaatttctaaattcaaatccatgtgatgaaaattgtaatattatgtgatgtgttgatggattatgtgacttttaatcctataaatttgtgaatttcgttggatatctgtttcattctttagggattttaatcataggctcattgtctcgagcctgtctcgatggtttttttttctcctgtagggtcattggtgttagttgttcaaaccttataggtgcatgttttctttacaaccgacacctatatattgttatatgtgccggttatgtaaccgacaccgatgcctttagtcatcagtgccatctgcttggatgccggttgagaaaaccaatacctttgtgtggttccaactaacacctattaatgtttttttagtagtattaatttcaagatataccggtcaaatgctcataggagtagggggatcgggatcctctgcattagagtacaaaatgcaaaggagctacaataatttgcattaggaggaaactgcaccatccattcatgattaaagacatatgataaacatccacagtatgaatgtgatagcaatggatataagctaaaatattgatgctacagtaatggattgatctgaaccgtccgttgttaatctaactactcaaatactactgcaaaacattgtagcatattgcattaatagttcaattatagaggatccatatccggagtagggcatatatgtttgtcggtgacatgggaccggggatatcttgactagaggtttggggcagccgcggtcacccacgtggcctgaccccctcgggggggtcgggcccgaggttgatgaggccgcccctccctctatctccccgaggggtcgggccgctcccgtttcgaccccccgggggctggggcgccccgaccccctgagggtttggcgccacgtgtgtgggttaggtgagcacagcggcgctcacctaaccgcgtttattgcgggttggacgagcgcctcacgccgcatttaatgcagcatagcgcatgcttatccggtccgtgatcggtcgcagtgtgtgaccgatcacagaccggtcagatcgcgggttagggggcaacaggcggcctgacacacgcctcgccccgtcccgtcggaatgatgagagcctccaggcactcgtccctagccagagccggcgtgggaactcctagagttggcacgtcagccccggccagatacattccaggcttcatcgcaaccattgcaaggaagtcattgtatgaagaagtgcagacgtgtagcatgctaaactgacacgtggtggacaagaatgaccggtctgtgactggtctgacgccggtcgcgtcatcagcaaacaaccgtgcttccacgttgcacctgcttccggcggagtggaggttggtatgacccatcccgtcggagggtcattcggacagcagccattgcaaatctccgcccattaatgagggaggacagggttatcccggtgtcaggcgaaagtacgagccaagttttggtcaaagtaggatgggtccccacccaaaagaagggtaggtagaaatggtgtatgtggtatccccttgagatataaaaggaggaccatgcctacgaagaggggggaccaaaaaaaaggagggacggaaaaaaagactagaggagacctgagcaagtagactggagaaaagaggagtgagaggggctctagagtgggaactctcttgctctccaactctttgtaactccttcatacacagatccaccagaacacaggagtagggtattacgcttctcagcggcccgaacctgtctacatcgcccgtgtcttgcgcatttactctctcgcgaaacattccccagaccgatcgagggcgaagaacctcacttagcgcccccggccgaaccggcaaaggggggcctgcgcggtctcccggtgaggagccccacgctccgtcatctggcgcgccaggtagggggcgcgcgtgggtttttctaagccctcgtcctctttcgtgtgcgccaagcttctcccgctcagcccaatggccgaacgggcagtggcgcacaacctctctccgagcgctagcggtgacgacagcgagcagaacccgcgtcgtcgagctcgtactccaccgcccccctctcgccgaagtcttaggcgggaggaggcgctcgagggggtcgaaagatccgcgacttcgccgcacgcgggcgatggagaaggacggcgagacggggagcgtcgtctcctcgtctacggtgatggcagcacgccccagggcgcgctccaggctgcgggcgcgctcttgcgtcacccgcccgtcgtccctgatccagagactccaacccgccgttggctagatgacgtggccaacttggtcatgacggcgcagcagcgcctaggcgccggcgggcggtcctccgccaccaaggccactggcgttgctactgccggctccgtgtcgtcgaggcgaagggcgcggcgagcggcagccgttacccgccgttcatctgccattccctcgtcaacgcctcccacccaagaagatgtgcgtgaggggccggatgcccgcctcaatatcgagcgccggcgcaatgatcgccgtgctgcccacgcatcggagggcgcttcctcgtccggagcgccacttcggtccgggcacgggggccagccccccgtgtccccggttggcggtgccggctgtcgagcctttgtggcgagccttcggaacgtccgttggcccccaaggttccggcccaccatcaccgaaaaatacgacgaaagcgtcaaccccgccgagtttctccagatctacacgactgggatcgaggccgccgggggtgacgacagggtcatggcgaatttcttccccatggccctgaaaggacaggcgcgggattggctaatgaacttgccacccgcgtcggtccactcttgggaggatttgtgccagcagttcaccatgaacttccagggcacatatccgcgcccaggtgaagaagcggacttacacgcggtacagcgaggggacgatgagtctctttgctcgtacattcagcggttttgtcaagtccgcaacaccataccgtgcatccttgcacacgcggtgatctacgcgttcagggggggcgtgcggcacaaccgcatgcttgagaagatcgcctccaaggagccccagaccactgcggagctttttcagctcgcggaccgtgtggctcgcaaggaggaggcatggacctggaactccaccggttccggtgtggcagcttcggccgcccccggatccgccgctcggtcagggcggcgggacaggaggaggaagaagaggtcggcccattccgacgacgagggtcacgtcctcgccgtcgagggcgcttcgcgggccacccgaaaggggaggcctgcgagcgacaaaaagaaggaggccggcgctcccagcagggagcgcccgaccagcaagtggtgcaccgtgcacaacacctccctccacgacctcgcggactgccgcgcggtcaaaagtttggctgagcggacgaggaagtgggaggaggagaggaggcaggagcgccgtgagggcaaggccccggcggctccctccagcaaccggcgaagtgaggccaagcagaaggcccccgccgagaacattgacgatggcgacgatgacctagggttccaggagcccggggccaccatcgccaccgtcgatgggggagcacgcgctcacgcttctcgtcggagcctcaaggccatgaagcggagcttctggccgcggcccctacccatgaggcgacgcggcgggcgcggtggtcggaggttgccctcaccttcgaccagaccgaccacccgccatgcattgcccggggaggacagatcgcatggtggtttcccccaccgtttgcaacgtgaagttggggcgtgtcctcatagatgggggtgcagccctcaacatcctttcccccgcagcctttgatgccatcaaggccccggggatggtgctccggccgtcccagccgatcatcggtgtgacgccggggcacacttggccgctaggtcatatcgacctcccggtcaccttcggtggttccgccaacttccgcacggagcgggtgaacttcgatgtggcggacctcagtctgccctacaacgcggtcctagggaggcccgcgttggtgaagttcatggtggcggtccactacgcctatctccagatgaagatgccgggccccggtggccccatcaccgtccatggcgacctcaaagtcgcgcttgcttgcatggagcagcgcgcggaccacctcgccgcggcatccaagcccgcgggtggcgacgagaggctcagcacctccgtcccagccgccccgaggcatcggatgatcacgtgcgacgaggtcccgatcaagcaggttgccctgggcgacggcccgtccaagaccacacgaatcggtggtcttctggacgataaataggaagacgcgctcgtctccttcctgcgggcaaacgccgacgtcttcgcctggagaccggcggacatgaccggggtccccagggaggtgattgagcaccgtctcgccgtacggccgggcgcaaggccggtccggcagaaagtgcggtggcaggccccggaacgtcaagccttcatccgcgaggaggtggcgcgacttctggaggccagattcatccaagaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaaaacacgcaaccaggagaccttactttcggatctagcggaaactttcgaaagtctccgcaccgcccgcataaagctgaaccccgacaagtgcgtgttcggcgtgcctgcgggcatgcttctcgggttcttggtctctgcccgaggcattgaggccaaccccgagaagatacgagctatagagcggatgcgccccccagcaagcttagggatgtgcaatgcgtcactggctgtatggccgccctaagtcggttcatatcgaggctgggagagaaggcgctacccctatttaaactcgtcaaacgctccgggccgtttatctggacggaggaggctgaacgggccctcactcagttgaaggcgtacctcagttctcccccagtcctggtcgccccggagccagatgagccgttgctactctacctggcgggaaccccgcaggtggtcagcgcggcgttggtcatggagcgcgacgaggacgaccctcgcttcgcgcatccccaccctgtgtcgactcgacccgggagagagcagggaggagaggcccccgagccgaacggtggcccaaggcccccgacggccggagctggccctccgcccgcttgtccgaaggtgccaggcgcccccgacccccaggatggccacggggccactgcgggaaggccgcgcctgtcgccctctgaccccgaggtcatcggcacagaagccgagtgcgccccgcgcggcctctcggagcgtgacgaggacgatcctcgctctgcgcgtccccaccctgtgtcgattcgacccgggagagagcagggaggagaggcccccgagccgaacggtggcctaaggcccccgacggccggagctggccctccgcccgcttgtccgacggtgctaggcgcccccgacccccaggatggccccggggccactgcaggaaggccgcgcctgtcgccctccgaccccgaggtcgtcggcacagaagctgagtgcgccccgcgcggcctctcggacgaagagcgccctggaaatgcggcccctagtgaagaagatcggccccgccgaaaggtgtagcggcccgtctacttcgttagcgaggcccttcgggacgccaagacccgataccctcaggcctagaagatgctttacgctattctgatggcttcgaggaagttgcgccattatttccaggcgcatcaggtcacggtggttacgtcctaccccctcggccaaatcttgcataaccgagagggtactggacgggtggtgaaatgggcaatcgaactctctgagttcgatttgcactttgaaccacgccacgcagtcaagagccaggccctcgccgactttgtggcagagtggacaccggctcccgagcccgtctccatccccgaggccagctcgggcccttcgcagctgcctcacaccgcctattgggtgatgcagttcgacggctccctgtctcttcagggtgccggtgcgggggtcacgttgacctcgccgagcggagatgtcctcaaatacctggtccgcctcgactttcgggcaaccaacaatatggcagagtacgagggactccttgcgggactcagagtggcggctggactggggatccgccgcctcctggtgttaggcgactctcagttggtcgttaaccaggtctccaaggagtaccagtgctctgacccgcagatggatgcttacgtgcgccaggtgcggcgtatggagcgccattttgacgggatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccgaggcccgtcagagtccaggcctcgggacccgaggggagcgctcccagctcccttagattgattgcttggatcgctgagatccaggcgtacctcgcagataagactctacccgaggaccgcgaagggagtgaacgcgtccagcgcatctccaagcgctacgtgctggtggaagggaccctctatcggcacgcggctaacggagtcctcctgaagtgcattcctcgggaataaggcgtcgagcttcttgccgatatccatgaaggcgagtgcggagcccactctgcctcacgcaccttggttggcaaggcctttcgccagggtttctattggccgacgactgtcaacgatgcggtcgacctggtccggcggtgcagggcgtgccagttccacgccaagcaaacccatcagccggcccaagccctgcagaccatacctctttcatggccgtttgctgtctgggggctcgatatcctgggtccgtttagacgggccccgggcgggttcgagtatctgtatgtcgctatcgacaagttcactaagtggcccgaggcttatccggtcaccaagatcgataagcactccgcacttaaattcatcaggggcatcactgctcggtttggggtgcctaaccgtatcattacggataacggcacccagttcactagtgaactcttcggtgactactgcgaagacatgggcatcaagctctgcttcgcctcccccgcccaccccagaagcaatggccaagtggagcgcgccaacgcggaaatcctcaagggcctcaaaaccaagaccttcaacatcctcaagaagcatggcgactcgtggatcgaggagttgccagcggtgctttgggcgaaccaaaccacgccaagccgagcaaccggggaaacgcctttcttcctcgtctacggcgcggaggcggttctcccatccgagctcaccctgaggtcccctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcatcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcaaacaccttcgtcgcttctacccctagtgggggtcgggtgtcaggtctcgggctcgggccaaccccgcaccccgcccgggcgtgcagggttggccgggggctaccacatgcataagcttatcttttttctcttccgtatttcaataaaagcattttcgatttcctaaggactgtgtctgtgccattgtttcctttcgaagaatcttggcttgaattagcacgctcgtgctcgatcctgccctcagtggcccgggccggctaaaatcgccaaacggggcccagaaccgagccgtgccccggggcgtggtgaactccgggggggaatcggcaaaggcccacaatcgggtccccataaccctcggtcaccgcgctcccggcctggccagtctcgacacgtggatctccccaggcactagccccgacccgcgccgtttgaggctgggacctgggcacgagtcctcgttcaagccaagacacagaaggaccgcggcacagaccatcctcgtctcatatacacaacgaacagagctgacacaaaaatttcctctttatttgattgcagattgaattagtttatacaagaagggggcccgaaggcctcagaagaagaaagaaaaagctatttaagattggcgggggcctgggggctcacgccgacgcgcccgggtcgccggcctcgtcgtcgctgtcgtccgcaccaccgtcgccgccctcctcgtcggagtcgagggcgaacgcgagccgaggggccgtaccctcgaagctgtggacgatgtggacggcggcgtcccggacctgtgcgcgcgcgccatcctcggttccaggagagaactcgtccagcgctgcccacggggagaagtccgggtccctggcctagtagcttgccagtacgagctccaccgccccccgggcgaggtccctcgaggatgacttgatcgtctcctcgagctcctcggggagccgctggagggtcccggccatctctgagaggcgctgggcgaggcccccctggttggcggcatatttcgcgatccgcccgccccagaggcccgcctgccgcccggcgcggtctagacgggagacggcgtcccgaaacatgccgggccctacctcgcctgccaagcggagggcctcgacctccccggcggacgagtccagcgcgccctgcagctcggcgatggtgtgttcggcagctgcgaggcgggcggctagatcgccgtcgcccgcggctgccccgccgctgcgcgccctcgcgtccagctccttcgcccgcgcctcgagctcagcggcccgctgatccagtgcggccctctcggcacgggcgccttccagattacggcgcgcctgctcctcccgcgctgccccgcggagggacaggctgtccgccagccgctgcgccgcggcctcggcctcctcgagagctcgctcccgctcggtgagcgcgtcctcgcggaggcggagtgcggactcctcttcggcgcaggcggcctcgtgcgccgccagcgttgcctcccggatggcgacggcggcctcgcgacccgccagttccctttccttcgtgtccagggcgcgggcgcgctcctccagcaccgtggcgcgagcctcaagggcctcttcacgctgccgggacgcgttgagcttcttctctagctccgcctcccggctcccgtattggaggcagaggtcgtcccgcgccgcgttaaaaacggcggtggcaatgagggcagtctcccgctcctcctccacctccctggcgatctccgccaggtccctacgacgggcctcgagctctgaggcgtgccggcggtgtgccttgcggcccgcctccaccatggcctccaccgagcgtcgcccctcttcgacacgcgcccacgccgcgtcgagctccgcccgctctgcctgcaggacctccatctgggcacttaacccgtccaacaccgtggtgttcgcggtggccaaggcctgcagaaggggctccgcgctcagtggggcagcggaaggcatgggggagagccgcctcggtaaggatgccgcacggctcgtcccaccgatcgacgtgccggactcagggacgtcccccgaagctggcccgtcctgagcgtcgcccgagaggtcgggcccgagcggtgcgcccgcggcctcgtcgtgggtggcctcggaagtcgtcgtcgcctcgggcggagtcgggtcggaggcttggcaggccgcccggcgtgcgcgcgccgcctccgtctcccggacggactcctcggcccggtggagtcgggcctcctcccaagcggcttcctcagcctggcaagcccggacagcctcctgggcagcttcctcggcttcccggaggcggtttgcggtttctcgccggtcagctccccgcctccgggcctccgcggtcgccgtctcctcggcctcagaccggccggacttggaatggcgggaagggcgcgacgggatctcgctgaggtagaagaaaaactagaagacgaaaaacgggtgagtgaaaacttgccttgggagatgggagaatgaatacggccgcagtgggcgcagggacgaacctgcgaggaggtcggctaaacgaccaccttgggggggagatgaggtttccccggtatggttcggtcccccccatcttgtggagccgcttcttttttcgcttcccctcgggccgcgacgtcggcacagcaccctccgggcgcctgctgctggcacgcaccgccccgccccctcggggaggagatggggagggggtatcctcctgtttcctcttcccccgggcgtcggtagggcggctgccccccgggcccccgtcacggggcccagaagcacgaccccctcccggggtagattgttcccccctgcggctcccgcccgcgccatcgtggcctcggggggcccgctcccccgacgccccgacctcctgcatgatggtcaggatgttggcgcgctctggatcgcaggagaggggaaggaccccttgagagatgaaggatgcctccacggagctgagattcagcacccgttggaccactattctgaagtcctcagggtcccagtcccatttgcgcccctggtgggtcctcatgatgtcctcgggcccggtgtactcccaggcgccccgggcgtgccgctggagcggcgcgatccggcgacgaaggtagtcgccgaacaccatggcccccgtgagcccctgggaccgcaaaccagccaggcggtcaagaacggcgtcgtagccgtctcccagatctaccggcgcccgccagctggaggcctgcgccgggggctggctcggaagtcggaggcgcgcttcgtcggcgagaggggtgtagaaccagtcactcttccagtcatcccacttcttgcgaaggacgcagggaatgtagcggttcagcaccggcccccgcggctggaagtagcagccaccgactaccgacggtggcgacaccggctgtacggtgaagaaccaccggaacaaccggagagatgggcgcaccccgatgaacatctcgcacaggtgcgcgaagatggccaacgtcattactgcgttgggggtgaggtgcgccatctggagatcataaagctccagaacatccatgaagaaagaagagaatgacgggaccagccctgccattgcgaagggaaggaagaatacggaccgccccgggtagtgtggcgccgggcgtccctcacccagcgcaaccacctcccggccggtggcagattccggcatgaatcggcgcggcagcccggcctgcctctcgctcacgatgcgagaaggcggcagcacgctaccgtcgagcggtgcggagccccgtgccataacgccggcggaggaggggtttgagagcgagtgagtgcggcgagggtagggcacaggaaacgagaagttagagcgcaagcggcgaaggcaaggggaataatggcgagaggaaggaaacgaatctcttcctcggcgtctttatacccttgccaaacgctatgcccggctcctcgcttcccgcgcccactatctcgccccctcgtttctcgcgcccactcctccattaatcctgctcgcccgtttgcggcgcacgaggcggatgtgcggccgtggcagtcgagatgggacatatcatgcgcgcgttaactacgctcgccgaccgatgcaccatcatcacatctccaggcgaaacgaaccggctcgtcccaattcgcgcgctactcaagtaatgtagcggtcttgaagaaagccgctcattattgtcggtcggtttttcccttgccgatgcgcgcgatttgcgaccactggattcctgtccgcctgtagagaccggtcccacctgtcaccaggcctgaggagtggcgtcacgcccgagcgttttcctcgaggagggcgatcgccctggcataacgccgggggctactgtcggtgacatgggaccggggatatcttgactagaggtttggggcagccgcggtcacccacgtggcctgaccccctcgggggggtcgggcccgaggttgatgaggccgcccctccctctatctccccgaggggtcgggccgctcccgtttcgaccccccgggggctggggtgccccgaccccctgagggtttggcgccacgtgtgtgggttaggtgagcacagcggcgctcacctaaccgcgtttattgcgggttggacgagcgcctcacgccgcatttaatgcagcatagcgcatgcttatccggtccgtgatcggtcgcagtgtgtgaccggtcacagaccggtcagatcgcgggttagggggcaacaggcggcctgacacacgcctcgccccgtcccgtcggaatgatgagagcctccaggcactcgtccctagccggagccggcgtgggaactcctggagttggcgcgtcagccccggccagatacattccaggcttcatcgcaaccattgcaaggaagtcattgtatgaagaagggcagacgtgtagcatgctaaactgacacgtggtggacaagaatgaccggtctgtgactggtctgacgccggtcgtgtcatcagcaaacaaccgtgcttccacgttgcacctgcttccggcggagtggaggttggtatgacccatcccgtcggagggtcattcggacagcagccattgcaaatctccgcccattaatgagggaggacagggttatcccggtgtcaggcgaaagtacgagccaagttttggtcaaagtaggatgggtcccgacccaaaagaagggtaggtagaaatggtgtatgtggtatccccttgagatataaaaggaggaccatgcctacgaagaggggggaccaaaaaaaaggagggacggaaaaaaagactagaggagacctgagcaagtagactggagaaaagaggagtgagaggggctctagagtgggaactctcttgctctccagctctttgtaactccttcatacacagatccaccagaacacaggagtagggtattatgcttctcagcggcccgaacctgtctacatcgcccatgtcttgcgcatttactctctcgcgaaacattccccagaccgatcgagggcgaagaacctcacttagcgcccccggccgaaccggcaaagggggcctgcgcggtctcccggtgaggagccccacgctccgtcaatgttcatagggataagtatgcacttgttatgagcacctgagtttgtaccatgtttttaaaataattgtgcttttttaaaggctaggtattaactttttactaaactattcttaacaatgatgtgtcatgtatatttgtagttaaattaattgttaaaataaatatttgtaaaggttttgtaatatttttttaagttcgtgtaccagagttattttttcttcaattgaggctgctgcctgtgcgtgctgatcagcgggcagaggcaaaatgacatcacgtcgccactcacaatcaccgcttgccagtggtttgccacaagaaatgggttttatcttgttctttgcggctctgcatcactaattcgacaaactctatttttcactcaactattggccgaatctatactacgcctttctcaagtattaaaaccatttcaaaaagatttctcaaatttgaggtggctaacgtggcatccacaaggcaacccagtaagtgactacctcccatcttcttcctacaccacccccctctctcccctcactccctcctatgggcactccacttgtgggtaaggttgcaagggggtaggcccgtgaacccacttacaatacaaaaaagcgggtaatcccgcgtaattgggtacgcgggcctgccccttgcacccctacttgtgggtcaccgacggcacaaccggtggctagcaggcgacagaggaggaggagctcgagtacaacctaagccaccacactcctcctattgaacttgggaaagtggtgacgaagatctcacaacacgagtgaaggtactcaaacatcgtgcgggattcatatgggtcatcatgacaacaaccgtctgaaggcagtgggaggtggagaggaagacctcgattagtgtagagggaaagttctcaaggtagtactttaggttgaggcggatggagtgttgccttcaaatgcattgcataagagggaaaagagggatgccgctatagcaaggaaggagttggtcgttgtgacatcccctgaggagagggcggtaccaagaaaggagacgatggaggggaggacgctacctagcagggaagtcggaagctgtggcggcaaagagggccttggagagttgtgcatggatgagagacgacgtggtgaggagctggaggaggttcgctttgatggtgatgtagttgaagggcgagaggttgatggcgttgtcaccaggaggtcttaggcggagaaggagattcttaaattggatggaagcaaggagccacatccgcgggtcatggcgcagggaagagatgaggcccaacaacgtgagcgtgaaaagcccaaggagcacaaggaggacgccaagctttgcttggttgcatgacgtgtgacggtgtcaagggagaatgattacgtgaaccatctcgtcagagtgtcgagcctctccagagccatcttcattcccgttgtacggtgatatggcagaaggcaactagggtttggtggaacaaaggagatcaagagaggtgctggagctcccgcaagagagggaggtgagactaagagaagggagtagttgaggaaaaaggtgagagatagccatgtacatatcgatggagttgttttaatattcattcgcgatatacccggtttaaagggattaaaatggactccaacccacccaaagagcgcgcgtgcaatttgaaggtagaaatgggctttcatggcagtactttcctgcggaaaccggcccaaggctacagttttcgggccccagacccagaatgcgaggtaccaaggcctgcctagtcactgaaaacgccgcttctcttctgcgagcctgcactaaaaaaagccagaagaattttgccccagatccataccaatatcaacacaagttcttctccaaattgctggcattagaactttgcaaattttaaattatgcactgtatggcaaacggggaacggggttcctcttgccttagttccaacaatgcaaaatttatttgaaagtcatcggttcactagttcatcactggcagaattaattataccatcctcataccgcctattcacatctctatctcaaataggagtacagaacattaagcctttgatttctggattacgagcaatattttgaagtttgaagatagatactttaatttaccgaacactcggcacagtagtcagtacagtcacataattacacacgcacacgctggagctgctatattcgtcaagaggctcccacctacgtataaaagcgtataaacagtggcgtaattcttctagagttcaagaatggcgagggattctcgcagaaatcagtggtaactcgtatcttctctttaactaaaagcatcagtccatcagttatatacacacgaattccttagcataacgtcactgagctcaccgcatagcccgctttgtggtaggggatcttcacctgtgaagtttacgaaggaaagaacggtgctatggtttttctggtggctcttgctgttttgctctactccgggacatcaacctctccttgatttctttaaatgattggagctcttcgagtgcatcagatttcctacgggacacgacagaactggttgaggctgcttcactagattcaaccgctgatgcttgagatggacaattagagtttcgcagagggcgtgcagttttgagcaggtgcaccagagagccaactgcggcatcttgtgatttatgggacgacgaacttgcctgatctctagcttccttcccatcactgctcctgtatattatatagtgcatatagaaacggtgttagaaccatagaaactcagtagtggaaacaaagaaccgaatagtagaaatacaagaggacatacataactgttatattttatcaaaagccatgggtacagctcaacaaagataaacatgaatggggtgaataataatagaggcacatatccagataaggttatattagatctgaatctcctgttaatatagggtgctgcgtcaaaagaatatctgatggcactgggaatagtaaaatagactaatcatcttattcaatacaccatatagactatcacgcaacaaatgtagctcaatgcattgaatataattatcctattttggcaccacataacaatgaccgcccaaacaagcaaaactagatgtttaatttagagtaaatttcacataaccttatgtattaggacatgccactacaaatatgccattttagataaatgccactactattcacgatatcggctacgtgccactagaatttggggaaattagaaccgtgccactagtattatggtccttgttgaacaaaaccacaaaggttttggcatgtggcacaaccccggatatcatggttctagagtttcacaaaacctcattgttaaccaattgttctttgtttcatcataagtatgagtttctaatatcaaatctcaaaactcgaattaatgaatttttttatctatcataaaaaactttagccatctaagttaagcattttttattttgctacaatgtcaagttaaatttgttgacgccttgacagtgtggttttataaaactatagtactataatataatacccaaggttatgtgtcacgtgccaaaacccccgtggttttctgcaatttggaccataataccgggggttctatgaaatttactatttaatttatgtacgagtgtaataaaagtaaaaggaaaactccatttgagcaattcactcttcctaaggcctgaaatttgaccctcgaccacaaaccagatactcagcaatcagcatccctgaataatcatcatccctctcccatgtgctatccatctagcttgtcagatgtagcatttctcgccattcaagttgttcactcaatatggtggtacagtgactgccggttggggttgtagatttctgttttcaatggttctgtaattgatttttatggtgaactgtaggggaaggcccatattgtatggattgtcattaagaaaataaagtgctgaattgtactttcctggagctcttctgcagacttatctcacacgtgcaagtagttcaactagcttagattttggtgtaataggtaaataaacttcattaggtgttcacagaagtcattagcaagcaaatttgcctaacccataggcatcaatgccatgccagctactgtgatggcataggtttgagtgaccattaccttgttatgtgaggacataagttcggtcgacccagcaagccagattatgtgttactacaggattaatcagtgccgttgatcagttaaatgttagtttgcgtatcattttcttggttaggtctgtttagctattgttgaggatcgttaggaacattatttggatattgcaaacgaccttctctatacaacagaggtggcattcattattaaacacaagcaagaacttagcctactctcttctgtcctgtcactctgttctcttccagggttccagggaggtgagggttcaggctgcaccctcctgtcgagcacaactacaccctttgccatttaagtccagggccaagccataacaaacatacttgcacatgtaggacatgtttgatatgtgtttgatgaccactagtacaatttaatcttttataagtgctttgttagtttctttctgccgttctggttgtatcttgatatcgcttttggttgttggccagtgtgttaatcattgtcgagttgtagcctagtggctattttgttccagaaactttaccaggatggccggtaatcccgactacactcttctatctacctatgctttctataaatagcttggctttggccttttgtctaaaaaacattttaatatgttaaaacttgttgattgtgactaagaggcaggttacatagaggttagaacttagaagttgcaaaaagaaaaagtcatcgagtcaagtccaaatttgtgctttgcatttgtagcaactgttagctctgacatatgattgtgttcactctaactataaagcaaagaaacttaagaactggtaactatgcaaaatctagatctttgcaataaactacatattggtagagctgtcgatcaaggcacaccgagtccatgttaactaagccaataaccctcatttttattattcctttttgctatctctaccagttattctaacactagttttgtagtatgacaaaataacatgtccaaaaggttttcaaatccttagtccccttaatgtcatatttaaacttttgaaaaaaaaaatcaaataatgtgcaacataataggatttgatagctctaacgatcaaatatttgtgtaaccggatagcctctagcattctttaacaactagatctatggatactaaatcaacttagtactgcctccctcccaaaatataacggataggagctagtacttcgtatttcatatgaatagataagacttcatgtaattcgtttctggctttatctgatgcactactgccctagcaaatggcgaaattcatcaaatctatagatagaatatttaagttactaccatacatacccaggctgggagctcggtgtatcaacatcatccacagcaaagggataatctgcatcatctatatcatcttgtcgaggggaatcacaggaggagagtgcagagaacctgccagattcgtccttagtgtccttgccctgcacatgggtcaaacggtgtcaacgcagacccaactcaaatacatatttttttcctggcttcaatagctagaggaagataaataagttatccatagctaatgcagaggataagattaagtcccataaaggcaatccactaaataaaaattaaaagtacaagagcagacatatattgcagcagacaagggtaatccaaatatccaaccatttgaagatcaaaagctgcttttgggtaagcctcagaaaataactaactcaacaaccattcttctgtttcaacaagtactatgaacgcatttcttttcaacaaataatatggtctcagcaagaaccaagagacaatcgaaacagttcacaactaataagagaccctgatatgtagtctattttttgccaaaaaaaaaaggagagatgagagctaaatggtgtatatgctaacaaacagtatttaggctgcttcaactccagtactaataatggcttacattccactatcaaacatggtttgttgcacaatatcatgaagctaaacttaacataacaacttaaacttgtgaatatgtactgctaaacattgacttgaaatagctcttggtagagtttgtttcctagtttccaaggtaaatgccagtaggctctactcagccacatgaaaacagaaaagtctacttcagatataccagatgaattgccttacactcactctcaaaagttatatgattcatgaaggatccagtattgagcagtgatgaagataaggcatacacaagtatcaaatataagttgaaagcatattggaggctttaaaaccatggatcaccttgcgtcctggcgacaagcttgcatagggatccattattcgaaatccatctgccctcccaaacgaggggcatctctctgatggagactgttgtgcactagatgttcctgtctcccctactctcctcggagacgttggtggcaatgtgatcggccggtgaattgggctcctcctgtcacccacctgtggtatgctcattggtgcagaccctcccttaggacgagattgaagatacccgctgggaaaattgggtggcgatggagtgggtgatgcgttgagcaaatgaggtggcgaaaatctagcttgctgcctaggcgcctgcggccagagcgctggcgtcgcccagctgtgcgggcgctgcggctgattggacagcgcctgcgggaaagcggaacctgtggctcctgtgagcgaagctgggaaggcacgcattggctcggcagcagggctgcccacgtagtcggcgatcagcatggagggcgacaaggaggagatctcgagattgaaggcagcgaggctggggaggtactggacagagacgacgaggcggccgtgctgcgtctcgacggggacgaactggtaggagcgcatggcggcctcctcgtcgcgggagagcggcacggcgaaggagccgacgcggtggaccatctcgtagttgtaggattggttggcgcagaggaggcggaagacgcggtacgccggcaggaagcggagcgtggcgtacaccgaccgaagcatcgtcatgcagcgcttgtacgcccggttcacgggtatcccctcgcccgccgcggcgtccggccagggctcgcacaccaccgtccatctctccaccacctccccgcccgctccgccgccgccgccgccgccggctgcggcgtgagccaggaggatgtccaccacgagcggctcccccgcctccggcgcctccactccctccgccgcgggcggaggctgcggatcgtggagcgggaggtggaaccacctgtcccgccgcctgaacgacgccgacgcggccggctgcagcgggcgcggcccgcgcacggcgagcacggcatggagcaccttgaggtggaactgctccaccatcagctccgcgcccccgcggccgcccgtccccgagtccgacatgctggacattgcgaccgccgaaccccgaccccagcgccgccgccgccgccgcccgcctcctccccctcaccacggctcaagctccacgacatggctggcgctcctcgcagcagcagcagcagaagcagtacggccgcataaatccgatctgctcgcgatcggagggaagcgcacggcgacgggggatagatctgcgcgtcgatgggagggaagaagaggagaggaagaggttggagttcgatggatgcggggggtgagaggagtagagttgtttatctgcaaggattaaggatcgctcgctggtttggttttggatttctggggttaaagggtcgctgttggtgtggtcatgatgagattataatggtggcgacgacgaaacgagattattttcgtgctcgtttaagataccttaagatattaaagttaactgaaatttttttatggttgagtttcaacgtaatttttctttctcaactcataaaatcgttcccggaatataggtacgtgtcagcccttcttcatttttgtttaatgtattggccattcgacgtatatgaacatatggcaaaggaatctttcaatggacgccggaatattgtcaaattttagtatcattcatcatgtgatcttagtatacagcttcagaggagttactgttgtatatttgtgttcgttagaagaataaagaaaattaaatccctcattttccgcttacacttccggattgctgaacgggagttttttaaaaaaagtggatagaaaagttattttaaaaaattgttaatttattttttaaaaatttaaaataataactacttaattaattatatgctaacggtggatctaattttgtccattttcttaaattttttatccccttctttcaaacacatccttaaaaaacaagaggagttactgtagtaaattattaaaatatcgtgtgctttgctagcagcttcttatctttgattatgggtaaatgttttgtcaacaccatattccaccttctttattgcgatcgaatagctttacctcttactcctctttttcatggactttgacaaacgcttcgaaatggtgattgctgcagaactgacgcaacatctctaaactaccctgaaatttcccaggaaaacagcccgtgccaaagctgaaaatgagctggaaaaagacgagtttggcaattctataccgccttgtttacgttttcattccgtcggtgcttcttcaccagtcaagtcgttcacttcttcctccaaaaaggaacatcagatggaaaatcaagtacgatgatctggtcaattgtactattaaattaataatacaacgaccttatccattattatcccatagcattattcttaggactcattccactaaaagtcctgctacaattgtaccgcatgtactattaataatagaatcttttagaggttctctcctatctttaagagatacaatacatcctcaccacctcaccaccaatatccctttagactgtctccaacaacgcgacgcatactcatttatccgtcgtgcacagtgattttgggtaaaaaaaaacagcctccaacgggagaggcaaatgcgatacgcatattgggtagcggccaaagcgctaggcaaatatacgtctcctctctccaccgaacactggagcggagctcgcgcagtcgcgcggtgggccagggtgaggcagagctggtgcggtgaggcggagctcccgcggcggggcggaggtggcgcggcggggcgggagcgccgtcggggagcaccgtcggggagcgtcgtcggagcgcgccgtcggggaggaggcgtagtgggcccgtagtggcgttagggcggagtgcggccgacggggagagtccgcggcggagcgcggtcgtcgcagttcccgctgctccgttctgagcatcgccgccacgaggacgagccgtgccgcgagccgccggtgggtgtgctccgcctgccaccaccgctccgccccgaccacagccgtcgcgaggagtcgtgccgcgagctgccagccgtcgcgaggagtcgtgccgcgagctgccagcgtaggctgttggagagaagaagattgggagcactgggtaggctgttggagaagggaatttttgagtgtccgacctttttactgtgcatcactcaatccatgatgagtctctagaatgggtctccgctgttggagacagtcttagaagttctcttctatccttggaagacaatacatacatggtacaacctcgccaatggagtgtagaaaagaatgtatgcccgtagcgactgttaaaactgttccatgctagctacgaacataaacatttgttctttctttttattcagctgagtgcctgagtccgatcaaatatgatgggattgagattttgtacagccggtaaatattgccttgctttgtacacagaattcaagattggaacatagactcgctgaatggctacttctgaatgctgagtggctgttaacattcggaagtctttcgtgttagttgaacatacattttaaccttgcaattcaggtgatatagaactccttttgtataagatcgaccctactgatcgtccaataaaaaatagcaaatgagttacatctatcatacagaagtgcatgacaaaggacctaaaagcaaaacaaaacaaaatgggaaaactggaaagcccccttccgtcagtagcatcttgtaggttcaatcagttcagagaagagcgcccatatctccagctattgtaggatctccgagtgaactgctgcggcgcaaaacttaacccaaacatctctctcagggccttccctggctcaaggagtccgatcagtctggcaacaagggatgcactctccctgacatgctccaggtctttggtttcggtccaaaggcaacgagcaacctgtagccttctcctcttggaggcaagtgaaaccccccatttggtgtacatgctctctcgttcctcgattgagagccgtctttgcatctgcctgcagagcatctccctttcgcgctgcaacttcttcgcactgcatcccgagtcaatttatcagtaggtatcgaagtgtcacaaccgatgtaatgcagtgaacttgtaagaagtatgctgaacatgacttaccttgaaactagagaagtattcgggatactagctatcgctccattggagtaggtatctttaagaaatgatagcctcctaagttccacttccatgtaaatggaatcagctgggtctcctttgaatagcaagaaaaaataggtcctatggaccaaagaaacattgcatgcatgccaaaagtcaataatctcttgttgcttcttctcgaattccaggggccaccgtgaaggtgactgtagggcatctgtaatcggatccagtcctacactcctgatggttccttctgccaagtctccatttccactctggcaatcgaaacaaagaacaaaatcataattaaatgtggcatattggactatcttaaagtagtgcaacgagtatttttagtttataaataagccctccttgagctattaaaaatgtgaagcaccataaccgtgcgcagttctcaaacaagtagaatgagcagcatcaacaggaacaagataacatttccaatgactcacatgaccaagttgcttctgatactgaacctgtgccatttctttcagttcagcaacaaattcacctatgccagtaaattctgtgtcgcctgcaacagaactgttagccttcagtccatccctcgtggtagtaatttcagaaagcattgaccctgcccttgatagggtctcgctctctgcatcatagttcagtgcagatccccttctttgacaattttgaggtctcccagcgaaatctatgaaacttctgtttggtggggtgcaatcgtccttctccaaatcttcaaacaaactagatccagtaagagacctacagctcctgctcctaccaagtactttagagcttgacgaattacgtgttgaagatcccagatcttttacaatattggcaaaaggttttctgacattttccaaatgctgctcaagggtaactggagattcatcacgaagcctagaattcatagatgaatttgaatcattgttgatatgcatactagaacctgcatttgggtcttgcaaactattgctccccacagccgacgattccaaacattcatttcctcctgtttcattggtttctatacaccgtacttctttgcagatatcatctgaatcttcattagagatctgtgagagatgatcacttctgttagttgggagcatcccactgaacggaggactgctgactgagtacctagatggggtagtaaactgcacattattttcagcctgctgaggcttatgttccctctgtgccactcgccggccttgaaacctaaaattttggacactgtcaacaacttctgatgactcagttgttgattgctcatcttcacacgtctgtggaacatcgaaggtaaagttcctcccagaaacctacatgtagatagaaggaaaaaggtaaataactttatgtggttatgaaacgatagttatactaaggaagtctgcataccgaggactgctttgaaacatggacatggttatctccaacaacctgaagcaaatcctgaagcctggactgagctaaatcacgctgtaacttcaattccttaatttctttctccatctgcaaggaagaatatgtgaaatcttttacaccatggctagaagttggtgtattgctggcattgaagagaattagcataaagcatgcataaaaatgatcattttaggatctacaagttctttaagtacaaagaaatagcaagagtgaacaccataaaggtcagaagtagcatttaccttccggatttggttatccttttccttcaccaatgattcaagactagaataggaagctggacatcgcaattcactctccaacctagcaagctctttttgcaattgcttaactagtgctttatcggacatgactacattaacctgggcatttgtaactacttcctttgcacaacttgcaaatagcagagtgtttctcgattgttccatatggctacgggcaggactcattgtacaaataattgcagttcttgcattaccacccagagaaggttgcagtatgcgtgtgagctttgaatctctgtatggtatgtgcccatttcttactttgctgcatagatgaaagcaagtaatcaaatgagccacagcatccatcctctaatgccatgggaaattggaattcaacacgacacaaagtattaagttatgttgtcaaccttagtttccgaatgacagttcctagggtaagtaaacttctattaatatgacagccttctttcagcctagcaccagctgataatgcctgagatgcacgttcacttcctgctaaatcaacaaaattctgcatggtacaacaaaatgcgctcaaacttcaccatttctacatgaaaaagaaatatgaccaaaatttaaatgtctcttaccacactagccacaagtgtagttgatttatccttacccaagaactcacgagcagaactttctattgtctgaaaggacagatgggtaagttagagttaatggaccaatgcaacatcaattttacatatttactatagcctttttcttttctaatgtgactgcgtagtgaacaaaccagtttaagtatttgatgcgatctggagctgttttcatttaagtatgtctccccggttttcctttgagctatataaaaacacagaatcagatggcagtaatcaccacctataaacttttttctagataatgtattaatgattaatctaccacaaacatcgcaccttcacatacagaaataagctccttgagatggttccagtccctcaatacaacctctgtgaggttttctacataggttcctttctgtaaaataaacaacaccaagatcattagtagaaagcaggagccaagcaggatttaaaaataattagataagtaggagttgttttgacctctgcatcatcccaaagtctaagaggagtgttttctgcacttagcagatcccttacaacttcattatatatttctattgctgaaaatttcaagacaaatgctctctcctcatgctgcaaaaagaacaacatgcctatcagcctgacagttcaaatgtgtctcgtttcaacaccagctatggattaataggtactaagataggtggctgattaccttgccaatgtaatcataaatatctgctaccgtatattcagttatgccagtcatggtgtatgtctttccactacttgtttgaccatatgcaaaaatactcgctgttacagaacaaattaaaaggaaataaaatgtgttcagttagttcatgcaatcttcaatcaaaaccaaattggataagataggcaataggtttggacttaacagttaatgccactaactacagagagggcaacctccttggccccttgcttgtatacttcgttcgtatcgcagtcagagcggaataccctatctgcaattggaatagagttgtgtcaaaaaacacagctggaaagtgagaatattaaagagcatacttgtagtacgagcaaactaaactcccacttatctgtattctagtggtgtgtagttgtccactaccaaaaaaaaatgtccaatacatttgtaaatgtaaacattcaatttcaggagggttagcttaatttctaaaggtgttctgtcagattttttttactgggacaggaatgtgtcgatgtgttctgttacttgtaacaaacgacgatgtataagtaacaaattaccagtgattggactccggcaggtatgttaaattctgagattttaaattttaaagaaatatacaaggtttgtcctgatttgaagcaactggaatgcaatacataagagctgaccagataagcaaaatcctaacaggagatgcagaactaatgaattacagatgtagaaaacccagagttgtgaacttgtgatgaactaaccgaaggagtatgcagtcggagccgatggcctgtcagggaaggtgctccgggagattatggtagtgtcattgatgcactcccactccgacggatcccctctcgcaatctccttgtcgctgagaggcctcagcctcactgacaccagtatcctctccagcttccccacaccgccgccgccgccgccattgaccacctcacctccgtccatcttgtcccactgcaccacctcatccccgccaatcgcccccatttcacccctctacacacacacacacacacacacacactccccctctcccctggcccctacaccatctgccaagagcccaaaatcacaccattataagcgacagaaaagcagtcacatccaaaataataataatcaaacgggtcagcaaaggcaaactggaattcaagaacccgtcctactcgttgggcggggaggggagccacggggtgttgagttgttgctcctgcaggtggaggagaaggcaaggcaagcacctctcgtggacccccaatcgtcgtggagacgattaagatggtggttagagcgtcgtccgcaacagtagaatcgcacactaactaggcctaaatctagcaaccgccccgcaagcagagcagctactctactcattccaatgttgactatcgcggctacttcccgagaacgcctaagcatatcccgcagggggcagcatcgcgagctactgccagatcacaatatcacatcagtgagctaggcactagcagccaagtagcagaaaccccgtaatgctcaagccacagcaagggagggagcaagaaaaacaaggtgaaggcgacgagtctacctaccctagaggccgaggcggaggcgcgcttctggaagcgggagccgccctgcagtgcccgccacggcgcgacggccgagcttggaggcggccgccatggcggtcgatatatgtgtcggttaactatcgagggggaggacgagtagggggttcccgtcttcctaagatgcgccgtggaggttccgttccgtgagcagcagcggcggccggcagcccgccctccccacgacggcacgatctggcaggtttttgggcgatatcgtagaggacggtggcttttccttttggccccctcccttcctttcctcgttttcccttttcccacacggttgaggggagagagagccggagaggagaccgttgattcccttgtccccactccccacgtcgctctcgctggttgctccttgccgtgcgtttttgcgcgatgcccctctgcttttcggtgtattgcgagcactaaacatacggaggcacggagtagtggatcatcattgggttgggtattcttgtttgcacaggagttgaggtctcagactggagtgactgacagactcacggcggccagactggtgccttcagaattcaggaagcagggattaccactagcggcacgagggatttgatgatgagattaagatgggaatttaatttttaatcccaatatcttgtttggtagaggtgatgaaaattgataaggaatttagttagagattatgtcattaataaaaacggatggctgagatttgcttaaacaaagtgaaggaggaattccctcccaattaactgcccctacccaggtattgaaaagaaaggagttccttcctcaattctccatcctcatcccaccaaaattttcatgtctcccaaacaaacaaaactcttaatagtctcatccctctaaatttccaatccctcctaaaaactttctccaaccaaacggaccgtagggggttaggcgtggatgatgatgcgtggttgtgtttaggaattttgtttgggagaaagagggaagattcatcttgatgtgactggcagttacagtcccttagtggtaaagcaattgctaattggatttttctgagaggttacgtgaaacttactcgatcggtatatgtttactaggcgtgctgccttaagcggtgccatttgcttaattagctagctcttgtggctggctgtatgcctgtatatgttttcttgtactgtcgatctgtaaatggttgagaaatcacaccttgttctgcgtagatgcgcaccttctgcattacttcagctggtcttgatctgagaatttgttttcatttttgtcgatatcatttcgggaataatagcatgcttggcacttagattttgtcgcttgatgaggtgaatgatgatcggcgtagatggttctgtccctttgccggccgtgccagttactgcgtcgcaaaaagttgcactcatgctgtccaaggcataaggatcactgacctaccctttcccggtgaacacgcactcatttccctctcaaaacttggcgaactagcaaatcaaaagacaatagcacggctggtactaccagtacagtagtactgtccacaacagtgatcgaacgaccgatcgattcgaagccacgatcgagcttcaagggaaaaacctacactacacacaacgaactgtacgtacttgtgactacgtctacggtagtagtactcctagtacatatagtatcggttgccatccgcgactgcaaccccgatagctaggccaacgaagtcaacagcgcgcgccaaccgaagatctcgcggcatcatctagcgagcgattcggcaccgcaccggttaactctcgcgcggcgcggcgcatgtggcgtccatgcggacgggagccgcgcgtcccgtaccgcttggcagcgaccgaagctgccgctcccgccgcgggaggaggaggaggaggaggtgcggcacggtgcgtcgtacggattttgtcggtagccgcggcgcgtatcgcgagcgcggacgtgcgaagcgacgcgcgctccacggctccagtgaaacggcggttcttcgcgcgcatcgtcgcgccgtgcggctggtgcgcgaatctgctggctggcaagagaaaaccgttgtttttggaggaggcgctgcttgtgtttttgggggagaggagggggtcagtcgagagactgcacgcctgacggaattcttcgtcaggttaacaacaaattaacgtccttttaggacggggtccagtgcgcgtactttgccggttaacacgtgacaggaatttctttgggtgaatcattgtgcgtggtccagtcgtgtatgccctctagaatccaaagtgctcaaaaataatttatggctgatattctagccaattgaattcatagcagtatgtactactacactgttgttctaccaaaccacattcttacagcccacttgcgtcgtctcgtcacattagttaagttaggcagttgtcggaaatggtgattgtggttattctttttcgactttgtgatattttgttgtcaaaaggtgcaaaagagaggatgtcactgattgaggttgagggcatgcttaccttcaactctaatcaaagtcgggctgtctactctattctctccgtcccaaaaaaaaaaaagacaaaccctagatttccgtatccaacgtttgacgtcttatttaaaaaaattatgaaaaaaaataaaaagacaaatcgcacataaagtattaatcatgttttatcatctaacaacaattaaaatactaattataaaaaaattatataagacggccggtcaaactttagacatggaaacccatgatttgtctctttttttggacggagagagtacatacgaagagaaaacatctggcacatgcttctttattgttcactgatatgtcgagcatgtttgatattgacacatctaatctaacggcaggctggttgggtgattgattgattggctacccttacctatgatcagccaatagcctgaggtttgatacactgataagcaaaccatgtaatataatgtccgagtccattttaatgagcatctatccgaaaattattattaaagtagaaactttatttcaaaataagtcaattcgtaccttcttattaccctcgttcacaaattgaaaaaaaatctaccctttcataccctctgcggctctacctacccacccactcaccaattctaacctttcattaatgaggggtgttttagtctttttctctagctcttgttaacttcggacgttatgattttttttttgataaaaaagcatattatatgtgttgctatagtgaatataatgtatggtcataatgaatcttttgtctcctaaacaccatataaattggcatgtccatgttccatgttacaccataatgttataatgctaaacaacatacacattgtgttcctcagagagatttgtctttagattaaaaggacaggattatatgtagttctaacatgctgatcatcttcactccgttgttctccatcaaaataagccggactttgcaaagtatgtgtaataagctcttgaaaaaagtatccactctgttttcttagggggggggggggtaaaattgcaccacctgttcatattcagggttgcaaacaacatatatgcaaggctaatgtaaatattcaacttataccaaggaaagtccatattaggtaaaatttgttaatttttaaagttttataagtaaattaataggacactaaatagagtctcatgcgagtacaacttcataggtattaattctggatgatggagttatttatctttatattacaccacttccttcgttcacgacctgtttaatagggctccacctcctaaatttaatttgaaaagctaggtcaggcgtagagtggatcagaagtagagttgtaaagcagcctaaacctcactacacctatttatttcgtgatagcactttagctcacttcgttccctttttgggtggagttaaaaccgttttgtcggactccagctctaagagaagtggagctggagctctaccaagcatgctctaaataaatgtagttttagcctaaaaattgtccttaaaaaagtatatttccaaagtatttcactagaactctttaatactattacctttttttttcttattatttttagtcactgaaccaatagtactctcctttcccccattttccacttatcgttctctcgtattaatgaaggtatagtaggagtagttttttaacctttgttttaatgctccacctatttagagacggagggggtacaaaagatagctctaaaagcaacaactagatgtccatgtaaccatgttagctctggcttttggaggcctagtatttaccacattaaatcagcaaaaaaaaaagagaaatgtattcgatgtatggccttagtgggtccagaagctataatttatacaaattacaatttatctattatatactaaaagtccatgaaactttctacaaacgctctcaagccaccacgtggcgctctaataaaatagagaaaatcctataaattctaagaaaaaagcataacatatatcccttaatttttatttaaattggtgggtccaatattatacaccattagataaaattgatcctaaaacaaactaaataccatgggtcccacctatcctctcctcccgtgcattggcaggtggagtatataccgtaccctccccccctttttttcctttcttcttcttttttccatttatatatataatggatatattttttaaataatgataattttacaaacaaagaatctaccatcatataacttaagccggtgtactttttactctgtactattattttcaaataatgcactattttaaaataaattttacacaattatatcgtgtcatatcaaataaacaatatctatattaactaatttatacgtgcacttaaactgatggctccattatataaatcatcggatctactttttattacactggtctattattctcaagtaatgcactgtcaccattatattgtgtacccattaaattaacaatttaaaatctatattaactaatttacacttacgctagaactggtggacctattattataatcatcggatctattgtttgctaataaataaagcgtccaaaattctctttttgcccgctgcacaatgcacgtctgcacctttgcttttcgcacgtgtgacaaagcatagtgtctgagacatctaaggtgatcacaaccgctatagtgctaccgctttgccacgtattaaatcatatatggagatgattaattttgttaataacatgaaaaaaaattaaaggtgtgatgcagtgagagaataattaagcaccatgggttgtgtttttctcaacactaattagctctatttaagttgaaaatgagagttgttacataacaattataatgtatttgtgttatttcatatttggattttgtactatttgttcgtaaaggtgaaaggaatcattatgttataaatgtgagcgcaatattgacgaatatcaatagaactcttactatgacaaaggtgataaagggagtttaaggccctctcttttttttccgatttcatattttggatttttgtttgcacgctttccaagtttctagatggtgtcttctttaaacaacattataactttttagaagtcaattcattcgtttataccctcaaatagctatcacataaattatataattcatcaatttcagctatcctaaaccttaagtactacatattttttttcatgcgagccatgatgatcagtaaattggtgaacaacggatcatcaaagtcgtaagatgaatatataagagttgctctgaacaattgtaaataggtgtcaaaattaattgttattaattagacatttaatggcttgctagccacaaaattaatttctctctacatatatataaacatggacgaagttggaacaaatattaccatatgtcccatacatatatattgcgcaattaacattctaattagtcatttaaaatttcttaaaatgctctcaagctgccacgtggtgctataataaattagggcaaatattaaattctaacaaaaaaaatcaaagtatctattattttatttcgcttaaatccgtaggtctaatattataaaccattagattaaattgatcttaaaacaaactaaatactacgaggtcccacctcgacataggtacgcacctacatgcgcgggtacgtacgcctcccctcccttttttttcatttttctctttcttctttttttcctatgcatatgcttccctccctttattactatatcatgcgtcttcatgagacgatttaatcaaaagaattttgagtatcttgcactcgcatttttaatttgcgggcatactacacgatatgtatatacatggactgtatgataattaactagcaatagtttcttatttactcgagaaaaaaaacatgattcaaaagtcgtaagtacttaatccatcttctactcaaaagtttgtgaatggttttctaagataccttaagaaaaatagaacccttaaattattataaaataacattatccaaactttagtttgccccgaatttatgagacaaaatttctgaacaaacaacaatcttacctttcaaataatataagtgcccgcgtatacgcgcgggccaccttcctagttatataaatgaaaatagaagttaaacttgtataccaaatgcaactaagtgataccccacgctttactataaaatacataaatgaatatatgccaaataatatataaataatgaatgttcaattattatgaaaataatgtgagaaagatgatgtaacatccttgtatgttaagctctacaatgttctcttttagatgatgtatctagtatgagatttaagataatctataatattaaattactagtggataatgatgtgttatgcttgtatgttgagctttatagttcctactaattattattagttggtaccaactatatagaagatatatattctacctttaaaatttattgtaaacataaattaaaagttgtatatcaaattctgttccacttccaaaataaggtgcgtgtaaaaattgtgcaggaaaattcacttggacattaaaaaaggttaaaattaagctccaaataaactatataaaattatgtatttattaattcaaaacttagaaatttattgagaaaactaaactaaggctccacaccaacctccaaccttttagaaatctgtcagcctgtcacatgcgactgccattctggatgatgcattttgatgctctctttttttccgagatgattctggatgacggtggaatgctagttaatcaaaaaactcatcgccacgttgctaatttagctgactttgtcaacttcgtcgaggacacacaacacaaccacacacacaaatccagcgcagcaacagatctattgactatcgaccatcaaggggattggatcgaacacacatacgtggcaaccaagtcttctgctccctgaattccctcgtctagatctcacacgtcacaagtctcgacgacctatagcttgcttcacggacgcaaacacaggggttgccgacttgccgtgctacgacacttcatgcgtaatttctgtgtgctgatcgatgaaccaactgctgtctccgcgttactctacgcatgcatgcatgtatataaacatgcatatggcgcgcaattgttttcgacgattactatatcgcatgattcttctgcatctcctgaaactagcatgggttctgaggcgcctgaccctgccgttgctgcatccgtgcctctcgtccgcctgaaccacgtctcctttcagtgcacgtcggtggaaaagtccgtcgacttctaccgccgagtgcttggcttcgagctcatcaagcggccggagtccctgaacttcaatggagcttggtgagtaattaattaacctacattacccctgaagcgtccagcacaaaaggaccgatcaagatgtaatctgcaatgcatgcaacttcgtagttagaaatttgaaccagttgtcgagctgcatacacaatgcctgatcatttcagtgtgaaatgctgcttgttacaggctatacaagtacgggatgggaatacatctgctgcagcggggcgacgacgccgacggttgcagcatcccgacaagaccgctgccggcgatcaacccgatgggaaaccacgtttccttccaggtatcagtcgcatgcacgcaggtcgatcagctactgttatgttcgagagcagagttcgtatttgtcttaactcgatttgagcgaatggcagtgctcagacatggcggtcatgaaggcgaggctacgagccatggaccgggagttcgtcgtgaggaaagtgtgggacggggagacggtggtggaccagctcttcttccacgaccccgacggcaatatgatcgaggtctgcaactgcgagaacctccccgtgatacccctcatcgttgcatcgacgcccgggcttcctgagctgctgccgccggcgatgcagaccaatgtccatggctagctcgagctacgttcttatgtctctcctttgtacataaatacatgattaaatttcattcgtttgaattggttcattcgtacgttagttgtaagtattctatttgctgcaccatgcatacacgttagttgtagtaattgattgctgccaagattacattactgcccaatatatatatatatatatatgaacaagttgtttatatataataaagtgttttaagtgttccaagtctccggtgtacgacgtacatgtctcccaagtattttactctgttcgtcccattttaagtgtagccatgattttccgcgcctaattttaacggtccgtcttatttaaaaaaaattaaaaacataagtcacgggtaaagtgctattcatgttgtatcatcacataacaacaacaaaaatactaattataaaaaattttcaaataagacggatgatcaaagttagacacggaaatttatggttgcacttaaaataggacggatggagtaatcctgaacagacttttcccgcctgagaaagcttaaaatcactacagaggcttttgctttgcctttcatgtgaagcgatcatcacaaagtgaaaaggaaaaaaaattactctcgttattttaaaggccatggagtatgcgtatcctctgcttttgctgtgccgaggaaaagtgggttacttctttaagtatgaaatcaccgtcacaccacatggagttataaaaaaacagtcacatacaaagttttgtcagaaatgcaacagtatttatccataccacacgagagcgcgtgctgctcagctctgtcatgcaatgcaacaggccgtgccaacgtccacagcccaatacatttgtgtggtcaattggcccagaacatgtacgagtcgctgaaacccagtgccagaaatagcccttatccacacaagccacacacagccagtggctccaaggcggcacggcacggcagcttagccgcgcgcgcgcaggcgcagcaaacctaaaaaaaccaccaccacccacgcaacacaaacacaagccaagccaaagccaagcgaaacagctgcgcgcagcatggcaaccacggcgtccccgttcctgtccccggccaagctgtcgctcgagcgccggctcccgcgcgcgacgtggacggcgcgacgaagcgtcaggttcccgccggtgcgagcccaagatcagcagcagcaggtgaaagaggaggaggaggaggcggcggtggaaaacctgccgccgccgccgcaggaggaggagcagaggcgggagcggaagacgaggaggcaggggccggcgcagccgctgccggtgcagccgctggcggagagcaagaacatgagccgggagtacggcgggcagtggctgagttgcacgacgcggcacatccgcatctacgccgcgtacatcaacccggagaccaacgccttcgaccagacgcagatggacaagctcaccctcctcctcgaccccaccgacgagttcgtctggaccgacgagacgtgccagaaggtctacgacgagttccaggacctcgtcgatcactacgaggtatactacgcaccgtaactcataggcagaattggcaattgcaaatgcagggtagcagtagtgtacacccatggtctctttctccaggtggaaatgttagttgtaagagcttaattggtagtacctgcttaactgacctggattgaatttacagggcgcggagctgtcagagtacacgcttcgtttgatcggatctgatcttgagcacttcatccgcaaactgctatacgatggggagataaagtacaacatgatgtctagagtcctcaatttcagcatgggcaaaccaaggatcaaattcaacagcagccagatcccagatgtaaaatagaatgcgtgttgtaccctaaagagaaagcatgtaactatcaatgattttcccgttcaaagatgcccaatgtatattttgctcttccagaagagccatgagctagggtatttccgaactcaaatcgggttcatacaaaagcagaacattcacagtcgataataattttgtcgactccaacatggttacataaagagaagctgagcaaactgagggtattaccctgtcgtgaagactaaggaagggtctagcactctagtttcatggcatttccgttctatggtttttgctgagtattagcggtgtgaaaatgtcgatacttcaggtaatccaatcacattgaaataacaccactgctttattgctttatgatggtgagatcaggtagaacatggaatccagccctcaaattcacaggcaaaactcaatgttaaattatttgcaaagaggatgtgcgcatattccaatagggaattatttctcgatcattggcaatatatttatttatctcattccatatagatacgagacaatctctgctgatgacattacgtcacccttaagagagtcattcccgcaaatagatgtttaatgttttggacttgagggtttgaccagctgcaatgtgtaaatctcaatcgatcaaaggaataacctcgtggtctttagaaacatcaacccatggcctgaattgatcttcatgtgcattattctgcaaaagagtgtcatacaattcaaaaattgccaattacaaaactgcatctcaatctttttttagaaaaatgccatcgctgcattaagtactaatgtcatcatgctacttaggtagttgtgttgtactaaactgcagagtacaattccacgcagtaagaaaatagtactattcagtaatgctgcaaataaactgtttacgctgctacttatatcaggctcacctagactgatcttaaaatgaactgtatattgagcagcaaatgaaccatctattccgacttagaaaaaaaacatctataagttatcgaaagaacacatttgctctagcaatagttctatgtggagggactaaaagattttgatggttaggtaagtcttgtgcataagaaagagatggtggcaagtacaaactagaatcatgaaagcaggtaattcctacactgtttatttattaagaaaccaaagcaatattaatgaggttacctgcaaccagaagaaaaacccacgcatcagagctaaaccatttggaaagctagtgtgcataacttggtcaacgagatctaaagttaaataaacaaaaaagacatttgttagtgcaataaccatgtagaactgccaacagatacattatgtaaatcagccagcaatacgctatgctactagtttatagtcaaatttaaaagtggcaatggtgtttataagcaacaacaaagaaagctaagtgatctgttgaagataaaagaaagcttctcaagaaaaataaaactatcactttcttaatatctagttttgatcttggtatggatctctgcatataagctcaaagtttaagcaaaccaattgataagctgacactgtccatacactgccgctggtggttttaaaaaacatcaatcaaagtgctcccatatctgtagatatcttgggcacagaaatactttaatactgagacttggaggttcaacactctagtaaaactaatgcagtggcaattgttcaaaataacatggcatgttttcttctggccttgcactcactttttcctttcggaaccattagtcctacaagcttatttgcaaaattaagtacatcaaaatgttgttctaagatcctatgcctacaactacactccagagattaaaccaacacatcaataagctattttgactgtatactaattggtcatgaatgtaacatcttaagaagaaatttgtaaacttataacaaacagttgaacaaaactaacatcaataagctattttgactgtatactaattggtcatgaatgtaacatcttaagaacaaatttgtaaggttataacaaacaactgaacaaagggttaatttgtaaggttataacaaacaaagggttataacaaactatacttaacttgcaatgtttgagcgagaaaactatgaacacatgtaaccataaattatggtcaacatatattcacaaagtgcaaatggttaacagtctgtaacagaatattaagattatccatggatttaactttacccagttacaatgaccataaatataattctgaggaaaaatgcaatacacaacagaataaccaaagaacaaacaacacatgtaaaacaatatatgtgcacgatacacaggcatacctgggtaatgatcaaagtatgaatttcccatttcctgtgtagggtagaactttacatcattgcgcacctgccgtaattttactaatggtgtacgaatagaagccatgtcaaatagcttaatatattcttttcgactaaatggtttgctgagagcatccaataacctctgcttgaaatctgaatccggtctactgttgatatgtgccggccatataacaccttgtgacccctgcatattataatatttttaagtaataagagaagtgcatcatgtaaacaagaggagaaaaaacccttatagtagattttattgtttgtgagataaatgcaaaattgccagatcaattggagaacaatgaaatactttagcatgtacattacataaccttagtatttgagactaattcttctttgaagagtccatatgggtgttactgttactgttccataattcaagtaggggaaaatttgagaaatatcatcacaaagatatgtgagcctggaccctctcgtgtcaatgacacatccgatggtatttttcaactcagtgatttttgcggtggtaataggcaaattggcccataaagtggaggggatgttcagcgtgaatttgctagagaatagtgttctggttggtacaatacagtatcagcttattcatacatgtccatcaacaggccttttgttgaatcgtactgaaatatcgaagactactatcatcttcttttgcgtatattctattaggcgaaaaacagagaactatttctggactgaaaacgtgtatacgctgctcaattcaaagaaacaacagtgccacaggtaacaacgattggagatgtataaaaaattctcaccggggggatggaagggccggcattattggaattgcttgaactcatcttcctcttcttcttactatctaatgttcgcacggatgcgtcacccaccgccacccagtcgcatacttttgggtccggaagaattaccaccggctcgtctgaatccatggccacctctttctcccgcgcatcctcgacctcgctgctgctctcggaggacgcggcgcacgggtaggtgacgacggcgccgtcaatctcgagcaccatgttgtcgttcaccacgcgcgtgtgcttgaggaagaggcggtagtcctcgtcgatgtcgacgagggagtcgatccaggagggggcaggaggctcggcgtccacctccaccgacgactccttctcctccggcgggcggttggtgctggcgcggccaggggagggatcggagacgcactcgccgtcggtgctgccggtgtcggcgggggcctcgtacttcacgagggaaggaggggagacgccatcggaggggagctcgagggtgtaggagtcgccatcggggcggatgtggcggaggaagtagaggtagtcggggtcgacctggtcggcggggtaatcgccggcggcgaaggggaactgcatggcggggcggcgaaggggtttgggctcgactcgaggcccgccttgggaatttggagggctcctctcatcttgcgcctatggacgctcgcgatttattggtggcgccatatgtgggggtcaatgaatgactgaaatttaatggtttcctgaccgaattcagctatcacgcagtatatttatggaagcattgccctttttttatcttattattatggtacagtgtaatactgtaacttggagtaaaaaatttacggattttttgtggttccagacaggctcgaccgctcgagtggaataaactggaggataagcgggaatcgttttgtgctcaagttcttttagtaacaggaatcgttcgcatacgcaacagtacatcagcaataatgtttgtaatttttccaccggtacaacatgattaaaaatgtctgcatattcaaaatgcaaagttcagaatttgtaatttttcaggtctgctcgtcagttcaaatgtttgttgaaactggtcgatgaagtgtttgcactgcctgaattttggttcgctcgaagttgctacctgtatttttttcagaaagagagaggaaaaccgcgaacaccaagaacaacacgaaaaggccatcttttggtggaaactttaaatttccaacaaacaaatcggacttctatccccgctaaaaaaaaatcggacttctatatccacacaaccaaaagttacatgaatgtttagatttcgactctcactaaaaaaaatattcatgcgttgcaacgggtgaagactattttaatttattattattatattatttagttaagatgaaattcactgtgttaaattcgcttagatatatatttttgttagaaaatcataagctgcaattagatgtccgatcgtctcaaattagtatgtgagtttttaaagtgatttcttatacgatttcttatgtatttctaaaagcgaacgaacttaaaaaccgaaaccggatttgtattttcaaaagcgaacggacttaaaaaccgatttatacacggatgacgtactaaaataccagtaaaatcatcttcaatttttatatcgactcttataaataagaaatgacgatgaaaataagaacagaacttgaagactgagcttcgaatctatgcttcctgatgagtctcgccacatcaaaaacctgcattcagtcagtcttaatacgcagcccaaacttctgcagtccttatttgtgttgcattcgagttttcgatgatattcgaagaggagaaccatctagccctgcagctctagtctcatcgcccctacgactcccctgaaccctcgactccttcccactagctcgccgctgcctgagcacaccgctggagttccacgtgggtgcaaggatggcggcggcggggttcctttcagctctcggcagccctctatggccgcttcttgcgggcgggcaggagcggcggctaggcttcgggcgtggcgtcggcaggtcggctgctccggtgaggacggcgtccggttgaagcggaactcgcgactcactctcctagtggcagagtggcggcaacgctgttggaggtgggcggtgggccggtggcgctggctatggctggtgaagcggtggtgttggctccttctggtggggcggcgcggtggtgatggaagcggcagatggacggcgtcagcgggggagtggcgatggcctcagggtagtaggggacggcaggtggcatgccgctgctaggcagttggcagcgccacggcggattcctctgcgtgtggcctgtccccttcgtcgcgatggtgaagatggcgacgaaggacaaaggtatgctcaccggcagtggtggtcctaggggcagcggcttactggtgtgacctttatgcctagatctagccatgtgattgttaagggcgacagctgaggtgttctggagtcaacggcggtggcctaagcgtcgccgccgtatccttggcaaggagacggcgggattgggtggaggtggtatcgttcgcagcgatgtctagcaaaagcgcctgggagtccgggcggaagacttctccggcggcgacggctgccctaggggtagcgatcgaaccgagacggtggcggcctgagtgccggtgcaaggttcgcagtgaggaggcggatcccgttggcggtggctgccctaggggcggcagatgcctgggagtccgggtggaagagattttcctcaacggcagctgcagaggtctccgacgacggcccttggggcggcgacgagctgggagtccaggaggtggaggaggatcccgaagacggtggcggccctaggggcggcagaggcctaggaattcagcgaagcggaaatggatcttgccggcccgcatttggttggcttgttttggctgggacgacggatgaaagtgggctaaaccaggcgacgtttggcatcaactcatatgaagcgaatgaagatggcatcaacggaggctcgcaacgatgatgcactaggagcgttgacgactagacaacttccactcgccgaatctcgttgttttaggagatgatgtcggaaagcaaggatgtgtcagggtagttggtttttccttttcttttagttttgtgttctctcttgagatgtgagtctaagtgctcttgtatatttttagctgtgtatatccttcgtgaatatagaggccggattaatgaaaattcattatctaaaaaattggtgttgcattcacctctaacagactcctttgcactacttctaccttcagccaaatctattcaatcctgatccggcggcttccggtccctagtgccttagctcaccgacggtatccagtgaaagcagagaagtccttccaacgcaacttgccactttccgaatgagctcaaacaaaacacaccagatcaagcaacacttagacccgaaatctagtatcgcgtcccagccatcgatcgtagtggcaaccaaaccgtattctagtatatatgcttattgcaaacagatcaccccggaaaaatggtaaccgtgatgatgctgtcaagttggtgcgtcaaaggctacctatagcaatcaggggccattacgatggcttgattgacttctttagactgatgtaattaagcaggccagctagcttccaattagtctagttgtccattgtttccatttgtatcctttggtcccatttgtactgcttttacagttttatagtagtccatatatagatgaatttacttatggcgagagcatctccatggtttaaagaagagcttgtataatcacggagcgttgccacaggaaagatcaagcctactccatctatcccataaaaaactaacatagtaatggatgtgatattttctagtaatgtcatctccaacattatgttggttttttaagacggaaggagtacacttgagtaatataggatgataatggatccaatattttagcatataaaatgtaaggggataggtttaaaaaaatgctatagtgagattcaatagacttttgagctaaaaatatttaagagttgagataggtgtcccgtgttaaagaacccatggacatggtccctgtcccgttaccacccaacatgagacgaatgattgggccggaacgggattgtgagcatcgtgcggtccatataggaaagtttatattggttgggcctgttcgagctgtactagttgggccggaatagtatcgtgagctacgcgcggcctataatggtatcacaccgacgtcgagcacgcagcatggctctcaggctccgaaagggctaatcggcggtcactcacgcgcgccctcccgtgcgcgactggacacgtgtcgcgcgcggagagggggcgcggacggcacgcgcagggagactatcgatttttccggttttttttctgtttctgtttggttttttccggttttctttcggtttctctttttttttgtgtttttaaagatatatgtttgcaaagtttatattcgtatgtatactaaattttgtattcgcacgtatacaaagtttgtattcgtgatttttttctctcgggttttaatatgtacatatacaaagtttgtaccgttttttttttgacaaattagtccttttgaaaacttattttgaaactaaccctcgtaaaaaacttcaaccaaaaataggtcgtgggctcaacgccaatgttaatggcgctaaggtccaagggatcagcgccacattcgttggcgttgaacccgtggccacgtggatccgaagccgttctgcattctgacgtggcgcgaggtcagcgctaactctattggcgctgaactcataacccagcgctaactctaaacaatcatcaatgctaatgtagcgcggtggtgtgccctctgtgcatgcaagcaagaggtagcaggttcgactagtttaccgtacttttgtcctgctagcaaatctttttttttgttcttttcttccggcacttcccctacattccgaaataatactgtaagaaaaaggagataataatatgagaaaaaagaacggaagtatactaatataaggcgtgcatgcatacatatcattaattagcacctctttttcactaaaatattattatttaaatcatccaccattaagatatctaattttattgggtgcatacattttatttattaggataatctaaactatgatatgataacaattatttcttggtatttgaattaagggtggttgtgacttatattttggaatgaagggagtatatatttgaatgtaccattggagtatatatgttagaaatagtaacgtgggaaaaaatgatggaagtattatatttatttttgaagtattggtccagaagaaaaggacggtaagaagtatactacatatttgaaggtaccattggagtatatatgtcggaaatagtaacgtgggaagaaagataatggaagtattatatttatttttgaagtatatcggtccggaagaaaaggacggtaaaaaagaagaagtatactacatatttgaatgtaccattggagtatatatgtcggaaatagtaacgtgggaagaaagataatggaagtattatatttatttttgaagtatatcggtccggaagaaaatgacggtaaaaaagttgcaataaaaatagataatttatgctgctcaagggagtcaaacttgttacctcaagcttgcatgcacagaggccacaccaccatgctacaatagagttggcgttgacctcatgccacatcgacaaatagatcagcttcggatccacgtggccacgggttcagcgccaacggatgtggcgttgaccctttggacctcagcgccattgacattggtgttgagctcatgatctatttttggttgaagttttttgcgagggttagtttcaaaataagtttttcaaaaggactatttgtcaaaaaaaaacggaagtttatatacacgtatgtaaagtttgtatatgcgtatgcaaagtttatatacgtgtatattttttatacgtcaatttgttgatacataaaaaaattatatatatgtatgtatatattttacatacatacatagaaattttatattgatacataaaaatacaaagtttctatgtgtatatataaaatatatacatacgtatatatacatgtagtagtactgttatagtaatagactaatagtagtagtgctagtagactagtagtagtactaatggactagtagtaggagcctgatcgcgcaggggttagggcgcgcgaccagtgggcctgtgggcggtgtccatggccgccggccaatctttgcacaaaccgtgacttcatgagggagatcgctatgttatggattcttcaggatcagcaccactagctctcgacatcatcaggcgcgggtcgcgcatgcagctcgtgctcgcccatctgccgtgtgccggcgagtagctagctagctagctgcctggctagctgggcagggtcgccgaaccttggaattggatctagctagctaccgctcaattggcagctatgagcttgtgattgtgtaaagacgatgtttcgtttttattttatttctggtcatttattccatgtgtacgatcgaggcgcgagtattttcgtgtaccaagtgatacacaaacagcgccgtacgtgttgacaacagctttaagctttttacagatccagctattgtacgtgtgacgtgtctcctcagtcatcagatcggcatgtagagcgcggtcgatcgagatcgtacgcagcttagagatggcttagccgcggcaccggtacggcggacagccgcactgctcgcggcgcggtgagcccatatgtctcctccatgtcgagctcgccggccgaccccgtcccgccgggcaagctccagtcgaagccgtggagcagcctggccagtgctagctccaccgcgagcatccccagctgcatgcccgggacacctcccgcaagctccagtcgaagccggagagtgattttcatcgacatgccgaacacgagctcgccgacgttgaccaccgcgccgctgttcttggtcacctcccgcaggaggctatcgaccccgtcgtggacagctgcccacgacgcggcccggcgccggttgaagagcctgttgatgcacagcttccgcagctggcgccacaagggcccgtagcaggggcggatccaacgtgggtgcaagaagtcccccctacacctacaaaactcatggatacccccttcaatttttttttgccaagattggtaaaataggatgtgttaatagcattttagcatagtttaatattgagatgatgtgtttataccgatgtactcgatatgtttagtcccccaactttttatttctggatctgtctctggcccgtagggggcgaacaccatgtcggcgcggtcgtatgtgaggtagtcgatggccgcggtggtcgggcggtcggcgaaggcgcggtcgtttacatggaggaccagccgggccatctctggcgtcgacacgaccacggtgcggaggcggccgaggcggaggtggaggaggccgccgtagcgcgaggcgagctgagccaggccacggtgggtcatgtcgctggtatgcaggatgttgccaacgaacggcagaccccgcggccccggcgggagcgggaggcatcgctcgccacagtgccatgacgagaccgtgtgatagaggagaagcattgttggtaggagcacaaggagaggctgccatgttggaagccaccagctctccattactgattgttatttgctagctagctctttgcctttctcgtgcctagatggattgatcctcgtccgaatgagaacgaagacagatggggagacgagagaagatgaaacagtggcctcgttggtcttacggaggatggatttccatggagcaattgagtgttcattcaagccgccaccaccctaggcgtctccctcctctactgcagcagctgcaacccaccctgaatagatacagaagagaagagaggatatttcgaggagacacatagcgaatgtgcatgaaggagctgaatgcaaatttgcatccaaggtgaacatccatgtgggaaacgtacaatggacctaccatgatacatcaaaaccaagtccaagatatacgatttacaagatcgtggacaaagtgatatcacgttgcaactttaaggaatggtgatgtaatttactttacatgaaagtatgtgtgtacatcatgtaggagaagtcccatatcacgtatctttatgtatctgagatatcccatatctaatataccaacatataaataggtagatgcatatgtcaggtgtatgcatgcatagcttgtatggacaaagaaatggattataaagcccccaactagagcatctgttgtttattgtatgcggtccacaacgttataaaagatattaaaaatgaataaatttatcctatgacaaattctttcacaaacaagcaatgttaccgacatatagaggaatatataaagaagaaaatcaactgtaaataaatatttttcttcatatgtccacgtaaatttaatcctatatttcttcatactttattactactttaggataacttatattgcctatgtttttttatatatatttcttatctgttttgacgagcgtcatcgccagaaaaaaaaaaagaattgttttcacatggatagcgtggttatgaacttcgatatataggtgtcgtctctgtcggaactcgggagagctctacgttggcctacttcctcgtttatcggaagaactctgttagtctggttgatcaagcgcactgtgtactgatgtttctaggcatgtttgtaagtggttatcacaataattgttcctttctccaaatctccgaaacgatcacatgagatattgagatgctttcagagtaaaatggcactgcaagttacctcccagaacaagtaatataccttgttagtttttttaataatagaaagaatttacatctaagctacagctcctgcctatccctgtggtaagacatataataaccgataaatttgttttattcaaataaggtgataagataaaatccctaacattcattgagttttctagacaataattctactgaatactatgttattgagtttagaccctgtacacacagtaatctgttgtaatgtttgaacctcctaattaaattttgctgggcgccccctgaattttgtttcgcacgaggcaggagtagctgccacctgaattaaaaaaccttcaagaacagtttgttgcaatgggaaatatagtgcgaggtcagcctatatagcacaattcaacggaaggataagctcaattgcagcaaaattaatctgaaagcaatgggacccctccaaatgcaaacacttcgactggctgttgctgcaaaataggatttggacagcagatcagctacatatatatcagataatggtcaaataactattcctgtcaactatgctataggaacctagaaacatctcaacgtctcttcaaggattatccctttgtacggtaggctagggaagctgaactgcaatgaaattgacctgacacatgatgaaaatgaatcactattgaactggtggatcatgagaacaactcaaggtgggaaagacaaagccaaagcaaaaaaatcaatccacatgctggtagaatgggagatatggtgcgagcggaactgaaaagtatttcgaaatcaagaaaaaaagccctgctgcagctactagacaaattcatgacgaagtcaagctatggagaatatgtggagaaacaaacattgcgagattatcggtataatagtacttttgatcgattatattaatagttttcctctctcttctttttcctcctctctttctttttcttttcttttacttttcttttcattctatccttcaccgttagtgattatgtaagtagtttctccctctacttatgctggctcggttttttttttaaaaaaagaaagatattgagtggcttaaagtggcataaatctccaacagtaagcacgttgtcgttttattcttttagataatggaagttgtcgttttctataatgatcaccctaaataaatctcttgcatcagatgatgattccctagaaaattaacttgccggctggtatgccgtgtggactgctatcctgccaactcgcttgcactgtgtcatcatgtatcggaacttgcacacggctgttcatgcatgcgaacttgcgtatgaagctgtggcgcatgtgcgacagtgacgtatgatctaatttatatattttaaaatattcgaaatataacaagattaaagtataaattaaataaatatctctactatttaaaaaaataagaggggcttccatcgtccgtcaaaaaaccgggcgaaaaaaaccaagtttgtctgatcaaaaaataaccgggcaaaaaaagtgcgaaaaaaaaccaaatatgtccgatccagaaaaaaaggcaaaaaaaccgggctagaaaaccaaaattgtccgataaaaaaaacgggcgaacaaaaacgtgggaaaaaaagaaaagaaaaaacaaaatagcgataaaaaaaagtccaactcggtcccgtaaaaaaatagagataaaaataaaaaaaagtccgactcctcgttgcgattccctctcataagaaaaaaaaagttatctgagtcccactcctctcggtttgagtccgagatactaggcaacacttttcttggtttcaatctataccgtgatattccatacatcttggtgaaaaaaattgatgtgctagattgaagatctgtttgtaaaaacggaacctacatgtcgataacattctatttttatatgatttcaatatttggggttgtacatttgcatttgagtccctataatttttatatttacatttgagtacctataatcttgcaataagatgcttttggtctttttaaaaaaaaaataaataaaagggatataacaaaggcagaaaggtgcataaaaagaaaaagaaaagccacacaaaaaagaaaaaaaacaaaaaaacaacaacaacaaaagtctatttcccctaagtggcgaaaaaaactgtagatgcaaacggaaaaaaaatccgattcctataaaaggcaaaaaaaaaagtggtgaaaaaaaacgctagatctcattcctttaaaaacagaaaaaaaaagtctaattcctgtaaaggcgaaaaaaatccgaaaaaaaattcgtctgattccctaagaaagtggcaaaaaaatggttcataaaaaataaaaagctagttcatataaaataaaaaatgcacgcgagaaaaaaaatagaaagggcgaaacaaagtccaatttctaatcagtataaatctcgtctctatctctaatctaatctaactatttaaaaataaaaaatgcacgagaaaataaaaatggtcaaaaaacgtgtgagaaaaaaagtcagaaaaaagcgcaaaaaaacatgatgaaaaggtttttccgtcttcttaaaaaaataaaaaaacgcgtaagaaaaattatttccattgtcggcaaaaactttttaaaacaacatgcgaggaaaagactgtctgaaaaaatgcgccatttctaaaaaaatggtttgaaaaaaccacggaagaaaaaaacactatctatataaaaaaatcactctgaaaaataggatccattgattttttttaccatctactacacggcttttatttcgtcatatattatcatgtattggaaaaaagcaaaaaaatgacattcagaaaaaacaggcaaaaaaaccacgcgagaaagtatttgtcagaaaaaataggcaaaaaaacacgcgagaaaagcaaaacaaaaaaggggagaaaaatatggttttcgtcattagtaaaaaaaaggaaaaaaacatgctagaaaaaaactgttagaaagaaatgcgctatttgtaaaaaaatggtttgagaaaatcgcgcaagaaaaaacaccgtttataaaaaaaagccgctcattaaaatacaaacattgtcattgacatgattatgcatgaaaaacttatattatcattagatttttttcacccgttgcaacgcacaggcatttttgctagtatattataatattgaagtataaattgatcgagtatgcatcataaaacttctctcaagctctcctgccacgcatgctggaagtagaggaggagcaggggagaggggaacgatgggaggtggaaggagcataggcatttttttttctagcttccctctcacttagatgtgaactccatatattttcttgatgactggacggtcatgtggatgtcgcgtcaataaaaactgttcttagaacagttgagtaagtcgttttgcatggttgtagtagttggaggagttagtatatccggttttgccgttgagtaatacaaaatagatgcaacttatattaagggagttatattggacttttctcctttgtgagcaatattgttaggaaggattgcaattgggccctttacataacctacataactggcccataaatagcccaagtccaaaagttctcctctcttaagtatagcagccttgacacagaatattttgtgttgctttcttgattctcattccaggatgagtggtactccctccgttttatattataagattttctagcattacccatattcatatagatgttaacgaatctagacagtattaatatgagcaatgctagaaaatcttataatttgaaacaaaatgagtactttgatttataccaatgaaattcgttgccaatggtgggcttttgcattgaccagcctataacaaagctggtccagcatctcaacgcaattgtgacgcatgaatcgtccaaggaaagtctgcactgggccaaaataattcagacatttcagtggcaccgccagctttgtcttgagctcgatcgaggagcatggtttcagcttgaccttttatcgcgtaatttaactcatgtcaccttgacgatgttctttaccacggctttctcacagtctgattgcttactgcaggtagtacgtgctcacttcgcaacggcgacatcctctttgcttgatgtgaaaggcaagtcaaatggaaggatcgattttgatggcatcgatcgcccataaaactcccactctagcgagcgcaccaccaggagcggagctagagcgaaacagagggtggtgccacttgcttaatttactctactttagattgagtttaagctgatacgagtgtctaagtttgtattgaggggagtgcatacatggtgaaaatagatgatgtatagctaaaagattttcttgaccgggttcctaggcacccccctactatatactagctccgcccctgcgcaccaccaccgcaaaaaggaagctacggaagaacagccaccactgtatacatccccatccccgtccttcctccttcgacgtaacaaggccatgatttgtcctgcaactgcaagcaacgagaccaaaagcggccggaatagctgggtggaaaaaggccgattttcttttttggtgtcgaactgatgtgcgtgattcaacaatcgccgtcgagtggcaaaagcacagtgcatgccaacgacgccacgcccgcgtcctgtgtctaatgcgctgatacgcgccatgcatcccttggcgacttggcgcctttctttcttttgctagagaaaaatctcttgcgatctgcatatctggcagcaatccagaaataataatgatgatattaaacggtataaaaatgtctataggtaaggtgcgtctgcgtgcacatgactgcgtccgtattttgcatcatgcctgtggaaatttaggaggtcgtcattctcggcactgatcacaacagctataagatcaaggttgttttcgcacggcgatgtcaaagctgcaaaatcagcctgtacgaaaaattgcgaaatcaacaattgaccacacacatctctgtagcatatcgcatcgccacaccggcaggcacaacgccttcagcgcagtaggaaagggacgtgagcatggtaagtggatatgtacgcatcaatttggcacctaagctccccggcctactactggtaactggtaagtggtaaccggttgcacctcacacggctcgacagcgaaaagattcaaaagcctaataagatcggtgccgactggatctttgacagccacgaacactactcgattgtgcccacgcaccgcagcccaccgcaaaggcccaaaccgaacggcctcgcgcggcgcgacgtcgcgtgctctcggcgcggcggtggcccgcgtggggcgccgcctccgacccgccgcgccattcctgtgagttccccatacggccataccccatacgcggtgaagggaacaccgaacacgtcaactcggagcccatgcatgcggacgcagatgcgtaggccctcgacgcctttaaagtttttaagcaaatctatggatatccaccgtcaatcacgtggtgggagccgtctagatgcatcgtctcttatcttagtttggcccgtcgaatctgacatcccgatgagtttgagctttcatcttcacaacatttgtcatccatgatgttttggctatcgttccggttggccagtttactctgctgccgggattgtattgacgatctcgaatatttatctgcatggttgtctggtcagtttcatcgtgcccctatgctgattttttttgtcgagtttgtcatcgagaattttcctgtccacggaaggacagaaaactcggcatcagattaccctcctgaagattgatcctgtatttttgtctacgccttctgaaactgacgacgaatttaatttctggaacgcactgttttgttgccaaatcgtggtcattcggttaacagttagcatcgtgtcagcgttgaagaacataatggaatacttgcaatcttgcacacagaagtttaacgcgcggggatagctacggaaaattcgcgagtagaacgaacatggagccaggtactgtattaagtagcccaaaaacctcgtgagaggcatctgttttgacgtacaaggaaagtatgaaccgacagccatacttacggccgcagtagtagatgtacacgtactgcgcgtacgtacgaccctgcctcttcactattcacgccatcgtttttattccacggccgtgcgctgctgatttacctcgcgacgagggcaactctgagctgagagacgactattattattactcctactactccgtggtccacggtccatagggccagctccagcccaaacccacaccgccgcgcggccgtcctctctgcgcctttaaaactgctttacgtcgggcggtgagccggcccaagacccggtccacctctcgcagcccgagcccacctgccgccaccgccgcgcagcgcgtgtccgtacccaaccaatccagtcacgccacgtattatccgtgacgcgtccagccggccgccaggtcggatgacgactcggcggcaggtacgcctcgcggaccgcgcccgttcggctgacacgcgggccgctgctgctcagatgcgttgcgtgttgaggcgacgtgctgggtccgggccacccacgtcggcttttttaactttgcccgcgccgcgagagaaggcatcgtcgtcgcgcccaaattgtctaaactgccccgctcggctcgtggcaccgcgcgcgaacggtggcccggttgggcgacccgagagccgatgcggtgtacccgccgctcggatgtatttttttttcctttcgtcaggaagggtattccggtaacttcgtgtgacaatggaaacgattagtcaattttggcgattcccgcgacccgctccagcatacgggcgtccgacgaagaagccacgcgacgcgagtgccgccgcggcaacgcgtggaagccgggccggcgaaggagggaaacatttgaactgtgctaatctctctaataatggctgcgaatttctactcaatactattctcatttacgctaacgtggtatttgaatcttctaaaaataaaagattaagtatttcacgtaaaacaagatgataataacttgtgattaattgagttttaattattataaacttgaaaaatatattaatttgaattttacaataactttcatatagaaatatttaacacaaaacgaaccgtttagcagtttaaaaagcatccaattaaaatcttaatcttcatccaacttttattgaagaaaagtatcagacctactctctctgtcccaaaaaagacaaaccctggtttccgtgtccaacatttgaccgtccgtcttatttaaaaaaattatgaaaaaaaataaaaagacaagtcacccacaaagtattaatcttgttttatcatctaacaataataaaaatatgaattataaaaaaaattatataagacggacaatcaaagttagacacagaaaactagagttcgttttttttttttttttttgacggagagagactttagcagactgttcggcaacatggttcggtcgctttcgatgttccctaaaacgatggatgaaattaaaacccaatactcgggctgcctgtaaggccgggatgcttcatctgaatgtaactttttgtttggtttacacaaagaggaaaatatgccgtcagtttcgtcacaacaaatggatttggaaaatcgccgaaataatatttgatatgttatacaaacaacccttttatgcgaagaatacaaacatccttttgtgggcatgcttgtttgaattacgacttcgaagtcgatctccaattttaaattatacagtaattttattattattgtttacttagcattagtattttaaccgttagtacaaaagtcttacattataactacttttcaataaaattttactataaaatataatcactttacgatttaagcagtatgacaccacacatatggaaacactctaagaacgtaaagaaaatactattaggcaacacccctataaatttaatatttttgggtagataatggggagaggaggcaaatgtgtgtatcagtgtatagaaatattgcactggagttacggtgggttatgggaatgaaaaatggcttcggaagttcagccttaacgaggggtttttgatttccagttggagcattggaggatgagcttaggttaagtttcccttagcaactagagaggaggcagaaggggatgacaaggcagaggagccatacgagagatgtcttgggtggctaagcgtcaactagtaaaacgacgaggacagcttgaggtgagcaggatcatcgaggaacgatatgaattcagctagtcaatgtgttggtggtggcgtgacggaatgacgcatgcaaagtgcctgaccaatgatctagagtgttttaaggtggcgatgggtcgatggcgaggccaacatttataggcgacgagggttaaaacacgggtcctatataagcgacgaggatgatggcgacgccgatagcatggaagcaatgctcaaggtgaactcttggccacggatagtcaattggcttggcatcggtgacagtgtacggtgggtcgatgtccgagttggtctaagtggaaaacacaaaggacatttacattcttttttcatgtgcgcatgtgccccttctctcgtcctctacttgaaaacattaattaaattaacgtgagcgatgtctaccatgaaattatcatgttttcaaaaatatgtttaattttgcaatatcatacaaccaaaaacatttatggcgttatatagcagttttttctttacgcagatcatgtgtttttggcttttaactgttggctcaaaacttccttcccaacatgcacattgtgtacttgttagttagaaaaatgcaaatcctatatttctatgtagggtgaaatggattggatattatccgatccgatccgctctgaaacgagtatatggtatgtgttctagaaatttagcggatgcatattatccgatatttctattgaattatccgataggccgtttgttgaataatactaagatttcttagtcagatactttcaccgtctatctcacacttatttagatgtatttctatattacacatatcatgtattcatgttgttagcacttaattacacaattattattatgatgggtcgtttattgattattgcatcgttgactttgcattgctaactcaatcgtttattacttgcatacacatataacatccgataaatttaatctatttctgatccatgtctgcgccgatcctgcactattttcgacagccgaaacaatccatatccgctcactatccatatctgcctcgaatccgtttaacaaatatgtttaggatatggtatgatcaccatacataatccatttcgttttcacccctatttttatggagacaatttgctgtgttcgcagaatactactattaaagcagccgattaatgtttgaatggtttttccaagccaatctgtaaatgcatataggtatttttagaaggatggacgtatatatacattgattaataccaaatcctcagcacatgaataattgaatacagcaacagagccctggcaaagattgaactggaagcaaacccacccatcccgagcaaaatccaatttgaacctttccacaatccgcactcacatttcaaaaaagacgccatttatgatttacctccaaaagaagagaggcatcagtgcctcctggccccaccaagtgtcccccccggccactaatccctcgcttacttttacccaaaccccatccgttcaatcgtccggcccagcccacccccgtcacgcacactaatcgcgaggcggcccggcgaggcggggcggggtagaccggaaacacgcaaacgctcccgcgcgcggcgcccaaagtctggctgtctgggggtggctacggttaccaccactgccccatttcacatttcacccctctcttttggcttcttcgaaaagagggcgtatacaaaaagggagagtgatatcagacagatgagattacgaagtggcaagataggatttaaaaaaggctaaaaaacaacttaaaaaatcaaagatagaaagcagtaagcaccaagggcagaaaaagaaaagaagaaaagaggaaagatttggaagggagggaaaaggaattggggaggagtaaaatgggagaaaggtgagggtcgaggggaaactggcgcatttgttgtgggcacggactttggcagccattcaatgctccaccaaacgctcatcccttcttccaccctttccttcccctcctccgccccccctctcgcctcctctcctcttcgcctcaaaagccgccgccaccgccgcccagggttccaacacctcccgctcctcctcagccatgccgtcctacgcgcaccaccacagttctctggtaaggaagggagcgttagcctcaggagacgataagaaaacgactcttttataattctttgatgggattttttatgggaagggggatgacgaggaggagaacgggcgtttcttgagcctgtgtttgcttggtttctggaattttgggaatttatggtttttgctgtgtgtgtatgtgggtgccttttggacggagaaggatgggaagatggacgcgctgaaaagtagttgccggtcggaggaggcggccgacgagggggcggccgcggcgccgtcggcgtgggggatggttgagagggacgggttctccgtcgaggacctgctcgacctcgaggagttctgcgaggcggaaaaggacgccgccgaggagaacgagcaggcgctggccctcgtcgccgcgccagaggaggaaaagtcgaaggacgactcccagccgtcgtccgtcgtaacgtacgagcttgtggcgcccccgccgccgcctccggagattgttgacctgccggtgaggtttctcgagactctcgttgaccgtgcctttcggcggaaaggctgcggctttcgcgatggttgtcttttttttccccctgtaattaatttcttgctgtgctgtatggtttctctgcaggcgcatgacgtcgaggagctagagtgggtgtcgcgtatcatggacgactccctttccgagttgcccccgccgccgcagcctcctgcgtccgtcgtggcgtcgctggccgcgcggccgccgcagcctcggcagctgcagcggcggcctcaggacggagcttaccgcgcgctgccacccgcgtcctatccggtgcggactccgaccatctgcgcgctgtcaacggaggcgctggtgccggtgaaggcgaaacgcagcaagcgctctcgggccacggcgtggtctctctcgggggcaccgcctttctcggactccacgtcatcctcgtccacaaccaccacctcctcgtgctcctcgtcggcttcgttctcgtcgttctcgccgctcctcaagtttgagtggcacccgctcggcggcacgtcggacctcccggacgatcaccttctgccgccggggaagaagtccaagcacggtaagaacggcaagaacaagcctaagaagcgtggccgcaagccgaagcagctcccaccacatccctcgggcgcggcggcgtcggcccccgcgccgggcgaccggcgctgtagccactgcggcgtgcagaagaccccgcagtggcgcgcggggccggagggcgccaagacgctctgcaacgcgtgcggcgtccgctacaagtccggccggctcctccccgagtaccgcccggcgtgcagccccaccttcgtgagcgccatccactccaactcccaccgcaaggtgctcgagatgaggcgcaagaaggaggtcggctccggactcctcaccgccgccgccgccgcagcgcccgccgtggcgtcgttctagctaaagcaagctagccaccccgcgcgcccccgcggtggctgtacatttttccagccgtattagtcctgtaccgtacctggatttttttcccctttcttttccagtattatcttagttccggttggattaattagagttaggtgcctttaggtcatgttaggtctaggaattcagctttccggtgctccagctcaaaagcttttactatagtttgttagggcactgctgctgtagcagcagtgcagccgcggcagcgctagcgcagaacttcatttccattctagcttacccgaaggagttttttttttctctgaggtagtacctgcatatgcttggttcatcaatgccggtgtgattatttctgaggcaaaaggaagaagaaaccaagaaccaaagcgccctttgcatggcgagaaggggaggaagacgaaagcaaaccgatcgccttgttttattccccaaggccaggagagaagagtgcagcacagcacagcagcagtgtgagcgatgacaggttggtgtgtgttgcgtgcacccttggttacatcgcgtgatggtgtcaactgtaacagcatgatatgcttagggggtgattagatggggctaaaacttgttagtctatgtcacatcggatgtttgacgttaatttagagtattaaacatagactaatttaaaaattaatttcataaatgagagcttatctgtgaggcgaattttttaagcctaattaatccataattattaaaagtttactatagcatcatattgtcaaagtcatgttgtaattagacttaaaagatttgtctcgcgaattagtctaaacttatgaaatgggttttgtaattagtggatgtttaatattttaaattagtgtttaaatatctgaggtgaataagtccctgaaaaccaaacagccccttagttaggaggatgagggttgagatagcgaggggtagaagcaatcggcatcagatatagatggagatgttgcatgtttgcagaagtttgtagtactcctgtgattgagatgaggcaggaatgaaactgggaggtagggtcctttgcaagttaatccaagtctagtcttgctgatgcaagtgtgtcctcccactctgccttggtggtgggctctctgtacctggaacagaactgtttgaaaaatggaacatctactgtacacctctacacctcttggggctctccttgcctttgctcaggtacatggcctcgcgtgcgttcccagtagtgtttgtttacgcacaagctttggtgcagcagctgcagcggtagcagtgctcgctcagaacctgagacactggcttctcgtgatcaagcgctactgctagtaccgtgctagacgaagatgatggcatgggagttttgacgggcgcgcggggcgagattttttttgtttgcaccgttgtttttgtggaagtgcagggtggtggtggtgactcactcgtttggacccagctgcattttccgacctaaccagagcggtaatggcgatggtggtggtggtggtggggcaccgagaagatatgtggtggtgaccggccgtggtgaccgcgacgcgccttttcttctactgccgcctcctctgctgccggctgcctcgctgccttgcccggcctgcgcgcgcagccgcgctccacgcacgcacgcgtggctcccacttccactcccacactaaacccgtgtcttgtcttaagcaaccacgcaattgttttcgttttgttccgcgccttcgtctcccctcccctccccactccccagcttggattctttgctcctcctcctttcagttccggctgatcgtacgggctaactttcctgctccgttttcgctgatgttctgttcccaactgactgcgtatctttgcttctcgagctgtctacgaaacaggcagggcaagcgtgatgagtgccttcacgaggacggggattgcgctgtctgagagataaccactacgccaccagaaaacctgtgtcgctcaccggttgatgacaggagatttctgtagccgtgcgtcggggttcagtttaagcagccggagtgcccgggaatttcgttccgaggcagcttgttttcggtttggggggtttttggacggatcgtgggcaagtcagactcgggccggcgcggataaggcagaagacgacggatcgaataatgcagctaagacgcaccgaatccatcccgctgtgagcctgtgactctattcttcctagttttttctttcttgtatcttaaacaaatttcactctcacagttcgtcacgtgagcccgacgggccccgcagcgtcggcgcgtccgggtctttgctcataaaaaacccctcaagttccctccacgatcctgcatttgaacatccgttaccgtaggcatgtgttggatgcgtagtaaggtagtaagggtcacagactatgatgaggacgtctgctctactctctccgtcttaaaatataagtatttttaacttcgatacagtcttcgatatgctattttgatcaataatatatataaaaataagatattttaaataaaaagagttttcatattataatagtttgtttaagataaatctaataacatcaattttatatgattgatcttttttttctataaatagttaaagtaaaaaagtatcacttgacactatgctaatattgcttatattttgggatggaggaagtgtattctcgccaagatagcatggaccgtttagattagtcttttccaaaacataacaattttaaaattaattataccgggttggacttggaatttagcattttattagtgtattccaaattcgaaattagtttactagaaagctgtaattgaagtaaagtatattcttattttaatttatgcgctataatttactagaaaattagtttactggaaaatttcaatatttataaaatcaataacagtagtctgtgcaactgcaacatatgggttagtaaccagtgccttatccatttgtgcttataatttcatcggttcttctcttgttgaattggcccttttatggatattatggatacacagacaagatgattgatgaacgatttaccctagcagttcgagacttcgagggcaatcttagtgtcccggtgaggttaagcctctaggtttaggagcggtatctggcactgtgtagcattgctaatgaggtgagacggtggcttgggtagtgaaaatgaatgaaatcgttaatcaggtgacatatgtgaggtcaagtgttcaactgttcggagtcggtgttaggcaatataattgtaactcctttgttcgtatagcgtatagcgacggtcggtccggtcctagttccttcgtcggttgtttgtttaggtgatgttggtgtgtagtggttctttttcctgactttagggcccctttgaatcacagggttgaaaaaatagaggaataggaaaaacacaggattctaataggaattgaagtataaaacaaaggattgcaaaacacaggaaaaacacaggaatagtcgtttgattggagcgcaggaaaaacgcaggaatcggatcagagagatagactcaaaggaaatttcccaagaggttagatgtaacatcttgaaaattcctaataataaaaatcactaaaatttcgaactttttaaaacttttgcatcatgctgggtgttatggttgtcattgcttgccaaatataaattgtaacaatggagaatcaaattaatggcgtacacctgaacaataaatatatgatacaagaatacattagtgcacaagaaagcaagccaaataaaatattaatttctattataaatcatagatcaaatattaaatattcgaaccatgttgatagctcgatgtcaggtttaactaatgagattgtaagattaaatctaatgtatgtggatccaatctcacatgaagtattataaattcacatgaaatgatgattaccactataatgatcctattaacaaatgagaatttcatgggaatatatatacattaatatttgaacacttgataaagtcactcatataaaataatggtcatataattaaattaagctttataaaattatgtgagtttttaattaaacaattagattaatattgtgccgagtctcaatttactatttagagaataaatagattgaacccatccgtgtaaaatatattgctatacaactaaactcgaccaatctgctaatgtattaatcatgacaagtcgttatattaaattcaatattacctcaaagttttcaaaaatatataagttcaccttagggtcaataacccaaattaatctaaaaagaattcatttatgcgataaataaataaatatgggtggtaataattttggataaattttcatgaggatttagtacttaaatttagttaacatttaactaagtaaaattagagtttataggattaaaattgtataggagataggctaaaatggggtttaattagggatagcactattcattgcacatgaggtgtttgatggagttcctagccaccctagccctcttcctccccactgccgcacctagccctgctgcgccgctgccttgcgccccgcgcgccatcgctatcgccgtcaccgcgcgccgcgcgccgtcatcgtcacgttgccgcaccctcgagccccgcgccccgtcgctgccgcgccgctcgcttgtcgccgtcggcctcgcgccccgagccgccgcgcgccccttccctccgcgcgtgctgtcgccgtcgccccgcgtcgcgccccgtgccgcgccgcctcgcgccccgcgcccctgccgcgccgcgcgcgtcgctgtcgcccgtcgccgtcgcctatctccgcgccgcttgtgtcgccgtcggctgtgccgcgccgagcccagcgccgcgccgagccccgtgccgctgccgcgccatcgcgtcactaccgtcgccattagcgcctcgagccccgcccgcgccgcgcactgtcgccgtcgtgcccgccgtcccgtcgccgcgcgttgccatcgccccgagccccacgacgccgcgccatcccgtcaccgtttaaagc

SEQ ID NO: 58716 - DNA, 45062 bp, Oryza sativa
tgcattgcactgtaaacaagcaggcgggcggtgtcagagctaaaaaatccttcggttggtctaaagatatggatattttatattatggtgtgttattattataagtaataatctcataattcattaaatgctgtaggtgagaggcaaacaatgtgggttgctcctagtcatgacaacgatactctttttgtgggcaatatctgcaagacatggactaaagaacatgtaagatgctgaaacagtttttcttttttcctattctgttgttacctgaataataacttatttgggcatgtacagctgaaggagaaactcaagagttacggtgttgagaattttgatgatctactattagttgaggacagcaataatccaggaatgaatcgtgggtatgctttacttgagttttctactcgccctgaagcaatggatgcttttaggcgattgcagaagagggatgtagtttttggagttgatcgtagtgcaaaggtttcctttgctgattcctaccccgaagttgacgatgaaataatggcacaggtaaccacttattttggtgcttttgtttgttgatgttgcaaatttgattaaatctgttgaatccttattctggttctttggttcaggttagaactgtatttattgatggccttcctccctcatgggatgaagatcgtgtcaagaagtaccttaaaaaatatggagctattgagaaagttgaactagcccgaaatatgccagcagccaagagaaaggattttgggtttgttacttttgatacacatgataatgctgttgcatgtgctgatgggataactaattctgagattggtgaaggtgacagcaaggtctgtttccccaactgagtttgatgggtcttttttactgtctactcattctgttggacatgaactaatattacacaacaccttgctacttgatggttcaggcaaaagtgagagccagattgtcgagaccattgcagagacctcctagaatgaagcatggattaagaggaaattttagggttgggcagggtgctcctcgaggtggacgttttgcatatgatcgtcctcctccacttcgccggcctccacctcgtcttttaagacccgatgttagtcgcttaccaccaccggtcaggagccgcccactgaagaggccagtagatattagagataggcgccctgttatgtcaataccagatagagttaggcgtttgcctccacccgagagatcatatgacagaaggcccccaggtgtgcagatgttatgtgcaatctattctctctctctcttcttttgctgtgcaaaccactgtaggtcactttttcatacttcatctgtttacagctcctgtgtacccaaagagaagcccaaggagagaatatggaaggcgtgatgaacttcctccgccaagaagcagagctacctttggtgactatagttcaagagttccagtggatagacgcccctatagggatgattattcaccccgggggtcagcctattcggacctaggtcctcgtagtgctccccgcctttctgataggcgagcatatattgatgatggttatggagggaagattgaccgtcctttaccaacatatagggagggccgtggtcgtgattatgatacaatgtctggttcaaaacgctcatatgctgagatggtgagggcagttaattattgttctcttgtgtttcatgctttctcctcatattcctcagccaactaagacattgctattgttatgtcaggatgatgtgccacctcgatatcatgacattagtgttcgtcagtctaaggcacgcttagactatgatgttggtggcagcagtgcccggtatgcagatacatatagcgagaggttggtgtacattttgaaatgttccttctctttgcttatatatatatatattttaatatcttacctgtacattgcttgtttttgaaggcttggacgatcacatgcgggatacagtggtggcagatctgtctctggtcatgatccagtgtacagtagtggtcggcatggcatgagttatggaggtatatgctcttgaacgctctgttgtgttagggtacctgtgctcacgtgctcaatatatattagatatctattctcacaccatttggtgtttcaccttttcaggttccgcaagcagtaatgatgctggtggaatgtactcatcaaatttcagtggtagctacatgtctcgtgggtctgatgtgagtcttcatcaaaatgttatctccagctcattatctatatcaatttttgttggcccaagctttctatcatgttggtttccccaatttattcatatttctctttgtgcaggttggtggaagttcatattcatcactttactcagggcgtaatgtaggtagcagcagtggctactatggcggtagtggttctagttcatattactgaggtgcgtgttcaatctgaatctgctctgtttctccttgagtttaaaattgtcctgcataaaagttttcattgatgtctcacaccaccaccaccaccatcgctgccatcatcgtcttaactgctcacttcagagaaggcaaatgcttccccttctatcaaacaaggaacaccctccgtgatcaaccatgaattgttttgatggtacagattttgcatcatatcgtctatggaacacacatggcaccgtaggaggttggtgtaggccccggattgtatggagctccttaatttaaggcctacggacctggacaagaagtggcaattgtgtgtggtgctcctgaattagacatgatcaaagaagtcagaaacaccaagttggttaaagcaatagtcttgtggatgttctggctagtttctttaatgtaaggctttgctttatttggtcaagaattgtgaacataatcgccagctatggtatcttggcatgtttacttccagtgtttctaaacatttttgagagatatggagtgtttcagtaaaatagtattatgaggtagttccctgaaatacatggtgccttgaagatctcttgtgatgtgctggctgaagatcagacttacaaatgaagccttagaagggggcgctttgtgtaaggctgttacttctgaaacatttggcatctgctctctagtggtttggtaatttgctgtgccaaaagatgattggtcagactgaaactctggactagttatttggtaactgctgaaaaattggatttgttggttgctgaaattgggagaaaccatttatatggctcaaagtagttctttcaccaagcgattacctaggccttgccataataagtttaagataacagaacctgcagttacagaactatgattatggtcttggattgccgctgttgattagcagcagcatagaattcagggcacccaggtatatctaacaagcaatgccatcattgagcacaacatttcacttgctactcgtttctgtaatttctgtcaagtgctgcatggagcatggataatatatctttgggaaagaagtggtaattggacaattgcaaactttgaagaaatttgcaggaagcatgaagcatgatgcactgactaaataagtttcagaaaaaaataaatatggttttgctatgacacctatgtttgatttaccatcatgataacatgatagttatggtatatttgggccctttatcccattagatggagatatatttgggccaaatttcttacaaccaaatttattttgtaacaattttttgtaaatagacaattttaccaagatattaacgcattagggaacaagttctctgttgatagctataggcagtagcggatgcaatgtgtgttctagtgaattggtgaaattgatggttaatactaccaaatacgaattacacagtatacagagagctgcaacaaacctagcaaacttgttagtgttaatacaaccattctctgaggtataggaaggagttaatacagtaagtgactgcattgtctgaaatttactcgattcatcatataagtgataataaccattattggatcctgagatcaaagtttgcatttttacacttcaaatttttatgtgtgtactacatttgccagcccttgcagtaactagaaatgttttaatatttctatcacttcctgtttagtgtgtttgttggagtaggatcccataagggcaacccacaattatttcagatcttggtgaactgcattagtttatcatttatggatggaagattgcactatccagcacagagagaaggtatcggtgaattcggatattggattgaaatctgagggaatcagcaccatgttgttggataattaggtgcctgtctaaaatagaaggggaggaggggaaggaagggacagttggttgaatttagtggaatgaagatagccagaaaacagcatgatcataattttacaagatagactatggaagcatttttgttcaagtagcaaatgcaaagcaacataaacgatttgtttgagggcctcgaattggtgaacagaaaacttaaccatacagtttagttgattatttcagctgctttagctacaaaactatactgatttgaagtagaaaagaacaaatacacatattaatctactacatatctattgaattattaatatttaatacaatgcatcttttataccttatggtcacaaagtttcattgcattcatttagttcagtactacttttttggtgatggtatcttctaattttgacatctgaatagtttcagtagaatcaactggcacatatattttattagttctgaatgctatagtgtatctcttgttgatgtttatctcagttaaatcatgtctaataaattcattttatccgcctatttttctgctgtttgcttggccaagtactggagtactttattttttctcatgtggtgtgagatcgatttgatactgtagcggagcactggcttggttgttttagaagatgtgctttgaccttatactagtagatagtgcagttgttatacaagatgctgcttgttgctgcactactatttcgtccataacctggaaggaactgcttcatgagaggtatactaaacgcagatcagagttccttttttctcccttcttttttctacttttcagatttgtaatgagcattgtaagcaagggaacggatttcatgtacaggtatgaaatggttgcgttgagattgcatgaaaaactatacttgattgggcctgtttgtgtctggctgtgatgatgtgctccgtatatcttttgcttgctatcgcggacttgtggtataggctatattcacagtttcatcgggaacgtagtttgcgtcgccacagccttgtcgaagggggttgattacttgaatgtcctgaggctcagctacggccaatgtgaatttgtactgatgatgcttcagcccccatggggatgttactgcgttagaatgcattaaatcatttgaaggtctatataggaatgcatcttacgactttaaggccttaggccattcacaatgtggcgtatagtttcgggttgccatctcggagattcccctctagagcagctgtgttcgtgtgtcgctgcgatgtcctacactcatagcgcggcgtgtggtttgagggttgctagatcggagattctactacatatcagattatcagccacgggcgtaccctcacgaggctactcttgttgagggcacgggtggcccggccgtggcaaggccactcgagcgtgggaaagggctcgtgtgagccgtgttggagcaactgcaacatgggcctaaaggaccacttaaaccgccggtcacactgtgctatagagaatcggaatgaaaaaagaaaattaactttgatacgcacgtatccaggctcaacaaaccaaactaaaatggacccaacctaagttgaggaaacactcttgggctacacgggccacagtgctgagtggtcttctgtggcccgttcgaatctacttaaaatagtggattaaattttggattaaagtggcacttttttcaaactgctaaacggtgcattttcgtgcgaaaactttctatacgaaagttgttttaaaatatcagattaatccatttttcaagtttgtaataattaaaacttaattaatcacacgttattaccacctcgttctacgtgaaacacttaatcttcatctttatcttcagaagatttaaacaccattgtatccccagcccaagtgtcatcaacaaataattccattgtacggttgtacccctcgtgtctgtttcttctccctccggttgcttcgtctcttctccctcacatcgcttcgcctccatctgtcagcgctgccatcgcacggtcgaggctcaacgatgaggctccgaagtggattggagattgttggccctgggctagaagctcgaatttggctaaggtgaggaggaggaaggaaggtgggaaaacatccatctccagcgccattttcgcctgttgtagcttctcctgatgggacggcccgagctcctcgtgcaacaccaacatatctagctctacatgcaacatggggacgagaatgcaagggtgggagcaaccaaatccgagcgtgagaggcacgaatcagtggggcgggaaggtgattttggggattccatctccgaagcggcggtgactcagagccacaaccttcacagcgcatgtgcggttcaagttccttgcggcacgcgcactcgaggcggtcgaagagcgcgcctcccagataaggggcgagcggctcagcaggggcgcggacggagtcaacacattggcgcatatccacataatttgagaatatattctctcacctctcaagacacttgtaggattagcttgcattatgaatgaccttagaattccacaaattagctacctagctctcgtttagagtttaacaattagctacctagctttcgttgaaagtattactagttcaatttttcatcctatataaaattagcttatgccaaaatttaaattttaaaaaataattttagagttaattttacaagtttttaacataggttttttagcattagcttttaaatcttcaaggacgtacaaacataaataaagttgtttagcatataatcagctcctggccaaaaacggggctgatggtaggacactactaggtagtttgtcccgaagacctgggtgactggttctgtgttaatcctggtatcttctctgatttttcgggttgtcatccgtcatcctaccgatgatagcttgttgtttgtccccggtgacaggtgacatggttggctggttctgttaaccctgccaccctggcatcacctgtaatttttcgtgttgttgtcatccgtcatcctactgctactgatgggcaagtgggcggagctccacgcccgcggcccgcaccagccacaccctaccccaaggcacgtcgacgacgtgggcggcaacgccgtgatggcgtgggtctctcgactctgccccgatcccgatcctgatcgaggcggccgcgtcaacacgccgcccgccgttgcacggtttcactcgagctgcgcctacacgccatccacggcggaacccgcgggcgccgcgccccggctgccgcgcacggcacgcgaccccgcgtgaccgcgactcgggccccgtcggtgcggccgtcccaccgcacgcgccgcacggtgaggtgacgtctcggccgctccatcctccgacccggccgcgtcgcccacgagaacgcgagcggtgggtcgcgccgcgccgctcgcggcgtcatcgccatgtgggggtctcacatcacggccgcgtcggcgaaaccacgcggtcacacgcacacacggggccccaccgccgcgcgccgccgccgccgcaccgcgcgccaccttgccgctcccgcacgctaccgctacccccttcgcgcacggcgttacaccaagtcgcaccgcatgccgccgctcccggcaaacggcacccccacgggcgtcacggcggaacacaaaactacggccaaacagtaacaaattgtaccatttttcttaaaaaaaacactatatccatcctaaaatataataatttttagcctttttataatttatcttaaatataatatcttctacacaaatattttcttctcaaccaattataattctttattatttaattttttcatatatcttttctactaaattattataatttttcaccacttaattttatcggttttcataataaccgtatttaactttaaaatctatatattctagaatggaaatggtaagatttgatacaaatcgaattatcctattcgatctgacggctagagtaacctgtgggctcaacaaaaaaacacttcttttagccacgcaaaaagtcgaaacacgaaagctagaaaagaagaaaacggacacgaaactttaacgccgagcgcggctgcgccgcgcgggggtgtcgggtcaagatgtcaacccccacaacccgcggttggcgccgccgccgacgccgcccaccgccgcccgcgtgcgcccaccgccacctgtcgccgccctaaaaagactcctccgttataatcccccctcaccgtcccttcccccaacctccgccccacaccaccaccaccgcctccgcctccgcctccgcctcctcctcaccaccgttgcgatggcttcttcttcccccaccaacgccgcggccgccgcccgccgcgtgccgccgccgtgctggacccccgacgagaccctcgcgctcgcccgcgcctacaccgcgcgacgcctcgcggtgggacgggcgcacctgacctccgccgactgggcggccgtcgccgacgcggccaccccgaccaagaccgcgcgccagtgccgccacaaggtcgagaagctccgccgccgcctccgatctaagcgccgccgcccctgcccgctcctcgacgcgatcgatctcctcgacgggccttccccttccgcgtccccgtcgcaatccccctccccgccgccgccagcctcgccgccgcctcttcctcccgctccctcctccccgcctcccaagaagaggaggctgcctgatggcgatgccgatgccgatgcggaggatgacggggagagcgacgtggtgaaggcgctgagggcgatcggggagggtttcctgcgggcggagcagaggcggatggaggcggcgaggaagacgcagcagatgcgcatggagatggcactccggcacctcgattcgcagcggaggctcatggaagcgctcgtcgaccgcatcattgactccctagagtaaatctcggtggcgcaaaggtgtctcctgtcaaggttttcttgcttgtcctgattgcccactggcttggcttgcgagtttaggagttaattagagttgttcatatgtactgtgatggatgtctgatgtaggcgtagcttggaaatcgtagtaacctttctatctatcttgtatggcgtatggaaaataataacttagcctgttctgtgtttattgttttgtctcaagctttaatttgttcaattgtgtgtggcaacctaatttgaagatatctgaactctagaatatagtagaatttaactgcatctccccccagacttgcagtttctgaccgccaaaaatcagttattcctgttcttttgcagcttgtcgacatggttgatacctttgtgacaactgcccaagtagtcaattgaagccctaaggaggtgtttggataatgggttaagggttatgaggggtgggattgggaaatggaaatgaatagagggttgagataaaatgaggtgagatgaatgaatggtcaagataaaaacttacatgccctaacagcagattatgtaagcggaagaaaaaggaattcactggaaatattgatgttgttgagctttgggggtatcctgattgtaccagatttcgcttttcatagcagaaaatttttccagcgacttggatttagaattcatttgctaattcgtccatccttactgggttggggctgatactaactttgtaaaccgagaggcagaactacaatctaaatttttttagcccaagcaagttctcatgtcgtggtctcatatttatagttaagcagagcataatctttgttctggatgtcattttgttggatagatctgaatatccagtagccagttgaccattacatggcacagttgtacacattgttctgttgtgtcatttgttgtatgtcttcattctataactctctaagtggttatttcaagcagttgcggaaggaaaaagcagtagtgatgttcaaattacatataatgtttttctttgtttcctgatagtgtgcactaaataaattcatacattagaaaataataaatagcacctatgttgaatgcctccagaaaattccatgcaaaatttgactacagagtgatcaaaagcaatagataccaggaaacaaagaaaaacatactgcaatcaaattttgagcatactgtttttgataatcaaattttgcttttttgataatcaagttgatctattgcaaaacagaaaacagagaaaacagaaaattctcttttttgtagaacaactgtaatgttgagcatactgtttttcatatcaagataccatgaggcctttctttagggcatgttctactcagaaattgttggccgtcttacttcttgccattaaaggtaaatttattctcttcccacttgaaattgtttaaacttgcttatatacattaatacatagattgcttcagtgagattctgtggtgctcttctttttgaaaatattgcggtgctcataagttgttctcttttttaaaatttgaacactgcctgcaaccattattttcttgactgaaccaacttgagacaattctacgcttgattagaacttttattttgccacagggttttcagatcattgatggtaattgtatctattttgtctgtgtttttgtctttttgataaaaatcgagccacgcttgtgacacagattttagaggcatctgtgagtaaattactgaaatacgcccaccatccttttacaactgacatattccctttgcttgatattctaatttatcgatttatctgtttgtgtcatgccaagtctcatgctctcagctgagctggaagtttagttgctttaggtgaaaaacatcaggatattgttgatcaatatgctatagttacctcgttattgcctagaatcttcctatccaatgagaactccacatgactccttgaaacttttttgagtataatataacagtgaaatctagtgttccctttatgtgtcagccaattttctgcagatgaaggcaagtgccacttaagtaggatgttggaccacaatcaaagtgagtggtcctttaacatgtttttgcttaccctttagctaactggcatgctcatcaatgggcaaccacttgagatgagcatcagcaaatgaaaattcaggtatgctcattgactcaatgtagcatgttgattttgaaagcgcgaaatttctccatgatgctcggctttacttccgtgttccaccatgtgtggtccttgaattcttgataaggttatgtataataagcagttacatttatcagaaatcatttcgaaggtagagttgcgactggtgagagttgctttgtgtggaatattccttgaaaattcccatggctttcaaagaactagagccatcttttgaaataattcagctgtatctttttattgcatatgcaaatattagttatttgataagaacatttctgttatgttgtttataggacttcggtgtgttctcttgaaccgtgttggtacgatattctgggcacaggaaggtaaatttaaggatctttctgtattggtccagacttggagtatttttaatggttgatacatctgagtgcaatgttcttgaatgctcaggaaaatagcactttttggttctctgtttcaaatatatcaaaacattagcttttatactgaaggtgtatctgccatctgcagggttttctttttgcctatattgtgaaatttatatctggtatattcatgtgatacattcaactactttcagttataacgaaatcagtatgttctccagattcgttatgttgcttttcatggctacacttacaaaaaatataactatcgaggttgcattttgtgcattgctttggacatggaagccagtaaaccagcatttgattgtcttcttttgcactggcatttcctgttgcacctgtaaatttaatcagtacttctaaaagaacggaaaaacagatacttaaatctagctgttaaaaattactcttctgctgtcacttggtactttctacggaaatggtcaccttctatgtttaaagtagacaaaatttctggtctttgatcaaaaggaaaacatgccattcacagtcctgcatgtacactttgagaaaaaaaaaagttacaagccaatttgcaagcacaaaagcaggaaaagaagagtctaacctaatgcaaaagcagcttctcttttgccctccatcctctttagattcgggaccattctggagacagcctaattgccaagctagttagctccaaagtaactcctagatcaatgtattatgtgctgctattgctaagatatgtccatattggcatgatgaatcatagcattgacagcctcattttcttctgcagagtatgtggagtgcaccccatagcagacatagaagactatgatcacaaagctccagaggccaaacctctgaaatgacatcaccttgagagtggtcatcaggaacacattcaggaagacggatgcagccgccggccatggcatcagagggaccatccactctgatggtggctctggcatgtctcgccgtaccgcgcagtggaacatggcggtaatcgtcacggaggtggcgccgaacaaagccattccccatcggcattgcccatggatcctcctcgagagggagaagccaagggagctcagtgtaaggatgagcaggaagaggaggacatgcagagatcggttggcacccagcttcgcgtatcggtggtagatgagcgcgttggcgaccaggtagaagaccaggagtgttccgattgatatcatctcgaacactacctgcagctctgtgaagagtgcgattgatgctgtgcacaatcctgcgcatagataatggtgatgatatttgtaagagcagttcaagaaatgccagaaatagtattgctgctagttatgaattatgataagttgtaacctgcaatgacattatctaaaaaaaggtacctgcattgcagttttcatgatctgatacagtggtaaggaccttgacttcggtgaagttattagtgtattttatgcttccgtttgctctatctaaattaggtttattatgtaggttgcagggggtctaacatcacataaacccatcagttcactactagtttacctcatttgtcagatctttgcaaagctgtactgccttcaacttttctatttacatttttgacatttcacggccttcgagacataactttgaccaatagttctcgtaatcttatcacagtacatttaacattataatatcatataggcatttctagtggcaaaactaacgaacgatacaatctttttcccaaaaaaactgtgaatacaatcttcattaactaatttagggtttcaaacatataactggtttatgtcaaaattaaaaatataactggtaaaatcgttgaatgttggcagcaagtaaaagagaaagaagatagtatctatagcaagctcacaatctccacaaattttaaccctccacttctaaactccaattgtgaaatggcataaactgcagatgtattaacactaatcactctatctacaacctctcaacctctttcaaccagaagagataaacaacaactcaaccacaattctacaaaaccttgcaaaacttttcttaaaaataaaaacatacaaccttatgaacacataaataccagtacgtactccaaaagttgaaatcaatcgatccgttatatatatagattaactacaaatctacaagttaacaacaaccttgtactgtgttttgaggtacctagaaagatggtggcgttcataggagtgccggtggaagggtgcaccttggccagccacgccggcaccagccgcgctctggcgatgacgcacaggtacctcgcctgccccagcatcgccaccagcagcgacgccacgatccccaggctcgccccggccccgacgacgctccccgcccactcccaccccgccttctccctgaacaccgccgagaacggcgcgctctccgctatctacacacatacacacgtacaccccatgtcaccatcagaatgatgatgagctagtaatgtgtcaatgtgagtgacaatgtgtgtctacctcggtgtagggaagcatggcgcagagggcgagggacatgaggcagtagagcgcggagacgacgaggactgagccggcgatgccgacggggagggcgcgggcggggtcgcggatttcctcggccatggtggacgccgagtcgtagccgatgtagctgaagtagacgatggcggcgccgtcgaggacgccgcggacgccgtagggcgccaggccgtgcggcgacaccaggttccgcgcgctgccgttccacaggccggccaggatgatgaacacgaagaagagcaggtggaacaccgtgatcaccatgttcagcatcgcgctctccttggtgcttcacttagcatcacacgaatccatccatcaaaaaccaagtaccaaccaaccatcaatgctgctggttgttgatgaattgcacatttgaaacgcatttctcatcttcttccaaactatactgacaaacgtacataatcaaatcacatgctgaactctagcccatggcaaggggacattagctctattctgccagtaccatgtctgccataaaatataggatctaagaacacaaaaccacatgcatgccgctgcgcctaattaaatcaagctagctagggtaggttaagtacacaccagtacaaaaatgacaaatcgaagaagtattattgagtcatttcacccataagcttaaggtaacgaaaaacacaaagcgattcacttctacttaataaacagtttttatcaacggatcaatgtccgtgtaatcaaatcaaatgcgactcaacaatgatctgtagtatgtgtacctgtagcacaagcagagagttaggacaaggatgagcgcgacggccgggaagtcgagcgcgttgtagcccttggcgatgccgtcgacctggatcctccacgcgtccggctccgtgatcccgcacgtcgaggccaggtagtccgtgaagctcctcgccaccgccgcgttcgacagcacgtactccatcaggatgttggctcccccgaagaaccccaccagctcacctgatgagagcaacagatggagtcaattaaccgcgctcgatgaattgatccatcgatcgttgaagagtgcgttggattaattcaacaatgtccctgaaccgtttgcacggcgccattaactgcggattttatggtggcgcgcgcgcgcgcgcgaagaggttaatggcaggcacacacaccgaacgttacgcggaggtagctgaaggcgccgccggcggcggggacgcggacggagaactcggcgtagcagaaggaggagaggagcgcggagacgccggcgatgacgtaggaggcgaacacggcggggccggcggtgtcgcgcgcgacgcggccggtggtgacgaagacgccggcgcccagcatcccgccgacgccgagccccacgaggtcgtaccactccagccgccgcttcatccgcgcccccgacctgtccctcacctcgctcgtctcctgcgccggcgtccacgtcaccagcgcccgccgccgcagccggtgcggcgtctgcgcgatcgacagcagcacgtcacgcagcgccgccatgactactacaccaaccaattaacctgcaaactaatcaagctctctcccactgtcattacagcctgctcatggtttaacttcttcactgatccatctcttctcagctgtgctagctgctagctgcgacgacgagccgcatcgatcggagattcatatatatatgccgcgacgcgaaagagcattcaatattcgaattcagtgttttatttggacggtgggaaatgaattgaagtctctctctgctcgcgctcggacagcacatatatgtactgagtactgactactgcaagtatactgacctagctagctagagcttgcatggagtatgctggagtagcttcaaattaaggcactgtcttttgcagcttaatttccaagcagcctctgctcactggctcagtgtccacacatgtgttcagctcataggacacatgaaagccatatttgcacatgctctgatgctcaacagttggggtgtgctaaatgcccttctctgaaacaacactgtacacccagtccaacgctgaacaatctaaaagtctgaactatatacagttgaaaaaatttaagtgatctgatctctgaagtctcctgcatgcagaaattgctagcagctagctaggtcgctgctagatactgctgtactctatataattcttcctccattttaaaatataagtaagcatttctaacgatgaatatgaaccgagctgaaatgccaaaaatacgtagaaatgtttatattatgaggattgctatggtacagcaggttgtaccgggcggtactggtaccgcgcggtaccaaaacacatctaaccgttgaatccgggatgggtaggatcgggagagaaaagatgagcaagggtggatgagggagtacctgtttcgagtcatcgttcccggcggcagcggcgtccaagtcgttgtcgttcccggcggcggcgcagagcaacaagggaacgctggcgacgtgggagaggataaagtctggcggcggcgcgagagagaaaaaacggaacggcggcggcgcgggagaggaaacaagtccggcggcggaagaggaacaagtccggcggtggaagaggaacacggcggcggtggcgaggaaaaagaacacggcggcggcggcggcgaaaatcatccagcttcgctagggttcaagccgctcgatctcgatccagacccatcaattgcacgcgaaattacaatactgcccttccaccgattatcatcactcggtaccgcttcggggacaaaactggtaccccgcggtaccgatctacgccagccgttcgatctgtctcgatccaacggtcaataatcggtaccgtaaggtaccgttggactgtaaaaatcctcttatattatcgaaacagagtccgctgtgactgtgaccatggaaattactccgtaatcatggctcctcaaaagctaatgtgttgtctgcttgctaacaaatgaagctcacatggcatgaggttcagacttcagaggtacagacatgtagatgcctcaagtagctgtttgtaaatggtgatcaaatccatgcatgcagcagagaccagatatgattcctgtctcctgatgacaactggtttagcaggtaagattaatacctaaccacaagcaaaggaggtcaaatctacatgagccctataaggaggcagcgagagagatgctataaacatgatctagtaggaaacatctcatatgcatgagcatatgccgacgtgtcgacaagccattcacacttggtgaaaattattaagcaaaaaggactgtcaggtaattagatctcactcatccattgaatttattttatttccagtagtttcacacatgtgcgcagttacaacaaagtatcaaagctgaatccaaattaaaaggacgaaataatattgttaatggataatcaagttgctctatctcctgatcatacataagatgagcaaacattatggaattcagcaagaagaaccaaagcataaaagatggtcatctcccataatcactaggtttggcagcatgccgaatcaaatccttgacctggttaggtatattaaacagttgataaaaagtgtccaatcgagatagtatatgataagcggaataaaactgtggaataaaagtgattctttgaatactgatccaattccttgatcaactttacaaaagcacgcgactttgtagacatagtgatatgcatgaggatagctggagtacattaaacggcatgaacgagaggccaagacaagttcagagcagtcaaagattcagagagcaagcataaaacgatcgaatagccacacatcaacgcgaggacgagctgctgcatgaaagcgtcagaattattcagaactgcagatcgatcggtggaatactgtatgtaattaatactcgatcgagtaaagattatatagctaaagattagctgtctagctagctgcagccttcctgcctgagcggtctaagcactattcgcgtaggatatgcttatgtaaaaagggcttaagcagcagctagctggcactatatggggttcctgaagaaagaacaacacaaggtatcacacttgacacatcgtctgccactaatggtggccttgatggaaagagagagggcggctttgcaactgctaattaatcattttgatttgtggccagaaggctagcatggaatcatctgttaatcaaagtggagggtgtaggttagatgctacaggtctaggcatgcagcctagcctgtcctttaatttggaatagggataatgaggtgtatgatagtataaatcctaatccaatcgcccataccttgaactcagaaaaggttatgccatgttcatgtgggtgttcagtatatatattgagaaaagctgagattgttcaggcccaattgcccaaagtcaaataccatctggattttgtattatgctgcagaggccaagatgtaatcctcttccttattgaaaaggtaacttaagcttatgtttacaactaacaaaatatctgaacatcaataatattgcacacaaatttaaaaggaagaagtgttggagaacaattcattcccatatcaaaatcatgaaaaaattacccatgtttgaaacaatgcctggaatagaatgtatatttcattgcttactgaattattccattgtctatactcctttaaaaaggagtagtagtagcggtgaatctttttttagataatggattaaaccggtctctacacccaaaggatgtacacagcctagtagcggtgaatctgtcaccccctattgctatattgttcaactattgcaatcaaacaacgacagggcttagctctggtgagtcggtgagaaaaaaaattcattttactactttgaactatttcattggttcacttagccaagtaaaactattttttggcctattttacaccctgaactattaaaaacggatcatattacttcctaatggttcattgcaatgaaatttggtaggattggtaggtacattataacctacctcacaatattattcaaaaaaaatcgttactatatacaaatatttgaagcactaagcatgatttaaacaccaatggatctacaaaattttagcttttgaaaatatttttgaactttgataatagtgttatctatagctctacaaaattgtagtttaaaatgcgactcatgtaaagagaatcaaatatgagaaatgctatattaagcaataaagtaaactatttttaatagtttaaaggtaaaatgaaccaaaaatagtttagttggtcaaatgaaccaatgaaataattcggagttaaataaactcttttttttttcaatttgtaatcatcacaatggtaaatgggccatatttagtgggccaagataaacccaaattccaagaaaagccatctccttggtcaaccttgggcctagtagaacaactgcagcccaccgttctttccgttctccgctaccgctagcttcgttctccgctgcggcagccggcaatcgcacggcggaagcaaaacgaggaaaaaatggggagctcgcggcgaggggaggagaagggactccctgttcctcctcctcctcctcccaaccctggtggtgtcacttcaagacggcaaaaggaagcagccatggagatcgaggccgtcggggccgatggtttgtgcccttttccccttagcatagctgtgtattagtaactcgttcgtgtccctgcggaacggaagaactatggttgggtagtaacagcttgtcgcaagatctccggttattgttgcggcggcgcggggtcggtgccgtggattttccattcgggccgcaaagagtcaagagtgttcttcctgtaggtgcgccttgtgattgggcacaagcacaacagcgtcaccatggatctttgtgtgatttggtggaggtggaagctaggttggttcttgcagtcactcaaagaatgccaaggaggaaactgagaaaatgtatttttgtgcttgcagtgtaactgctctttcttgaaatcagatcagatgcatatatgtttcacaatatctatccattatctaaaaaaaaaaaaagaactgattctgtccatgtagattcaggggaatactattctgagaactgcatcccaaagtgcattgacttgcccttaattaacctccgaatatgcagcttcagcttgtttggttttattcatcaatcttgtttggagatgtatgtgtgctttcggtcttcaccaaactccaggatgataatccaactcgactttaattaaaacaaggacaatcaaaaagaatgcttggtagttgaggactcgaagctcccatggagataggcaagtgcttattgcatgcttgtcttggctatgaggaagacatttgttgatcctcacctaacattctttcaggcaatcctatgcttgcacttataaacgcataccttcaggcatataagtttcaaacttcatacgattgttcaagtgacactattgtcatggctttttgcaaaccatgtctagtattctattctgttcttacttttctgatcctaaatggtggtccatctcatgtacttgcaaaggtttttatggtggtgatggaggatgacccaatcatttcccccaagtcaagccaaaagaaagtaatgtacgtgacttccatttaggaatcctgttagtttaattctttttggaaaagaacatttatgactgaactttcatccaggagaggtgaggaagctcagaagtacaaggcaatgaccacaacgaagcatgatatcttcctggattcatttctcccagctggatcttacaagaagctatacagttacacccaccttctcaatggctttgctatctatgcaaaatctgaaaaggtgcttctatttagttgatcttttatctgcttacctgtttatgaaatatttatctgtctttgttgtatgtgtaataggcaattaaaactcttagtggagcaaaaggagttagactcatccaagaagatataaaaatggccaagatgaccacatacactccgaggtacattggagctaatgtagtctggccgctcctcggtggtgccgagaaggctggtgacggagtagtcattggcatggtagatactggcattgaccccagcaacccaagctttttaagcacatcggaccaagcaaaaccaccaccggccagtttcaaaggaacatgtcaaactggcgaaagatttcctccagattcatgcaatggtaagattgttggagctaggtggtttgcacgtgctggtcaagcaactggagagttcaatgctacaatgcactatgcatctccttacgatcctgatggccatggcaggtgcatgctcctttgctaacaatgctaatcactttttctttacgacttgcctatgttgcatttttaatttcaaggacttaccaagtaccaactgatcaaaacattgcctacacagccacacagcgtccactgcagctggcaattttcatacgccagcaatatcaaagggctacaactttgggcatgcaagtggcgtagcacctggagctcagtgagtgaacaatgcttattccattcttcagatgttcaaagcaaaactactcttatgttgtgctgtctcttctgattatgtgacagtcttgcaatctacaaagctgcctattcttttggtggatacatgtcagatgttatagctgcagttgacaaggtttgtaaatcatacttctttcataactactattctcttccgtaggttaaaatgccagtgtaacttatatgcaggctgtagaagatggcgtcgatattatcagtctttcactgggaccaactactattacatctgggccagcatcattcctcaatttgctcgagacacaacttctccttgccaccaaggctgggatctcagttgttcaagcagttggcaatggaggccctgatgcaaactcagtagtttcgttcagcccatggataacaagtgttggggcatccacaactgacaggaagtataacaaatcaattataattggaaatgggcaagtcttctcttgcggcggcctatcacgtaattcatttcaacctatgaaattaatgaatttggagccttctcaagttctagtgtttaactgatgatactaagttccatacttctcttttctttttctttcagaattcgtagttcattttgctcttagattctatatgtcctagattacatcatcattctgttagggttgcactgaagtagctagaaaactaacattatactggggctttcttcgtttcaatttcttcacctggtaccaattttgtttcaacagtcttccttgttctgtccagcatcgacaccaggcgagaccatgtaccctctagcattggctgatgatgtgtgcaacacgaattcaactggtggatcttccaactgccaagatccggatgtcttcataagatctcttgtccaggggaaggtgattatttgcatgtttgtgtcgtcaaactactacgaaggcgacttccttgctggcattgtcgatacgattcagaaaattggtgctgccggagttatcatcactgaccgttcttcgagtgactccgacattgaatatcatcccacatttccgacgtcaatcccttcagccatagttgtgaacagtgctgatgcacaggtgattgtagaaacatttttgcagaccaaatgatttgctaatgcccttgttcagttttactattctcttatgcagtaactgggctctgttgtgttttgcaaccggatgcaggctctattggagtactacgacgacaacttggtccgagacaaggaaggaagtgtcaccaagttcggcgcaaccatccgaattctggatggacggcgagcaatctacaccagggaggcgcccgtcgtcgccgagtactcgtcgaggggcccggacgtcgacgacatgcagatgcaggcggcggacgtgctgaagccgaacgtcatggcgccgggccatcacatctggggagcctggagcccgacgagcgacgccatggtcgagttccagggcgagagctacgcgatgctgtccggcacgagcatggccaccccgcacgtcgccggtgtggtggccctgatcaggcagaggcaccccaagtggagccccgccatggtcatgtcggcgatcatgaccaccgccgacgtcaccgaccgctccgggaggcccctgatggcgcggcgtgacgggggcgtcctggagcgcgcgacgccgttcgacatgggcgccggggccatcaacgcggcgcgcgccgtcgacccgggcctggtgttcgacgccgggtaccgggactacctccagttcctgtgcgccgtgcctggcgtggacgacgccccggtgctccgcgcggtgggcgtgccctgcccgccgtcgcgggcgcggtggtgctcggacctgaacgcgccgagcgtgacggtggcgagcctggtggggtcccggcgggtggaccggcgggtgacgagcgtgggcgcggagaacgaaacgtacatggcgcacgtgcaggcgcccgacggcgtggcggtgcgcgtgtcgccggacacgttcgccgtcgcccccggcgcgacggccacgctgaggatcgtgctcaacaccaccgcgccggggaacaccttcagcttcggcgaggtggtcctcaggggcgacaagaagcacaccgtgaggatccccctcgctgtcttccccgccgcggcgttgagcccgtgaagccccgaacagggatagtcctggtatatacaaatattacttacgtatacgtatgcgagcggatggagttgtacgatgaatgaataacatgtatacatacactatactcgtgttcgagcaaacaagaatacgagccatgtatcgtataatcggatattatgggccgcaacggaccaaccggactgtgcccctgctgggttattcctctagttgggccggagcacggaggagagctggtcagccataatgggctttcgttctgatgcaaagcaacggcctctgctaacttcggcttgtcgagcatctctagcagcttttgccagatgccagactaccatggacgggtttgactgtggcttctctttttaatttttttgatttgatgtgtccagtgatctaatgattgtttagcattcttaacgatgatattaactagaagcatacgccatttacggatacggaagtccacgtcgcgtgccagcgcgctggctggtactcccctatccccttctgttctggagtagaacagaagccattgactttcagctttctttccctttccccttcgcggttggacccgcgtggccgcgtttgagcatgcgtgctacaggtaacgatggattagaaaaaggattatccgcggatgaggcgcatgacgccgcctcgacgcggcgcccccgggccgccgcgcttatccgcacccacctattcttactacggacagggggttcagatcaaacggcaaattttttttccaagtcacacatcgaacgttttttatcacatgtacggagtattaaatattttaaaaaaataattacacagtttgcgtataaattgcgagataaatcttttaagcttaattgtaccatgatctgacaatgtggtgctacagtaaatatttattaataacgaattaattagacttaataaatttatctcgtagtttacatgtgtattatataatttgttttattattagtctatgtttaatatgtgtatgtatatatgaggtgtcgcggtgtcagctatagcgcgcgtgttgtttcaacgacgcagcccgctcgctttcacggtctcacttttcacccatggcggccaccatttgacctgtgattttactccactcgcgagtgtgtgtgcaggtgagctgcatgcacatcgggatgtgacgcccgccggctggctgggctcgcgtctgcgttgcgtgaagcgtgatggcgtgggggctctccgtatcggccgcggggcgagcgtccatattccacccggcgcgcaggggtgatggcgtgttgctccgtcggtcggtgacagcttcggcgtcggactttacaatggaccggtggtggctgctcggaaggaacatcgggccgactgccgagacgttagtcgcatggagaacatcatatgatttcatctgatctgcaaaaccggtctcgttatttgactggtactaatttcaactccccccacacaccccccatatctttgatttttttttttttttgggggaggtagtcgtatctttgagagaatgcttctcctgctacccgagaaaaaaaagggacgccccgatatagcaaacatggcaggagtgcactacttcatctctcttttaaggactttagttgcaaattttttcttcaaactttcaacttttccattacatcaaaactttcttatacacataaactttcaaattttctgtcacatcgttctaatttcaatcaaacttccaattttagcgtgaactaaacacactcttaagcgataaaataaagtctatcaatcttcaaaataattgttcacctgaattatttatttcagctattatcgtattatgccgttgtatttattataattaaatctttatgacaagttactcggaaggaatttttttttagtaattttgctattgtagattttttttaatattgtacacagttttgtttatatgtctcattaagtattttactatgtttattagttcatttttaaatgctgaagtgatgttttttttatatttcacccaatgttttgtgatgttctaacatttacatattgatgtttcatatgtcatatagaataaggacgcaacatttttttatatatattctttcattaaagtgtaataatgtaatatcttattataaagatttaattattacaaagatttaattgtaacgaatacaacagcataatcaaatcatatattgaataaataatttagaagaaaaattgtttaaaactaattaattagtagttagtttggtatttaatgagacatcatggaagatgagtgagagagaaggggggaggccatgtggagcagagcataggaggaccaccatgcgtactacagtagcatatgatattttaattttcgtcggacgtccgacgctaagtcatctctaaaagaatgtttttcctcaaatatccggctcaaggagaaaaattggatgccccaatataacaagcaatggcatgcgtaccacagtagcgtccaaaattttagttctcatcggacattggacgcctagtccttggactcctcggacgtttggtgcgaggagaaaaactggatgccccaatttagcaaggatcagtacatgtgaggaccattttggcttctactcttccaagtgataaagcaactttgtacgatatccgatatacgatttgaatatattgttatatttgttataattaaatctttacgacaaaatattatatgattatattttgattttttaaaagttttgttgttgttgccttttttttaatgttgcgtacaactttatttgcatgtttcaataattatttcatgatatttcactagttcatttgtagatgtttcacgtggttattttttatatttcaactagtttttatgatgtctaaacatttacaacttgatgtttcacttgtgataaaaaaattcaacataattaattattggtaaaagtatatttagatttgtcgtatgttttttctttgcgatgaagcactcattgtgactcaacgttttatgcaaaaggtgtcagtgatactgtcaatatttcttaaatgttgcatttttctaaaatatttaataaaattaattgaaacatttgaattaataaaattaattgaaacttagttaaatgttttaataaaattaattaaaatatttgactaagttttgtatttttttcatcaaaatataattgcatttgatcttgttgtaaaattttagttgtagtgaatataagggataaataattttgaaggaaaaatcattcaacgctagttaattagttagttttgcattcaaggaaccaccatgagagagaaacaagagtgtgggggaggccatgtagtggagagcagaggaggaccagtttgagaaaaagaaaagaaaaaaaaagatgtagtgcgcgtacccataaaaaggtctaatttttcagttcccgtataatgtcctactcctagtactctccgtatcttttgattatgacatatatagtgtggcacaaaatttactattttcttcacttctactacctttgattatgacatatatagttaaataaaagttactacttatagcttttcttttttacttatttgttatactctcgtcgttccaaaataagtcatcttttgcataagaatttattataaccctctcttatttatttttcacctactattttatttcaactaatcataatttttcatctacttcttatctcaacaatttaatactcacagagacttctaaggtgtttgtattttaagagtccttgcattttggagcttggacaattggacttcggagtggctggacaccatctacgggcaactcgaaaatggaaatatccgagcgatgtgcaatcaaaatgatttgccaccctgagaacagaccattgtccccgcgcagaatcgaagattttgccaccctacgggatgggaaagagatttgtttgacacatgatctgtttaacgaattacggacatgggcgagcactgttctgtgcgtgctgctgcccactgtccaaactccaaagcacccacacccattccacggccatacacatccgccgcccagacttttggacggggtggatctcttttgaacagcacttttcctggggaggcagccggctgcggggaggtctctagtccacgagtgttcgcgagcgagattatctcacgaatctcaagttctcaactgagctagatgctgactgggtcaggcgctaccccatgctagcctcttcgggtctgctcttgactaaaggatcggcttgattattttctcaatttttgctagtatgtttttaaaattgataaatggtgtttttatataaaatatacgtagaagttactttttaaaacaaatattttttaaataatccaccctcaattaatcacatgcttatttgtgtgtgtatttaacgacttaaaaacaaatattagaaggaagctaaattaaaaaaattctaaaataatcttcaaaattgagttttgtctagaaaatatgcttgtgcgttgcaacagataaatgctattttaacctaattattgttatacggtttggctagggtgaatttcactatgggaattcgcttgattattttttctagaaaatcatgagctgcaattaggagtccaacatttatctcaagttagcatgcaagtttttaaaaagatttcttatacgactccttttgcatttccaaaagcaaacgaacttagaatccgactcaaacacgaatatgtatttaaaaacgaacaaatttaaaaaccaaatcaaacacaaatgacgtaccaaaataccggtgaaaacatctttaatttttataatagtacagatggtggcagatgagaaacgctaggggtagcttcacaaggtatagggatagccaacctggattcgatacatcaccccttttaattatttgatattagattcttttctaatatttgtgtttttttttccttgtaggcagatgatgaggctgccagggagcaacttgggatccaaaggtcttgtttagttggggaaaaaattgagtttggttgtcacatcggatatacggacacacgtttaaagtattaaatgtagtctaataacaaaacaaattcagattcagccagaaaactgtgagacgaatttattaagcttaattaatatgtcattagtaaatgtttactatagcaccgcattatcaaatcatggcacaattagactttgtcggtgacatgggaccgggagtatcatgacttagagacttgaggcagacacgatcacccacgtggcctaaccccctcggggggtcgggcccgagggtgatacggccgcccttctctttgtctccccgaggggtcggaccgctcccgtctcagccccgagggccgaggcgccccgaccccttgtgggtgttgcgccgcgtatatggggtaggtgagcatagcggggctcacctaaccacatttattgcggtttggacgagcgcgtcacgccgcatgtaacgcagtgcagcgcgctcgtttatccggtctgtgatcagtcacagaccggtcaaatcgtgggttaggtggcgacaggcggtctgacgcacgcctcgccccatcccgtcaggacgagagcctccaagcactcgtccctagccggagccggcgtgttagctcctagagatggcacgttggttccggtcagatatatgccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtgtgggccgtcccatcagaaggtcattcggacggcaaccatacaagtctccgtctgtttatgaaaagataggataagtccccacaaaagaaagagagggagagatggtgcatgtggtatccccttgagatataaaaggaggaccttgcccacttagaagaggggaggggaaaaaacgatcccagaacgatcgggggctggcccgcactttgtagcttcttcatacacagatccaccaaaacacaggagtagggtattacgcttctcagcggcccgaacctgtatacatcgcccgtgtcttgtgctttttccattctcgcgaaccttccacacacagacaaggagtttagaacctcacccagggcccccggccgaaccggcaaaggggggcctgcgcggtctcccggtgaggagccccaagctccgtcagacttaaaagattcgtctcgctatttacatgcaaattgtttaattgatttttttttcatatttaatactccatatatgtctccaaatattcaatgtgatggataaaaaaaattgttttggaaactaaaccagggccgagtttagttccaaaatttttcttcaaacttccaacttttccatcacatcaaaactttcctacacataaacttctaatttttcctcacattatttcaattttaaccaaatttccaattttgacgtgaattaaacacaccccaggccaaaatacagtagtggcatcgtcccagcactagcagtctagcactgactgaccaacaccaccagagaccaaacatggcattgagggctggtttggttggtggtctaaattggtcttactaatttttggcaatgccaaattttatcaagttttggtatggctaattttggcaaggtaaagttgcgtttggattgaagccaaaatagcctaacttaactattgaaatgatctattttcttaggcatgccaaaatttgacttcaaaccaaatagacactaaatactattaaaattactaaatattaataagactaatttaggcctcaaaacaatccagccctgaaggtagggcagagaatccggagtgagatgcagacaaaaaaaaacctgaaaccacgttcatttcagctcagggcttcaggcggtagctgggccagaaaaaagggagaaacgaaaaagggcagggcaggaccgcaggagacggtgcacttccgctgacaggtggaccacagactactggtttactcgtagtatgatgaaagaggagtagacgacgagtagttcttgacgctagtggtggtggagcctggaagattcgggcatgtgtagattctaatttttttctttaaatttttaactttttcatcacattaattttttttacatataaatctttaactttttttgtcacatcgtttcaaattctttaaacttttaattttaatgtggaactaaacacagctttcagcgagagatgagagagagcccaaagcaatggaagaaaccaagtaatattgtactagtaggaaataggaaaagcgttcgaaatttacaatctttgacccgcttcgtcctcaatcttcttgcttatacacagtcataatccctcgtactagaaattaccgtgcaaaatttccccacacacgtgctgctatggttctaaatttctaatcggctctgatgagtcaccttcccaacagatgagagaggattttctggctgagtttagcaattagcacagctctttgatcctatctttgctttcttgctccgcctacctggatggatggatcccccctccctattaatacagcacgcttcttcctcttcctcctcacgattcaagccaaacgcagccggccgacctcctcccgtgccttcctcctcgatccccggagagagaaaaaaggctccatcttttttcctctttccgtttttgggcgcgaacgcctcgtcccccccggatcgatcttgctcgcgcgcggtccgtagtcgcgtgctctgttcgaaaggcgagtccctttttttttttcttctccggccgcgggcgctaatttttttggagggcgacgcgccacctttggcccggccatgaacgcgctcgccgccaccagccgtaacttccggcaggccgccaggctgctcggcctcgactccaagctcgagaagagcctcctgatcccgttccgcgagatcaaggtgagacggggttttttttttttttgattcctgtttccagcttgttttgctgcggttgctggctttgttgtttcatcaggcgtagcgtaaccccgctctctgttcaggtggaatgcaccatccccaaagacgatggaaccttggcgtccttcattgggttccgcgtgcagcacgacaatgcccgcgggccaatgaaaggtggcattcgctatcaccctgaggtgaggattgtggtttgatgagaatctgtttttgattttgtccagtaataatgccggggatgtaaatcatcttccttattatctggaaatttgaccggagatgattaagcatgaataaatagtgaagtggttataaactcggaatgttttgacagtgactgtctcatgtcaatgggatcattgtttcgttttggtgagttattagatctacggtacttgttaacttgttattccttccttgtttgcatatggcctttccagttcggtgagttattcttttaggaaatgtgcgtgatgttactttcagtttcatacctttatttgtaatctactttatgatattttgtggatcgtctgggcactgggctgtcagtttgtcatgcagatggcgtgaactgaaaatccttgatattttgcaaagcatgtgttgcttttgtactactatgcgcttatgtgcttttacattcagatttatatttctttctgttgaactgtcaacctaaatgtatcttttccatactgacaaaagaatcccaatgggcacatgccaatcttcttcctctgtcaaattgtttctgtaatttctgttttttcttgaactattatttaactggcattttgagaaactagaaagtttgatgcccagacatgctacagatgctagtattcagtattggagacaaccactcaaccagctttgttttcttctgtgataatttcttttgttctttactgctccaatcatacttcggttcttgttgctggaagccattaaatttcatacagataggtgcttgttataattaaacctagggaataatcccttaggtttttccaaaactgcgagcttatggtattttcctgttgaaaatgccagagttatatatgtgcaccatttaggttccaaatgaagatgagggattttcaaattttaggttaaaaaaaaaacagtctcctggagtactaataaatataaagcattaaaagcgctatgagcttctgagacttttattgtcgtgttttactttgtacttaataaataaatggatttcctttgatgatgaattgatgtttgttatcagttagctaacagaaaagcagctaacctatcaatcaattcctagagtaagcaattgatgtcagcagttgttaatttgcaaaggaattttttgtaagtattaccgtaagactttcacaagctaatgtagaaagtcaactataatattttctgctgaccatactttgtcttataaattattcattgtagtctgagattcatctgtttctcatttttaaaactacaattgataatgaattttgggtgaggttccccctcctttataactttcttatcttcttaaatggcacccagctctcttgcgtgttcgagaaaaaataaaactaaaactaataagctatggtttcaccattctgctttgcaggttgatccagatgaagtaaatgcacttgctcaactaatgacatggaagactgctgttgcagcaattccatatggtggagcaaagggtgggattggatgcgctcctggtgaattaagcacgagtgagctggagcgtttgacacgtgtatttacacagaaaattcatgatcttattggagctcatactgacgtgccagctcctgacatgggaactaattcacaggtatattctgctttctctagtatttttctactacttcccttcatcatgtaacatcccctgtaattttgacacagaccatggcttggattttggatgagtactcgaaattccatggtcattcaccggcagttgtcactgggaagccaatagtaagtatactatacaacaacacaaatctagtttgtgtaaataaacaatttacatccagtgattgtattttggatatttttgttgtaggatcttggtggatcattaggtagagatgctgctacaggaagaggtgtgatgtacgctactgaggctcttttggctgaacatggaaagtccatttctggatcaacctttgttatccaggtcagtcataattaataatcgattgatttttgctatgcggattatttctaggatggttgaaggacaatactccatccgtcctagaatataagaagttttaggcttggacacggttattaagaaagtaggtagaagtgagaggtggatggtcataattggatgagtagtggaggtaggtggaaaaagtgaatggtggagtgctgttattggttgggaagagaatgttggtggagaagttgttatattttgggacaaatcctgagggctaaaagttgttatattttggtacgaagggagtaacatgcatcatcataacagcaaaaaaaaaaaaaaatctagctttcttcctgaaaattttaaaaccgcaattcagctatcaaatcagtctgttcattatcattttatcagtatgccagcaacatatgtattttgtttgtaataatcaatggaattttccagggttttggtaatgttggttcatgggctgcacgaatcatccatgagaagggtggcaaggtgattgcacttggagatgtgacaggctcaatcagaaacaagaatgggttagacatacctgctctgatgaagcacagaaatgagggtggtgctttgaaagattttcatgatgcggaagtcatggattcttcagagctactagtgcatgaatgcgatgttctcatcccatgcgctttaggtggagtgctcaacaggtaaaagctagtgtccatgtcgatccttaaattttctgccaatatgagttgtttatcgggtcggggatgactcttgaaactctgtccttacctggttgcagttgcattttcacccattatacctatctgttttttcttttttgtacttttgacattaaatggtacacagttgttttagacggtaatcttgttacatgttgaagaacctattttatctgattattctagttcaacagtagtatgcaccaagaaaaaaatagccaatttacatataattgatcttctgaagggaaaatgcacctgatgtgaaggccaaatttataattgaagctgctaatcatccaactgatccagaagctgacgaggtaaccacagaacaaaacattgtaccctaactttgtctttgagaaacatcagaaatgttgccaattttggcagttctgattgatgctgtatgcactacagattcttgccaagaagggagtgaccatattacctgacatttacgccaactccggtggtgtgatcgttagctattttgagtgggttcaggtaattgaaatgccggttcctacgatcttgtttcgcattagctttggatgaatacagcatctcccttatgcgctttgaacggttgcagaacattcaagggttcatgtgggatgaggagaaggtgaacatggagctccacaagtacatgaacaattctttccagcacatcaaggccatgtgtaaatctcatgattgcaacctgaggatgggggcgttcaccctgggagtcaaccgggttgcacgtgccaccctcttgaggggatgggaggcatgaggccattaacaacactcatatccatgtccgaaaatgttggacgaccaatgtctgatctgataaattcatcagaagtggccggcttggaaggagctcacttgcaataatattcaagatagatcggcgtcggcgtccttccaccgttccggcgaaaaataataataaatatattaagggtacctaacaaaaatgtgatgtttcttctttcgtttttacaaaaggccgattcaatcgtgcgtgattatagtattgacaaaaaatggtgtaagctctagaggcaatttgaatttcacaaaggttgtattctgtcattgtcattctgtggttcaaagtctgcgagatggttgacccccaagtctgaattatataaaataacattgcaaaaaaactagaatacccacatgaactgatagggcttgtttggtttgaagccaaaatttgccctaccaatattttggtagttccaatacggttttggtactaccaaaatttgtagcattgaatttgaactattatagttttaaaatttggtaccaaaacaaatatgcatttgccaatgttaaagttaccaaaattttaacaggacaaaaattggcatcaatccaaacaaacccacaatacaccctcattcaatctcaatgctaccgcagcaaaatacgcggagttgtgaatgttttgcgcctgagagaaatgtactgaaaaattgcacaaagagagagacggggatatagttcaccaggccgaattatttgagcccactagactgggggcatttaagcccaaccccaaagaagaagcaactgggcccatccatggcggctacggcccaatagtccggctccggcacgccgcaaaccctagcacccttgacccccctgcctcctttatatacacgcatcccctctcccccaatcgaaagctcaccgtcgccgccaaaacggaacattctcccaagcccctcgtatccgtcagttaatccccaataatctctcttgtatggtaaagtatattggtatctcttgtatgcacatcttcgttttcatatcttgtataatcatggattcgtggtggctgtgacgactaggtgaaattcaagctcaacagaccaaatcacaggtctctctccaaggcctttggagatgggatctgtatgccgagtttccgctcagccgagccatctatgatccatgcttactcgcgctttgtttgcctatttggctagattgtttttaaccctttggccagattgtttttttttccgttttgttctgcttggtttggtttatgttccaatttcacgagcgatgctaatctcgcacggttgggttgtttaggcctgatgccacgtcactgttagccacgagcattgagctgtgatgctatgatcaggccgagacaaagctgattctggcgtctcacaagttgataggaacctggggactgctgttccatcggtccacagagccggtttctgtgactacatttaaatttgattcaaatttgatgtttaaattggattgaaactttgtcaatacggaatcttttatggcgatgatgataaacttaaggcttgtttctcataacattcgcagttgccgcctaagagctttcgccttgccgggcttgagagctaatgctgctaactccttccttggatgtctgagccatatggttttcattacatttacatttgctattgggtcttgccattagtattcttggttatgattagggttaagttctgtctcctgtagcaatgataattgtactgtcatccaagtatccatgtgtgtggttatgttttagttttctgttcatgtgtgtcatgttttagtttgctttgctgacgggcaaatgatgatgaaatcaaggcttgtttctcataacattcgcagttgccgcctaagagctttcgccttgccgggcttgagagctaatgctgctagatccttccttggatgtctgatgcctgttgcctagtaaacttcacgtgattgatgttcaagcagtttcatgtttcatatttaattgttacatcttagtagagtgcttgttatgcctgcccagtgatgatgaaaacaaggcttgtttctcataacattcgcagttgccgcctaagagctttcgcctcgccaggcttgagagcttatgctgttaaatccttccttggatgtctgagggcccgccttgtattctgtttacaaaacttaattacatcatctccagtgtgcaattctttttgtttgctcatgttctcatttcaagatgcagcttctatcaacaggtttgcgaaagttctgcctggctgatcagactagctgaggacatgcttattcacaggttcgcagcatctacacactgtttacattttggcagtgatctaaacatcggcgatcatcacagtaagcgtgcaaccatttcatcaacacaacactgtttacatctgatacttagactgagaccactgtcctcaagctacctatgctgctccaataccagaaaacagtaacaagacataactgaggacccctgctccacggctcctccaataccagaaaacaggaacaaggcatggtatgcaattgtatcaaattggaacgaaattcccaagagctttgtatctctccgactcttgccaactccatagtgtggtttctaccaccaggtgcttatgtttccaaatgtaaaacttgggccccttctgaatgtcaaaactgagctttatttttgtttgtttgaattctttatgtttcgcacactgtctttccagtctgcgaagttacaagaatgctcgtggttttcaccttctgctgctggttcgcacttctgctcatctatctcttgtgacacaaaagtcctggcttgtttcggtttgattagtgatgaagcaattgaccaagctcactactagtcactggcagctcagttcagacttcagaacatagctgtcaaactggagatggagtatttaactattatcacttttgatatgacgtttaataatttagggtgggtttagttccacgctaaaattgaaagtttaaataaaaaagttaaaagtttatatgtgtagaaaagttttgatgtgatggaaaagttggaaactaaacctacataagcacataaaaattcatgtatcataaatatatatgagtataaattatgaaattatatgagtgaaattatgaaacgttatatctaaaagtgataaatatctaaattaccgcgctaaaaaccgtggacattcactgcccataagtacaaaactgacacaggtgtgaattgtgagaaatgcgaagccgaggcttgcataaattcagctgaccctcgcgacactcggccacaaccggcggcatggacggacagcggggtcaccagccggggcgggggcgcgggcgggcggcgccgcccggatggaccggcgacgccgggtccgggcagggctccggccccgacggctcctggaggtacgggtgggggtgggcctcggggcccggaggcggctggggctacggccacagctcggcgcagagccccggcggcaccgcgttcgggtttggcttcggcggcggcggaggcggaggtggaggaggcgttggcgggcgcggtggctccagcggccgcggcggccacggtggcggtttcggctgggctggcgggcagggccacggcggctggggagccggcgctggggcgttcggaggcgggagtggatcaggcggcggcggcggcggctggagcgctcgcgggggattccacggcggtgacagccaccggcctcagcgcggtggcggcaactgaaactctgaaaccgctggacattttgccttgcatccgttgtacacagtagctgtgtgtaatatgtccatctttggttgagctttgttacctactgaaatactactaagatatatgggtacttaagttatcttcggttcctgtataatatgtccatttttgttcaaactttgtacctgaaatgctgaaataagatagggtcaagtgcagagctgatcatgctcgtatatatattccggatcgtgttggtgatgttttaattctggactgaacaatctgccatgtctcaataaaaaggtagttcgactcaagtttctcgagaaaaataaaaaggttaactcaatacaaaatcgaacaaaaaaaaataacaattgagttcatggaatagacattctttggaggcaaaggaattgtggccctgttacagacatcagaatgcagatttcgagcttcacatgaactcatctatgataagaagtttcagtactacaaggcagcacgttcttggcatcatgggtaccaggttttttatcttccgctgcaaacgttggttttctcaatttagaccggccgtttgaaacccttctccaaatcaaggcccacaaatggaggctcctgcacctactacaatatatcaacgtttcagactacccaattctcatttctatttagtgtttgcctaaacggccacctagcccattagatggtgattaatcgctagtcagcgacaatttgtccagtttacaccctagacagtgaattagtcgatttaccgcctagacggttctagtcggtcctaggccgcctggacgggacagtccctgggcgcaattggacaatgggacagtgcgtctaggtggcgactaggcgatagaaatcaaaatttgggcgcaataaaatttggaagcgccacacggggccgactcagtatagatgaggatttaggttaccttatttgagagcctagagagagagcgctgcccatgcctactccccttttcacgccgccacaagcgagagctctgccaccgtacccaccaatttgccaccgcgccgccacgttcttcactctcctcctttgctgcttcacgttcttccccctcctctgctgctcctgctctccctctcatccttcatccttgccgtcaatggaaggtggcaaacacatcgattgaagcagtcaaacatggaaccactcaaacagccagtgccaaccctagatcaggccatcaggggactagactcccttccaccacctcacctcctctattcttccagctccaggtaaatttttattcctctcctaactccagcaccttagatctgtatcagatctgtatgtatgtgattgagtttttgagaggtatgctcatgtgttggtgttggtgctgtactgctactcccctagccttctatgctatatatatacctatatatatatatatatatatatatatatatatatatatatatagagagagagagagagagagagacacacacactaaatatgaaatataaagttctgatttatgaattatgatgtgtatactgatgtgttcgctattcctatagatttgtactaaacccaatgctttaaacccaatgctttgtgtgcagtgtcagtgcgttgtattgacttgatgatttctgaacttaactatgatttatgctattttcctaaatgcctatatttaatgagtaccgaatgtctagaatcagtatttttctgtgaaacaaatagaaaaaacgcctaattcgcctaatccgtctagtcgccgcctaatcagcctagtagctagtcagtaggtggccgtcccactagtgtttagcaactaggtgaacactgtattttctaagtccttcaaatatgtgaaataatccatgagatgatagaaccatatctcatcctcaaaatatggtgctgtatttttcgttactggtcaaaactgaagcactaactatgataaataggagcgaatagttgttattccaaatcatctcgaagtttctaacttttgctggtttcagtatttctttgaaatgtttgtacaatatcctaatagcttagtagtccaaaaggacctaaacaaatgttacaagaaccataaaaaataacttgagacaagaaactaaaccaaaaaaaggtaatctactaaccacaactgcaaaatttaaagtaacaaattgtgtcagactcggaatcgtatcaagataacatattctggcatatattgagctacatgaaacaacatgcttaaactttcccttaaaagaacaacacatttaaccattgttggaaacaattatggaagacatttgatcagcacaatgtaaaattatttagtaagttattaaatgattagtgcaaataaaaaaaatgacttggcactttgccaatggtggaactgcaaagaaagaagaaaacattaacctaataattatttcgatttcatttgtaatcacagtataagctagaagaagatttcatgcccaatgaaagaagttcaattatgcctctggaaatagtacactctcaagcctaatacaaccaaccatcacactctatagagccacagagacattttttcttcttgatgttaccattggcatcatgaacctgatctattgtatagttgtagtggtatgaaagttcttggcggggtggaatgtcctcacaggcaaagaacataatgtgaggtacactcttgtcgtcatgatcatataggacattttgtgcataaaggttaggggtgcaactatggttgatgaattttgcaaagttgcccatctttgaagcatcaacagcaaagccagcttcctcatctttatcaggacccttctgaagtgagggtatggatcttgataggccctcccaaagggcttcatcataataattatgaccaatagcgaataagtattcatcggtcgaccttttctgtgcctcttcatcctccaacacttctccaatgtattcacatacaaagcttccagatggtatgaagtcaagagttcttactccccagcccatcaatttggttttgaagacttgcaaacgaaacctaaggccatgttgaccaactctgttatgacatgtaggagggcacttgcatgaaggtccacactcataaacaagaggttttgcttctaagatgcggcctttatcattgaaaggaatctccccaccatttttcactgcacatgcacaccttttagaatctgagcatccaccaacacaaccacagcctgctggaggtgctggctggtagttacgggggtactgcaggtgtgcaatgtagcgatagggcattgggtactcatcagatattgaattaacaacagatacagggatcttctccaatcctcgggatatatcttttatgataataccaccatatgattcagcttgtcctgaattcagaatgtcttggatgtcaatgtgtttctgacctgccattcttctcagtcggaacatataaacataacgatcattaccctctttctccctccagtatttctcgactatatataaacccccatatatataagtagggatcttctttcgctggcagtttccattgaggtgagtgacgaaaccatggataacacggactggtgtgttagtgtccatactcttcttgagtgctaagttggtaccctctatcttctgattggctatagctgtcattgctccagaatacaccaagacatccaaattattcttaatatcggaagattgtgcatatgatacaatgctaacagctatgcaagtcccatcctcctgtttgatatgatctacacccacccggtgtgggcgatgaagaccaacaacacaaagctctaccctcaagtggaagatatcaccaactttgattccaggcacattgccaatatatttcttctcatcgcagtctgtgatgaaccgctccctgaaaattctgtaagcttgtagatcaggtctaatcactgcttctgtcgacttctcttcttcttcatccaaaaggtccctgtaaattaagcgaaaattctgcagagatcccataatgttttccctagcgaggacaactccattctttggcatcccttgactaggaccatccatgccagttttgctcttcttatatggagttgatgtttccttctcacctttcactgagaaatcacgcatggccgagactctaacaccagaatgagcactcgcataacaccggacagaacttcttgttgctggagtgcacggtgtcgaagagtcttgggctctgtagaattgagtaccagagggccctgaagattcactatcggagcagaaagctttcgagaacgaccgcttgaacccaacctggaacctccatggaagtactaccttccgccccttacgattcgtttcgtcgccattgttgccaggacatgctaagttgctacttttggctgcagcattacactcatcggcacctccattgccactgtcatttccctttttcaccttcggcgcgcaatccgcggcagaagaaccattgctattatttacacaaggcttcttcaaaccctcagaaacgcattccccatctcttgcatcgctgccgctctcaagatgcacatcagcatctccgacgatgccatcggggttggacttctccaaaccacaatcttcggcagctgccgttccaacgccaccgcccctgccattcctcaaaccctcaaatccggagccctccgccgcgacgccggatttgcccgaaccgccgtcgtctccggcaacacggggaccgccctcctccacgctccgcgcatcaccagagcccttcgcgctcgcgctgcgggtgcatctcctcgattgaggatctccccggcctccactggacccgacgccttcccccgacgcccccaacccgcgacccttgccgccgggcgtgcccgcgacccctcctccggcaacggcggcggcggcggcagggggcttgaccggaggcggcctgacgaagcccggctggaagcgccacggcacgagccccttgtacctccgcgggccggccgccctcggcggcaccaccacctccgggatccccatccaacgccccccgcactgcccccaccaccaccagaagcctctaaccctgcacgcggagatgacgctccacggaggcagcggggagggggcgcggcggaatggggccaggtgggtggggtgggggctgtcctacaatggtggatcgggga

SEQ ID NO: 58717 - DNA, 13357 bp, Oryza sativa
taagaagaaacaatacagttgaaggttagaaaaaacatgcttacctattattatgcaccatatctgatctttgttgaaaatttcatctagtacaaattatataaggcaaaaattagaggtgaagcatgataaataaaaataatctaactaccttaattcagttacagttagaaataacaaaagttacagctgtaactacagtgcatatggactgtaactggaatcatgcttaactttctcctaaaattcaatagcatcagcattattccatattgtaacatgttataaaatgacccaaaacatgcaggatgtcatagattgcaggctcaagttacagggaatacacaatcaaagacatgtgtaagtgacataatcgactccaaagaattaagaagcaagaagacaattcaaggtcagaaaatcatgcttacctgtcattggcaccatatatgatatttgtagaaattttcatctagcacaaatttatatacattaaaaattagaggtgaagcatgataaataaaaataatctaactacctgcattcagttacagtgagaaataataaaagttacaactgtaactacagtgtatatggactgtaactggactataaggggaatacattaagcaaaatcaacatcatatgaagaattagaggctaaggataatgcagtagtatgtgaaagcaaaactaatagagtgggacttattcagattcaaaaatataaatcaagcagtatttagcctcaaaaatggtgtcaaaacaataaaaaaagcctttcattttgtcaacatcatatgatttttttttgcaaaactcaaattttgactaatgatgctttcattttcagttctaggatctcattacctccaggattttggaaaaaggcaaaaaatcagcaacaattggatcagagattggcaaaaataaagcacaaatactttatgatcaatacacatttcttaacgaaaatgaaagactggtaagtacaatcatgttttccaaaaatgaagaatatatttatttctttgtcgaataaatgtaaacaggtgaaggggggacaaatgagctatactaacctcatgcaacacataattctaagtccacgtgtcagcttgcaagcaaatgaagtatcggaggtgtacaacttgggaattttcaaaaagtaaataacaatttctgcaagcatcggaggtgtacaacttgggaattttcaaaaagtttcaagatgaattaatggagacattaaatcttgaaatgtcagctatacaacatggaaagacatacaaggtatatgcagctgcaaatctaatatactgctggttcacaaaccagacagaaaaatgttttcacatttacttttactatgcagattatattgctatatatagactatgcactgttcagcattcagtacagttaaagatttgtctcatttcatgctctccccaaagaagaaacacaaaacaactctaataaaacatgcactaaatcagaaatgtcaattaagaaccatacagtccatccaaagtcagaagctagctctgcctcatttcattggcagagaagaaagtacacaacatgtacccaagaaaagggggtacgcactgaaaaagcatccagatttttaacttgaaagaacatcaaattcagcaaaaaaaaaaaatgaagccaagactccccactctagcccagagacaaaattcaaagcaccagccttaaattcctgaaagcatcatacaagttctactatccttgttcaagcaaaacaaattctgaaccaaagaacaacatatacacagaaagagcaacaaaccaagaatcaaggcaaaacgcatgcaggggattggatttcatttaaccaaacaactcagcatactgggaaatcaagccgcacatatctgaaaagaagcgattcataagatgaagaaggcaacacaaaacatacttggggatgagttaacatgcatatgtgaaacgaaattcttcatatgcataaaaattcagatatacgcagggagttgacagatcaatcatctctgaaatgaaaatgcttcacatgcagaaaaattcaaacacatgcaaggcgtttaacagatcagtcaactaaatatctgaaaatgaatgcaacattcagataaagttgcagcgatgcttcccctactgtattcaaatgacacatatcagcaatataatgttgtcataattaattccccctaccaatcctactggggtggagctaggaaatccccatctaccagccacaaatccaagatcagtgacaagccaaaaaaaaaatcaccgattcgctgtgcgctaaccccacatcacacaaagcacaaaatatacactgatctgctgcaagtgatttgcagatttgtgcatagtaggagttctactccagcagaaacaaaacacagacaactacatgatactaacatacaaaaagaacacaatgagaggccagaaaatactggattttatagtggcttgttgctaactaatttggatcagcaccactgaacaatattgggatgcattcataattgaaaagaaaaataaggcactgagcaaacctgaaaaagtattgatacagttattatatgctcataataagatcaggaacacacagggaaattggcaagatgccatgccagatttacttggcatcattaagaaatatgaaacacacatggtatataccattaaccatgtaggtgcatcattcaaaactatggaaacagagctaagcttatgtgtgaaaaaagcaccccttggaaaataacctcttctcctaatcagaaccatagatgtctgccaaaaaaacatagctaagcttatgcgttgaatgtggcatcttcttcctacttttccaagcatagacacataaaaaagctgtacagagaagcaaatcaatgattacacaaatttataactgaagttgcacagatttgaaaatgcaactacaacaaccagggagtgcaatacgtcgccgaatgtatatgcagtttacacaaaacaaatgcaagcccagtccagtcctgaaaaatatggtgtgctagtacgaagcatcatttgctatccgtcggtactcaggcatgtgctgggtgaaagtgaaccaagaaacacagagaaacatttcagaaagcagagttgtctctcttcgcctcccatgcaaaattttgaacaagcaaataatctatagaaatatagcagtgtcactgtcttcagtcagggagttcatttcgtgatctctgagccaaataagatcgctgaaacctttcaaaacatctctctctctctctctctctctctctctctctctctctctctctctctctctctcatttgacaagtacacagttcatcactaaatctgctgcttgcatatcacatatacagaaggagttgtgcatgttaagaacagaaggaaataacaaaatcccctgtacaggacagaacagaacagaggggaaaaatcctagcaaacctgtaaatctgctaaaaggatgtccaatttactccgaaaaatgcaaatcaaacacaaaaaaaatccctatctaccagccacaaatccgagctcagtgacaaggcaaaaaaaaaaaaatccagccatcgtttccaccgatgcctagttcgttggttacgatttagtctaatcccaaatcacacaaagcagaaaattgatatgctgataatctcatccatgtactctatctgggcaatccctctcaatctttcatctcatgaacacagaaggaaaaggtactgtgaaagttcacctgcaaaaaaaacagaaataacctagaaaatttcaaatagtgtgtcgctttacctataaataaacagatcagagcactgctcacctagaacttaacaaaataaaaaagcaacagctaggcagttccctaataattatttgaacatataaatctcatcggcatgacatagaaatcaacagatcagggcactaatcacctagaacatataaatctgatcaacaatacatagaaatcacggatccactgaaactaaaacgaaaacgaaatcgactcaggaccaagcttcgaaaccttgaccgattcaaatcgagaaaactaaccaaaaaaccgttgaaaaaatttcaccagtgggaactacaaacgaagattggactcaccggttgaatccagggggagaaaatcgatccaaacgatggatctctctccctctcgctggagagaatgagagagagaacaagaaagcgagagtgaacgaaagagagagcgcgcgcggagacaacgaggagaaagcgataagtaagaaaaaaaaaacggctacggacatggcgtggaaatcgaaatttaacagcgccacgagaccgaggagaccaggttttgactcccacgcgtcctgatccaaaccaaaccgtgcacgcatcttaaagtatatcggactaccaaaaaaaacgacaaatatcgggagaagaaatttaatgacaaatatctagcaaaatcgtttttttttctttccctattctatcaatatattccagcactgtctaatactagcgtcttctccgacgacgaaaaaaggtggtagcaccaccagatagagggttggccggcgctacggtgggctggtggtggccatgatggggtggagatggcgccaccttggccatgagataaaaggggacggacggtgtgggactgtgggtggcaagagaagcttgttgttggctgaaattcaacccaaaactactgaaattgcaccttagtaccttacatttaccttacttaaaaggtggtttcttgacgaaacgtaaattacaggtagcgcatttttcttatataatgcaggcagtacatttttgctgctttatactagcaactgcaaatcttgttcttattcactaagcgatataagtctatatttattctcatcagtagtctcttgggctaaatgcactcactttgaactccacaaaagcgatcaccaattccttcccaccaaattttcacttctttagaccgaggaaggttaagacgaatccgacgtaattgtaacggtagagctgtcgcatcatggagatcttgctgtcatcccacggcgggtacctggccgtcagctcgataaggtatcctctcgtcagaaccgccttcttgtggctgaacatctcgaaggagtacttgccgtggtactgcccgaatccgctctcgccgacgccgccgaacggcagcgaatcgatcccgtactgcagaggattgccacaagaaaagatgacatcaaataactctgtagtacgtactggatctgcaattcctatgttcttgtttggatgggctcagtttggcccatataaactgatgggccgagattgaagcccatcaagcaaggcctgggtggggtaaggcgtgtgtgcatacttgtacaactgcgtcgttgaacgtaacgctccccgacgacgtctcctcgacgattcggcgcctcagtgcggcgtttttggtgaacgcgtagacggcgagcggcctcggccgcgctctcacgaaggcgatgctgtcctctatcttcttcacctgtgagaaaggtagccgtttcatttgatctgtctagtggtactccgctctgcatagaggaggatgttaagaactttttaatttaccgtgatgatgggcaggagagggccgaaaatctcctctgtcatgatcgcggagtcgagtgggggattcagcagaatcgtgggctcgatgcacctgaaattttttcgtgagttggtcaactttgggttgtcttaccgacagattgatcaacgacacgcagttttgttcagaatttacaggttcttggcgtccaatgtgcccccgtggaggacggacgccgcgaccgatttgtccttgagaaggtcactcagccgctggaagtgcctcgcgttgacgatccgcgccatgtggtccgagtcggcgaagaacttcttcagcgtcgacttgagcgccttgatcttcggacgagaccgacacgtgcacgccgcgagacagacacacaaacgtcaggcacaaatgcgactcgggtagcaaagcagaggaggcgtgacgtgaggtgaaaacgcaccaggacgggcacgaagcgctcctcgacgaggacgtagtcgatggccaggcaggcctggccggcgcaggacgaccacttgcccccgacgacgcggttcaccgcggtctgcaggtcccgcgcgctgccgccgatcgtgtcgaagatgcaggggcacttcccgccgagctcaagcgccacgggcgtcaggtgcttcgcggccgcggccatcacgacgcgcgcgatgcgcgggctccctgcaatgccgcgcgcgacagaaacccaacacatatcaacggcgtttcagccgggggacccaaaagctaccagtgtgtcctccatggaccatggttatattaccggtgaaaaggaccttgtcccatctgtgttccatgagctgctcgccaacctccggcccgccctggatgaccttcacggccgtggcgtccatgtatttgccgacgttgtcgccgaggaacttagcggtggccggcgccagctccgatggcttcagcgcgaccgcattgccggccgccaatgctccaacgagaggctccagagagaggcctgcatgcatagagcacacaaagtcgttgcctgattagttgatacagtacccaaaagtagccagtcagtgtactacccttgtccctcatggcctcgtgggcacccacccttgcgtctctactctctggattattacatgcatgcatgtgcaaaggctgtggattgtggtagccagagtgacatccacaggcgcagaccgcgcgcagatgaacggtcagtcatttacgtttttcacaatttcactgcctgtgaaaattctgactgctgtatcacatgctagctagtactatcaccgtcccaaaataagtgcagctatagatattcgtgcccaacgtttaaccatctgtcttatttgaaaaatttgtgaaaaatttaaaaatatttagtcacacataaagtattattcatgttttatcatctaatagcaataaaaatactaatcataaaaaaaatttaaataagacgaacggtcaaacgttaaacgtgaataataaaaaactgcacttattttaagacggagggagtacgtcgcttggtttatgctgaggcgagcatagcaggggtacacatgctaatacgctgtttttgcaaaaaagaaaaaaaaagtagaaagtccaaattacccttttgagcacacagtgaaataagtatgttgctatagtaaaaaaaacagtgatttgcagtttttactgtagaaagtcacggtactgttaacctctgactttaacacctaaagtcaggatctcaatccgtacgaattacctctctcaattaaaaaaacaaacatattttttcaccctcaacttgttacactgaacgaaggccaactccaaagcagtttcagtcctacgtggcacacacatggaagtccaatcagcataaaaaatatataaacaaatatggggcccacttgtcagttatgcttctcttggtcagtacatgtggtccctatctttttaatgtatttttatgatgactggactgccacatgtgtcatgtaggacctaaaccactttggagtctattcgagggataattcgtctggtattaaaaattgaggacgatgaagaatgtctagttttttaattgagggaggtaattcgtagtactacaattttttttttggggggagggaggggtattcggattttttcagaaagaaacatgctgaacattgggtttgacgactgaagcaatattctgagacaacgccccaagtataaactgattgccacccaaaagaaaagtactttagttccaactatcaagcgtcaaactagctaccaaaagaaacagtggtagctctgtgtatgttgagtttttctgggacggagagatatattcgtctgaagtactactacgaataatcaaagtttgcatgttagcaactggccctactagcaacaggataccatagcacagctattcgctgttacttaaactcaaaagctgtattgaatccgacaattcaaggactatcgtaagctaatcatgtgcactgagctatggtactagtacaccctttgagctgaaggagtgttggccagccagacaatcggtaggacgtaaatgagtgttgctatacgtccgatttcctcgtccgacccccatccaatccaaccttatctaccaatcgtttcgctccacgcagaccaacttctctctatgtgggcctctatgtgggccagagcagttacggagtagcagctaagtgctggtcggacataccagtcatatgtatagcgattttcgacgttaaataccctcacacaaacacaataaatcgaatagagccttctaatactccgtatatacgtttgctatatatatattgctattcttctatactcttgtactgctagcagcatgcatcgccgcatggcaggcagccatagctatatttgtcccgacaaagtataggtgaaaatttaatggaccgattcatcaatgcgagagtagcaccgttttcctgacaatgcttcacatgggcagccgcactctctgctaatgctcttgcttgaagaagggtaaacgaaggaaaaaaaatcgctgtgacctgtgagagattgatgatggtttgcttacccaacgggacattccagcaagagaagacgaggatgaccccgagcggctgcggctccagctgcgcccttgccgggaacgcgattagcggcacccagacctgcaaccagcgaggcgtcagaactcagaaccaggagaagcaaaccattcatgtaaaataatcgaacagtgcacactaaagcgtggtcagatcaggcttgccttctccggcgccatccatttcccgacctcacgcagcgcggcgttcgccgacttgacaagcacgccgatctaaaatcacacaaccattcgcatatatacaagttaaacggaatcatatcagcagatcgatcagttggcagtttggcacacgggaaatgccaaatgcatattcatcgccaactaatcaattaacctcgtctctgtaggcctcggcttggtgcttgccgaggtcctcgcggagcgcccggaacgcggcggcctcctcctccgccaagagccggaggagcccccggagctgcgactgcctccactccaggctccgcgtcctgccgctctcgtacgccgccctcagctcggccaccgtcccgctcacggtctcgccgggcccaagcgcgggcggcggctgctcgcccccgacctcctcgacgctaggcgccacccttcccatcctcctttcctcactctgcttcaccaacctcactgactcactccagtgtattgaaactttgcaagcagaaagttgaagaaagcctcgggccggcgaggccaatttatggcaactgacgtgcgcttgagcctatggcctacgctacgcatgaatgcatgatacgaattaaatgctggcaccagggcggttcagtagaattgacgtccattattgttgtaaactggtgcaaaggtgcatcattggtactactgccggttgctaggaccgaaaaagtgagcacatgccatgcgcccatgccacggagaaaacttgaggattttgccagggccagggcgatccatcgccgtccgggtgagtacgagggcgtgtgctcgtagcatggttgtgaattatattctaataatctaacctataattcaccaactacctcttacatccttcatactttattcatcaaatctaacggatgaaaatcatcgaatccaaccgctcctgttgccccacgtctcccccgcctccccttctcacaccccatcactcctgaaatcacggcgcatccaccctcctctctttctctctagctcttctctcctctctctctctcgcactcacccgacgtcgccccacccgcgcgtcaccgattccccatccacgatttctctcctctcccgcgccgcccctccgtcgtcgtcgcgtgaagtcctcgccgatcccccgcctccgtcgtgccgatccaagtcgcggcatcgtcaaacccctgttcccaggtcgccgtcactgatcccgcatctcctctgccccgttcttgccgatcccccgcctccgtcgcgccgtcacgtcgccgattccctctcctcgtcgggagcgccgccgggttcagtcgacgctgatccccaatttgttgtcgccgcctccttctcccctgattgaagtgttgtcaagtttctccgaggtgtttgtttttctgatggttaaagtgtagtacaaactgtgcaaataaaatcaatgttttcatcccgttcatttggtatccatgactaaaattttcatcccgttcatttggtatccatgactaaaaattattaggacttgatctagcctgagatagcaacgatcgattcattttttttcttttcaagttgtgctaatgtatgtatgttcagaattacatgccatttgggttcacatgtcattagagtagctggactttcattcatttatagttacaataattcctgttatcaattctccagtggtatatttgctgaaaatatatgaaacttatgaaacttgacacaaatctcacatcttaatagatcaaaatatatgtaatactactcaaataaacttttcctgaaggttttctattgtgctatatgtattatattttcagatattcacaacctattttatactgttgattactgataatatgggaagcattggtaagatgtacaggaatgatgattatagatatatggtacagcaaatttgtctatcaccaataccatgcaatttaatgattttgtgcagtccttgattaatgacatcttgaagtatatatacagttaggacaatgtcagattaaaatctaaatccatgcttacagttacttcacatctgaagtaagataaattatcctaggaattaaatccaagattttattggtattttggttcttaggattaggatttttgcatgaaaagagtactactagattgcagctaggtcaaggctctccctgaaacagccttttacatggacactgcatagtaaggtccagtgagttttatcatttcagacgtgtgcaactctctgttctttactccttgcccaaataaattgctctatataagatatccagttataagctctagaattttgaatttgatttttttttgctcatttttgcctactgcacgtggaatggatatcctgcttaatgaatactatcatgctgcaggatatcctgcttaatgaatactatcatgctgcacttttcctttttgttttggtgaatttagtactatgcagttggccttgatcaattcgtgctacttttgtttgcagttagtgaaactgagtttggttctttctattctattcagatacattgtttcatgcatgatcaatgactcaaatctcaatgaagataggcatattgctattccaggttggttatctgaatgtgcgcaggtttgcaatttgcatatcattggatgtatatggttgataacttgatatgggagtaattgggaaatctgtgataaggtatgaaccttcccttttgaagcatttctacagcaccattgaagtaccacatagtttttttggccatatttatttataaccatgcaaggaataataactcttcctgattagggctaatttttttttacaaaatctatgattaacagaattgttctaatttgaaacagagccctctggtttagagcttgatcagtgagttaaaaaaatggtagaatatgtgagtaccgaacatgttataatttgaagcgcactcctctgattgaaaacttttgaccagttaggtttgaactttgaattatgtctcatctttatgcatatactttctttcatttcaggtgagggtcattttatttagagattgatttgaaaaaattgtagtaataactctttctaattagggctaaattttgtataaaatatttgagtagaagaattgttctgacctaaaacggagtcctaacatgatatcagtgagagttacaaaatggttgtaatatctgtgagtacgaggatcgttctaatttggaactcaactcctctgatgacaactttaatcaggcagtgtgaattatgcatttcttgttctcatgaacaatatttgtttgaaaagtgaaagatcagaggtatgttttaccacggtggatgaacagaaagcccggtgaggatgacaaacatggagtgaagagggtatgatgtatgctgtggccagaagaagttgctcctatgatggaaattgtgagcaagacaggccctcgaatcctttttttttccctgatgaatctgtaatttggatatgctgctggaatcggttgaaatctatttgtaactccactttctcatttcccatcatatatgtatgcaatgctgaaagtgatgtgaagaggggaatagatagcgtgtagcctggcagactatggatcattggattgcatctatgttttcgttggtcttgcgggtttgagactttaagcttgagaatgtatttctatttttggatttgtctttctgtcatctcgatggatggatattgtgggtttttagttaacttttacctaactcattttatttatgaataaaaatgtaagtttaataacttattatttattcaaatgttatgggataaaatccttatttgtctctgaaggttgacatttaccgaatggtaccgtagcgtcagcgcacgggtaagttactagtgtgaacaattcgatgggaatacgggattgaccatgtgtcatcatctgcattactgcagggagaatcaacatacgtgtccgatctgcgttcgtcgtcttcaaggtgatgggtcgaatgcgcatgcttcagccgttcaccgccagggaatatgccgcgcgcgttctgatacgattcattttcttgtggacagatgagttctcaacgtataaaccttcgcccccctcaggccttccagtaggacgtaactacacagcgctaccacttcatctataaatctataagagcacaccatctacctatatttcaaatacaattttcttttaaactactcatccaatctacgatccgattgcaccgttgtattcgtaacaattaaatctttacaacaagatctcacatgattatattttgataaaaatcacaaattacttttatgatatgtctaaattacttttaaatatcactaagttacttcttagatatataaaagtaaattcagtaaaacctaaaagtaatttacat

SEQ ID NO: 58718 - DNA, 25478 bp, Oryza sativa
ttgtcattgagattttaaaaatcgaatatgattatcaatggggtttgttttttttacttactataagtcctggcaaccgccttactcatttgcttcgcggcctgcttgacgtccctccttcacggcaattgtgttttattaacaatttttatatgtcgtatcaatcgccaccactctactcttttataggcatgttacttaacttatctcgtcatgtgttttagatggtcttttctttcaataatctttatttttatcaaaaaattgagttacttataaattgtattcctaattgaaatcttatttttctttttctaatttcagaaattttttaaaaaaattagttaataccgtattgtgttcttttaatgttttaatttcggattttattttatttttatttcgaattttgatcaatctcatattgggttcttatatggaaccttctttcaatattgcttatttttaattccgaatttcagctatttttaaattgtatttctaattggactctattttcttttctaattttagattttattttatttttatttcgaatttgtattaatctcgtattgggttcttatatggaaacttctttcaatattgcttatttttaattccgaatttcagctatttttaaattgtatttctaattggactctattttcttttctaattttagattttattttatttttatttcgaatttgtattaatctcgtattgggttcttatatggaaacttctttcaatattacttatgtttaattccgaatttcagctatttttaaattgtattcctacttggactatcctttccttttctaattttagattgtattttatttttatttcgaattttgattaatctcgtattgggtttttatatggactcttcttttaatattcattgtgattctaaaaatcgaacataactatcgttggaattcattttttattttctagaagtcccgtcaaccgtcggtggctctgcaactatactcttatgcaccccgcgcgctgcttctcctttttattgtcattgagattttaaaaatcgaatattactatcaatggttttttttttactttctagaagtcccggcaaccgccttacttgtttgtttcacggtctgcctaacgtccctcaatttaatcgtcattaggattctatttgttgttttattaacaatttttatatgtcgtatcaactatcaaccgccaccactctactcctgccaccactctactcctttataggcttgttacttaatttatctcgtcatgtgttttagatggtcttttctttcaatagtctttatttttatcacaaattttagttatttataaattgtattcctaattgaaatcttatttttctttttctaatttcagaatttattttttaaaaaaattagttaataccgtgttatgttcttttaatgtttttattttttattttcaatttcagttgtttcaacattgtattcctacttgaactctcttttaatttttctaattttggatattattttattttttattcaaaattttaattaatctcgtattgggttcttatatggattcttctttcaatattgcttatttttaattcagaatttaagctaattttaaattgtattcctacttgaactcttcttttattttcttttgctaattttggatttatttttatttttattctaaattttaattaatctcgtattgggtttttatatggactcttcttttaatattccttatttttaattccgaattccagctatttttaaattgtatttctacttggactctcctttccttttataattttgtattttattttacttttatttcgaattttgattaatctcgtattgggttcttatatggaaacttctttcaatattactttttttaattccaaatttcagctatttttaaattatattcctacttggactctcctttccttttctaattttgtattttattttacttttatttcgaattttgattaatctcgtattgggttcttatatagaaacttctttcaatattactttttttaattctgaatttcagctatttttaaattgtattcctaccttgactctcctttcctttttctaattttagattgtattttatttttattttgaattttggttaatctcgtattgggttcttatatggaaacttctttcaatattgcttatttttaattccgaatttcagctatttttagattatacttctacttagactctccttttctttttttttctttttctccgattaatgtgggaatttttagcccccacagcgaacgtggtacctcattttcaagctgtcttaataatataatagatagatgctgcagctttgctgtaacctctagaattgtgttttttttttgaataaattttaaacgtcgtaggacggaacgaatattattttctcatttatgtgtgatatcgcctgttgatatggtatctttccgagataactgtaggtgtggtgtggcatatagcatgccaggttatcttgaagttgaaatgtttttttcccctcaacaatgttaaagttctaaacagtctaattaacttaaaaaaaatgttatttaaattgttcatggagcacaattgatttatttagccatgagcacaactgatgtcacactgaaatatgtcaatacaactatagaagatcacttctattttggtttgaaaagtcacttcctttaacacatagtgatgatatacaaaacagtacgcacacaatacgtccttttttcagctttgtcttaacacctgaccatgcaaatttagctatctcgaaccatttacaatccaaagctgaatctttctacggattgctttgtaaagcaccttctttcgaagagaaaattgttgcagtctagtctgaaacaattgcagcccactgcgattaattgcttcataaccaatggagtactagttttcttctctagggaaaacgtagaacttcagaaccttgaacctcacgtcgacactgatctaaggtggtgtttacatccagggacttaacttaagtccctgtctttagacactaatttagagtattaaatatatactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgataggaacttaaaagttttagtcccatctaaacagggcctaatactaacaaattttttaagataatggaataaaatttcagcctatgcttaactagccatagcccaaaatactaacaaatagtactagccatcgaaacattaccccctacaatcccgagcttagcaagaaatccccaaccttttttcatacggatcatcagtaatccagtacaacacgaagcaggttgctgatgtgtggcggcagcgagagaaacctccaaaggttcatatcctttttcacaggtcgaggaagccggtggtgcgccacaccgcgttgcgcacgcgccggaggtcgcgccctttcagcgtccgcccggcgccctccatcaccgacgccgccgccgcggcgcggcgcgcggccatctcgtgcggcggcaccacgagctcgtcgtcatcgtcctcctcgtcgttgagggcctcgtgctgcacaccacggcgacgcctgtcgctgtccgtggccttgggccaggccggcacggcgaccggcgccgactggtggtacggctgcgggggctgctgcctctccgggcgtgccttggccgggatggacgccgtgggggcgtgatcgtcggcgaggagggcggacaggccgacgctgccggcggcggggaaggcgtgggacgacgacagcggccggcggacgcccacgcccgcggacgcggacggggtgagggacggcgaggaattggttgaggaggcccacgaggagggcgaggtgttcgacgacgacgacgacgaccagacgacgtcgcgctcgtcgagctccagctcgtggtcgccgctgccgtcgtcgggctgcttgaggaggccgaggaagcggagcgacggggacgtggcggcgccggagcggcgatcgggcttggacatggccggggagcctcggcgctcactcgctcagctgccgctgccgcagcgcctgtgccgctgtgtggtggctactgaccagcgcgtcgtgggttttttttagcctttgggcgcgctgctattattggcgggctagtggcggtcgcgatgtgggcggggggaggtgaattattgtggggatgatggcaaccgagcccgagcggggtcgccatgtgttggcgactccgtgtcgtgtgctcgccgcgcgagggatcgcgtcgtgacacggccgtgccgagcggcgcctgaaatccaccagccttttccgaagcctctgcgcctggaatctggaatcattcctcgtaaaatcgtcgcccagaaaaaaaagcagcgaagcttttcgttgacaggtgcgtgcgagcagaacttcggagttcagaagcagtaatatcgactgtatatgcgtacagatacactcgtttacagatgaaccgatcagcatgtcatcatcagcaaggaagtggacagacttggtttaaaatggggttacagataaacaatcggatctcgctagcatcactagcggatgtgcgttccccttgatccaatggttatagaagcacgaatcacggaaacgattgacagggcacctaccacccccaccgtccctattccctgcacttactccctccgtcctaaaaaaaaaaaacaaacccagtttccgtgtacaacgtttgatcgtccatcttatttaaaaaaattattaaaaaaattaaaaagacaagtcacgtataaaatattaatcatattttatcatctaacaacaatgaaaatacgaattataaaaaaacttcatataagacggacagttaaagttggacacagaaactcagggtaagttggacacggaaacccagggtttgccttttttttttggacggagggagtaggtttttctttgttgaggatgaggaaaaaaaaaacgaggggtgcgatcaatcaagcttgacacggggaaaaagaaagcttggatatattattagccggtgaggccgcttgtgtaagacgtcagtctgtctgttcgtttcgtttcgttttcagtattcactcgttgccaacttgccttccgagcccaaattagctgaatctgctgcttatttcttggacgtgcagagaccttcgaggtttatgcaggctcagacctctcgagatttcacagttttttcaagtgcacgtgtggcagaaggatggaagccttggagaatgctgcttgggaggtaaaggcgcttatcattttggttttgcaaagatggggattggtgaacactgaacagaacgacaaagactggcaaggttatttgtttgaccacctctttaagactttaaccatcgggaagaaaattacgtactaactttctgtattgttggcaaaacaaaaggacctgtcaggctcttacagaaaaataacagttctgtgatcggcataactcacagggcactacgcaagtatctgcaaggaaccaaactatgaacgtaccaccgaggcatctcatatactctccactagtaggactagtaaaactgaagataagagtagtacactatcggcagaactaccaatgtacagcaatgataaatgaaggggccaaatgaaatgagaattgagaagatacccaatacacttccagatcgggcaaggcattagcaatttcaatcaagtaagaatttacattctaatgatgttgtggtcccatagaagatcccaaggggcaagggcattgcactagcattgttagctgttacacttacatctcatgagttctgacatcagttcacgaaacaccagaattgtgcataaaatagcttctatcaactaatctcagaacaataccatcaaaataagttggaaggagaaacgacagaaacacacaacctgtagaaataggttcaggtggtggaagtatcatgagatcgccatctttcttgcttaaaattccgatcacgctcaatcgcataccttcagcgatatacctacaggttttgcattcacattttaagtttccaaagatgcaatatgcaaagatgctggcaaaatgtatatctattatcgagcaatttgattacccttcttcgagacggataagctgacattcttcagaaggaatatttctttcatccagccaacacctcaaggttgaagataactcagtgttcccgcttgtcgtaaccagaagattttcatcgatcaagggaactactctcgagtcgtgcccagctttcaccaaggctcttttacctgattttgcatccgttatgtagaaatcagcagcaaacctctgcccaactccacaaaatatttgaataagacaaacatcacactatctatggcatcttactgcctttataatgaactcaattttacagcaacagatacaatgacattagagaaattaaaagactactaaataaacaactcagacataacgcagatgagcaacagttttaaaattgtgaaaaatgggtaatgtctactcgttgatctacttatgaaatgtattgttttttttgttccattgtactatgcagtcaagatctctcgaactttacatacaactgagaaacggtattatgaatttccaatttatcaccaatattgcacaagtggaactggaactgaaacaataggttattactaattgtgtacaataataatgcaagctagtttatgaaatagtaatgcttttgtaatcatcataaaaaacaaacacactagtattacagttggattgaattgggctagcttgagtcatgataaacaaaaaggtgaaacaataattaaaaaaacaaaattttaatgacataaggtgcaagataaatgaaaatacccatgtgttctgtagactccaccacacatacactagaagcccttgagatagcaacaaagcatccttacctcagcgtgtgtcaatttccacttggaacagcggttcttaggattagctacttcagaaccccatcttccacattttcgcaataatgtagatgtatatacacaattctctactttctcgtatgaagaaatcagtgaaatatcaccgcacgcaacaagctgcataaaacaaggggcatcaccacacatgcaagaataacacattatctgattttttttaaacaatgcaagaataacatgctgaaaactgaacacaactaaaaagaatattttttgtaacaagagtagaacataatgaaaaacaataaatgtactgtaataggaaaatgtggaaaaaaacacaaatcaatgcatcacagcatacactccctaaggtaaaaggcacaaaatttccccttcagactagaagatacattcaatgtactaccagtacaaagttgagaaaggaaacaaagaaactgcccttgactggttcgatatggccagtgaacctactgcatacaaatctggacattgctgtgcttgctccccattgcacgattatggaatccataatttggcgcatcctatttacactgaactacgtgaccaccaaaaaacgaagaacactcaaggtgcaaacaaaccccactatgaaacaatgcaagtgtatccggtccacaattccacaagttacatgaaagcactatatgatgtagaattacggcaccaaatgcattattctccatgcatctagtggctccaccaaaatgctccttatcaattcagcaattcagaattcagagacttaaagacggaataaaatagacttattggatcaatagcagcacattcatggcaaaagaaagataatgcttttgcaaatgggcaaacatacaccggtgatcttgacgagctggtcgtcggtggcggagcggaggctggacgcgggcagcccgtccacgaaccgccgcagggcgcgccccgacgcggaagccgcggcattccacaggaggaacgcgacgacggccgcggagaggagcacggccaccacgagcagtgcggcgctgtgcacgacggcgaggacgagcgcgccgaggccgagccccaccgcgagcagcgccgcgaccgcccaaaccgccgccctcgggaacggcgccagcgcggggagcccccccgcatccccggcggtggcgcataggtcgttcagcgaggccgcggtcgcggcggcctcctcgtcggcggtggcgccgcggtgcttgccgccgtcctcgcctcccggaagcataatcagctcgcgccgctgctggggtgggcgtctcggggtcggggggtttcagtttactcctctttcttttttcctttttttcttctattggacctttttgtcctcaactcggtatggtgggtttggtttttggcgtgcggtttaaggaaaccaacgtggagcgcatcggcaactctactttagcgtgacatgtgggaccataacaaatctggcccgcatgtcagtgacacagacaaggctgtggggggtgagctgtggagtacacggcgtagttatcctcctctcgcttttggagcaaaaaggagtactagcaatatgacatgtggggcccgggcaacctgtaccgatgtcagcgagagcccgtggtgcgatgcctcgtgcgtcggagaacgtggaccacgggatcagggcattgcgtgctcacatgagctgctcctcatcactgggttgtgagtgactgacactgaagcggttggcgttgtactcgcacaatttgtgtccctggctagtggggcccggttcatgtgcttaccgatcatgtgtacttgatctagtactagtactcctagtaccgagtgatctgtactagtactatgcacaagtatggttgggggcaaatggtatagtagtacaggaggagctaagcagaagaattaagaaactgacacagccttaacctacgttttgggtggattagttaacagtaatctcatgacctcatccgacgagcggttttgagccgttgcgagaagaggaagcaaacagtcacatgcctaatcttttcgatactctcaagtttgaatcgccacttgccccgagactgacggtggtgcagactgcagcgacctgctctgcatcacaccactcgtatacatggaggcgctactgcgctagtggtgctagctagcgctgcgctgggccccctggatccgatctgcaatctgatccattcaattgtactcgccgtactctccctctcggtcaatgctactgtagtatcgtactcttgtggccagccgctggcgtccgtggtactgtacctcgactggttgacggaagcggcgtgatgccgtgcgtagaccaacgcgccatgtttcactgtgctctccgtatactgttcacaatgccccacgcagaaagccacacccgtgaccgctccgggtgcgtccggtggtccggcggaatttcgaggggaaaccgagccgagcgctgcgccgtgccggcgtacatgcgtgtcggcgagcgggggcacgcgaggcccagcaacgggtagtggcgagatgggcctcccactcggccgctcctcgaacggccaatactgggctagagaaaggctcatctgtaacagcccacacacggaccactcaccctagccgagttaattagaggaataagttcactctgactcccttacaggatttgagatccgtgagtattcactcgagtcccgctcagtgagagattgaaaggttctgtacatctctttagcttacgttggcgacaagtaagccagccgggagggcttagtacgtgatgtcaatgatttcatgcttacttgtaactgcagactgctcatctttagttccttcccaattgctatatacaatatgctctggtcaatcgaccggtactagataatgacttgctcctacaaagtttacacacaccacccccacctcaagagaaagcaaaggctttgcccggtcctcagtatcctcgcgcctacgctggcagagaattgacacttaccaaccaacctcgtcttttcggccacgcgcggacaccttatcacattaacaacaacgggatcgatcgatcgcgccgatctttagctaggtggccaccgccgcattgccggcgatcgataagatggccagatgggaggatggaagagacggcgccacacgacgtcgcgctcctcctcgtactcgcgctacgcgctgtcccgtctcgtcgcggcagctagcgcatcgtctcgccacgccacgcacaccggtatacccgatcggtgtggatggagctagagtaccaattaccaaagctctttcgtttggtccctgtcacgtactgcagttgcagggccagctcatgcatgtgcacgcttcgcgcccctagccagggtagctgctatctgcaactctctctccgctaaagcggcacactgctgatcgattgtaatttgatggtgattgctgaagctttttgccacaggcaaggaccaggcactgtgcaagctggatatacaagattctttacttcgcgcgaacgcaagtttgccatagcaaagctttcagtggcattaagctgaaggtcgctaagacggccggggacaatgcaaagaagtatgagtgcgattgcgaaagcaaacggtatgttacacgcggcatatgcaaccggctcgggtcaatggggaaaaaaacgatgatccatgagtccagttacgcactgtgtgatcagatacagacatggaccataaagcagtgcaatgatcgaatcgttagccacattatccttgcaaagtggtgtttgggcggttaacccaacggaaggtcgcccagctctttctctgtttttttgagagattgggaggcccagcttttcgttgcgcctttccggtgtttctagaagatttcacacggcctgaagctggagctccaagacaccgttggttttaaattggggttttaatcagctcccaaagtcgcagctttagccgtgttggactccttttgatctccttcttttgagcaggtcgccatcaggtgtaaaaagcacttttttgggtgaaatcggagatcagagatcaaaggataaagttgcccccccaatagcataaaaaatcggtctgttggtttgtcaattgtcaagctcgaattggtgtacaaaaaattctgaactagtcgttctctgtcgatcaaaacagtgctaaacaaatgtgtgcaacctctctttcacgtacattgccgtataatatttccgaaacggtgtacagatatacaagtggaataattttaaattccaaagagcttttgattggggataaccagttcgtcatggtttgtctgaagatctctctgataactaacgatttgattggataccttagtttttccacgtagtcgtagaagcagtggtttagacgtcatatgtattgagattcttctctaacaggtccaataccaaagcaaataagcaatgcccaccaatgattatttagaaaactggagtataacaatgaccttgcctgttgctttgactataatgatcatttctaataatgatcctttcaattctcctactaacctacgcatttaaagaaactaatctgtatcgcaccaaacagttaactaaccataagtgatcatcaattctctgagtctctgacccatcattggtcacgcatgttgaatgcgtgaatggagaacagcaatccagacagggaaaaagaataaaacaaaccaattaagcaccaacatataggccctgactagtcccaatatcaaattaatttccaacataaaccagcaggacttgtccaattcagagctagtcaggtttcttcataaataagcatacatccagccatatgatctgcacaagcccgtatttaccaatttaaagaaaaggcaagttcctttatccaaaaataaacaaaccactactgccaaaaatacttgtgctatcctacgcgtccacgagataaactccattttagaattctcaggaatatctgtccggcaaaaatcgttttacgtttcaatcatgacacagtacgggaggactggaggacccgtttcggccacacattcgagccaccgggccacggctcgagaactttctcctcgctgcctcactctcctgaattcctgatccgtgacgtgcaggcaggcaggtccagaagtactcatactgctgctgctagctatcgatcgatcgatcgatggatgtatccatccctttgggatttctcactcttttatttttcatgcattgtgcctgcacagtagcggccaattcgcaaagcggcaaagggggacaaaaaagtcgacattgccaagcagtcgaatgtttgctaggctccaaagcgaaaagccctggcacgtattcatctcctgttgatagtatagcaacgagacgacaacgacctgccgactactgggtgtagaacaacggcgtcctcttttccttgacgtgtagtgtcgtctcatcgcaagcgttccggacagatcacgcgctgtattatcaaccgtggactgaatgcaaacccagggaggatttgtttttcattcgctgagaactctgggtcagtttgttaaattttggcagggtagaaatgagaagatatttgattggtgttagaattataatggtaagagaaagtcctcgagtcttatcggctatcaccataagttgatgtatattattagtcggtccgggtttgagaatcattcattgcttaatactattgatatgatagtctctccattcatatcttcctttttgaaaacgtgctagtaaaagatcaatatatttgcaatgcctaaactttagcggagtaaattttccatgtaacgttttgggtttgctatcatacaaaaattgttgctttagccctactatcagaacatcgaagttttagctagggagcactataaatagataccatcttttttaaatagtaagcagtctctgactttgcataccagaaatgagaaccaaagttgtactaaaattatactgttctttttttatttgttccatcattatacatccttttattcaataaaaaaactactgcatgtgtgccgaatggcaaagccgaggatataaatcatttccatttatctaagtgagaattatgtgtttggtactccacaagaattttaaaatgtgttttaaactacatgtttggatataataatttctattgtctgagtgggaatgcataatagttgtaaaatgtgtttggttctccacaagcgtttctatatatgtattcattcactcatgtgagtgagaataatggctgcatgctactccctccgtttcacaatataagtcattctagcatttcccatattcatattgatgctaatgaatctagatagatatatatgtttagattcattagcatcaatataaatatggtaaatgctagaatgacttatattgtgaaacggagtaagtaagtagcactgaaaaactgtgagatatatcgaattacgacttgtgatcctatatatgccttgtcctgagtcaatgcctatctaagattgacggtgaacatcttggaactctccgcgtcaatcttagatgaataaaaggctacaaattccaaaattaattaaaaatttccatatctatatctatatctatactattataaaaattgaagatgtttttgctggtattttggtacgtcgtccgtgtttaagtcagtttttaagattgttcgtttttggaaatacatatccgtgtttgagttggatttcaagctcatttgcttttggaaatagaaaatgagttgtataagaaatctctttttagaaaactccgcatgctaacttgagatgaaagtctgactcctagctgtagctcatgattttctaaaaaaaaatcccaagcgatatcccacagtaaattttaccataactaaatcatataacaataataagattaaatagcattcacccgttgcaacgcacgggtatttttctagttattttttaaaaaagggaaaatactattcatccaaatctattcaactggtataacaatattaggataagatgaatctctatcatttggtgtattgtatggatacccttaaaaaaatatataggtctaatatatagagggtttacactaccaactcaagctgatcgattttcatgaaattttgtgattttgaggtggctcaaaatgatattttgagggagatttgaatggtttttcagaaattcaaatttgaaattgtaaatcgaatagaaatttgatcaaaattggatgaaaattaccggttgtagacatgttgttagggatcaaaatccaatccccatggttttgtgaaccctactaatatgactaagaactatcatgcattctccactaactgcatattttcttagataacaaaaggctcaatagcaaatagcacctccgtatcaagagatgcacacaagaacataaccaacaattaatctaaattacaaaagggactttaaggcgagaaaattagcccgcttgaatgcaacacactagagtacaaaatctaaaacttcattgttttaaattaacatgcttgcaaaaggtaaataccatgattactcaacctggaaatcttatatacgttcaagagagcgatcgatcaaatgtgaatttgatgtgcttgcgacccattgacagtgagcagtaaaaaattcttggccatgcatatctcagactctcagtagtgttcctcgtcgagccacctcaaacctaagaaagatttctttcagttgctcatttcaaacgattcaacacttcagttatgaagaaccatgggttgccctaaaaagaataagccaatgccaaaattttaaatttaaaaacttaattttgagtttattttaaaatattttcaacatattttctttttcagcattgggttttcagtcactaagaatatgtctataaaaattttacaaataaattaaaccgatgaggcctggacaatatatgacagagtcaaaaggagcatcgctaaatcaagaggtcactagatcgggacatggaggtgtgaggagacttagtgaattagagttaaataaggagcaaaagagactaaggctgtgtttgagggagagggaattgagaagattggaaagatacgcaaaacgaggtgagccattagcgcatgattaattgagtattaactattttaaacttcaaaaatgtattaatatgattttttaaagcaactttcatatagaaaatttttgcaaaaaacgcaccgtttaatagtttgggaagcgtgtgcgcggaaaacgaaacaaacaatttccctatgttctccaaacgaacgcagcctaaggttatctataattttccttacaactttcatcaaaatccgtgtttggggtctaccaatcacactgaaactatggagtatatatacctaaataaactaagaaatgatcaaagttagcttggagaatcctacaaaatccttattatgttgacttcttacatgctactccctcatttccataatataagacacaactacattttctggacgttccataatataaggcatgcatgcatgcatacaattaattaggacctcttctccattaaattattacttttttaaatcttccatcctcaagatctcttattctattggatgcatgcattatatttattagggtgatacaaactatgagatgataataattgtttcttggtctttgggttaaatgtggttgtgccttatattttggaacggagtgaatatcatcttagtatatgcatgtgtacttatgtgtagatataaaactagtttaataatatcgtcaattgaacatctttcgaatagattactactaaatccgaattcgaagtgaccacaaaagatgcttgaattcctatgcaactcttccaatgagctcgatctagttttctccattttagcaccatccaaaacacaaagtccattggcttaattgcttccaaggtttccaccaccactactccaacgagattcctcttgcaaccccaatctacaaaccggccccacacgtcattgccacggccctcttttccctctctgtccaagggagacggcagatcagtcgaggagacgtgatccacgtactttaagctacatgtacacacaaattaacctagggtaatatactactctctgtctttcaagccaccgcattccactcgacgagcggccatggctcccacagctccggcgtggcgcagaaggactccgggaacaagccctcatcgtagtcaagctggtcgtcgcactgatccgactccaccgacacgtccgccggcgtggcgcacgtcgcgccgccgagcacgcagctctccggcggctcgaggtccaggcaccccgcggcggcgttcctcttgtcgtcgtcgtcgtcgacctcctcgctgcctgatccgttgcagctgctgctgcttgctgccgtcgtggcggcaccaccgttgccgctcctctcctcccgttccctcagcctctctcttagctcgtgcaactgcatattacatgcaaagagcaatcaagttagcgtttgaattaattatggaacacatgatctgcatgttcctacgattagtagctaagctagcttgcttaattcatcgttaattacctggacggtgagagcgagcttctcttgcttgagggactcgacgcgggagtggagggcgtcgtacttggagcggagtgcggcgtagtcgtgctcgagctgcttggagcgccaccgcgcgcgcttgttctggaaccagatggccacctgccgcggctgcaggcccagctcgcgcgccagctccgccttctcgcggggctccagcttggcgtggtgcgcgtggaacatggactccagcgaccgtatctgctcctccgtgaaccgccgcttcctctccccggccccgcccctccccggcgccgccgccgccccgccaccgcccaggtccatgtactgctcgtccgccatcatcgccggcatgcacagctgcggcggcaccaccggcgcaggcggtggcatcaagaactggtgctgctgctggaggtggtggtggtcaccccgatccatggcgatcctagcccagctagctagctgtgttcgaccattcatccctctcccggctcccggcccggtcggccccttttataccggtgcgaggagtgacgtgtccacgtccggtccgggggagatgcgaacatgtggtctttgcgattgcgggtaaagaaaaccgccggggccccacgcaccgtgacaccgagcaaagctgcttttgtttcccgccaagtgtcacgaatccgcccgcgccaaaagctgtgcccctgcccccgatggttatccggccgcctcgggatcgccacttgacacgtggcgccggtgacgagcacgagtgcgagatattcttctctccttctcccgtaccggttccttgttggcctactgctaatcgttggctgctgtacaacacctccggatttctttttcgtttatttctctccctctttggcctctttcgatcgatcgccacctcgtgcaggaaattggtaccactgctgctaaggtgtacatgcagtagtcgttcactcgttcgtacgaagaaccggatgatggcgtgcgtgcatgcgccaatgggtggcggaaaggtgggtgcgccggagagagacggagacgcgcgcaattggaacaggtaggccaatggccgaggagagcgcggcgcacgcggtcgcggtcgcggtcgcggcgccaagtgtacggggggcttcgcccgaaaggctcgtcgaggtggcgcgccgcgtttgtcccgttgcgcgcgggcgccccgggctgcgcgcgcctgcgctacgtcgtaccagtgtgtagagctagccagcgcgcggtgccgggtcttttcggcttgatgtgtgatggcccgctgcttgttcacgtaccaacgagacagtggtgggggtaacaagattagagacagataattagatacggctaggtgataaccacttcgatatgaatgatcaactggatcgatctgattagtgcgcagggcttatctcgatggatcattatcgtcgatctctgtaccgggtgaattttctcctactcgatatcggcgaggaagagaagaaaagcggttcgtacgttgttcccaatctcttgtccggtcacgtgttggagtcgatcaggtaagttaaaagcggtggtgatccaatgtgttggatcaccttttacttggattgttcaattcgatcgaggggataatcacgccgcaatcgcggtagcgaacgagttaacttaaaagcgccgcgatcatctattatatactaaaactccataaaactttctacaaacgctctcaaaccgccacgtggcgctctaataaaatagagaaaatcctataaattctaagaaaaaaatagcatatatcccttgattttcacttaaattggtgggtccaatattatacaccgttagataaaattgatcttaaaacaaactaaataccatgtgtcccacctatcctctcctcccgtgcattggcaggtggagtatataccgtaccctcccccctttttttccttttttcttcttttttccatttatatatataatgtatatatttttaaaataatgataattttacaaacaaagaatctaccatcatataacttaagccggtgtactttttactctgtactattattttcaaataatgcactattttaaaataaattttacacaattacatcgtgtcctataaaataaacaatatctatattaactaatttatacgtgcacttaaactgatggctccattatataaatcatcggatctactttttattacactggtctattattctcaagtaatgcactgtcaccattatattgtgtacccattaaattaacaatttaaaatctatattaactaatttacacttacgctagaactggtggacctattattataatcatcggatctattgtttgctaataaataaagcgtccaaaattctctttttgcccactgcacaatgcacgtctgcacctttgcctttcgcacgtgtgacgaagcatagtgtctgagacatctaaggtgatcacaaccgctatagtactaccgctttgccacatattaaatcatatatggagatgattaattttgttaataacatgaaaaaaattaaaggtgtgatgcagtgagagaataattaagcaccatgggttgtgtttttctcaacactaattagctctgtttaagttgaaaacgagagttgttacataacaattataatgtatttgtgttatgtcgtattttgattttgtactatttgttcgtaaaggtgaaaggaatcattatgttataaatatgagcgcaatattgacgaatatcaatagaactcttactacgacaaaggtgataaagggagtttaaggccctctcttttttttcccgatttcatattttggatttttgtttgcacgttttccaagtttctaaatggtgtcttctttaaacaacattctaactttttagaagtcaattcattcgtttataccctcaaatagctatcacataaattatataattcatcaatttcagctatcctaaaccttaagtactacatattttttttcatgcgagccatggtgatcaataaattggtgaacaacggatcatcaaagtcgtaagatgaatatataagagttactctgaacaattgtaaataggtgtcaaaattaattgttattaattagacatctaatggcttgctagccacaaaattaatttctctctacatgtatataaacatggacgaagttggaacaaatattaccatatgtcccatacatatatattgcgcaattaacattctaattagtcatttaaaatttcttaaaatgctcttaagctgccacgtggtgctataataaattagggcaaatattaaattctaacaaaaaaaatcaaagtatctattattttatttcgcttaaatccgtaggtctaatattataaaccgttagattaaattgatcgtaaaacaaactaaatactacgaggtcccacctcgacataggtacgcacctacatgcgcgggtacgtacgcctcccctcccttttttcatttttctctttcttctttttttcccatgcatatgcttccctccctttattactatatcatgcgtcttcatgagatgatttaatcaaaagaattttgagtatcttgcactcgcatttttaatttgcgggcatactagacggtatgtatatacatagactgtatgataattaactagcaatagtttcttatttactcgagaaaaaaatatgattcaaaagtcgtaagtaattaatccatctcctactcaaaagtttgtgaatggttttataagataccttaagaaaaatagaacccttaaattattataaaataacattatccaaattttagtttgccctgaatctataagacaatttctgaacaaacaataattttaccttttaaataatataagtgcccgcgtatacgcgcgggccaccaccttcctagtttcgggcaacagcatcacgtcaggacgaggccagccaccaactctgtaaccccacgaaaccacaccacgtcgatgattttcggattttctctccccgggccgggttcccctattctgattcattaattaaagacaaactacggagttgaactaccacgttgataattaaacaagccattaatgacgaaactagcctgttaagctacaattaccgggatatatatatatatatatatactacagccgtggcggtggtagttcgtcccgtcaagaaagaaggatatgataattggacttccggccggcttagctagcttgggtgtggcttgctactagcatgcacgcgcgtccacactccacaggcagacatgcttccgtgtcggcgtcgcgcacgcggtagcgaggcgctcggcgcgggcacgtcacagtagctgtccgtgggtcacaccgcgattaatcacggctacagctacagctgcacagtgcacagcggaggggaagagttgtgttaattatgtgggctctagctagcctcctagccttgactagctgatgtcgatgacgatcactgatcaggatacagccggggaccagcaggggtggcggaggaggacgaggaggagagggcgcgcgcggcggcggggcccgcgctcgacggcgacgggcgaggccgcgcagcggcgggcacatggcggggcgcgagtggtggcggggagaggcgggtcagcgtcgcgcgggtactcgtggctgctgcgcgcgtcggcgtcgcggcgtggggacgggggcgcgaaagcttcgcgcccgcgcccgcgtggccacaacttgggcgtttctttccggtcacgcatgcgccttcgattcgcacaggctgccgcgcgctctcccggccggctcccactcctcctacgtcgccgctctgggcttcccgttcagcaatgcgtagttgacatatggccctgttggtttaattctcggtgtggtccttacacagaagatcaaccgtgcacctcagcttatcgccctctctttcacatggatcagtttaacgatccgatccatggtctccttagataatggaatgaattccaaagaaaataggcaaaatgaactattgaatgatccgatcgacggctccttccttatcgttcttgttgctcggcgatggcgaggcgccgaggcgtatcttgtgtgttcacgctttcttctttcttaaccttcgttgctgcaaatgcaagccgggttttctgaagcgaaatctctggtataacacacgagactcttgaaaatcacatggcaaaatcatgcatttagtccgcacggcaacagagctatattctactactcgcacatacttttgtcagtaagggctggtttagttcctaactttttttttaaacttctaacttttccatcacatcaaaacttttctatacatacaaacttttaacttttccgtcacatcgttccagtttcaatcgaacttctaattttaacgtaacacaccctaacttcaaaactaaagttagcccaaccatttgaagaaacgcacgtttgctagctaagtggtccgtccagttattctggaaaccaaaacatcgctagcccctttgcagaattgcgctaaatcgcactgaccattagaattttgtaagattatcgtagttgattagctggccctaccagatcgcttgtgctattccctcattccatcgtttgagtttgacctctaacagtgcttcaaccttttctaatcaaggaggcgttgcgtacgtattaaagaaacatatctcaaaactcgacgtggaatttggtgtcgaccactctgagaagaatacatcggcagaaacccccaaaaaagacatttttacacgtaaagtgcaatattaattctaggtttctcattcgtgcatctttcttggtctcttatgcatgcaactgtacaacttggcatcttccaaatccaaactgtacgtgaagttcaatgcgtcgattcatgtccaagactaattagagtttttacgcaggtaaacaagtttgtacgcagaacctgtgttctttgggaacccgactatccaaacatgtctgcgagcgtcttaagaaaatgaaaacaacatgtttgcaagcgaaattcatagaatcaggttaaaggtgtggaaatcattaaggacccagacttaccttggccgcacaggcaatcaaagcctacaaagctcacagctcggaaacgaaagacgggataaatgcaaatgctctttagcaaaaacaatatcaatgaaaagaatcaaggtattctcctataatcactcgaatatacagaagcatcacagcattgtttgttcagtccaaattctcgaggtctgcacgttctgaacccactcacacaccccattagcaagtagcgaaatatagacaactcaaaagaaaaaaaaatcagttgttcgaagtggaaacagaaaatacagtgcctcaaaaactcgaaattcaactaattttacagcacttaagtagattgtctgctttgccggccaataagcatgcattgctcttgtaacagggagcagagtacatgtcccttgacgcggcaaagctcaccgtctattccacacccattgtgcgtgtttgcacctggtttaagcttgacagactttacctgtgtcaacgtcagctaaaagttagatattatccttggtagatgaaaatataagtgcaaataataatttagcccagagccccagagcatgttttgataactattcgccactgtcttaatttaggtgaactttcagtgatccatcaccagagctgacataaactcccagaccgcccaacaggtccaaacagctcatacttctattgacataacaaaagttaaaatgcactgcagactgctgctcttaagaagccaaaaggtttacgataataaaaaggtgaaatcaggtattcatgagcgtatatgataatatcctctcaacaaaaaaaaacagaatatacacattggaatatgtttgttttcagaatgcattcaactatgtagagaagttaatttgtttcaaacgtaaaaacggtatttatttcagaggacctaagtaataaacaggtattcggaaaatttgccactggtactcgaatgaaaaatcccttgtctgaaaagcataaatacaagagggtgaaaaaatagcttgagaaaagaaagaattgtgcatgttaccttcacatattccacataaggcaaagaaagatggcgaccaaattgcagaagtatgaaaaatttcaacaacttccatctaccctttccaccaactaagagcaagtccaaagtgttgtcatcatggttggcttttggtgcaataacctgcgaactcaaactttgcactgtcttgcatgaatgattgcaaactagaacaccaagaaagtgtcctttcctgactacccatttatcatccaaatttggcacaagttccactgatggtccaatttcattgtcttctggtggtccagggagttcaatagggtggtcagactcccaggttagctctgtatcccattttggcccattgtcccactttggttcagagtcccaaataggtcctggatctgaaattgttgaggaaatgtcctccttgtcatgaattgatggggctgcccaagataatcgtgtatcgttagtagtgacaccaactgaatttctctcagttcttgttttggacctggttcttggccagaatgatgaatgatgtggttgagggtgtaaaacttcctctggttctgaaacaatgttgcttctgcccaaagaaaggcgttttgcttttggatcaagaccacgaacatactctgaaggttcagtgcttgctgctgtgctacctgatgtatcaacgtccccaagtgacatccgacttggagtcataatagagtcaatacttgacaaactggaagctcgtggaattccttctctttttgatcggctgcgcattacattggtatatacatcagacacaaagttttcttgtcctataccttttccatggccagtcatctcctttgaagaaggaagatactctaactcatagaaatagcttggcaggcaaaaaaatttgagtattccagccacaaaatatcgaagagggccaaatttcttttgatatttctcagaaagctccaggactgcagcaaagtaatagtgcctttttcagcttattaaattattatgcaatcctgtactgctaaactacattgcactgctgcaaatactggaacatagataaataaactacactttaatgagcagtcattgaagaaacggagacaatagcaaatttaccaatgaagcatacaagttatctcaaattttacaattaagagtacagtaagataacttgtatgtgctaattgagtgaaatgatgaaagtatatgccagatcattagcctagtaaagctgttgggaagagcaactcagcatgcatcagatcaagtgtttagtataaggataagtactcaaggcggtctaatttttggtaaaccaaaagtattttaaaaactatcgtattctaaaagtacttttgtcagctaaaaagtttaccattgtcccaatacaacttatgaagcattccaaatttcaagatttatggaaaaaatggcaatgcaagatatatgaatctgagggatttagaatgtacgcaacttttgtggccttagcccttaggatatcagtgcatacagtataaatgagaactaccataat

SEQ ID NO: 58719 - DNA, 60930 bp, Oryza sativa
aaaacattaaaagaacacaatacggtattaactaatttttttaaaaaatttctgaaattagaaaaagaaaaataagatttcaattaggaatacaatttataagtaactcaattttttgataaaaataaagattattgaaagaaaagaccatctaaaacacatgacgagataagttaagtaacatgcctataaaagagtagagtggtggcgattgatacgacatataaaaattgttaataaaacacaattgccgtgaaggagggacgtcaagcaggccgcgaagcaaatgagtaaggcggttgccaggacttatagtaagtaaaaaaaacaaaccccattgataatcatattcgatttttaaaatctcaatgacaataaaaaggagaagcagcaggtggggtgtataagagtatagttgcagagccgtcgacgggacttctagaaaataaaaaatgaattccaacgatagttatgttcgatttttagaatcacgaggacaataaagagtaggcggcggacgggttgtagaggggcatagtggcatcgtttgatgggacttctcaaaattataaaaaatgaaactacaagtccaatttttaaaggttcgaaacttctaaaaagtaaaaaaaaacaatgctaatcatgttcggttctaaaatctcaatgacaataaagaagggaggcagcgggcgagccgtagaggagtacaatggcaaagccgctgacggtttggtgggacttctagaaagtaaaaatgaaccaaaacgataattatgttcgatttttaaaatctcaatgacaataaagagatgagatagttgatgggccgtagaggagtataatggcaacgtttgacgagacatctagaaattataaaaataaaacccaacgtgacaataaactctaaaaactataaaatccattttttaaaggttccaagaagtatgaatagaaatagtggtagatcgagcaagcaaataaagaaggagatgacataaggggtagtaattggtgtgacttttaaaaactatataattagaaacacgagaatgataaggtttggtctttcaaagtcttaagacaatgagatagctatttaacaaattttgaataaatcatattaaaaatagataattttgtatgggtgctagccgcgcaattgcacgggctacccagctagtttgcattaaatcaaaacctatggaaatagtacaaccaagagtattaatgaggcacaatatgatcatttctccacactactagagatggcaatgggtacccggtccccggtcccccgtggagaattctcccattaggtgatggtgatggtatcaattgtgtctccatggggaatcaaatggagagaaagtagtctccgtcgggtctggcgagggcgggtttggttcaccgtccccgtccccgccctccgtggaggcccgatataaaagtatgtgtgtagtaatatcctgtgtatttggcccataaaaaccagcccaaagcatagagtatataaagcaattgtgtaaccctaaccattccaatccttatcccctccgtccccattccccagtccacacgccaccgtccgccccgctcgtcccaatccccacgccgccacgcgccacgccgtcgtccgtcggccacagcggctgagtagcgctggctcccgatctcgcgcccgcgcgcagggccgccgcacccgccgtgtcggcgtccgcgccagcgccgagctgcccggtcccaggtggcccagctcccagctcccgagccccgtggccaggtcccagcgccacgccgcgccgtcccgttcccttcactcccagtcccagcctcccaggtccgaggacgtcgtggactcggcaccggccaccggacgtcggcctcctcctccaccctccgtcaatatctgatccatcatgtaggcttatttgttttgctgatggtggatgcaggtgaaggcttcggtggcaagaaaggggaaaacgacgagtccacacgacgaccagccgctcgagtccgccatggcttcgccttcaccaccgctaagctccgacgacgatgcaaggtgagcacatctagctgtcctactcccaacttagtacccctccctagatgcctaactacagtaccatatccccctccccctccactaaattcctcttccatggctgcatcgttgtctcgttgagtcactaactcacgttcggcggtccacaataagggacgccaatgcggtgttggaccagccatcgcatgctagacaggtacctagaggatgagttggtttcaattaatacagaaaactttaagattcttgattggtggaaagtggctaggacaagctttcctacattgaggaaggtagcacgagatatatttgctattcctgttagcactgttgcatctgaatatgcatttagcacaagtggaagggttcttagtgagcatcgtagccggcttactccagaactcttggaggccttaatgtgctcacaagattggctgcgaaacaagtatcgaggtacatatgctgttttattcatacatcatgcttagcatagattttacaatgcaatggatgcaaaataattcttataattgttatcttgtagctgataatgaagaagcagcaagcttttggagttgccttcaagatatccaagatcagattgaggtattctttcaacaacttaaaattagcaatcaaactcctactgccattatttgttatatccttataaaatacttgactaattgaatatcttttgctacttctttaatttagggacttgctcttgtttgaagacatgaatgtatggacatgcactgttcttgcaatgattttggatgtttgtaacccctgttatgtgtcatgataaacttgtaaaaccatggcaatgcttttggatatttggcacaaaagacctactccgaactatggttttgtgtatgcctaggacaacatgtgttgctactgcaatgtggtgataactaatgagtgatgactgatgaatgatgaatgatcatgtattattgtgttgttgcttaatctgggaatatgatggatattgtattcttgggcacacttttgttgcactacttgttgctgcactgctgttgtaagtgatgaattgatgatgtgcatttgtgaactgatgatgtgcatttgcgaatttgtgatctgaatttgtgaacttgtgttcttgtagttgttgttgatgtgctgaaattgatggctagaattgctattttgagtgttaatcttttgtatgtaaattattgtttgatatgagaaatgcatacatgttgactgttgagtaagttgatagcggggatggaggctccacggggataaattacccgcacagaggcggtgatggggaaagatgttgccccgttgcatttcacggtgatggtgatggggaaaattctccaccgcggaggcgggtatggtggagtaacctccgacagggaattccccgttgccatctctacacactactactaatttatctcgcaattatttgtctttccaaaatatagaatatgatacgatattgcctagcagcacgaatctgtacatgccactaatttatctcggaattactttctctatttcaaaatgtaagtgtctcatacatgatgtgatattacttaaaaccggcttatccagattcacagtgttagataataccacatattgtactgagaattagatatattttgggatggagctagtagtactgaaattaagatgcttctttttttttatgatggaggtagtattatgcaataaactctggttttgcattcagtgccttttcgcggtatttttcaaccaccaaaaacctacatcctctatttcatattatgagtcgtttcgactcttttttctgttataaaagttagccgatatagcggaacgacgactaaccttctcgatcgcttcaatcattgatcacccaagacatgccagatgacgacacaggaacacacgatatttgttaacgaggttcacccgaagcctacatccccggggctctgattatgggcgctcctccccaaccaatatagcttttagccgctacgagtccatggccatgccgccatcatctccctgcgtgtctacgctacattgtagtcgccatggttacattgtggtgcccccctttctatttaagagagatgccgggttacagactccgactctaactccaccccctaacacctattacaactccaagtccaaccgtaaccaaataggactagtatattcgacatctattctaacattttccaatttggtgctttggatattgtttatagaaaaaataaacaatatccaaaacatcaaattagttatattctaataatatgtttattttgtgttgaaagtactactatgttttctctacaaacttgataaaaaaagtttgaggaaaaaatcaaaagacttataatattaaatactagatgaatactgctttatgcaattgttgaaatgatatcaagatgatactggctggatgtattcttactttttggtgaaggtgaaccctaaccgtctgtcttaattaattaccccccgggtcttgtctctcccaaaagcaaagagaacgattggtgcttgctgtcaagattcggaatcattatttgtggattcggaattattatttgtgaattcggaattattatttgttaacttggaatatttcgatcgtgtcgatgtatcgttttcaaaaggactataactatcactgttttaaaccatgcctgccaaagtgccaatcgtaaataccgcgaatacggagtcctccgtgagtcaagtgttagtcagttctagaagggagcacgagacttcgatagatcaaagtaccaaagcccatttgaattgtaggattaagaaaacgtaagaataagacaaacatagaattttgatagaaatataagtgtaaaataaataattgcaaaacacaaggaaaacataggaatgtccgtttaattgaacagtaggaaaaacacagaaattggatgagagagaaaaactcaaagaaaagttaccaaaagattgaagctcttactaatttcctctaaaatttctataggattgtccatttcataggaatttcaaagaattggataagattcattcctttgaaacaaagcgcttcataggaaatttttctatataattaaaatcctataaaatttctatatttttcctccaaataaaggagccctcaaagtggagtaatccttcggtacaaaattctcctgtggacagcatgtgcacgcattgtgtagaacctttgctaatttgacgccaaggctgtgttcttcttatatgtttgaaacggctaattagtcacacgtaaaacataaaaaacgattagcatataattaattaagtattagtatataaaatgatgaatatattagatttttttaaacaacttatatataaaaaattttcacctaaaatacactgcttaacagcttgggaaccatgtgttaaggaaaactgagtagcagctaaactataatatttgaatagaacgcagcccaagcacaatgaccaggcgattggatagatggtggcctgatcagtcgctgctaagggcaaaagaggctaatcaacaaaccatcttcgattcatatgtttggtttgggaataagctaggatgggtgggttcattcttaaattttaggatagaatggttatattttctgtttgattggagggatggagtggatttttttttattggaggagtgaaagaagatggaatgatcctacacttatttggttagagggatataggtgggatattgcctcctcaggagtgttaataagattgccacagaagagggcacaggatgatgttgctgatagtcaccgctgccgccgccgcttcctgcacgagaagacgacatgggaggagaagaacagagggaagaggaaggaggccatggcggatgctccctcacacactcgaccttgccgctaagcctgccagtgggctggattttattgggcgaaatggattggatgttgatttggatggtggtggttggattcaaatgggctgatattaattttggattggagcgggttggcctgtgaagaattgcggtttgggctggagtggatgcgggttggcctgtgaagactatccatggattcagcccatgggttagcctccaaaacaaaccgaactatccccactccactccaaaccctacactccccgcacgcgcctgtgtgcggtgcgccgccgcgcactgccgccgccgccgccacaaccgcgcgccgtcaccgccgcgtgccgtcaccgccgttcgctgccaccgccgagcgccgtcaccgccgttcgccgccacagtcgccggactcactcaagaaggtgactcatctttcatgtttcttgaagtggcgttctctctctgcttggtcgagctccgctgatatatgttcttgctgtgggcagggaggtggcagatctgcggttgcgtgacctccatcttggatctcggtgagctagggggactgttcttggaagtggttcttgggagcatcctggtatggtaccttggctatttttgtgctttttctttgtttcgatttttagataatgtgggttggttcgattggagatgctgaagagtggtgggtttctgttgggtttaatgccgcagctggtgtcccatcttagttgtctcatgtgatacatactctgctggattgtagtatgtgtgccatcagacatcaggattagtcacaataattaggtcttaactcttgaaaggtaaagacttatgaagctattgccaaattagcagtaccaatgtctcatctaaccttgagaagtcatctagatctctggtatactgcaatgctactgaaaaagaaaaaaaaagatgttggagatttgaacaaattggaattacacaaattgattgctagcaatgttctgttattcgcaattaattctgtcagatggttgtttataatatatcagtgcaattgcaccctttcccaagtcccaacctctaagtcatgtttattaagcatgcagcttttttgctgcttaatggtgactgttgagcgcatctagaaaatccagcacttaaacttttaagctgttggtcaaaggataaaacattttgaatgtcagttcattcagttccatataactactaatctgttgatttaggtggctgtctttcactgtagtattaagtagctaactattttatgtgttgacatgacatgaggcctgtctttcttgttcaaagatgtgatttgatattcattatgttattagtggagtttcaaaaggtgaaaaaaaagtgcacaagaatatttatgcacggttctttgaaaagaaacatgtccagcccccaaatgctagatgcatgattacggtgtataacaggttgctgttgggtatgcttatcatttcactagtttttagcacaagtagtaaatgtaaatattaattctgcacaagtagcaaatgtagatattaattttctattcttgtcaaacacaggtttattaaacatgtctatgcaaaattctgaaagttcatctgccaatatttctagtcatgagctgccttcacaaacacgtaagagagcaaaagtgtgggaacattttgagcaggagcttgtcatgatagatggtcttccaaaagcacaatgcaaatattgtggcttaatgttgtcagcgactagaaaatcaggaactagccatctcataaaccatatttgcgaatcttgtccactagttgatggtgaagttagaaataggtttatatcaacagttaggaaacaacccgtggaaaattttgtgtttgatcctaaaaagactaaagagttgatgataaaatatttcatccatgctgagataccattccataaaattgaggatccctacttggatgattggatggcatccatgcagccaacttttaaacttgtgggtcgtcaatcaatccgcgacaagatttacaactattacaataggctgaaacaagaattgcatgctgaattagagaatcttgattcgcgtgtatgcctaacatcggacatgtggacctcaaatcaaaacctaggatacatggttgtcacagcccactatgttgatgctgaattcaaaatgaaaaagaaaattataagtttgaagcctgtgaagtatccacacactagctttgcaattgaagaagccatgatgaggtgtttgactgagtggggcttgagtagcaaactgttcaccttaactttagacaatgctagtaacaacaccgctgcttgtcaagaattagtgaaaactctcaaggatgagttggttttggaaggcaaacattttcatgtgaggtgttgtgcacacatcctcaatttgttggttcaagatgggatgagggtgattcgtgcagctatagataagatccgtgagatcctaaagtacattgagcattcaccctcacgcattcaagcgtttaattcaattgcttctagtaaaagtcttcctccaaaatctggtttcactcttgatgtaccaacccgttggaactcgaccttcaagatgattagagaaatattgccttacaaggctatcctcaatagctatgcctctgaaaattgtgaacttctaccaactgacgaagaatggttgcatgctgaatcaatttgtgaatttcttaaggcttttgaagaggctactagaggtgtatcagctcataggacaccaactgcacacacattcttgccccatgttctttgtatccgtcatgctttgagtgatcctgattggcaaaccagcgatcttttaaaatgattggctgctcctatgcacaccaagtttgcaaaatattgggatgaaaaattggcaaacaacttcaatttggcacttgtcattaccactgtgttagatccaagaaggaaaagagactatttggatttcttttatgagaaggtgtctccccatggttctaatgttgaaagtaaagtggactctattatagaggagatgaaatcatactttcatgtatatgaaggaattgcaagaagaaggggtgtatcctacatgtcacagtctagtgagagagttagtgttgtaggctcacctgttttgggaaaaagaaagctagagcatgaattcatcctcttcaagtcaaaccggaaggttgcacgtactcagaagtcagagattgatacatatttagaagaagtatgtgaggatgatagtgaggattttgatgttttggcatggtggaagaaaaattccaaaaagtttcctgtgttggcaattatggctcgagactttcttgcaattccacttagcaccgtgccctcagagtccgctttcagcagtggaggaaggattcttggagacacaagaagctcattgacaccagagatgctcgaggcacttgtttgtgcaaaagattggctacatagagccaaaaaacaaggggattaaaggtataatatctcacgccttgtatttcgtctcagactttgtggtctgtgccatacaaatagtaattgtagatgtgttttcattttatattgtttgattagtcacaaaatctagattaatttgtctgagtgcccaccagtattactaatatttgtgccaaattttctttgatctaggttcgtactgagtactgaccatatgatgttttgtgaagaaggtttggtatgatggctgtttttttttttacaatggtggggtccctgtgctcagtaacttaatgttgttttttgttcatcagttggtgaaatgttaggcagaatttgtaacaccttgcaatgccttttatatctattagttgtatccttacttgtatatattcttatttgagcagctagagcatgttcaggagatagatgagagcattgtgtatgtgaaggataagcaaggaaggtggcctctctcttctcccagaggggcaaaaaaggccccaaccaggactctgtcatcctctgccaggtaacatcttcagctctaactctctgtctctgaatcttttctttctgtttgatgtgctcagctcagatcaatccgctcaatttctcctcttgatgaggctgctcaggccaaatgttttgttttgtactcaaaagggttcagattagttcagggcttcagggtgttctctagtccatgatttgagcttccatgagctaattaggtcagcagttagtagagtacttttttttcaggaagagttagtagagtacttgttagaaatagagaaaaatcttttctttctcttgcaaaattgtttgatatgatatgttgtatcctactatgttgattctggctgcagaattttggggctctcaaccttgttttcttcctctctttttttttccatttcttgaaagtccttgtggttgtatatagtagtatagatatttagttgaatagtggggatggatggattcattcttcattcttactagtgtgtccactaactcatgctagtcatatcttatagaaataataatattcaacttgtaatctttcaatgttatttctgaaatataaatttctgatggcttctttctcttccagattatctacaactgcatatggatcaaggcatagatgatgttttggtagtttttgttgaagatataaaccttattatggcccttattattgctgtagtagtgagcaattgacttaattgtaattatatgacatcattagtcttctggtattcatttcagtgctggatcagctaacaaacaatgcgatgcgtatcattctgagtattttttttttgtttcattttcttgtttttgcccaattttcagtgtttcagcaagcaatgatgttcttttaatatttctgttttgaattaattgtctgcacgtgtgtctacactgctgctctctatactgtagctgagatccatggctaaagaagtaacgaggcctcctggctccaagctctctgtagtgtagctgggatccatggattgaatccattccagtgaagtggactgaacccattttagtgtaatggtttggggtgggttggactgaaatctgatgcggggtgggttggtttggattttggaggagaggaaatggggtgggttggtttggcatgccattccatgaggaggtgggctggggtggattcaaattggatctcagcccactggcaggcttacttgccgctgcttcttgccactaccgccgtcgccgtcgcttgggcatacgcacggtcgccgccacttctcgcatgggcgccgatctagaagagacaagaaacggtgagagagagatactgtgaccacacatgtgcatctcatgtgactcgcgcgatagagctatgtcgaatcgatttgctagattttcatcggtgagttgaacctgaatatcagtggaatattcttttttggagccaacccatcccacctagtatcacaaccaaactaataaaggtgtgatgaggacatcaagctaataaaatctacatgtcgactacttgagacaacagtcatgcagttttttgccaactttacttagaggttcaccaataggattcaataatcaatgggtctttgttttgtgtggattcaccaataagattcaatagtcaataggtctttgttttgtgtgtgtgtttttagtttgtgtgaatttgtgtaacaatttgtagttactctagcaaaggtcagaattttatttcattatctaaaaatcacaaccaaacatctatataaaaatagattcaacccaacgtaatccaacaaatcccttcaaccaaacacacgcgactaggtgcgccgcgcgcgtggccccggcgtgccccgcatgcgggacggggggagtcacgaagggggctgcgcgatcacgcagccggcttcgctcgggcgcaaggggagcgtgggtcggggcatcgcgggtaggcagcgcctacgcacttacgcagacgggcgaaggcgggtctggctgtctggcacatggacatgggtggggctctcgacctctcgtcgccctgctcgtgttcggcggattcctgcacacgcgcggctcccaagatcggacgtgcgcgcgggcttgaatcgtgctggattctgacgcgaactacgaatctgttgcgatcacgtagatagtagtagttccgatgaactactatctgttataactgttcgtctgttcggaaaaactagtggaattctggctacgttcagaggacttcagaatctggacggggattgtgtgaggcccacatgtcagcggcagaggatctgcttcttcagaaaattctggttcaatccgtgcatgcaaagccactttcctcgggatggaaaagcaatcgatttcaccaatcaaacagaactgacaggacatcaggcagtacgcgagggttccatgaaatactgttgttttcagcacagaaactgaagaccaccaccctgcgcatcgtcagactgtataggcatcttcagcgctcaaaagtgaggagacatcagtgaacgacgtcgatccacacctagctgttcgtgtgaaggccggaaattccctatcgatccacaagatgccctgtccctttcaggcatcatcatctggattgtaatgcagaaaagtaaataatccggtgaggcggtgactgtagcagtgtggctgatcagttcgctgtcaaagattcattttttaaaggcaagttccttttggttcacaggaaactttggccaagcatgcccactggattgttttatggttttcattgatcatttcacctatggccctaggtgatgtaagcctggctgtggacagatgaacaagttggagagttgcttcggattcaagaaccctattatggcgaaacgcttaagagtcaaccaagcaaccatggctagcaatggagtgtccaaaccagtctctcgttttgagatagagccaattagagattcttatccttgaaagatctcgtcaaatttctctgaattgatggtaccaaatgcaggtcactttttcatgaaaaagaaacgccgcacaacgataacgactcaaaacttttttgccgcagctgcttttgtaggagaatttgataatcaatcattgcagtggttttcttggataggcagatctttcacaatacctggtcagtattgatcaatccatgtagtgcaccatttgataactctctcactgtcacacgcatcagataacatatcttcagatgaaaccattagctgaaatcagctggaaactggcaaagtaagaattggatcagctgatcttgaaagagacctgttacaatattcggtcttcgggtccaacttatcaccaaatatatacatgtatacactaaacatttctctactatacaaaatttcttctattagcgcctacaggctaaaaccataaatcacattggtaagagatgaggcaataaaaatacgccattgttatgagatgaattatcttgaatctgttgtcttacttcattgacatggaaatggtaacaatgtttggtacctttccaatatttactgcacaggtacctccaggaatcccatataatacttcattattgcattgctgcatctttcctgtagtagatggaactgccatgtaattataatccctgctactcctctagtttgtagacctaaatgccatgcacattggtgggctgatcttggccaaagcaagcaaggacgcagggaagatccaaagaccatccccgcatatcaaaccagatgcaactgctggcaccattagtgctgctttgcttttgtcaattatatgccaggtgaagactatcaggctcccgatacacatgtcgatggcaaagcttgcaccaaccaggaaaggaacccccattgccatcggtaggggaacccatctcccatacttcggtgggcaaaggtccctcgtaaggttagctgccactgcaaagccaaaaaacccatagcagagctgcaagcaatgctggggcagagcagagaagccctcaacaccaagaatcgccatgtttcggtagactagagcatatggtgctttccagtacccttctgggttgccaatgtcaaaggcactgtagaacaagaagaaagttagtggtgaaattacacaacccatgacagttccaatggcctgagcaataatcatcgatctcggtgatgttaatgttagatgtcccgtcttgaaatcatgcatcagatcagcagatatggacaccagcgatttcaccaaaccacagcctactaggccagcaactacaccagagtctttcccagcccaggctgcaagaatgaagagggcaatctttccataattgtaggccatattgatgtcagttaggcctgctccataggcattgcagaaaccaagggcaggcgccaataagtatgctatgacaacataataccacttcatctcatggaacatcatgggaatggcaattactgcaataaaagttaatccaagataaccagagaaggctagccaggaaggaatattgtctgttgtaaaaacttcattacgatgaagttcatcgagcactggcatgtcttcccctgtaagtggaatacaccttatatcagatcatatataaactagaaaggtcatattgagttctgtcagattatttacccttctttgcattcttcagttttgagctatcaaacagattcttaatagtgagtgcaactatcttcacaaaattgtataggccatcacctaggatgagagctacacagatgaaggcctaaagaatatatatgaggtggtaagaatcaaaagatcatactatacttgtacactaccaaaataaaatgacgaaactaaccttgtacccttgcaggcttttcatgctgctttcaggtatatctgctgaataccaatcccctttcaaatcactgatcagtggccacattactccccatgagagaatggcgccgagtaggagagacagattaacaaggtgggagcaaatcatccctgccccaacatatgtgagactgaaatcgaagaagaatctgataacccaaaaagttttgaatcagatgaacttgttttttgaacaaatcaggtgacactattgttggtcaaaatttatttaatagaataatgagctaagtgattgttgttacgtttgttgccaagcttttagtccaaaagttggaaactgcgagaacccacaattgtctccaccagagtaaaaccactggaagaagctccaaaagaaactcatagcaaaatatttggtgaatccatttacttgctgcctgatgtgccaaaaaacacgttcagttaactgaaattttataatgaatagtagaactcattatgagttatgttagagaaccacatactttgccattgcatccccatgaggtgtgtggaatccatttataagcacagctgttgcagtcccacttgggtaagttaatttgtagtcaattatcatgacctgaaattttaccaagtttaagaaacaaatggaaattatcaagatctggaattttactaagtttggtaacaaatgaaatcatccatttacatgtggaaaagcactgccagctgttcattttttatgtattcacaagataaatatgttgtgaaatgaaaaggagaatatgtccagaatcacgcataataagtctttgcatgtggacttcaaattatgctttcaattaaattcaactgcaactcaagattcaaataataagtatgctttttttcagaattaaaaaaatatattttatttataaaagtacaactcaaaccacaagcaaaatagctatattttcttcaggggactagagaagtaccacacgctaatgagttggtattgtttgtttcagcacaaatcactatcaatcgattaagcaaaaatgttggtatgtcttaaccaataaccaactaggtggtttaataaagccagactgaaagaggtttcatgacagagacaaatttatttaatataccagaacgattcattcagcacgccaatttcaaacaactaaacaagaccatacaagaacaattcaatcagcagtccagattcaacagggaccataaggccatcaatcagatacgttaaaatactagctgcacttcaactctatcacctagctaaatacaggcataattgtccttttttttagcttatgtaatctgtgacatcgtgaaatgaaattaaaacacctacgaaatgttgaagggacaaaagatagaaaaggctgaaatggagatgatggtcagtttaccacaattttgtgaaattctcacaagggtgaactggtgaacgacaaaaacgcctatgaaatgtagaattgcagttctaaggagtaaggagctacagcgaaccgtggtcaaatggcagaactgttgaaattataagcatataatgatttaatttattctataaataaatcaagacattgcagatataaactagcatgagcgcatcattagatctacacatataaactaagcagtaaaacacgaacagaactggtcaaatggcagaactaccgaagatacagagtaaggctgtggaagctcactgaccttcctaagagggacgagagcgagaagtccgacgaagctgacggcgagaaggaatccagtcatccacgcaatgccgggctccttgtagctccccggcacgttgccctccgtgtcctcgcccgccatctcgtaagtcctcttgttgagcccaagcaagtaagaaccaaacccacctgcacagaaagatccaaagaaccaatcagtcgggatctccattagactaggtagacgacgaatggaggatggatgcaatggggggtggtcctggcctccaactgcgatgctgtagcaggcgacggcgcaggtctggacgacggtgttctcctgccgcgtgaacgggcgggcggcgaagccgaggcgggcgagcgcctgcgtccagccgcggaggacgacgaaggcgatgagcgcggctgagacgttgagcgtggggacgaggcccgtggtaaggttcagcttcatcacgatgacgctgtacatggcgcccacggccaggctcgccaccagcccgcgcgccgtcagctgctcccgccacggcggcggcgcgccgccgccgccgcgggcatgcgtggccccctcctcggcgtcgccgccgccgtcgagcccggccatctcctcctcccgcgggtgcgctaccaccagctcgaggcgcggcggcccgggctgccgcttcctccgcctctcctgcttcatggcggaaagaattttccggcgtcagattcacccccgtgtccgagttccagcggaggcatgtgaatgagagaatgaagggtcggtgaaacaaaaagatcttttttttttcagtacgaggatgagttagcacgaatatgatgctagctagtgagctcctcacttgtgttcttctacatccgttgtgctaagcaacgaagctatgaacaagtgcgctctctcgccaaggatcagtgcaagaaatccataggggcaaagaaaaagatgaaatttttatgggtgattctccaaagaaaatcactgccttttatcttcagtgtggtatcgaggattccagaaagataatgtaaaaaagacccacctgaattagcctggattctctcttgctcttgctccaactgaaaagacaagaacagcgagccaaacgaaactgaaggtgagaaagagaactgaatagcacgtcacaaaagaaaggggaagtgattggcaaagagaaatagcgtatacttggttttgtttcgtcagaaaaggaagcaaggaggtttggtaatgtttttatctaccaatataatcactagtagaagaaatagaatttatctcacccatttatttatgagttaaataattagtagaaaaaaattctcctagcattagttgaagtatttgaggtggtactataaaatatatctattaaacggtttagattgattatgttgacaattactccttctatcttaaaataaatatatttattttgagatgggaggagtataaaacaatttctttttcagatagcatcaactgtcaacagtaatggggaaaccaataaaaataaataaccatgatcagtggaagccagtgtacaggaactaaacagcagacacatactccctccgtcctataaaaaggcaaacccttggtttgcgtctctaactttgactgtccgtcttatatgaaatttttttataattcgtattttcattgttgttagataataaaacatgattaatattttatatgtgacttgtctttttaatttttttcatattttttttaaataagacggacagtcaaacgttagacacggaaactagggtttgtcttttttttttggacggagggagtcggcacaacatacagtaaaaaatcgcttccattaacattccgtgcaagaaacacaggcagagtcccgccactcacgcgcaagcaaaccagcagaccctgaatgcttacgaaatgacaaaggttataaaaacaaagtcaacaaagaagaatcagtcaatcagaccttcaaagcaagatcgaacgattttaaactaagagccaacctgcaattatacgtgacgccggtaaaagaaggaagagaaaaagaccgcgaaggcgaagctgtcaagaaagcttcgtcaaaactcaaaacgacagtgaacgaactcgcgacctgaaccattaacagtcgtctgtcagtaataaacagcaacagaaaaagcattaactcgccggcgtaccaaacaactagtattagtactcctgctttccttcgtaccggtctcctcctcgacgagacggcgacgtcgacgacgacgacctgagctgcatgagccaaggctatagcgccgcggtggctaaggagcacacgcgaccggcgaccgtacgtaagcaaactggccgcgagcaagaacatgcatgcatgatgatgccatggcatgccaagcggcggcatgtatgcgcaaatttctcaacctggcgcaagcaaagcaactgaagcgagcgcgtgcgaagcggcgtgcccccgcgcgcgcgcgaggtggggttggggcggcaagcttcacaccggccgtgccgcttgggctttggctgcttccccctttcgttttctgcgggcgtgtgtgctcgcctcgcccacacgccaccagcccaccaccgcgatcgcgacacacagatatcacgacagaattccacggccctcggccgcagcgtgtgcgcgcgcgtgcgtcctcccggcggttcggtccgtatgctggggcggcaatggctgtgtacatccgatccgatgtagagaccgggtttatcctattttctaaaaatatgctggggcggcagtgtgaccgtgtgagtccggaaagacggaaagtagtaacagtggcctctgatgaaagcgtgaaacgcatctcggcgtcggcaagtaggcgcagagatggatggataatctgtggatcatatgcaaacgcgagatagcctcgagacctcgagcagatagtaaaaatcaagctgtagcaatagcaaatatcatgcgaatactggatgaaaaggactaatcacacgaagaaccgcaccgccgcaccgtactgaatgaaaaggactaatcagtacgtatggctgtgttctacagcgcattttgcttttacaactcccccgtttatcacgagtatacttttcaaactgatattttttatcaaaaaatcttttatatagatttttttaaaaaaataaactattttttaaatttgtagtgagtaatattccctccgttataaaatgttacaaactagaagggtgagtcatattatacccattctacatcaacaaatctggacagtattttagaacaagaaaactaaacagaatcataatattttaggatgaagctaggatatacttaattaattatatgctaatatttttttatacgattaaaaagctaaagctaaaggcacattcgaacaaagcccaaatcagtgaatcactgaacccttcacgcgtccatgttccggacaccttcctgaggaggcggacaaatttatggacgcacgaagcgcatatgttcaggagtgcagacaatgcaggctgatgcatctgttctcgacttctcgtgtggtttggagaagttgatagttagggccctccatgtcgtgcccccctcatcacttcatttagtttgttttcttcctatcattgtgggggtactagtatctcttacccgtctctcatccagcaattttttttctggtggaattaagaggttcactttcagttgaagacaaggcctttccctgaagttctgagaagactggtacggcggcaaatctttacataggactagaggctggggcgccgcctgcacggactaaaacgacaatcagtcggtaaatagatgagggaaatctatgaaaatttgataagcgacatcatagattacagttcaactcttgtggatatcaatagcatcgtaattagtattgcctttttccgtaataaatatcctactacagatggacactttattatcaacgtagagcatctctgttgaaatttcggttcgttacagactcttggttcacatgaatatacaatgtttttattacataataacccaaaattaatagaaaaataatccctggtacacattgctatacactttgggtttttgcaaatagggtaactgaagaataatgggcccaacttttcaagattacattcagcatcccatcatattctgaagaatccaaacatgttggaatgtaagtacatgaaaacatacgttagctaatgaaatcatatattgagaagcacctgcagatatataccataccctaataaaaccttaccgcactaagtgcccgagcacacgaaaaaattgttcataggtcaatcagtgataatggaacaccaaaattccattgatgtttatttatgagctagcagctaattagaagtgggtaaaatttactcagctagtatacctcttacaggcacatgggaaccagcctctagtaggatttgttcagttcacgacaccgcaaactccaagctccttcaacagaagaaggtcttggggaatggaatggcaccgagcagaagatgctgatcgaaccaaaagaaaaatacactatcaaagcacagcaaactaaaactccaaatgaatcaaaacatcaagactgcaggaaaagtagtagctccccaacatcaatactggatccacgtgctgaagaagttggtggaggcgcgaccatcggccaccacgtgcggcgagcggctagaccggccagttgacgacgacggctgcaggttacgacgatgacgatggcggcgaggcacagttcctcgcaggcaaaggagagacgagaggggaagaggagaggagtgttcgcctcgtcgctttctccgcgtccgcctcgaagtccgcgctcggcgacaacggcgaagcgaggggggagaaggaggtggaggcgctcggagacggcgacggcggcggaggcggcggcgacgacggcggaggcgcgagacgatgcggacgacgatggcgacggcgcgaagcagaggtggcggcgcgaggggaaagcggagacggcggcggttagggttttgggctagtgcgtgccgttttgcgaaaaaacccctcagcttccacattttagagcgcagacctaattcacggtttttctcaccttctaatagaatacccggatctacgaagggcctaaacgtaaaaatacaactcagtaggggtgggcaaaattagaccgaaccgaaaagaccgagaccgagaccgaaaaattcgggtagttgttcggtccctaacatcaaaagaccgaatttatttcgggtatttcggttattgggctcggttaaccgaaatacccgaaaggaataagtccattttgcgtccctcaattcttgccctttatcgaattacatccctcaaccacaaaaccgggtatatcacctccccaagtgttaaaaccagtacaaaacaactcccttggtggtttttgatgctgacgtggcatcctagtcattaaaaaaattaaaaaatacgtgaggtcccacacgtaagtggcatttctattcttcctctccaccactctcctctctcctcccccttctctctccctgaacagagcacggccaggggaggcgccggaggtgcgtgaggtgtggggaccgtcggaggatgcggcgggtgcacgccgcgagggagaggatccgctgtcagtagcagtagatgcaggtggtagcggtggcggtggaggagaggaggatgcaggggttaggaccgaagcggagctcgaacaaggacccaacacaccaaggtggacggccagggacggcggatccgaatgccggcactgtgcgccgcccggatcttccagctgacgcgggagctcagccacaagtctgacggcgataccgtccagtggctgctccagcaggcggagccggcaatcgtcgccgccacggggacggggaccataccggtgtcggcgctgacatccgtcgcaccatgccagggctagagctaggactctcataggacggccacatcggcgtgctcgccgcacagtcgctcagccagttctaccaccaggtcggcggcgccggtgccaccggtcaactgccgcacccgcaccaccatcaccaacaccatcagcagcagcaggaggaccgggaggatgagcgcgacgacggcgagtccgatgaggagtccgggcagtagtaggcgcaccgccaattgttcatccatgcatctcacgttgtctctttggagaagaaaaacagaattccaggaaggacatgcagctaatggaggggggatgcttttgttactgttgggttgttcttcatggggttttttatgtctgattttttcctcgtgtggtgtcgaagctcgaaagaggctaccacttgctccggcgacttgttgggatggatcatgatcatcttcagttgttactcctgctgctccatggatggtcgccggtttatccccctccaagtgtttaggtggcagctcaatcttttgcactccacagtcagcacatgacatgctattcgaaaggtagcttgatgagcttatgtattttgctggaggttggcggcgcggatagacaacaggaggatgtgttgccggccgagcagatcgacgccgtgacaggtgaaccctccccgcgtgggcgccgcggccggcgatcctctcccttgtggcatgctcctgcatcctccggcggtccccacacctcccacgcctccggctccgccgtccccggccgtgctctgttcggggagagagaagagggaggagagaggagagtggtggaggagaggaagaatagaaatgccacttacatgtgggccctcacatatttttttaatttttttgatgactgggatgccacgccagcaaaaccactgtcaaaaaccacgagggagttgttttgtactggttttaacacttggaggaggtaatatacccggttttatggttgagggatgaaattcgacaaagggaaagaattgagggaggtaaaatggacttattcctacccaaaataaccgaactagcccaatagactaggaggcccagtaggccagtactaagcccactaaaataaaccctaaatcaccaaccctactcctagtctcccactcggctcggctccctcaccctcacagccgcactccccactcctccctctcgcgccgcgcctccgggctctagcaccgcgccgcctgcctccaccgcgcctgcgccgcctccgtctccaccgcgccggcggccggcgccgcctccgttcgccctggcccactgcgtcgccgccggcgccgcctccgtccgccctcggcccaccgcgtcggcgtcgcctccacctctgcccgccctccgcctccctcgcgccgtctccgccttcaccacgccggcgccgcctccgtcgtccaccgcgccgacaccgtccttcaccgcctagctcgatttgcttttcagtttgtctttctgaatctgcttgatttcctagttgcatgtgcagatcagcagatgcatcatctctctattgatctattgagttgccttttgatttgtcaaccatacatttgttgtttggcttttgtgattttttttgttcagagacttctgctctcgggttagttcggtcatgaccgagaccgaaccgaactaaccgaagaccgaagtgctcggtcttcattttttttgggaccgatcggtcttgagtttttgatgactgaaattttaaaaagaccgaaagaccgaaccgaatttctcggttagaccgaatgcccacccctacagctcagaggatggttggcgagggacgccggacgaattacgaacaaaacagagggcttttttgtaaatttccaccacgcgtactgtagcaaaacgcgtacgtggcacaccccatcgcgcgccccttccgccagcctttatatattccgatatcatgacacagagcgctcagtgacaaccgattttacgtcaaggggatggagcgacggcagatccggtgttggcggcttggtgtagtggcggagctggaaccatattaagggtggtgcactactttactgtatagatggcggcatttactctaaataatgatagttgttcatttgtagataactattgataaaaaaaatcgttgagtagcaagtaaaagtgcttactgaaatataagacgaaaagaaaccgcgaagggaaacatcaaaaattacataaaagacgttcaatctatataaaatacatccccggtctcaaagctgtcaatctcaatatcatcgataagtaatccataatagcctacaataaaagcagaacagaagtcagaaacatcttagttttcaactaaaaatttatatccaacaatgaagatgtaaaaacataaaaataaatgtgtcgcaatattcttacaattttactaagtgatggttgatggactgatggcagcaggacagcaggagtccttgtcccttccagaaatcaattgaaactttcagttcttcaaactttaaaccctagcttatatataaatttggatattgaaagggtgctatcaacaagttacaaatcaaattaataggatttaaaataagactagaactagaagagagggtaaattgaaagtttggaactaactaaaaggaagatgttctcaaaaaaaaaaactaaaaggaagataatacctctctttagtctcttgcttgtgcactgctgagtgctccgctgctagctgcaggctgcccctgtagtctggctgctcgctgccgcagtgccgccgtaatgctgcgggctgccagctagggcgaccagcagcaggctaggacggcgagcaatggtgagtcggcgaccagcggttgagcgacaggagtagacggcgactcggcaaactgtggtgagaggagattgcgttggatcaaagacgaacagacacacagccactcagatgccgtatcgcgggaaaaagaaagacaaaaggcgaaaaacgggagtcgaagagatgtgcggtgccggcgtggctgtgattaacgctcgaggcgtcgctctcgctcccggtggcccagatggggcgctattttcatgggcctcaggtcttccatgacttgctcatgggccaggggtggtgcacgaatttgggtcgaggggttcccatgtggtgaaaatagggggtaagtactaaatctgaaaattaggctgggcgcctgtgaacccccctaagcccattggactccatccctggcttggtgagacagcggagaggacgttgccgaggcatgtgacaacatatcctgaagcggtggtacacggggcggatgacggatccaacacccctgttttttacctgtggccatcatgagatccaccgatgctatccttcgacgtcgttgcctttgtcatcactgtacgcacgcctctacctttcgcagtttcaccattggtggaggcaagatgtccatgccagtcgctagggccattggggagagagacggaggatgagagacctctgtcggtcgcttggccctaggtgacttgctacgaagctacacgatgcaagcagaaagacgatgagaaaaggggaggatgccgatatgatagtttctattatttttctctcctgttcaactaggaatgaatattctaatgaagggtgtatagcaaataaccacattttgagagtgatttttttcaaagattaacttttttttgtgtctagcaactaaattcgcgaaatcacgatatagaagttagcaaaatttgcctagtactacaaatgtactgatctgtcacaccctaatccggcaccactatacaacggcacctgacatgagtgtgtcgtaggaaaaataacatgaaccgcttcctacgagaccacgatatcggtaccagtctgtcgggtcccaaaactaataattcggaaaccgacatattaaaactgtatcaagccctggatcagtagattgatacaggttcaacaatctggttcttcattgcatacatttagtcaaggtttcaaaggagatattattacataataatattagggtatttacaagattgtggctaactgttacaacagaagccatagaatgactcaactctactgttttgctatagacttaaaccatctatctaatctatacttgagaactaagttagaatgagactaacttatatgattgaactcccagcttcagcaagaacatcaaattgactctgaaaaaggggggttgaagcaagggtgagtacaacgtactcaacaagctattatattcaataatgaatgcatgaaatggtaatatctgagtagagctaggtttacttgcagaaagcaaagaatatagaggaagaaagcctagaatgttttaaatacaacaatatttaataaagtttggaattaagtttctaaccaaataccatatgagtcccaatgctcaaatccgtgagcacggctattcgaatagattcatttatactttactgcagtaaatgtacgctttacccgcaatccatgacgtgccaaacacattagccttgtcatggcaaagctttttagttactaacatcagtggtacctgttccatgaactctagtccccatgcgctctgaatgtaacgttatcagcagcgagaggagttctgacgttcccgaggtttttggagagaactggttgagagacccccgtgtaggatcaaggaggccgactagagggggggtgaataggcggttttaaaacttaatggtacaaaagaatgcaagtcttccacatctcattatcgggaaataacctagtagacaacttatgcaaaagagaggttaatcctataaacatcggtttatcatctatcaccaaagtaacaattacacaaattgtttaatccaagatctttcaatcttttctctctttggtgatggataataattcgatataaacaatatagagagatgagatgaaagatgatttcaaatcaagatagaaatcttataataaacaaaatatagaataagctcccctcaagtgtacatacatatggatataaaggaacacatatgcacataatcaatcaagatcaatgagggagctcacactatattttggatccacaagagagaccaagttagaatatgtgaagtttaatacatacctctcatcatttttattttcatatccaaatgagactaatcaaagaaaggctcataaaaacgttagtctcatataattagatttgtcattaatcaccaaaaccaaattaaggcacttgaacttacaatctccccctttttggtgattgatgacaaatccattgataataaccacatttggatatgaaggatataaatcaacattatattgatatgccaatgacatgctgatgcatatgatgcatatgtaatgctatgatgtgggatcctagaatatttcccccttttatagctatgatcataaggagatcacaaatagatcacaaatattctctcccttttggcattaatcaccaaaaaatgaaaaagggctagaaaataggcaattacaaaatcccaaaaaggaataaagactcacaaggccaaatatatatatatatatatatatatatatatatatatatatatatatatatatatatatatatatatatatatatatagaaatagcccatttagaaaaactcccccttactcatagagtcttttctttggatagagaatttggaatatgtttcatatgtagaaggggtgagtttgagcacttgaactttcacttgagatattctcatcaaaggtttttttcaagaatgtcaaaaattgagaagagcttggtcaaggctatttggaagaattttactcaagtgcatgatatcggcaagtaatgacaatgatgagctagtgttgggttcaagatgatcaagggatactaccatttgttgagagaccacttgtgtataggaattcgaatttgggatcaaggaatggtagttggctttggtagcaaggatcaacttgtatttggtggcaaagattggaatttggagtctatccatgaaggcttggttttgagaagtccaaaaaaaaaaacttttgagtttaggtggtttcatgtatcatgggcatttcaaaaaccaaaagagttcaaataaggaacatatccaacatagctcaaggattcatgaagttttcaaaataacaaagatctcattatttgaaacatcttatatttcaccaccatgctcaaataatcaacaagaagtgacatgaactttgaaatccatgtttagctgaaaaggcacatagcaatggcgacgtcttttagcaatagaaacctgtgtaactaagctcggaaaaatatgccataaatcctggagatagttcatgtaaaaatacaaaaatttcattttggggtcctttcccagatctcaaccgaattgaagaaacaaatctcacaagctttcagccaactcaaaatttcagactttttcagatttttggagactgaaaatgaggttgaaaaggcatccaaatgaccagctaaaattctgagtaaatttgtaagtaaacttcaactattgaggatcaaaagccatattgtgatcttcttcaaatttgcaacccatttggagatacaaaaatcacaaatcagcccaaaaacatggttgttctgaaaatttcagcaagctgagcaaaacgagaaaaagtcaaaatctttgcaaatcaaatcgaaatgagttgaaaccttgcagatttgatctttatacttgtgaggaacttttccaaaaagaatttcttaaaaatcatttttctatcaaaagataagacaaaaggagcattgtaggcctttagggtgagtaaatttgagttgagagctcaaatcacattcaaatttgaaatcgatggagtttgacatttgtaaagccttaggaggattatagatacactttcaagccaagattcacaaagaaatttggctctaaaggcttaacacgccataagcaagtttaggccgaaaatggtcaagtcaagatttttgctgaaattcaaatggttgtagagtttgaatggttggtattttggaaaaacattgaactagataaatgtttgaaacgaccaactctaaaagttttgtatggaaagcttttccaaaaaactcaatagattttgatttagagaaataaaatattttcaaccaaaacaagaccctaaaagatcctattgagaccaattttgctattttgtttgacaaatggaaattttgactccaaaagccttgaaaaacatttgaaatacaaattgggatacatttgaaaggattttcacatatatgggccatttaaataagatttttgacttttgtctaaaataggctcttttgaaagggtatggatgcaaccttttggaaaattcatgtttgggagcaaagggaatatgggtttgattcagattgctcccccttgatgcaactctccttttttgcttcatgaattcaaggtttgatactaaaggccaagtttgagaaaaaggctacacaagctctcttttcaaatacattcctccaaaagtgcaaaaagaagcaaatgagatgatatttgagagaaactaatatgcatgaagttcaaatatgattttgagccaaaaagatacaattattcagatttaagaaataaactcaccaaagtgatagaaagtgaccatatatggtctagttaaaatttttggtgagttttgacatcaaatttcttttaatatgttggtcttttggataaggttcaaaaaccaaaaacatttgaaataaccaactctatctaacttgttttgggctccatttcaaattctctttagatatccctgtagagagaaaaatagttttgctcgaaaacaagatcctagaaactagaattttagtcaaaaatgcatttttactttgcaaatactttttcttgcaaactaaagtttggaaaacatattagaggccttttgaaatattttccaagtaatagttttcaagaattatagtttttctcaaaaaattgacttttggtcaaaatgggcgttttgaaaacatttctaccacttggattactttgttcacattctaagggttgtagtgcatatgtaagaaatgcaatactttcccttaatgcgatattcccttcaacccaacaaagatgagcaaataaacacaagatccaataaagatcaaataagattgacaataagcacaagatgataaatatgttgcattaatatgatcaagcctatagcttcatatgccactactcattatgctcaacatgcatttatgatgatgttcataagaagaggaaatttaattttggaactatgaaaatgcaatgcaacatacacaaggctatataaaaaaattacaaaccaaaagcatgttaccgagatggcattggtccttgatgtgaattctccatcctcattattggctccaattcttgaacttggtgagaatcacattttctcgcataggccaaaactccaatgcctctcatgtacctatattctcattttggcacattttggtccccaacaaaattgggtccatcaatgttagttaccaaaatacgaggcacccaaatggtcctccttctaggtgcaagtctaggtaaaccaacatatctagcaaacacattgccttgcctatttttcctaagcacataatcatcaaaaataatattaggcttaggagtattacctatgggacaatttttaccaatatgtccctttttgcggcaattgtagcaagttaggttttgacctctatgacttgtcgttttgtcttgcttcttgccggtttgcctcaatttgaagttgcacttctcatccttcatgtttgcgcacacggaggcaaagtgtcccttctcatgacaaccaaaacatgtaatgtgaggatggttcttactcacatttttctttccatcatttcttaagtatgcatgcttccttgcatatctaggcatgtgtcttgtcttcttagcattctccttgcgatgaaagccaagtccacacttgtcatttgtgctcttttgcttgcttaggatttcgtcaagtgtgttcttccctttgtagcttctatccaagtcttcttttaaatctttgacttgggcttgtaattgcttgttttcctctacaaggttagcaacaatatacatagaggaggaagaacaagaattttcatctatgcttgagctacaaggtacatctaacaagtcatcacaagaggtggacacactagccttagatgtactacatgagctagctacacatggcatatcatcatcaattaaattacatgtgatgcctatgtccacctttggcttactaaatgcatttccaatgagaagagactcataagcttcttttatcttcttataagaatcacaaagttccttataagaatttattagctccacatttgagtctttcaaagagagaagagttttctctaaaatttgattttttcttcttctctttggcaatgtatttactagcctccctaagaatgttaaaaagatcatcatatgaaggttcatcatcatcaccaccatcatcaacaacacaagtattttcaataatactatcgagagaatcattctttacctcattcttacaatttgtcattaagcaatgaggtgatgtggatggtattgggagctcctcatcatcacttgaggaggtggagtcttcacccgacatcgattcttgtgtgcaaccattctcaacaagtgtgggcacttcatatttttctttaagctttacccacatagcatgtgcactcttgagattgcatacttcattaaacatgtcatcactcaaaccacaaaataaagcattagtagcttgagcatcgagatgtaggcatttatcttgcccacttgttggagcatggtcatccaaagcatgagaaaagcccacatctacaatccaccatatttttgggctcatggccgtaaaataagaaatcatgtggattttccattgtgcataatttgtgccatcaaacataggagggtcaccacccgtgtgtactatatctctagaagccatccttttctctcggaatagttaagtccacaaaatgagagaccaagctctgatacaacttgtaggatcaaggaggccgactagagggggggtgaataggcggttttaaaacttaatggcacttaaacaaaactaacctaagttgctaggcaaggtaaggtgcaagggttaactaagcaactaagttaagttttgcaaacctaggtgatatgggctcaaatatgtctctatgaatgtaaatagcacaaatgtaaatgcaacaaataaatgagacaacagacaaggaatttttcaccgaggttcggaaactcgccagtttcctaatccccgttgaggcgagcccaactccaccgctcaaccacgaaaccaccgcacgcccccttcgtcaaggggtgggcaaggcgggagccggcccacggagaggactacccaagcctcgatcactcggggtagttcttccttcactccgaaggtggtgaactccaaaccactcacaaacggcaccgggcctcctccacaatctcctcggagaggtcaccgagcaacacctatacaagccgtctaggaggcggcaacctccaagagtaacaagtctaggatgcttgccgaggatgatcaagtgtcacactagctataacaatgaagcaatgcacttggattggcttaactcactctctaacacctcactagataaacaaagtgcacaagggtgtgagagctcttgcaagggttcaagataatgcaatggagtgccaaaaccttacccttgctgctggggagtgggtatatatacccccaaccaccaaaactagtcgttggaaccgaaatccccaactctgtgccctgccggtcagaccgccgttgtgaggccggtcagaccggactactttgtaacggctagaaagctagccgttacagggcaatcattgagcccactcaacctggtcggtctgaccgcagtgtagtggccggtcagaccgtcaacggctcggtcagaccgccgtcggctcggtctgaccggttgcggctctggcggctttgtatcgccaccaaaaaccaaaccagtgcaacagaccagtgggccggtcagaccggctttaccacgccggtcagaccggctaacaggcctggtcagaccggcctaaggcccacggtcagaccgcaggtcacttttcagctcaaccgaccgttaataaaacggcgatatctcttgactcgggtctcggaatttggcgttcttggactctatggaaagcttattcaaagggctatccaacccatgaacaatccatccaagaaacacaacttttctctgggagaaagggctcacactccaaaggatactccaccggacataaccacatgaggctacccaaacctataggatttgcccacatctctctttgtttaggacttgagaaaactcaccatacttggctagacaagcccaccaaatacacctacatgcatatgaactaatatggcacaagatcatccacaagctcgcttcatagacccctcttgatagtacggcgcctatctagcaaatccggtctacaccaaacaccaagaccgggaaaagactaagaaaacattcttagctccattatacatttgccttgcgcatccaacttggggtcaagcttgagtcgagatcaacacttgtgaccatttgattcaaccatgtttataccaaggtattcacaatacacacacagtttgtgatatcacaatttatctcaaatatttacatgcacctcggtaaatattacaatcgccctgctcggcgtaagtttgcctcctgcgcgaggacttaagaagaaccactatacagaggtaccaccttttctagataacttaatcagctaggtctatgcccatacgagaattgcggtcgtactcgtatgttcttcacatgtacttggcaattttatgtcggttggaacagtactagccacccggaaatcaaccatttctaccgtattgttccaatctaagtttattatattttatgcaatctaactaggcatggctaagcaaaatctagcatatatctggtttgctatatattcaggttatgcattcgaaatcatgtatggctaatgcataagataccggagatatagaatataggattattatgctcaaaggggaggaataataacttgccttgctccaacgcaaataaatccaagataggcaacctgattatccgatccttgaaatatcacaggctgccatccaaaatagactctactaaagaagagaaagaaccaaattcaataaaaatcacaaaataataagaaagcgatgaagggcaagaaaggctgggtttggggtataaatatctcctttataaggtatagggattattggctaatattttatgtggaggttttagagggttggaggctaaggtggagaggggatcaagcaactaatgtcgcttatatttcatgagtgggctttggttgtttggagagtaagagaaataactggttaagtgagtatgtggctaataatggctggtggcaggtttaggtagtataatacctaggatttggttatatttaggccgattggggatagggcaatatatcggctagctctatattttatatataggttctaggtagttagagagtaggtggctgagagtaggatggataggcgatactggtgggtgtggaatttggatgacgggtgggatttatctagtaaggtgtcagctaggatttggttgtgtgctagtcgatgctagtgttgaacagcataacgattagatttggtgtcttctctagccggtgtcgatggacagtataacggctaggaggtgggtgcaggttaattcagtggggcgaaagtgttactccgacaaccgtgagtggcggcggagcagctaagatcacacagagcccgagagctaattgtgtgacgtgctgtggaggtcgtgggaatagtgaagctccgaccgttatacgcgtcgaggtgtaaggtgccaggagcagcacttcgaccttgggtttgggttttgccgggctttacaaccaacggttcgacgtcggggctagtagaccgcgaacgtccccatggaaggcgtaaagtttcaaccggcggctttttaatggctaaagggtaatttgggacggaagaaaatatttaaaaaggcaaatataaattcaaacaatatttgaataaattcaaataaaattataaaataacaaattgggtatcaaaatatatcttttgaatttagatgaatttaggtccaagtttcatcggaatcggatctacggttcaggagatatgggcttctaaagtttggattttgaatcaaatctagaaaatgtgaaatagtactgtaggggcccacctgtcagttttccttttccttttcttctctctttcttcttccttcttcttcctcccgttctcttcctcttttctgttgccgagtgagttgagaggagggagaggaggggcgccggtactctggtggttgagaggctgcgacgtcggcggcaaaacatgttcccgagcgacgcgcacccggggagggtggtttccggtagagagggttagggtcttagggaggagaccggaacggcgacggcaatagcttgctccggcaacaagaggaagtggctgtgatggtttgtttcaaaggggaagggaaaggggaaaggggtgaaatggattcgcctcgtctaggcaaacccgatggcgcaagggcttggccaacaacgctccggtaagggatatcgacggtggccggtggtggctagacataacaggagagagagagctcgaggagctcggctcatatgtggagaaaaggggagggctggccttctatttataggcgtcggacgtcggttttgaaggtcggttgtagaggagaagatggagttggtcttggtggcggcgacgtgagaaggaagacgacggcgccggctgtggcttgtgattggttggagatggcggtttgctccaaaggctgacgtcggcggcgtgaggtggcagatgacgtcggcggcgatgccttagcggcgacggcaggacgttggcggtcggcagagctgcaagcagagccgtgcacggcggtggtggcggcgcgtgatagcggcggcggcgcccaccgaacagggagaagagaggagcggcacggctggagtttggttgggccgactgggccgcgtgccaaagttgggctggcacaacaaggaagggtaaaaggagatgggccaagggagaaagtgaaggactttggcccaaactgaaaataaatgtttttctacattttgaatgggatttggatggttagactttaaatttggaagagatttggataggagaattatttgtggttaaatagggaattaatttggaagagggaaatatattcttcttagcacaagagcaatcattctaatatttataatatatctattcttgtgccgagaagtcttagattataggaactggaatgggagtctagatcaaaatagaaatttgaaatttggaaagggaattaggataggtttataatcaaaggatgggtccacaattaattccaattaaaatcggaattacttggtttaggttctagggcaatagtggggaatttcttggaccataattcataaaaatagaaagggttttcaaactaaatttgaataaaagaattttagttgaaaaaaggttttaaattaaaaccaaatcaagaaatacctcaatttagccaaatatatttttaaatgaaaaacacaaaagaaattaaataccagagaaggattttatgcaagttagttttagaaggtccctctaattatattttcctaggtttataaaattattaagaacataaaaagtggcatgatgcaagattagaaaatggttaattttcggtatgttacacagtcccaggataaagcgttggtatccacagtaacaattataaatcatcgcattctttaaattaaataaaatagagaacttatttacgttaacttaagttgcaactcttgggcaaaccagagaatgcagcagatgacatgaagcagcaacagcaatagcagaagctgaggcggcgaaaaccaacgaactaacacccaacaccacatgcggcgacaaaaggagagagcaaggcggcgagacggcgctcccccacggcacgtgcgcatgcgtgcaagggtgaggtgggctgctgcttggctggaccgagaggagtggcgcatggcccaggcggggagaggaaggagtgggttgggccggccaagaagaaacagcccaaagaggaaggaggggaactagactttctgtagggttttgagggagaaggatttgatgttggaattgaattgggatgtgtttcaagtttgatatgtgaacccaaaaatataaaggattcaacaaaagaagtcaaagtgagaaatgtgacattcttagaattgggaggaatatttggcaagaattacgagggaggatcgaatttcggaatttgactttttgagacttgattcggaacatgaaatgctggggtgttgattttttatatcgacgagagggaataaggagatatttgaattgagatccatagtacgacttcaattggtttttattaatttaggtttttaacgttttgcaaaaagtgggacgttacatgatcagagtagtcaagctcagcccttactacctcgattttgctatatctcactcgaaagatttttttctaatctctcactcgattttctcacttaaatttacagtgcattttcttgtaagttacagtgtaatttatgaaacttacattgtaacttttataagttacagtgtaatttttgaatcttcgcatgtaagttttaaaatttatattggatttggtttttttcttgaagatatggtaatttagtgtccattatggtgtttcttagttgctttttgccttttactgtgtctatcggattttaatccaaagattaaaaaactgtgtgatacgatcataaaaatctttcgaaagatgtacaggtactccctttatgaaattgtaagcatcgacctagcgcattagcccaagctagtgagaatatgaattttaggaataagttcacttcgtgaccctcaaaagtgatcaaaatttaatccgtgatcctaaaccacaaaaccggatatctcgaccccctaactcttaaaaccggtgcaatttgactctctaggcggtttcgctgatgtggcgcttacgtggcagtattgactcggtcttctttccacgtggcgttgatatggcgcttaggtggcgttagaaataaaaaatgtatgtgggactcatttgtcattctcataaaaaatatattgtgggacccactaacatgtagggcccatatgccatcctttctctctctctcttccattctcaagtgttatcttcccttcacaagcggcggcggtcgagggaggccggcacattagggcaagcggcggcggcaggcaggcgacactagggcggcgacggcggcggggccagatcttcctcctccctctctctctctccctccctcatctctttctcccccgttttctcttcacgggagcagtagcgacagacgggggtcgggtttggcaacggcggctgacaggggccggagcggcggcagcagagctcgagggagtaggcgtggccgctcctcgtcgctgtaccatgtggagaaggaatgagagggagagagatggggtcactaacgccggcgccgacaacgacgccgcgggaagggcggaggaggttgtggatggggttggagtaggcgctggccaccgctgctccggcctctgtccgctgccgccgaagatctggccccttctccggccgtcgcccgcccgccctctcgcccaccgccgccgccgccagtggccctatcccatgctcgcggagggaaagagagataggggaggatgaagaaggtagagagaggatgacatgtgggccccacagtgggtcccacaatatatttgtgtgtgagtaacaaatgggtcccacacgaattttttatttctaatgctacctaagcgccacgccaacaccatgtggaaagaagaccgagttaatactgccacgtaggcgtcatgttggtgaaaccgccctccaaaaccgtcgagggagtcaaattgcaccggttttaagagttgggggtcgagataaccggttttgtggtttagagtcacggattagatttcgatcacctttgagggtcacgaagtgaatttattcctgaattttataggtgctcaatgttctttcctttctttatataatcaaaagtacctacactatccaatatccggcgacaagcaaaaggagaacaatgctgattgcatcgactgcagcaccttcttctttgatcatcacggattaaacaatcaaaagctctgaccttgtcgaagatttggagcacaaattaaagctctgccattctattttgcgtatcatgctctgaatgctaaaagcaaaatgtatgcctttggtgatggatcaattaaaaaaaaacgaaagcttagccttttcgaacacctgatggactaatttaaacaatctactagcttctggtggtttctgatgcagaagtaccaggcaacatcattcgcaaatctcaggtcgtacatgcaccacttcaccaataggctgtggccctagtaactttcatggatagtatacttcaagcaatgcccacgagaatttctccctttccacacgttgttcttttgcgtgggcagcagccatgcaggcgtgaggaaagcagagcacatttcatggcctggaatttttcctggtggtgttaggtgcttagttgggtcactttccgttgagcacaatgccattctctgaagttttgagaaggctgctgcagtacagaatgtactgcaaggagtaatcagaggtactacctccgtcccagaatataaccatttttaaagttgaacatggttattaagaaagtagatataagtgattgatgtagggttgtgattggttaagatggaaaaagtgaatggtggagggttgtgattggttgagaagagaatgttggtgaaaaagttatatttttggataaatcttgagagttaaaagttgttatattttgggacggagggagtataatggtatagtacattgtactactacttcaatttggacgatcgtgtactatagtcttcgtgtgattactttattaaattagcgtaccaggtgcctgcaggtattcgtagttgaagttgacaagcattacttgtcagtaaacgtggacctttgcatagtccaaagttaggctgtggccattacaagtgcttgcatattcttggacagtcgagtaacctcactatgattggtatttttttgcaagttttttagtactgaattgcttttgtactgtcgattgtacatttgtactacgaagaacctgaactctggcgttaaccaacctgatattttccacaaatgttcaacagtcaacaaagagatgccaaccaccagaccgacctgaaaccatatcgaccgcgtcagtgaagcatcatatcacgattctcgcatgccctactgccctgcaatgcaaggaagaaagcttcatgattcttccaaattccaatccgtagcagtcagatgcagacggacgcaagggcacgagcaatggagattattcgtcagtaaagctgatatccaacattccaaccacgacgaccaggaaacagagctctgaactttgctttgatgcggacggaattgtttcttactgaagcccaccgcctatagctggagcccggaattgttagggtttcgggacaaagtcgttcttggtactgttcgggttattcatgtgctgactttacgctaacatcttcatcaaggggtcttcctagctctgtgttatttcccttctagtttcatcggggtgttagagatatagttttgtattcctatctcctaccctttttctctgattctctctcgattctgtttctataaatagattgtagagatagagatgtaccgggtctatgtgtacttatgtgcatgattaatctaattatcgcaatgactcctagcgctttcacgccggccatcgtaggggacgccgctcgcctctaaagattggtcgaattgggtgcgtgatttccttactcaggtgctcaccccctcctcacctccgtcgtcgtccccgtaactttctcttctccctcgacggaggagagtgttggttccatcgtcactaccgcgagcctcattcaactcatctactaatcactatgctgttctgtttacaatggtttgagaatcctaaaagcggaaacattctttggttcccgctaataaacccgttctttagtggtggattaacaaaaccagacaaaagattcagtcttttcgaagatctgtaggacagatttaatcagctagtggtttctgctgcagaaacaacaggcgaccatcttcttctgaagaaaggaaaaaaaaacagcaacagtcagcagcgctcttcaatctgtctgtggatggatgctctgaaccgaagcgccagtaacctgaacgcacgtgtttctatcgtttccatccgccaatgttcgcgtgggttgcaggcgcgaaccaaagtggagcacgactaatggccgagatttttattccttctcatcatcgtataattcatccatccaattattcagcgaacctatccggccttggcaacggaatagcctatctgacagagtgacagttacacccacaaaacctctactgacgaaaagctgatgcaaacttcgcgttgaaacgcaccatattgaatttgaattattgatctctcgatgataaacatccgcaaccttttttcactattatgcttcagtcttcagagggatgtaacaaatcagtgcaggccaagctcggaggtgacatgcagtggaaccaaaaagagctaaaagtcttaaaaggtcgtagcgtcaatgagtgtccagttcatcgtgtttgtgtcagcgagttaagtaccctgtttgtggaagtagtgacggtgagattgccacgaaagggaaaaaggcaatgtgccaaccttcacaaaaaaagaacttgtggtgcgagccggagaatctgttggtgataagttgagggaaccgcaacggtgggcaaatgcgatcgaaaaagggatcgtcgctgatgcggacatgatgggctgacgggaactggcacggcacgccgagatgccaatatttctctcgccagatatggcacgacgacgctactgtgctagcacttgtcctcgactgtgtttcagtatcgtagcacttgacaataagcacaactaattgttgtgttttcatctaattttcttctcaactgatatacacagtacagaaccccaacccctatgaacagcatttctgcttttggggatttatccgtcatagctacacccgttcttcctctcgctgcgcctaaatcttaaatctaagtccaaaacgctcgatacacgatctcttttctagtgtttctgcattgacgctatacgtctatacgatctctttttttacgatctatacgtctgcattgacgctgtaaattacagcgatgcattggctagtttcccggtatgaacttcatgcagatgggtggcttgaccttggccagcgcgagcagcgacgaagggaacgtccaaatcccgtcgccgcagatgaggccggacgcgacggccggcacgagcagcgcggccctcttgccgtcgaacctgtgccagaggaacaccacgaggctgccggcgcacatgtcgatggcgaagctggcgccgacgaggaacggcacggccatggccatgggcagcggcatgtaccgcccgtacctgcgcggcaggaagtcccgcgccaggttggcgagcaccgcgaacgcgaagaaccccgcgcacagctgcaggcagtgcctcggcagcgccgagaacccctccacgccgatgatggccatgttccggtagatgagcgcgtacggcgccttccagtacccgttggggtcgccgacgtcgaacgccttgtagaagaggaagaaggtgagcggcgcgacgacgcaccccatcagcgtgcccaccacctgcccgaccagcatcgaccgcggcgaggtcagcgtcaggtggcccgtcttgaagtcgggcataaggtcggcggagatgagcaccagctgcttcaccagcccgcacccgacgagcccggccaccacgccgtcgtccttcccggcccacgccgcgaagatgaagagcgcgatcttgccgtagttgtaccccatgttcatgtcggtgagccccgtgccgtaggcgttgcagaaccccagcgccggcgccagcaggtacgcgatgatcacgtagtaccacttcacctgccggaacatcaccgggatgaggaccacggcgatgacgctgagcagcgtgtacccggtgtacgccatccaggtcgggatgttgtcccggttgaacacctcgttccgctgcatgtcgtcgatcgccatggtgtccgcgtccgccactgcaaatgcgtaatgaactactcctgtaagcttcagcctgaactgaaaatacgcgaggcgatctaaatctttttttacggtgcatttacctctgttgttaagacccctgcgccttgatctttcgcgtacgctcttgagagtgacaacgatcactttgacgaagttgtagaagccatctccaacgagaagtgcaatgcagatgaaggactgcacaggtagcgatgttgagtttttttttttcaaaaaaaaaaaaagctaggaaatgtgtatatattgtgctgcctgaactagtctagtagtactacaaatgtaccattattgggacaggtgaactgatgaacacaccttgtaaccgaacaggcccgacatgctactttcagatgccttagcagagtaccaattccccttctgcttgccgatgagcggccacattattccccaggagaggatcgcgccgaacaagagagagaggttgacaaggtgagaacagatcatcccggcaccaacatacgtgagactgaagtcgaagaaaaatctggtgatggaagaaattactcagcaaaaagttgtttttgttgcggctttaccactgaagcatacaatgatcagtgaaaaagaaacagtaaataaaaattgtatggaaacagtaaaaaaattacgtatgtttccaagctttcagcccaaaggtagggaactggaggaatccgcagacgtcaccgccggtgtagaaccactggaagaagctccacaagaagctgatgccgaaatacctgaggaatccacggacttgctttctggcattgaggggaaaccattgaatcaagtcagtgaatcccaactatttctgcagcgtttttggtcggctcaatcatgatttcatcagcacttggctgaaatctgaaataaagagcttacttcgcattcttatctccttgaggcgtgtgaaacccgtttatgagaacagcagtcgctgtcccacttggatatgttagcttgtagtcgatgaccagcacctgcaaaatatcggtttttatcagattccttcatttttgcatgattgcgataattagcccactttttgttcagaaaaaaaaagactgaaggacacaataaacgtgtagaatagactttatcagtagtgtactgtagcactccaaaccataactgaaagacacaacaggtccttaataagtgagaaaaggagaaaacgatggttaatgtttgttaatcgtggtcaacgattgcaactctgatgctgaacgatcgtacaaccaatgccatttttttcagaacgtatgacagtaaagatcaatctcggaaaattcagggaatctgtcagaaacggtaaacgctgaaaggtacggcatggaaaggggaaaatcaaagaagagcaaagggagtcagtagtgtacctttcggagagggagcaaggtgaggagccccacgaagctggtggagaggaggaaccccgtcatccacccgatcccgggctccttgtagctccccggcacgttccccggcgtgctcgcgccggacagctcgtacgtcttcttgttcagccccagcaagaacgacccgaatccacctgtgctccacgcgaacgcgcgacgcggttagcgcaacgagacgccaagattggccggggtgatgagaggggaggggagacaggagagctaccgccgtagccgatggtgtagcaggcgacggcgcaggtctggatgacggtgttctcctggcgggtgaaggggcgggaggcaatgccgaggcggtcgagcgcgtgcgtccatccccggagcgcgaggaaggcgagcagcgcggcggagacgttgagcgtggggatgagccccgtggtgaggctcagcttcatcacgatcaccgtgtacaccacgccgatcagcagcgccgccaccatcccgcgggcggtcacctgctcccgccacggcgggacgcgctccgcctcgcgcgccgccgccagcgcgggctccgactccatgtcctccgccgcctccggcgtcttctcgatctccagcgcgccaccgccgcccagcgcgtggcggtccatgctgccggccgcacccgacgaggcgccccccctggggactagcagctcgagctccgagacgtcggcggcggcaccggtggccgcggcggctgcaggggagagatgtaatcgtgagcacatttgtttacgcgtaccagggcgacacaatccaacaacccatccatgtgcgcccagcgcccttgcattagacagaagagtacaagcgccgttgaattgaaacgggcaggattagttataaaattggcttctagcaaagccagaggcatttggccatctgccactctgctccacgggggtcagtaatgacagaggccaacaaggcgacgaacaaaagaaccacaaatcacgagcagaaaccagaaaggcagcaaaagcacaatccaacaccaaattgtaacgagcaccgcatgcagaaacctctcacctgtactgtcctccctgcgaaaacagcagcaccgctcggagacgacgatcagacgaacgccaccacaccggggatgggaacgagaggaggcggcaggcgggtcaattaaataggcgtcaactgcggggaacgactgaacgagagaagcagctcggttcactgtactgcaccccctctgcacgacgtatccagtacacgtgtggatgcgggggagaagtacaaaaaagagaagggggggagaattttcagaggtgcagtacaaggggaacggacggcgacgaaaatggcggggtcggtcagtgatgtgcgatttttttttccaagagcaacgaggggttggcgtttggaccctgcacctgcagcaacctcctcttcttcttcttcttcctcccgtgcacttgacttttgcatggttgggtgagggatcgcgacgtgtggaaatacaggaataaactggtgatgggagtgtgccccatggctttgcaattttctttcccctctttccgtggtcggatgctcggattttgtacatgtactgcttgtccagtttcaatctacgcgatcttaatttgtgtgatctagagtcgtagtacaagcattcgcaatatttgaggagttcgtgtacgcaaatgcaaacctcatgtacctagtcgcatgattgctacagatgcaacagattcagtatcgcttgatttcgtgtaaatagtactagtagtagtatcatgcgactgaggtatggaatatatggcattggttgtcatactcatacccgtctccacgaatcggcacacgatttaaagcatgacaaaagagatagtgaagtgatatcattaaatgagctggaatttttctacgttagaagtgaagagaattttatgggtggaaaagagaaagaaaatgtgatattggagttgcagtttgtataaatttattcaccgtattcaataatttagcgagaccagagatttatcgttggcatctggacgtgtgttgctcctcttattcctgaggcacacgagtgtagtgtgcatctttctataataataatagaaaaaagagccttatcagttgtccatattttctaataagccaaaatagcttattagagaataaaaattaatttataggtaaaaattttatatatttgttcatagtgattaaaagccaacgctaaaaagaaattaagttcaaaatattttaaaatcaaattcaaaattttaaaatttggtttttgctttgaattattaggccaaccgatggggctaagagttttggaggtgtttcactgtgttaagctgctgctacacagccgtagtagtgcggctgacaccgtagatatatatctttgctctggtattatagttactgccccgctttcagtcacaattggtactaccgaacaccccctctatgtgttatactcaactaaattttaactgtgcaaatatagttatcgtgcatgtgcactcaaccgcgttccacctcacttggtggttccacgtcactcttaattcaattgatgtcaagttagtcctgatataattataaaggaaaaaattgtactcctggtatccagcttttttctgactaaaatttagggggcatatttaattgcaaattaattcattgtttttggaaagtcaaattcataatagagttggccgcatgaactcatgcctgttcagtgtatggtgttccgaaatttaatactaagaaatagataaggtaaagtagcattcttatgaggctacttgccagaaatgatataatcagaaaatgatatgatcagaagttggacatgaacaatgactctgtatatccaaatcgaaagtcaaatagcataggctagagatcgtcgagcactcgagcccccaatcaatctgtagctattacgaaacccaggtaattaagttaagaaatccggtgcatccatctcatttttcaattaagatttcccattgactgtagtttttttttttgtttggggggtattattcttcctagaatattggtggagtacagccggttgcaacggtttgtagtagaatgaacaatgcgcgacacagtattgtgataaagcctctgcatcagtataaaaaaaaggaactgaagtcgtaccattaaatgcccttcttttgagattataatgttgattataaagagcacgtagcaaacgataagatttttctaaaaaaaaactttcctcacctatatttcttaaaaacattttttaaaagtgcattttttgtaatattaatttattcgtttgtatactcaagtaattaacataaactcagttaacaattcatcatccattagcaaattcaaattgtcctaaattagctgggttttctatcagtattaaagaaattctattggttacactggagtactggactaatatttaactggtacggttaatataaacctagcgcaactctgttggaaagtcaaatgcatattagagatagccagttagccacatgagctcatggtttacaggaatcaagtgtatggcgttccaaatttaataaagaaaacagataaggtaaagtagaattcctctgatgcaactcgccagaaatgatctcatcagaacaggggaaacatacactaacatttctaaatggcaagtcaaacaggcataacatatagagatcaccgtgacccaaatcaatctgtagagtcgtagagtggacgatcgacaaggcctcgttgtgatagagagcatcactgcatcagcatcggcctataaaggcaacgagtgtcatacggagtattagcgttagttgccaaaaacaagcctggagttagctccatgtatggcagtatggacttctgaaaggagctagaaaagttcttaactaaccaaaagcatctgaaactgacgctactttcctcctggtactgctactctgctaagaagattttaaggctacgaaactttcgtagaagcctacataacgaaaaggttgcatgggcacgatgaacaacttggagacacgagacccataactgggccatcaagcccatcatgccgtcaagaatcaggaaaaggcccaaactgtaaccgctcctactacatcagcccaacgtaccaacctcatgggcttaatcggcccattacgcgctggttcggcccggtacagcgcatgctgcaaccgcgtacaggccatcggaacgacacgtcggatcgtcggcgtcggcagcagcggttaaattaacagaggcgggagggcagcaacaagtcaacctgccaccgtgccaccgcctctccgtccccatcaccctcgcaattactccacccgccggccagcccaattgtcgaaatggcaatcacccacatcacatgcagatcctccctaaaccactcgatcatcccgcccccactcctcctcctcctcatccaggtagatcccaacagccgatcagatctcccactccattattcgcctcgcccattgccccgtggccacgggcgaagccggagggaggggagagacgcggttcctcggtcgccatggacgggctcatcaaggggctgatcaacgtggcgatcgacgccgtcgaaggcgccggacgaggtgagcggggcggcgaggacgacgcgccgaggaggcaccgccccgcgcgggaggaggaggagggccgcggcgacgagcggtcgcggtcgacgtgggccgaggtgagcgccacctgttcgcgcgattgcggaagaagataaaggaaatcgtgagggatgtaattggttgggtttgtcggtctaagcttcttagtgttttggggatgtggcaggtggtctccgatcacaagggcggcgaggcggaggagcgcccggaccatcggaattcgaggcgggtgagtgacgattgctgttttgtctgggagaacattaatccagaccggaattcggttttagttaatcttcttctggtagtttgcagttagtgttatggtagtaggggcgtagttaaggcccgtttggcacagctctggctcccaagtccaacttatttggagctggagctgttccaagcggtccaaatcctttgtttttcggagcggagttagcagagctactccacaaatttgtactacgggggtggagctgggtttttctgctccacagctccactctaccccaaaagacccataagtgcttaataatttaattctctggttgaatttaggatgggaggcaagagaggagggaggatggggattgggagagggtggatggccggaagcagcatcagcacaaccaggttttccattttgtgtacacattttctgtaaaaattgtaagtgtgccactctgcttacgtagctgggctccacgtctgtagtatgaggaagagtacaggagggacagtagtagccgacgcccacagcagcatcagcaagcgccagcttacaggaggcagcaacaggttcgattcagttatcttcttcctttttctttttgcaatacagatatgtacatgaatttgagcaattcacatattatatgtttgtcgtgttgtagccttggtggtgctttggtggttgtgtgtggcacattttgagtttgttccttagtcacagaatagtgatatagagtgtacaggtctagtagtatatgcgcgttatgtagaatgactctttatttctttgatcttcttgtttaagcttcttcctgaaaaataaagagttggtctaatggtacagctcgattgaagcttgtatatctcaaccttggctcattagctttcaaaaggaaaacaaaaggagatggaagcttggagtgaatactaaatagagcttgataatctcatttccggatgtgtttttcctatgctcgttgcgcttgactaatgagttgatcaagttaataatgtgctaatatttactgcaaaatacatgcttataatctcataaacgaagttacaattatttaacagttcttcctgctgctatttagtttttttttctagcatcagtttgaagatgggacaggtattttgagtgtatattgtggaggcttacctgtttggtttggggtactcaggatggagatgagagaaatgatggagggtggcagactgttggtgagaaaaagcatcatggaaggccacagcaggtttgcttttggttttctaacaattagatacaataacatctgcaaatgttataacttactgagatttttaggtatctgtttttgagtcaatttgagcccatgtttatactcaaggtcaactgactactataaataccccgacaccccgtatcactgttcttgtttggctgaataaagtcaataaacttattacatattattttctaaaagatatttaacgtctgtcagttgatgctgtctttgaactggttagcatgcaaaaagggcccctaagctattccattttgttcaaccaaaccccttttcttaacttgttgatttgagcccctgagatatctacaatgtgtaatcaagcattctattgcactctctgttatatgacaaaatgagccccaagtgtcaggcacagttgaccaacaatctttcaggttttgagcaataccattgaccaatactttgaagctttatgtatcagcccaagcactttggtttattgtactttttgagaactttagtgtttgcatcgttctaccactgtcagagtcagttacccttttataaatgaactgatcgtcagtttccatttcacaatatgagatcgccgtattaatatattctgagcttccttatcctgtctgaattctgagcaccttcataattactatactatacagtctgaagcatggaatgcatacagaaggccaccatctgaacaacagtactgtgaggatgctggtcagatccaccatggcctaaatgtagaaccaaccagggaggagctcaacagcttatcaagagcttgtagccggctgtgggaactcgatatgaaccgcctaacacctggtaaggactacagaatcgaatgtggcgaagggaagaaggtatatcagaagggtgatatggcatctgaaactttgttcagctggctaggcgatgatgtgcttagaaagcccacctactctcgtttctgcgcgcttcttgacaattacaatccacatcaagggtacaaagaagttgttactcagcaggacaagcacgaggaagtagcatttattgaagagattgccaggacagcgccaatcaagtacttacaccggtatttagtgctcaagggagtcgcgtctcaagactatgaggacttcaagagaatgctgacatcgctatggttcgatttgtatggaagaggtggcagttctagcagctcttctgcatttgagcatgtgttcgttggtgagatcaagggacgacgaggacagggagagaatgaggtctcaggattccataattggattcaggcaagttcttgtaatgttacaacagttcttgtattccttgcataaaaattactctgattggtatttcgtgaaacaattgcagttttacctggaagaagccaatgggaatgtggattaccaaggttacatattcccaaggaggcgtggggaatcggtaagtatctagtcttaaaattgatagacaagatgaacttgattatgagtaatggagctaaaatgtgcaatgctccttttggcagcctgattcagagacacagctattgactattcagtttgagtggcacggtgttctgaaatcggtatccagcactctgattggtgtcagccctgagtttgaggttgcactctacacgctctgcttctttatgggaggggaagataaccgcgttgagattggcccgtacggagtaaacatcaagtgctaccgaatgggaaacagcaaaattgggtcagcatttccaattgcagataactgaattcgttccatgcctgctcctgcgtgtatgtgattccttcagctttcagtttcacgaagttattagtgtgctgttcgatttggtcgtttacacaaaagaaccacattgttcaatttgttgtcacaatgtctctactgaaaattgtattatttggattaaccatgctgtacaagttgtagtcacaaagtcctgtaatttgtttttctcaaaacccgtaacaaaaaaatatcatctcagcacaaaaaaaaaatccttcagaagtcaatcctgcattgtgattgtcaactccgacaagagaatgaacaggtcacgtcgcggcagtggcagcagcagccgccctcatgagcatgagccttctcctcgcgtgagcgctcgcgctcgcgttctccccgagcgcagcaaggtggagcatccgccgcctcgccgccgccgcggccacggccacgtcgtcctccacggccgccgccgccggcgagctcgagctctcctccccggcatcatcatacacttcgccgtccagctcggcgtgccgcgtcgcccgcctcagccgctcgaccacctccgccatcgcggggcggtccttgccgtgcttcgcgaggcagccggcggcgagctcggcgacctccctggccgctctcacggagtacctcccctgcagcctcccgtccatgatccggccgaaccgcgggctcccggcggggtgccgccgcacccactcgaggagcttctgctcgtccttgggccgactcttgtcgatcgaccgccggccggcgaggatctcgtacagcacaacgccgaagctccacacgtcgctcttggtcgtgaggtgccccgtccggacgtagtccggtgccgcgtagccgtacgtccccatcacctgatccaccaaagccaaaacggattcatttctgaagaattcagaagtgatatgatccgtgttgagttgacacattttctgaactgtgatgtttgcacataccgctgtggagacatgtgtctgaccttctgatggcccttcccttgctaatccgaaatctgacagtttgggtctgaactcatcatccagcagcacatttgcagccttgaaatcacggtatatgatctgacaaacaaggaaaatcaggtgaaaatggtgtgttttctgatgaagacgcgcagtttttcggagaagatgtggattacctgaaactccaggccctcgtggaggtacagtaacccctcggcagcgcccagcgcgatctgcagcctgacgccccacgggaggacggggtgggatcggtcgaacaggtggtcgtccagcgtcttattcggcacgaactcgtacaccagcagccgctgcgggcctcgctccgtctgcgccgcgcagtagccgaggaggttgacgaggttggggtgctccacgacgcccagcagctgcacctcggcgagccactccttgtgcccctgcacgagcacgatacaatggagtcgtcacaaatggcggaagcggtcgagatcaaccgggagcgtgtcgtcatgtgtgtgcgtgcctggcggctgtcggggttgagcctcttgacggcgacgggggtgccgtggggcggctcgccggggaggcggaggacgccgcggtagacgcacccgaagccgccccggccgaccatgagcagcgggctgaagtcgcccgtggcgccgcggagctcgcggagagcgagctcgcggggggcgccctgcctcgcctcgtacggctccggggtgctcaccgccgaggagctcgccgacggcctcgtgctcgcccacgacgacgtgcacgtgctcggcgcggcggctggcacggacacgttcgagcacgcatcggtggaaacggcggcagcggcactcggggagggcggagccggtgccggcgccggcgccgccacctccggccgtctcttgctcctgcgcttgtcctggaagaggcacatgcagcccatttcttggaggaagaagcccggctgctaccacaatttcaggtacttcaagaactcagaggttgcagagaaaaagatcacgcattggtgattaaaacagagacattttctatttcttctgttgctcgacaatgacttgtctgtacttctacgtgattaaaatccaaccaggagaaggccaagagcaaagagaacacagtggaaggaagaaccaatcgatcagagaagaaaaatccagcaaagccagatttctgccagatggaagagaaatccaacagtagacagctgccgatcacaagaaactcaatggcagcagatgctcaagaggagacatgcctccaaatggccgaatcgtttgatacaacagtcatggaccatgaactgtgtactgcctaccgtgatccggctgaccggctccgaagaatcaaagtgctcaaccagtcagttctcagtcacctcccctgccaacctctttatccttcttgcttttgctcgaagcaagcagaacgcacacacggtttcctgctaatctgcattctgcaagcatcatgggtgtttgaaatgttcaaacttcaaacattacggcgtccattggatcatcaacactacaggatgcggaaagatatccgcagccacatctctggctttctcccaagtcccaaccaccgcctcctctccctcgaccgctgcctgaaccacgagaggatgactagatgatcccacacggcacactacattgatgttgctaataacatccttttttttcttcctctttgtgctcatctagtcatctctcgttctcttttttcattcttggaaatctgcacccggttgacaagaattattgactgccgaacagtgatgtacttcaacgtattgacccggatacgtcgttgttggcctgctcggtgagctatctatgtcctgactttttgcttcactctgtgtccatcttgacctgcatggctgactatcttgtcgttcggtccaaaaaccggcgccttatgagcggaggacaggataaatgatgtcccaaattatcacagcaaaacagattcctgccgcaggtaagggcatatacaacggtatttattaatggtctctctattgccatgcaaataaatttaatatatcgaagaaagataaacgagtatggttgttatgcatgacagcggcttatagtcgactcttagcatttataagagcaatttttgttgtatggcggtgaaagaaaggaaaaaaaagtaagaaaaagtattttgatacattaatgattagagactatgttgtctctaactgttgtaagatgctagtctctaggtaatgtagagttcatatctgactctacctttgtacacgtcctaagctaatctagtagagtatttcttcagactccaaatactatagtcaataacacgtgcattggcacgggttatatactttactagtactatgtatgttccatgtgttgcacttgcaaggggatatagagtaaaacgaatgaatggttttataaaaaatcatttttttttctattatggttttctagcggatctattctcacgtggaagagaattttttaccattcttgaggtaccacgaggtaccaggtactaagaggtaccaactttgtctatccatccgtttgcaaaggatacgatcggaataacacgtgtggtaacccttcgctctgcatcctcgtcttaatttgctctgggcaccggtgacgtccgcggacggcgcggcctcgcctttcctccagggtgccatcgggcgtccgtccatcgttgcggccttcgatccaaggcgccacctccatccgtccagtgcgccgccgggactgccggccatcgatccagggcgtcgttgcttcacaaagacagcctccccgcttcttctgctagccatctccaccctccccgctgcagggcaccgttgccttcctctttcagccatctccgccccctttgctcctggtcatcgtgttcgccccaactccacacagcaccagtgagtacggatccaaattaagctccacactttgtcagtcatgccatgtccatagcatgcagagtggtttgttattctaagccttgtttagttccaaagttttttttttccaaacttccaacttttcatcacatcaaactttttatacacacaacttttctatcacatcgtaccaattttaaccaaacttccaaacttcagtgtgaactaaacacagccctagtagctcgcatgaagtgagtcttcagtattttagaagtgccaaagtctgtttctggaactctgaaccttctgaaactcacctgaagtggaagtgtggaactctaaattttctttagtgtagtattcaggtagtacacaatgcttattcagatcttgtttgtggaacataggatttgttaggaatttacatcagacatgtattcagaactttttgaggacggctgatcttcaagctccctgttccttctttagatgattattggagtattgttcttgaaaaggctctttcgtaagcccttttgtaagtaattatgattcagcgcatatttgatgcaattggtttgcaaacaaagctctggtttgcaagactactagtttttttttttgcatcaggcctctgaatacgtggatttatactgccttctccagtgagaagctttgggcctgtttggggagctttagattctgagaaacagctgtttggtagccagcttctgagaatctggaaaagctctgaaacccagcttctccagcttctggcttcttagttcatttttcagaatctgtaactacagattctcagaagctgtggactatttggggcagcttctagcagaagcagcttttgggaaaagctgcagctgggacaagctcccccaaataggactaaatttgtctgcttccagagttccagttgccttgccgcatgttgctggaggcctcagcctcgccgtagcctgtagctaccgccgccctggcgcgattggcctggcagctgccggtgcccttgcgacgcccttcctcactctagcggattagggagaagagacgaggagacgacgccatcaggattgaattggcaaggggaggaagcgggagtgccgacgggatgggaccctgaagccgccattcccctcggctcaccttccccgaggtctatacatactaatagggaggagggactagacccctcttcctccctccggcctccctccgctgtcgccgaagaacgggagaagaggaggaagaggggccgaacaaaagaagggattacaatagcttgattaggggaaactagagagctctcccgcctgttgagtctaggcttcaaggatcaaagttccagtattgaattagaagaggccgaggagtaaggtagcttacaaaggaggaagggagggtaatataccattaaacttcgtttttattcattgcaatgcaagtgcagtattttgctagtaccattaatcttgagtattatattgttcgtgttccatattattttctccaaagaaagactcaactgccgagtctccggtcccacatccataatttcatcgacaccgacttcaatttacagggcaaaaacaaaatacagttcacgaaaagaccaaaacgccctctgcctcgcaggagaccggtcaacgcgtgagacaagtcttgatggcaatagcgtaaatacgcccgaacgcccagcgtcatcgcaggatatacgcctcgacccggagattacctaggccaaagggttccgttcctttccgtgttgcctcccaccgcaatctcgtttcggctctccggccctctcctagggtttcgattcctcgccccctcgatcctcgacgacgcgaggtgcgtacgcccatggattctatagcctcgccttccctcctcgattcgatccttggtccatctaaatccgtcgtctttgtttggtgatctgcaggtggttttccttttttttttggttttgtttgtgagagtggggggagatgccgccgaaggctaggaggggcgccgcggcggcggggaggaaggggccagggacgaggggcaggctggtgaaggcgcaggcggccgtggaggaggtgcccgccgaggaggttaaggctgcggaggaggccccgaaggtggaggagcagaagcgccagccgtcaccgccactgcagcagccggccgcggaggagaaggcctcgtccgacgctgcagcgaacggcgcgagccacggtgaaggtattgcttgcttcttcttcttctttcttttttttttttggtatagatcgtttatgttgggttgtactatgtcagttttttggtatattaagatgattgctgcattagtgtatttttatgtggggtgcaatgaacgtccgaagtagcatgtcatggatgtcttgttatattgactgttttccatttaatcctggttagcattgcttatggtcgcatggtttgcagttggaatattagatctatgagatcatttagtactgttccaacggttggtctttgattcagtctgagtacatggcattgcccttcaacaaacagcaacattgatctttcctagttttatgcaagcaaaacatagtgagaaccactcttaataaaacattaagatcatatgtttatggcaaaacataaaagatcgtatgtttatactttatactcatggctgtttttttggctatatttttattggatagcagttgcccatgtagtaaggttgtacttatttcatttttagatgagggaactacaaaagaaacatatgaagaggataaaggtgaacgattggaatttgaagatgaaccagaatatgaagaggaggctgctgtggactacgatgagaaggacttggagcaatatgaagagcaatacgaggatggtgatgaatggtggaatatactgaagatgtgattgaagaggagacggatatggtagacgaggaattggatggtggggacgatggggagggtgaaggatatgaaaatgccgaagaagagcataatgtggatgtggaggatgaagagcatcatgaaatggtgaaagagcatcgcaagcggaaggagtttgaagtttttgttggtgggcttgataaagatgcaacagaaagcgatcttaggaaggtttttggtgaagttggcgagatcactgaagttcgtttgatgatgaaccctgttacaaagaaaaataaaggctttgcctttctgcgatatgcgactgtagaacaagcaaggcgggcggtgtcagagctaaagaatccttcggttggtctaaagatatggatattttatattatggtgtgttattattataagtaataatctcataattcattaaatgctgtaggtgagaggcaaacaatgtggtgttgctcctagtcatgacaacgatactctttttgtgggcaatatctgcaagacatggactaaagaacatgtaagatgctgaaacaggttttcttt

SEQ ID NO: 58720 - DNA, 6428 bp, Oryza sativa
aagcatgaatagtacatgtggatatttttaacatgtaaatctcaattttagaaaaatttagagacttgaaccaactaaatccgagctaagatgaattaattatgaatttttgaagattaaatcggattaaatcatttatatagattttaattgaataatgacgcaataatgaattatttttgaaaaggaaaagggaattattgcgtcagcgggtcaggtttacggtggaccgggtgcacggcggctgttcacgaaaacggacggccgagatcgatctaagacgaaacgaacggccgggatcgatctaatccatcgcggtccacgggagaagacgacgatgacgtcggcggtgacgtcatcaccggcgacagctcgggtgcgcatgctcgccggcgaacgacagcgcgacggcacaaacggaggacacctacgcaatgcgggcgacacagcaaaccttaccgaggcacgaacggcggcggacggtgaccggacgacgacggtgacgaggatgagcggcgatgacgatcgggtcgacgacgacagcgatattccggcggtcctcggcgttgtcggaggggtggacaaggtcagcggccactcggcgaacacggcggtggccttcccgagcgacgaggacgaccggagcggcggcggcgcatggctggacgaactacggcgacggcggcgcacgggctaacgcggctagagctctacgaacggcggcgagcgaaggcgaaggtggcggcgggtagaggagacaccgggggtccttataaagggcctaagggcggctgtggaggcccgcggcgaccggcgacggcgatggaaagaatagggttggggaaagaaaaacgaatccgaatcaaactcgaatccgacgatttccaaaggaaattagacaaagttcctatagaggaaaagatagaggagatcaaggggatcctttcccctctaccaatttcaccggagaaggaacggcgcgaccgaattggaaaggggcggtggctagggtttcggccggcggtctgctggaggtggacgacgaccgacaggtgggacccacctgtcagcgacgggagcgcgcgcgcgggcggctcagtttgggccgacatgggccgagggagagagagagaggtttgggccgactagccaaaagagaactttttaaacctttttcaatttaaatttttcatgaaatgcaatttcatttattaaaaatacttccttagctcaaataaatcctagaaaaatctaggaactatagaattaagcaaagtatttaataaaattttatctggccccattttatattggaatttattaattaaaaattagatcttctcttctaggcttttaaaataaattctaataattccaattaaacaacaatttatatatttgggatttttagggtgtgacaaacctgccccccttaaacggaatctcgtcctcgagattcggaagaactagcgaacagatgcgaatgagctgactttaattcatcttctcgttcccaagtggattcttcatctgagtgattactccattggaccttgcaaaaacggataactctattcctggttcttctctcatctgtctccaagatacggattggtttctcaacatatgtcagatcctcttggacttctatctgttcaagattagcctcttcggtaggtacccttaaacactttttcaactgcgacacgtggaacacattatggactcctgccaaagattgaggtaactccaactgataagcgacctctcctcttctactgacaatcttgtaaggtcccacgaaacgcggtgccaattttcctttagtgtgaaaacgatgaacccctcgaagtggcgtgacacgaaggtacacataatctccttcttcaaaacttagatctctgcggcgattgtcggcgtagctcttatgacgagactgagccacccgcagtctttcttgaatgatttttaccttttcctctgcttccctcaggatatcagttccgaaaacctgacgttctaccgtttgatcccacaaaagcggagtgcaacacttccgaccatacagtgcttcataaggagccatctggagactagcttgataactgttgttgtacgagaattcggcgtaaggcaaattcttatcccaacttccaccgaagtctaaagcacaagctctcaacatgtcttccaatatctaatttaccctttcggtttgtccatctatctgcggatgataggcagtactgaagttcagcttggaacccatctcctcctgaagtttcttccaaaactttgaagtaaactggctacctcgatcggacacgatcttcttaggaacaccatgcaaacaaacaatccttgccatatacaattctgctaaatgacttccggaataggtgatccttactgggatgaaatgagccactttggtaagtctgtcgactatcacccaaatagagtcatgacctgacgacgttctgggtagaccagtgatgaaatccataccgatttcctcccacttccattcaggaatcttcaaaggctacagcaaacctgcgggtttctgatgttctgccttgactcgatgacaaacatcacatactgctacatattccgcgatctcgcgcttcatacttgcccaccaaaatctttccttgagatcctggtacatcttagtactaccagggtgaatggagtataacgtatcatgggcttccttcagaattgcatctttcaaatctttgttgtctgggggacacagattctctcacccaaccatacagttccttgctcatcttccaagaaaccgatagctttacctcttctcatattctttttgatctcatgaatatcatgatcattgatttgggcttctctaacttgatcaatgagagtaggctttgcttccaaagctgcaacaaagcctctactgataatttccagattcaatctttcaaattccttgcacaattccaatggcaactgttgtccttccatagcattacaatagcctttcttactaagggcatctgctacgacattagcctttcccgggtgataatgaattcccaggtcataatccttaatcaattccaaccatctccgctgtctcatgttcagatccggctgggtaaagatatacttcaaacttttgtgatccgtatacacctctgttcgagtaccaaaaagatagtggtgccaaatctttaatgcatgaaccactgcggctaactcaagatcatgagtagggtagttcttctcatgcggacgtagttgacgagatgcataggcaaccacctttccatcttgcatcaaaacacagcctaacccaagcttggatgcatcgcagtacacttggaaacccttctttggatcaggcaaaatcaaaatgggagctgatattaagcgacttttcaactcttgaaaactctgctcacattcttctgaccacttgtacttcacatctttctgaagcagtcgtgtcatgggcttggcaatcttggaaaaattctctatgaatctccggtaatatcatgcgaggcctaggaaactgcgaatctctgaaacgatcttcggttgtttccagttggttacggattccacattactaggatcaacggcaactcctccggctgagatggcgtgacccagaaacttcacttcagacaaccagaattcacatttgctaaacttggcatacaactgatgttctcgcagcttctctaatgcaaggcgaagatgttcttcatgctcttctttggttcgggaataaatgagaatgtcatcaataaagactaccacgaacttatccaggtattacatgaacaccttgttcatcaagttcatgaagaaagcgggggcattggtaagtccaaaagacataatgtacattcgaacaacccataccgggtggtaaaagctgtcttaggtatatcttcttctttaatccttaactggtgatatcctgatcgaagatctatcttggagaaaacggtggcacctttgagttgatcaaacaaatcatcaattctcggcagcgggtacttattcttgatagtcacatcattaagggcatgatagtccacacacatccgctgagtatggtctttcttttctacaaagataacaggacctccccatggagatgaactcggtctgttgtatcctttctaaagcaaatcatctacttgccttttcacttctgctaattcattggctgccattctatagggtcgtttatggatcggagttgttcctggtactagatctattcggaattctatatcccttttaggcggcataccaggtaaatcatcagggaacacatctaggtactcccgcactatgggaatctcttccaaagttatttggttcaggcttgaccgtagaggtccaaagggcaatgcatgaacggttacaacttgaccatcattgctggtgagagttacttttctactggcacaatctatcacacctttatatctggctaactagtccatccctaggatgacatcaagatctttggattctaacagaataaggttggccagaaagggtacaccttggatctctattctgacagaggggctactgtggacccccgtttttataacaggaatcattcgtgtaaacagtaccatttccctggatcaagtagtttggtacacacgagttcatagctgaaataccaaatgcacatacacgagagtctagtgctaattattacaccataagccctcaggcattgtcttaaatcatcggaccgagtggtccggaatacatccaaaagcagaaatagataaggcagcggaatttaggcagcggcatgccattgccacaggcaacggccgtactaagacctactgagcgccatcgtcttcatctccctcctagtagtaggcatagggatcctccggagcttcatctcccgcttctgattaagtttatatttgcaaaggtgagtaccaaccgtactcagcaagccaccacagcaacaatgcatatgaaaggggtatttcaaaggatggctatggttcttttgcacaaagcaagttttgtaattcttttcacaagcctaaaacctagcattgactgatcaaattttagtaccatgtttgtatttaaacaacgacggttctgtccaccatccattgtgatcccaaggatagcttcccgccattgagtcgttatggttttctgaggacgcctaccttccctcttctcaggaagtggctccaacagcataaaaattcatcatgcaacaacccatcccacacaagttaataatttagagactagccaagtgcaatacatgtcccggtgctcaataaccgcgagcacggctattcgaatagatttggtttactcacactgcagtggatgtacactttacccacactccgcgactgcccaacacatgagccttgtctcaacacatgagacgcgtcacagcaaagcttttcgataacctcgcattggcagtacccgctccatgaacttttcatcctcatgcactctaggcgtacacagtttctagcagtgagaggagttctggcgcacccgggaagggaagttttacacccatgtaattaagttataactaggttcaactcaacacacgacagtcctagcaatggcgacaccattgtagagcccctgccttacacatgagaaaccactatgcatggatactgcctccgctcgattatttactccactaggtctatccccattcgagaaatgtggttgtacggggtcgtttcatgcttaacttcatggcttggtccttaattgaccggggacggtactagcctttcccggataccacccaaatccaccatccgccccggtctaaaacaaatgtttaattcctttcatgtcaccattatcatggcaatgtggtgctcatgtctccacatgccgcatctcaattaccttcccaaaggtaattgcctaagcatataatatttgataaatatgaatatgcaagcttctaaagtggcatctctaagcaagtgtcataattgactagggactcatacgtaattatggttacaaggatttaaaggtgaacaataaacaaggcatggcataatcacaaataggatgttcatcattgcatgcaatcttatttgtaaacaaaaattaattgcgcaattgggatcaacgtgatcaaagaatagtgatgacttgccttgctctaggtcttgtgggtcttggccttcacccggatccgcggctccctcggtctctatagttacgtgcgtaagaacaatttgaattcgattagaattcaaacaaaatccaaataatgaccgaattgaaaaacgagcgcgggaggtgaattctatataggctactttatttgcgaagtggaattattcttctccctaagatattttgtaatttatagtcatgtcctaaga

SEQ ID NO: 58721 - DNA, 6999 bp, Oryza sativa
gctgttttctatttaacctgatttaagcctattcatttatttaaaattgattctataaacctaaattttgtacaaatgaagttcactcaatatttgtatttttccaaccaatgggtccatccttgattaattttacccatattttatttttatataattttcttgaatttaattagagttaattcttattccaacacttttaaatttaattgatacaaatatagtcgtaataatattttactcatttctatcctcaccaaatattattttaaattgcactttaattatttactttgtcaatttacttttcagggtttattcctaactaattatccattattcgcgatttataaacttcgaaatcaaaatccaataaaataatcgaacaaaatcggcatgatgcaattttatttaaaaagtttttgaaggcccatatttttggaactttgatttttgttggtcgaattttcagggtgttacagctacgttgtgatgagagtgcttggttactcggagtagtaaccatcaaaggacgtctaagctcttctacctccatcccatgatttcccgcaaaactcatagataaaaatgaatgcgtagcaccagaatcgaaaagcactgttgcaggaactgagttaacagggaacatacccaaaatcacatctggagcaccttgagcttctgcggcagcaacatggttgacacgagccttggctgctggtgcggaggagttgttttgagcagggacgaccttcgcgcgacggggcttcggacacttgtcagcataatgtcctgggtctccacagttgaagcacacactgggcttgctgccttgctccctcttggcaggctgttgctgtgatggagctgcaacagggcgtggagcttgattgcggttgttgttgcccgtgttgttgttgaagaactgacgctgcggacgagcaacagatgaagaacctccctgtggcatggactggggtcccaaagcaagtcgcagcctctaactatttccctgttgtgccttgaagtgagcgatccggcgtttcttctgctccatgcggttatacttgtcctcctgacgaatagccttatccactaacttctggaaatcatgataatccccagccatgagtgggtaagaaagctcatcattaagtccttccaagaacttctcctggcgctcttcatcagtgcgcacatcctccggagcataacgagccagacgattgaactcatgcagatactcagtgactgtgcgggaaccctgtgtgagcgacctgaatttcttcttcttgagagacaccactcccgatggtatgtgcgtcttccggaaagcagcggtgaattcaagccaagagataggttcagcagtagtcctgttaaggcggaagtgatcccaccactccgatgcagggccatgcagctggtgtgaagcaaaagagaccttctcctggtctgtgcactgaagcagatccaacttcttctctatggcgtgcaggcaatcgccagcttcaacaggattagtggtgctagacaaaacaggtggcctcacgcgaagaaactctgccagcttgttttggggaggtgcatgattgttcccttggttctgctggttttggagttgctgcatcatcaaattcatcaactgtgcctggtgagccaggacttgagcaagcatgggattctctgcattgttgttgttgttggggttggggccattcccattgctgcgagtgagcaccatctgacatagacaggagcacaagaagagaaacaggggaaaactacttaggacagggaattaaattgattaacttaacttttattgattttaactgagtttcattattacaaagctgaagactctcacaccacctaactcaccaacatcctaacactcgaaagcaaacaaaggcatgcatttacatcccaccaacgatgtaaacacatgcaagacccacacacacaaccaaacttaagcaagcaaactaacataacgatctaagacaacgacttagcaaaacggtctaggtcttccgggcatcggagttgattgaaggctcattcggcacgtccccatcatcttgagttggtccccactcgatcttggaatgggtacgcttggattcttcttcatcatcatcacttacgttgacgaccggaggatccgctggggctggggtagcttctttttccacaacccgaacctttggtgccaactggtagcgagggacgaatagagctctcttccttgcggtaagacgaactctggccttctgcggtggtgcttctcccttcaatgcagctagttccttctccaaacgatccaccttgtcttctagcttgcaaatcttgtcgcaattccggtcttcacggtcttgagcggctatcacaatctcagcgcgggtttcatcctagcccacagcatctcaaccaaatgccttgtggtagcatcattctcgatccccgcaggttcaaggtagctgccacggtcacttccctagggttgacgaggatggtagcgatactcggtgtcggccaaccggtcattgtagcttttacggagctctcctatggcgatccttgccacctcctgacaagcatgaatgtagcttcctcctccagcctcgaacattactgatggaatatcttcacgattgctgttcaaggcgactttgacccggcacttctcttcatcacgatcatgagggatctgggcatacaaaggggcaatcccaaatcctatgaggaaggacatcgtacgcaactcttggacaaatccttcggtaccgaacaaatactcaggcttgtatcgcggcatctaagacaagtgaaaggagggagttaagtcatttatccagttaatagcacaagtttttgggttagcttgaataaaaattagaaaatcaaagtaagaggtaaataaataaaataaaacaaacttgcaagataagatgaaacagttagaaacaggttcacaaactttgcacttttgaataacaggttttaaaagaaataaaataaaagagagttataaaatcattatactaagcttagttcattgcagcaaaattaaataaagcaatgttataaaacttttgatggtaaatgggccattagtacggtaatagatgtacagtagtaacaacacaggaataataaataaattttgaatgagaacaattaaagaggtcatgcattgcatgtgccattagtttgatttaattaaaagagaaagaggagagaacattgctacttttccaatatttttagagggcttctataggtaaccatttggcataacctagggtcaaggaggctctgataccaatttgtcacgcccggagtttctatccaaaattccaaacgcttacatgtgtagaaaccctcatccaggaatcagccgaggtacataataacaaattgataatagagtacaattattactctaattaataagcgaataaaatgtcattacagaggtagatagttcctctcaatcaataaagttctaagcaacggaaaataaaagaaacagcgcaggcgactcctctccacaggcagcttgaccagggctacgcctaatcatccactccatcggcatcactgtagaactcctcctctgatgaatgattgcaaggtgagtatatgacatactcagcaagccacgcagcaaatatgcaagtgcacaggataacaaaggatggcataatattgtctcatttgcataaacagcatttaataaatatttcagaatttaataaaacagttaaataatatttaaacaatattaatccaacgctatataacacaccctcttgcataggcccaaccatactgaacaaccaaccccggctgtacagttcaatctccaaaccaggaattaaccattccaaaccaggagctaatcaagtcattaacatcgtcatttattagagtgtaaattgtgagactaatcacgaaagacattgttagacccgcccataaccgcgggcacggctattcgaatagttcaaactctggccagaggtgtaccactgtacccacaacacacaacatcaacatcatgtcaaccatgcgtcgcgatacttgacaagtacccgaatagagattgtgacaataccctctatataatacaattcaaagcagtgcaccgttcccggatcataatcacccccttatgaacaaggtatggactccccagcgacccccgtgggcttatctccgccacttcacagtctggtgctctactatgaactatactatacagaaaataaagtcgttgcccacgctggcttgtggttggcacggtaaatgtttcacaaccgaaaatcgtgaaccagtccttaattgtcatgagcacgaccatcaaaaccatgtgctcacaacccaccattatcaggttttagttggcaaattaattaattaattattcatgattaaccatcatgagctatcattaagccatcattaaataatagtgaatcataagttatccccgtagtgaactaatgtttctaagcatgactaagcaattatgtctaatatctagctgaaccatcatataaagctcaactagtcaaattataatagcccaaggtatcaaggaataaagtaatcaagaacaaaacggccataacaaacaataggttaattccacccaattacattcgaaaataaatgcaatagttgaatagaaacaatagctttaaacgggatcaacatgctcaaagggttgtttgggatttgtgtgacttgccttgctggccttggaattcctcaaattcttctcctgcaaaatcggactctcccggaacgtcggaatctaaagagaaaagaacaaaatcaccaaaccagcacataaacaagcatgaatagtacatgtggatatttttaacatgtagatctcaattttagaaaaatttagagacttgaaccaactaaatccgagctaagatgaattagttattaatttttgaagattaaatcggattaaatcatttatatagattttaattgaactatgacgcaataatgaattatttttgaaaaggaaaagggaattattgcgtcaacgggtcgggtttacggtggaccgggtgcacggcggcggttcatgaaaacggacggccgagatcgatctaagacgaaacgaacggccgggatcaatctaaaccatcacggtccacgggagaagacgacgatgacgtcggcggtgacgtcatcaccggcgacggctcgggcgcgcatgctcgccggcgaataacagcgcagcggcgcaaacggaggacacctacgcgatgcgggcgacacggcgaaccttaccgaggcacgaacggcggcggacggaaaccgaacgacgacggcgacgaggatgagcggcgacgacgacggcgatgttccggcggtcctcggcgttgtcggaggggtggacgaggtcggcggcaactcggcgaacacagcggtggccttcctgagcgacgacgacgaccggagcggcggcgcgcacggctggacgaactacggcaacggcggcgcacgggctaacgcggctagagctctacgaacggcggcgagcgaaggcgaaggtggcggcgggtagaggagacaccgggggtccttataaaggtgctaggggcggctatggaggcccgtggcgaccggcgacggcgatggaaagattagggttgggggaagagaaacgaatccgaatcaaactcgaatccgatgatttccaaaggaatttagataaagtttctatagaggaaaagatagaggagatcaaggggatcctttcccctctaccaattttaccggagaaggaacggcgcgaccgaattggaaaggggcggcggctagggtttcggccggcggtcggctggaggtagacgacgaccgacaggtgcagcgacgagagcgcgcgcgcgggcggctcggcttcggccgacatgggccgagggcgagagagaggtttgggccgactttcggcccaaagccaaaagagaactttttaaacctttttcaatttaaatttttcatgaaatgcaatttcatttattaaaaatacttccttagctcaaataaatcccaaaaaaatctaggaactatagaattaagcaaagtatttaataaaattttatctggccccattttatattggaatttattaattaaaaattagatcttctcttctaggcttttaaaataaattctaataattccaattaaacaacattttatatatttgggatttttagggtgtgacatctttgactaaccggcgtcatgtacacctatctctactgctggctgtgttctttcgattgtgagtgagtttgttttgttttcagcgcacacgcttcccgtattattaaacggtgtattttttgcaaaaattttctattggaaaattgctttaaaaaattatattaatccatttttgaagtataaaattgttaatactcaattaatcatgcattaatagctcacctcgttttatgtatcttcccaatcttctttatctcctcctggaacacagcaacatgtatgtaacactctcttacacccccgcgtcactccgctccagggcgacacgggcggcgaacacaccagccccattgtcagcccctctccctcctttcctcagcatcgccgttagcaaagtcaggcggctgtagggatggtggtgccagagccgtcatcctttagttttgctcgtggtcacgacagttggggcactaacgagaccagggcagaaacttgcagcgggcagggcgctggtggacgctcctatctgcagatccagctcaggctgtgcgtgcactagtgagggtggcaacaaacacgtggggctggttgacaccgtgtgtagcaatggggacggccagtcttcggtacctcagccagattcatcgttcctacaccgacggcgaaggcgaccacaacaggccgtggagacagggagtggccagggaggtgaagcaagtagggcagtgtggc

SEQ ID NO: 58722 - DNA, 1126 bp, Oryza sativa
aaaattgctaatcggtgtcaacaattgtgaacccaattcgttccaagtgtttaagtaaaggaaaaaaatccaaattacccccattaattattactgtcgaccaaactaccttgttcaacttaaaaaccacacattttacactcaaaagctagacaaataccgcattccccctcccaaggttattccggatggtttttgtctatgtgatagtccagttagcaagttttttaaaacaaatggtcaggcccacctatcaattctctctccttatctctttgactctttcttgtcttccctacggccacaaacaacatcgctgccactcctcttcctctcttgcgtggtggataaggagctcgcgagcagcttgagctcggctcgtcgcaagctcggctcgagttcgactcggcaaggattcgagccgagctcgagcttgtctcgaagctcgcgagctctaccgagccgagctcgagctattcggcaaaagcttgaaattttcactcccgctacccatcccaatttctcccgcactccaattccaaaatcctaccaccaacagcagtccatcacctaaccatttatttcccttatatccccatcccgtatccaaaccctagctcatttgctctcttcctcgaaacatttctcttctagatctacaatcctaggctgctctagtgctccactgaccactgctgtggatctagccaagcaccgtccatccttcgcctctcctgtccaggaagaaccccatggaggacagcagcagcccaccgcctccgccgtgagtgacgaaccgacgactcggatctgagtaagtttcctcttctttctttgttttacatttttatttcttttgcacccacatgtatctagggccctacatgtattaactgtgtagtgtttagttgcttgatggatgttattgatttacattgaattttatggactaggtggagacatggagtagtacttatcttgctgtgctcctcttctgaagaaagactgaaggttgcagaacaccatgtgtttgccatttgccaaggtaaattgatggcaatgcttttcttgttgtacttgtttgattccttcccttgtgcagaatatatattgatagcagttggta

SEQ ID NO: 58723 - DNA, 667 bp, Oryza sativa
aaatctgtttcgtcgggtttgtgctcgggccgtactgggctggggtgattgggctcactggaaataagctcatttttggtccctcatgaattcatccctaaaccgaaatacagatccctcgattcacaaaaccggcccacacggacccccaccggatcacaaggtcctaggttgtactatgtccaattttagttaacatggcaagttgagtcagggtgggaaccccgtaggatccacatgttaacacccaacactttctttctccaccgtaggatggcggctggcgaagcagaggagcaactctgacatgacacatgtggggtatgtgtgggtcccatgctgattcggctaaaaacgggtataacattgtctagaaccgtgatttggttttgtaaattgagagacccgttatatctattatttcggtttagtgatgaatttaagatttggcgacaaaggacctaaaatgaacttattcgtatggttgatcacgccgagccgccgagctacttgaatgtccacagatatcggttttgggcctgtgagagaagttgggaacacctcttccacgcagtaaaatgtaagattttatcagcatattattaagtaatgagtatattttttagcaatgttctatgaaagttttaagaaaacattgtttaacaat

SEQ ID NO: 58724 - DNA, 1858 bp, Oryza sativa
aaatttgatattaaaaataattaataactaacacgtatataaaatacaatatgaatattacacattagtagttttgtaaagttattgcaaaatttaaaattatgttgtcattttaatatatttaaataatataataagaaaatatatgtgctattatacgagagaaaatataatgatgccagccgcgcaagctgcgcgggccaccatactagtttagataaaatgaacacaaaaacacaagttaagaaaagttagtgccgaaagcatcctcagaaatcattttgtttttaacatcttataattacgatgtaattacgtatcgcttacaatgcattaaatttatgcaataattatatttgatatgttttcattataaagctttctccatacatactcccacttgcgctgcgctgtaacagtgatcatagaacaccgaaaaaataaagatgttttagatacttccggttgaaaaatggaccccaaataacagcgaccatacagacatacagtttgcactcatacgtcaatcatagtaaccagggacacgtacgtgacacgcgcggtccacggaggggcttccacaactcacgctctccgacgtagatgccggctccaacggtagcagatttcgctcctcctagatctcacacccgcaacaacagaacacaccaaacaatgggacgtaaatacacagctggtggtccagctagctagaggcaccatccacctatattttaaatataattttctcttaaattacttatccgatctacaatccgattacactgttgtgttcgtaacaattaaatctttacaataagatctcacatgattatattttgataaaaaatcacaaattacttttatgatatgtctaaattacttttagattttactaagttacttatataaaagtaaattcagtaaaaactaaaagtaatttacttcttagatatatatgtaaattacttttagtttttactgaatttacttttatatgtctaagaaataacttcgtgaaatctaaaagtaatttagacatatcataaaagtaatttgtattttttcatcaaaatataatcatgtgagatcttgttgtaaagatttaattattatgaacacaacggtgtaatcggattgtaaatcggatgagtaatttaagagaaaattttatttgaaacataaatgataggaatatttcccctacttgctcaataaattaatagcaaccaaaactcataaaataatagcacgtgagtggtctctggttaaaactaatttaagatgcctcttcaattagatttaccgcaaacaatgacgtcctccctgcttggaccgccactcttttttttttcctcccgcgaaaatcacgtgagatcaacaagtcggcgacgctgcctcgctcgaccgttcgatcgatcggcaccgcacggcgccatctacagcggggcttcccagaaaagcgcaaaacaacacggccatcgtcgcggtggcccccgtgcagagctggaaagtgagtcgccactcacggccacaccgtacgtaacgtgcggccgtcgagcccctccaatccggagcagagcgccaccaccccccgcccgtgtccgtcccccgcgcgacgcgacgtgacgcgtccacactatccctagcatggcggctctcccgcggcgtgacacggactctggcgcgtcaggccaaacgcctccccttcccgatgcacactgtagctacttgcaacttgcgcaaggagtatccccgaacgcatatttcctttccttcgtctacctccagcagcatcagcggcggcggcagctggatcctccctcccgagactgagagcacggcaagatttgcaaaa

SEQ ID NO: 58725 - DNA, 521 bp, Oryza sativa
tcagaagaactttgtgaaagtatagtcaacacgtgcaatccaatccatgtcgttatgtctcatcttactaaccacttgatgtctcgggtatatttaatgcatccatgacactacaaagtccaccccattatttgatctttgatcagcaactcgttgaactgcatccactagctagtacagatcgatggccgtgtcttcgttttcgttcctcgagctcttgctctccttcctctgcttcggtttcttctactactaccacgtcaagtcgaagcagaagaaccccgtcatcccgctgcaatggccattggtgggcatgctgcccgcgctcctcgccaactgcaaccacctccacgagtggatcacttccgtcctcacagtcacaccgttgaacttccggttcatcggaccaccgagctcagacatgcggctctttatcaccagcgatccggccaacatccgccacgtcttcaacaccaacttctccaactacccgaaagggcgtgagttccaggagatcttcg

SEQ ID NO: 58726 - DNA, 2139 bp, Oryza sativa
aaaattaaaattttggttaaaattgaaatgatgtgataaaaaagttgaaagtttatgtatgtaagaaatttttaatgtgataaaaaaaataaaagtttgaagaaaaagtttgtaactaaataagggcctcagttgaattacagacagccaaagagccatagatgactaacctttgcctgcctggtggaatgaatacactcacatcttcccccggggttcgaattttaaccgatgaacgaatattttttcatcgtttggcagctgtagctttcatttgaaagcaaagcaaatgcagcctcctttcacagtaagaagcaacaaacgtactaacgaacagctgtacgtttccactttgcaccctgaagtcgcttactcccttcatctaaaaaaatgacaaacctagatgaaaaaatgacaaaccctgtgtttcatgtccaactttaactgtccattttatataaaaaatttttataattcatattttcattattgttagatgatataacatgattaatattttatgcgtgacttgtctttttaattttttttataattttttcaaataagacagacgatcaaatattgggcatgaaaattagggtttgtcttctttttttttttttttttttgagggagggagtagcacggtgaagcatcactgtccagggtctatcattcgttcgatcagtagagacatacccatgtgatgaagtaacatctggaaatgacagcaatgtggacccgttatacagtactactatcgatccctcattgttgcaattcaaggccttatgggttcagtttcatatcaaaattaaaagttaaaaaaaattagaataatgtgatgaaaaagttaaaaaattatatatgtaaaaagataaaaataaaaagctaatttttttaaaaaaaaagttgaaatctaaacagatccctattattgctgagcaagacccagcaggtcgccgtctgggctagtattgctgtaccacgtgcatcacatcgcacgctaaggagacagcagcaaaagtcccactcctccggttcgcatccgcgctagcgaaaacgaacacgactagtctactctactgtacgtacggcgcagccaagcccaaccgaacagaagtgtggcagggctgtgtgcgcgcgcgccggcggcgacaccgcgcggagctggtcatctcccggtacatgcgtgccgtgcgtgcatcacgtggcggccatgcatcttaccgatcaggcgatcacggccggtgagggcttttgtgttgggcccatgattctctctccttctctgtgcgtaacagcagaaaacaccggtgcgtgcgtgcgtgtgggtcgcctttgccaccgacggagaaggatggaaggcaacagtttttctggtggtacgcacactcttgtgctgttttccgtttttaaaagaagttttttctggtggtacctggacgcatggtcatcactagttgatttctcgcgttttgttcgtcaagtaatcagtggaacgtgtatgattcattaattctaagcatgcatcacattttgttgaccaagtctggagctaacctgtctatctgctgttttgtgctctacaaccagaagtctggagcacaagtttgtactatgagattgtaataattttactttaaaaaacaaattataacaccaatattttacccgtgtggtcgaggggactaattagaagttctacatagacagatcatggttcgcagagcgtgaactgaggattagcagtcgcaacgttgaggagctccggcaggcggcggaaacaaggatccccacgggactacgggaggattagcaaatccaaatccaatttaggttggcgatctaggctgttcccaataatgatttatgatgggcgccactttcccttgtctgatcagaagttatatgggccaaatgccgatcttgattaccgtaagttttgtaggccatacttgggtcgaaataatttttttggccaaacttggatctcgatcattatctgccatccataaatcttttttagaggaatctgccgtctatatttgagtatactaaattgggaatgcagttaatccgatgagatccaaatttgtgggcaacgcatatttgttgcgatacaaattgtgatcaatc

SEQ ID NO: 58727 - DNA, 2851 bp, Oryza sativa
  unsure (1)..(2851): unsure at all n locations
tacaaaatgcaaattttatgcgtggcttgtgattcaaaatagagtctaaacttccgatcgactagctacaagaggatggctaaatagcggagagtgccccctatgccgtatgacgaacgagacggcatgccaccttttagcttcctgtagatacaccagaaggatctggagactgacggccggctgggtggcttatcagcaattggatccgagcaattgggagccatgccaaagcgtacacaaatggtgggaaatgctattgctagccaacaaaagggaagtgcccaagaaagggctgcgatccttaatcctactcatagcctgggaaatctggaaagaaaggaaccaaaggatcttcgagcataaggaaacggcagcccccaatcttatggcaaaaataaaggaagaggcaagaatctggataatggcaggcgcaaggtgacttggagaattcctaccaacttaaccatagtgcttatgtaattttgtacagctctttttttttttgcccctaggggatatatttttttacgcctatatctaatgaaatagcacaatcttgtgatgattcctttcaaaaaaagaaaaagaaaacccacgtgcatttccttcgcccagaaaagtttttacatagaaatatattattctactaccttttacatagaggaaaaaaaggaggggtaatgagaacaactggattgtcatgtaagggataaaaaaaaggtgtttggaattcataagtttcggtcccctgaaatctagacactcccatgtgaatttcataaataagaatcaacaggaggtagataatcaaattgttttattgtgacatcccggcctaaggtttaataggattaatagaatactcatattaacaagttacaacttctttttccgaagccgatctctaaatctgaggttaagcgtgcttgggctgaagcaatttaggtatgggtgaccgatcgggaagaataatttatggatggatgaccgatctggtttgtgagggcaatctatgacctatgaaggctgtcatatgtaaacgggctcggcctgggataggcgaaacgttacatttatcctgttttttatgtgattttagtccctctaatattcactcaaagcagtgtactctaatataattcctcctcctttattcgtcatttctccttttcctaaatcctaatcttgtattggaattgtactttatgtaacattttaaatctatgaacgatctcacttgtcctcctaatggagcgattagttgaattgaagaagaaaaatggttttgaaggttctggattaggtcataattttttttagattattcttttttttactaatagataactttgggattattttgagaaagtattgagccacgtggtaatattggccggcagtgaaaaccgccagcattagtaagatagatacacaaaatgatttaaattgctccaggccaagcacgcttaaccctggagttctttggagattggcttccggaaaagaagcccttaagagagatggagattggcttccggaaaagaagtcctaggccgggatgttaccccgccgggatgttacaccctcacccccttaagagagatggagattggcttccggaaaagaagtcctaggccgggatgttacaccgccgggatgttacaccctcacccccttaagagagatggagattggcttccggaaaagaagtcctaggccgggatgttacaccctcactctcttaaaagagatagacgccaccgtcgatcaacctttaagtaaaaccgcgagagtcggctctgataccattttgtaatatcccgccttcccccaggccgggcccttaagtgaaaccgcgagagtcggctctgataccattttgtaacatcccgccttcccccaggccgagcccacttacatctgatagctttcatagaaaaataaactgccctcacagaccaacacatgtcttttctgtacactttgtcctcactcgtgtacacccaccgggaaagattttcccggtcggtcacccatcccaaattgctccaagccaagtacgcttaactttggagtctttgnagattggcttccgaaaaagaagttgcaacttgttgatatgagtattctattaatcctattaagccttagggcggggatattacagacagcgtaatcaagatcgttcatatgcttgagaagagagttgggtggtccaaagtgaaacaaaggcaagtttacccagtcctaagtgaaaatattgcttaaaggttgatccaaagtgaaacatcggtaacaaaaggtagcccgaagtgaaatttactctatatttcttgatagggcaaaagtaagtttgagttactaccattgttgtctaaacttggggtgatctagaccgtccaaacgcgcacagacattaactagtttaaagttcatgtctaggcagtggaaactcatcttttagttctcaactgagcacgcccagcaaacaagaaaatgacatcgtgagaaaacatattattgctagctgattacagttcgacagcttaacgggagttcagcatttatcatactgaggtgctcccagggtacgaacccgggccttgcatctggcggattaattagttgttaagcacatgccttctcttaaccctgaccatgagagcattcttcatgttaagtacgatggaaagtgcgggctcaactacatgggcggggatggtctccaaattggaacatttcaccacggcccccgccacggccttgagctgcacgaacgccatgtccttgccgaggcaggtccgtggccctgagctgaaggtcatgaacttgtacgacggtacgtacc

SEQ ID NO: 58728 - DNA, 654 bp, Oryza sativa
cacctaaggacttttagagcttaattaatctagtgctagtattaaactttgaaaattaataactcccaaatgcaaagtgataaaatagaaattccttcaccaaaaatcttatccacacagcacctaaccacactagtaaactcatgcattttaaagcattttagatttttacatgttttagcatttatcgttaccgttattccttttaggcggcgaaaatcgttatcggtgagatgattggtcttatagctgatctcaagaaggtcttataccaatcaaggcaagtgttgcccttcctttgaacacattgaatcccatattttcgggctaagtgttttgattgtaaagttgcacgggtatttctaactataggtactttcaaaactatagattatagttgtaccattaaaagatgcatgaattcccttttgaaaataaccccttgctgttttgaaccttaggattaattagagtactttaattgtgctcatatgagtatgctatgcttttataaagtgcaaatgcttagccttgcttagtaataaataaaaacatggttatggatcacttattatacttttgaaaacccttttgaacaatatggacagaggtgattctctgattatttgtgaaataaaatgagataaaatgtga

SEQ ID NO: 58729 - DNA, 583 bp, Oryza sativa
caccccgatctaatcttcatccccgatgctgatattgccaaatttggttgttaacacatgccccccaagtccggaatatttggtaatgtttcggatttgccatatatcgatttcgagcaaaattcgctcttgccgtttcctaaccgttactccagcgctttaaatactaatcgttgcccccgagaaacctcataccgtcttcttgcgttttcaccgccgaagctaactttgtcttctctctcttcgacgatttctccgacgcataaggcgatccctaggcgacttcatctccaattagatctccgcctgcagcgatgtcgtcttccgccagcccgtctgccacgccgttggctgagtacgctgaggtaagttctcatcggccagatctcttttcttcacattagatcgatcttctagcccctcatcctgttttccccttctcagttcttttggatttgtagcatctttccaacctagttgcaattccaagcttgtcgcacgaaaattactactttttcggtccagtcggcaaccctgatcctaccgagttcatcattggtgaaccaataggattcccttcaga

SEQ ID NO: 58730 - DNA, 1139 bp, Oryza sativa
tatatttaatactctatgcatgtgtccaaagatttgatgtgatgtttttgggaaaaagtttttgggaactaaacattcaagaaaatctttacttacaggtatgttcagaaaatcaaccacgttcttttctaattgcattcagataaacggacgcttgcagacgttcagaactatatatagatttgtaagtaaacaaatgttcagatgccctgcacttttctatctgcaatgcgtacatacggagtatatgtgcgagtaaatcagagtttgaaagtcagggcagcctgcggggggaggagatgcacgcgcacgaagcaaaaattcctcccgcactgaagaaacatcgatgggggctatgcccgagcccccaggaatgaggactgtgggatgagatctatgagatctgggggccttcctattctaggggttttagtaggggttctattgaacctagattctctctttcctcctaaaagttatttgatagctttgtttagggtctctgctgaagatgctctaataggattaataagtcgtcacgtgctgctaatatcaatatagagttttgaactaacagacccgtagtactagctgcagattctgtggtgagacagcacagacacaaacgagccatgtagtgtgagtgtctgcgttgtactttgtaattcttaaaaaaaaaaaaacgagccatgtacgtactttactaccattgaggccttgactcctttcgcgaagggaaaagatcgccatagtggattaaggtggacaggtggtacacgatgtactctacttgattgccggtccgcgatgaaagtaaaaacggcttaaggtggtacgcgacgtacgtgcctgcgtccatccactttgcgcgtcgtcttttttatcaaacaaaccgaacgaaaagcggcgcccaacagtgcgtggctggcctgattcttgatgtggcgagctcaccacgtacacgtaccgcttcgttcggctaacgaacaatctcagaggagtgcagtagtacgtcaactgctttcgtcttcttttgtagtactagttgttacgttaggtgctatggctccagtgctatatgcatgcagcgagagtggtcgcaaggacagagactgctacacccgcaagttgcaaaaact

SEQ ID NO: 58731 - DNA, 2501 bp, Oryza sativa
gactactatagggcgaattcgagctcggtacccttctattggctgaggatgattgaagattgtttcaaatattataggggatgtgaagattgacaacgattcggcaatgttcaattggcgcccgccaccgtgttgaatcctatcatcaaaccatggccgttccgaggttgcgctttggatttcattggtcaaatttatccttcatcatcaatggggcataggttcatgctagttacaacgaattactttaccaagtgggctgaagccgtgccgctcaagaatatgactcatacggaggtaattgactttattttgaagcatattatccatagattcggtattccgcaaatattgactacggatcaagtagcttcttttatgtctaaggaagtgaagagttttgccgaatcttatggtgttaaactgttgagttcttctccttactacgctcgggctaatggacaagccgagtcaagtaataagacgttgttgaagttagtaaaaaagaagattgaggaatacccaaagaagtggcatgaagtgctttctgaagcattgtgggcgcataggatatgtaacatggtgccactaaagtcacaccttttgagatggtttatggtcaagaagccgttttgcccgttgaggtgaatcttggctctctttgatatatcaaacaagataatttatcaagtggagattacaggacattgatgggagataatcttgatgaagtcatcgacaagcgtttgaaaggtttggaagagatagagaaagagaagtagagggtggccaaggcgtacaacaaaagagtgaaagcaaagttgtttcaagttggagacttggtttggaagacaattttgcctttgggtactcgattcagagagttcggtaagtggtctcctagttgggaaggtccttatcaagtatacggcattgttcgagggaacgcatattttttggaaacccttcaaggagagcgttttcagcgagcaatcaatgggaaatacttgaagaaatacttcccgagtgtttggcaaggcacttaggaggttctatgaccggtaattgaattatcgccctaagaccaaaatatgttctatgcttttagattcacgttgttcatcaaaaagacagggggcatgtgtttacacccaaatttggcacttaggaataaaatagggaaaattaccaaagtttggaagtctgccagttttcctctgcttgggccggtctgaccgccgttgtttggctggtctggccgaccccggtccgaccaccgatagtgggtcggtcaaccggcggtgtgtggccggtctgaccggcagagtccgagtccgggtctgtttcgtcgggtctcgaggtttccttgctcaagaaggcatgtttcgggtttcctttggattctatcccgagttggacgtggaggacagcctgtagagggaagaaccaacccctatataagagacatggccagttcaattgtaactaatcaatctataatcaatcaatcaaatcgttattttgcttttgcttctagttctagtttagtttgtccatctttgtcgatttgcgctgtaaatcgttcgccgccgctgtgagagtgtgacacctctttgtaggtttgtcctgaaaaccttccgttttgcccacgagacggtgtcggtgatatgggtccgggggtacccacgctgagggaatcaagtcctttcccccggccacgtggtcgcacgcccctccaggccagacgtgtaggcaacgaacggccaagaggtgcctaacttcgtctaggggcctcggggtagctcgttgcacccctcgggcccgaggggctgcgccaccccgaggccgcattcaatgcggcgtggctggttgtgtgccgcttagcgattggacgtgccccagtcgccttgaccgggctgtgaccggccaccagcggatgggacgggtggcagcgcacccacatctcgccctgtgtcaagtggcgtgggggtgtagacccccgattttggaaatcggaaatcttctgtgtttatccgtaccaatccctggatcagtagttggtacacacatacatagttggatcacaacatatcacgaatgaatttaggctaaaagagttaaatacttacattagggccaagtaggccaacaactattagagaacaacagcggaagacaaaataatataagggcccggttaacatgccacaggcagtcgactggggaacgagacctagaacaagaccgctctccgatcatcttgtgggatacgcaagtgtaccgacaagggcttctcttcaacactctcctaaaagatatataaatagcaagggtgagtaccaaccgtactcagcaagccaccacaacaacaatgcatatgatagagggtatttcaaggaatggcttcaggttcttttgcataaagctaattttacaattcttttcacaagcctaaaacctagcatcgactgatcaaattttagtaccagtgttcactttaa

SEQ ID NO: 58732 - DNA, 2675 bp, Oryza sativa
aattcgagctcggtaccccttctgtgtttatccgtaccaatccctggatcagtagttggtacacacatacatagttggatcacaacatatcacgaatgaatttaggctaaaagagttaaatacttacattagggccaagtaggccaacaactattagagaacaacagcggaagacaaaataatataagggcccggttaacatgccacaggcagtcgactggggaacgagacctagaacaagaccgctctccgatcatcttgtgggatacgcaagtgtaccgacaagggcttctcttcaacactctcctaaaagatatataaatagcaagggtgagtaccaaccgtactcagcaagccaccacaacaacaatgcatatgatagagggtatttcaaggaatggcttcaggttcttttgcataaagctaattttacaattcttttcacaagcctaaaacctagcatcgactgatcaaattttagtaccagtgttcactttaaacaacgacggttctgtccaccatccattgtgatcccaaggatagcttcccgccattgaatcgtcatggttttctgaggacgcccacattcccgcctctcaggaagtggctccatcagcataaaaatcatcatgcaatatcccatcccacacaagttaaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacgcatattaaattatggttcaagttaagttctctctctcacacactcatggcagtcctaccaatggcgacaccgatgtagggcacgcctctcggccctacctcaacggctgtcccaccgtagtgcacctgcctcactcaggggtgaaccatctatgcagggatactgcctccgctcggctatctaatccgctaggtctatacccattcgagaagtacggttgtacgggggtcgtttcatgcttaacttcatggctcagtccttaattgaccggggacggtactagcctttcccagataccacccaaatcctctgtccgccccagtcgaaaaccattgtttaattttatttctcctttcacaaatcatgtcatcaacataatggcaatgtggcgcttatgtctccacatgccgcatctcaattaccttcccaaaggtaattgccccaagcatatagcatttgataaatatgactataaatgattctagaatagcatttctaagcaattgtcatagttgactagggactcatacgtaaacatggttacaaagatttaagggttagcaataatcaaggcatggcataatcacaagtaggatgttcatcattgcatgcaattttatttgtaaacaaaacaatttttgcgcaattgggatcaacgtgatcaaagaatagtgatgacttgccttgctctaggtcttgtgggtcttggccttcacccggatccgcggctccctcggtctctatagttacgtgcgtaagaacaatttgaattcgattagaattcaaacaaaatccaaataatgaccgaattgaaaaacgagcgcgggaggtgaattctatataggctactttatttgcgaagtggaattattcttctccctaagatattttgtaatttatagtcatgtcctaagactcatcgaattattgagttcttaatcacatgtaaattattaccgcgaaattgatttcttacggagattactaaaaataatctataatctataggagttcatccaattatattttcattaatcctatatttaaatgctagtactttaggtatttaattagtaagaattcatctaactatattttcgttaatcctataattaaatgctagtattttaggtatttaattagtaagaattcatctaactatattttcattaatcctataattaactttcgcaattttacgactataattaacctacgattaaattcttaactattttgaattttctaaacttctaaattttactcaaacgcctatttattttctctctttctttcttttctttttccccttttttttcttctttcctttctcttttcttttctctctttttcctctcctctctttctttttctctctcttctctccctcccggctcctttctccctctttctctctctcagcttcttgccctcccgggcggcgacgacgatggacgcaagggggggcggcggcttaccgacggcggcgacggcgacggcgacggtggcgacgtcgccgcaaggcgcggcgcggcgcggcggcttcgtggcggcggcagcgcggcggctctatacgacgccgcggtggcgtggaggcggcggcgcggcggcgtggaggcggcggcgcggcagcgtggaagcggcggcgtggtggagtgggtagaggaaaggaagtgaggatggagggaaagagtgggaataagggggcttatatagggga

SEQ ID NO: 58733 - DNA, 1088 bp, Oryza sativa
  unsure (1)..(1088): unsure at all n locations
gatggcgctcgtgcagatgaaggtcacggcggcggccatggcgtggaactttgccgtggaggtggtgccggggcacgtcgtggagccgaggctgtccgtcatactccacatgaagaatgggctcttggtaagggtcaagagaagagagccagtgatgaacacctgagaactgagaggatacatgcttattaagtgtgatcaatatgctattacatgatgtacagtacagagttttaatttatgttggtgtcgagcgtggtgcttcatctgtaccgtgtgcggtacgcgatagaggcctaaatttgcacattggttgcgtcagatttgtaatggaatccctcaaggatacgaattaataacttggggggtgtgtcatatgattgtgtcatggcttaagattaggacattcaacttgctatatatggggcgacgcccatatcttagcacagtgctaaggtgattgcattcatgcatgatggccccgttagctcactttgtacgtacgtaccacgggtccacggcaagcttattaaatgctctgcctcaaagctctttcatagagtaagcccatctacggcccagcttaaatcagctgtgacccagaggcccaccaatgaaaaaaagtgtatgggccggccataatcggcctaatgtgttaagtcatacatgctgaagaaaagtactttcctattgagcagattaagcaagaaaaatattctgaagagactgaaaatataacagaggccaatagcatcagccagtcaagtggtcaacaagtgcagaactactctgtcctgtcatatatttttatcacagcaaaaatccacaaatctgactatgcagcatgcattgctgactctgtcaactcttatccgtaggagtatatncgtttcatctgatatcatcacatgttctagcagacagcagggcatgatgatgtcaaactatttgacccgtccttgattacaagccagatcaggcacaatttctgaagataagtactatgtatgacaaataagacaacatctaactactgcggcacagctgtgctgctttgaggtcagcaaagctacactggagttaacaga

SEQ ID NO: 58734 - DNA, 1985 bp, Oryza sativa
catgtcaaatgtcagcctcatgaacacgtcttgcaggttgcatctctcccccgttcccgcgaaatgggatatcagcggaagcagcgcattctccactttgtcactgctgcaccggaacacgaaagactggaatcggtggttgtacatgagaagctgggtcttggctcgctgccggcgccacgagtcgccgtccacgttgaagatgccatcacctaaggtgtcatcaaagatctcggcgaaatcgggtcccttggggtaatttgcgaagttggaggtgaagatgtgccggacattggccgagtcgcaggtgaagaagaaccgcatgttggacgacatcgttgggccgataaaccgaaaattgagctgggaggcggtgagaaacgaggtgatccagtcatggagctggtgacggttgacgagaagatcagggagcatgcccaccaacggccaacacactgggatggcagggttcttcctctttgatttgatgtggtagtagtagaaaacgctaaagcagaggaaacagagcgtgagctggagaatggaagagaaagccattgctttgactgcttgtacggttgctcgtacgcgcgtaatgcaaaacaaaggaggcggggtaccgagctcatgtgaatgcttgcagtaccacacgtgtataaggtgtattaatatacccgagcgagagtagtaagatgaggcggccaggcgggcgatgttagcaacagtgcttgtgatttcactgaaatttttccaagatttttgcatcatgaatgatatattggtattggaaagataaaattacttaatgttagctacatgaaccagctagctgccatcgatcgatgggaatcaactcctttgctccgcacagcgtgccatcttgtgtctcgttggcgcctgctgctcttggtatctccgcggaaagcggatactaaattatccccattctggctttgttctacctgccttacttctctaagcaaggttacagacttacagtgtcgtcatgacatacctcaatttccgtaatgccctgatatttccttcagcgctaaaaatatgtaccaatgtatcaaaatttaacttcaaaactatctactctctccgtccataaatataggagattttggttggatgtggcacatcctattacaacaaatctagacatgaagctgtaagatcaacgtgtgttttgattcttattctgtgatgaacaattggcatctgtgattattggttttgatatttggaatttattcacaaagtggttttggatttactgatattttatgtgaccggtcagaccgggcggagttgccggtcagaccggcttgtgttgagcggtcagaccggccggcccgcggtctgaccggccgacgctgtgtcggtttcagtttcgggttgtttctttggatatccgcgattgtttcatcgttatggcttctagatggatactatacgtatgtaatactgttgtttgctaataatgagtcaagttggggatagcttggtctcggaatatggtttctttgtttgtttcatgtgtaggtgactcgatgcctcgggagagtatttgcggtgatggaccgggagtcggcttggtggtaagacgatgtccgtggtggtcagatatcatgtgggatactaaggctagagttgatgcacgtggttggtgaagattccatatggcatacgatggaggtattgtgtgcgtatgggatgtggagtcgaatttggaaggagtccaaatttggtacgattggtgtttcaccgggtttcggcggtctaaccggcatctcaccggcggtcagaccggcggcgtaggcaggcagcggcaggcgatttcgtcggttcgaccgatcgatctacatcggtcagaccaacattcatcaggcggtcagaccggtgcgttcacttcggtcagaccgcgatccatcgaatttgagggtaacttttatttccgctaaaagttttggtttttgggt

SEQ ID NO: 58735 - DNA, 697 bp, Oryza sativa
ttttggtactctcctattcctacattttggtgcacatgtgatgggtatagccattttccagatgggccattcaaggtgagatatggaaactgaaccttctgatcttcatcaaaggttcagttccctctaatcctcatttcaaatggcacatataaatatggtcctagctgctaaaacccaacactagctgccaatctgttcatgtgctgcccaactaaagtattccatcaagcaatcaacctgaaggtgagatattggagaaaaacaatctgaatattaattgtttgccacactgttgcaagcatcaaccagcaatcagtttgttttcctccaattctcacttccagtgcctgaacaagcacagcatatccaacactgaagctagtaactactctgaagcgctagaaattgtaaagcagttgggttcaggacttcaggtagagagagatttatagccgtggttgatagaacacaaatcattcagattcagcagcagcagcaacagaagcatctgtttctgttacacctgcccttcatgccaattgtgtgttgtctgtgatgaagaacctttctactcccattttcagaggactagcagtacaggtaatggccaaaaaaaaaaacaaaagcagcttcagaatgtgatgggtgcatagtggctagtcactagtgacatgactgccctacacataggtgc

SEQ ID NO: 58736 - DNA, 692 bp, Oryza sativa
tcaaatgatgcctgcagttgattttacgtttgctgtaattatctagaaaaaacgttatttagtttgcttgggttgtctatttcaattgtgcagctggcaattttcttgaattttatttgtacatactactactgtatggtttctaatgctcctctatgatgtcggtttgatcgattttatgttcctcggttatcggttttgacggactggcctgcgccctgtaggaaggtatcgtatagaactgtgttgcaacattgagaattggtttttagagttgtgatctgcacttgtaaatctgacaaatttgagaaaaagagaattggtatttagcaaaacggagctgtgtaaagatttatttatgcgcttctctcgttttggccgaatcagttttaacaggagggaacctgtctttccccctccaattcattgaaacaaaatttacattagtaagatatatcctaatatcctactccttccagcttataaaacattatagcgttaaacaagattaacaatggatattaacaatttaacatgaggataacctgcaccttttctttatgaaaccaaagcgaaaggaaatatgcaagatcaagacatgtttcaaatcttctatatattagacaagaccaacaatgtgtcttcagagttttgatagaggtgaggcgcctggctgtggataatcgctattc

SEQ ID NO: 58737 - DNA, 659 bp, Oryza sativa
ttactggtttgtgaccattgtgttttgtgttacttttccatgaatacttctagtggaccatgtctgaatttgtaacatcgaaaaattgcgagacaaatcttgaaactgttatctctattatgacaaggaaacaattctatttacaaatcagtagtgtgcagaaacaataacttgacctaagcacttctcttgcgaatagagcttctaaagcatcagtcttatttactgggagcaagggaaaactgtgtttaatgcttgcacaattgaaaggaaaacacactttaatttgtgtgtttatgagaattatatccaggattccacagtgctgttgtacttatagccgtaagggttcattccactcaaatgtgccaaaatattggaagaatcaagcatgtcttctcccttcattcccacctgaaaaaacaaaatgattgaacttggtatttagctattttataaaaaaatgatacgaatttaaatctttaatctatgactgcaatggagaaaaatgatgagatgattgaataaccatcttgatgaattgtctctaaggctaatgaggtaatcttgcccttgcatatttatttgtgatattttcagctaaatttggtctattttctgataagatagttagaacacttacaacatgttcatattgt

SEQ ID NO: 58738 - DNA, 6772 bp, Oryza sativa
tggctgagcttatcagcaccacgtgaaacgaggcatgccattagcgcatcgttaagtatggactattataaattacagaagtgaatttatttgatttttaataaaatatataaagtttttgcacgaaattagtggttcagaaaacgtggctcatggcaaactggccctaagacatgacaatgacaatcagtctcatttattcataatgggatgtctcataaacatcccaaattaattatttgcagttgtttgtgttaaatatgtgatccgaattttggaccaacaatatatttggattagttatctaataggactgcattataggattagtttcctattaggactttgagtctttacctattaggactcctagatttctcctatatatatatcccttgtaagccgtacagggagggtgcgacagctcaatgtatcccctgcgtttgtatctaactcctctatagtgatcattgccggtcggcgtctatagttttttccctcaagggtttttcacgtaaaatttatctccgttgtacatttattttcataacagttcggcccttcataatagaactgcgagctgaaaatatgtgagatcttgtaacagttgccctgcatgctgtgttgcagatcgttgctaagggaatggcctttaccattcccatcggaggtggctgctgtgtgtcgcgtggccgatgaatccaccgaaaagagatattgacaggtctatctcctagtgttggaagctgtgggagtatttcaaatggtaatgtactaagttccttgggtgaaaacaaataaaaggtagctgataatttccacattcaaggaaaataattaaaatgatccaactttaattagtatcaactgaatgtttgtagacttggagttctttggaacatctgttactgtagaacattgcataatgtaattcatcattcatttatcctttttgattttttcaggagttttcaattgttcatcatttatcttttctatactaatattttccttttgagtttcagtttaaaagttttttttcttccgaattctacttatttagaaattttctatctttgtttttccttttttcttcaattatagatttttcccttctgttgttttttcccataaaatggtttttctttgtcgagtttggtttcaaaaggcagggagagtggtgcaccgatgccgcaacgatgagcttatttggtttgtaaccatggaaaaatatttgcaatatgggtaagtttatgtcaatgccaacattttgacaatatttatgtggtattggtaagtattgttagcaaatcttaattgcatccatgccattgtaactttcacaattttgatatataccattactgtccggggattcctaacgctggcccatcgttaacatgtgattagcactaatgatgattttgaagtcaaaatttgaaatctttcaactcaaactttaaaaaatttcaactggaaatttaaatttgcaagataaattttgaaaactttcaactcagatttaaaaactttcaactcgagatttgaaacctttcaactcgagatttgaaaactttcaactctgatttgaaaactttcaactcgagtttttaaatttgaattataaaaaatattttttattaaaaatatcttataatagaaattttgataactttcactacatcctaaattaattatgttgaaaacataaaaaaaaagaaggatcgtatagatgcatgcatgcatgcatgtgtgggaccaaggtgcatgcatgtgtgtgtaatgcatctgcacgggtggagaccgaggtacatgcatgcatgtgcagttggtttgctgcatgcgtgagagataagaatctggcgcatctgcgcgagatagcaattgcgttactgtccttctatctgaaggtatgccatcataatttgatatatactactacttacccttcactctatttctttcttttttaccaagttaccctttcttcttcattcattccctcctccctcctgttcatcttctcagcaccaatggcagcagtacaagcatgggtgaaagcgctggcatagaaggcgcttaacgacactgtcggcaacgggaacatcaccatcttcgagccaaggaacgaggacatggagcgcgacctcgacctagagttccgccgccaccacgtcctccccgcctgcctccacggtggtcaatgagggtgggcaccgctcgtccacggacttggatgaccttgttcgagcgtgtagcccgcgccgccgctgctgccatcgacccgaggagatactctcgtggggatccatcagccgatcgagaacgacacctccggcggcggtggagaagcccctacggctaaagtgcctcactcagatttgggctatgaagttgccatcagcctcgacacgccgctcacgttcctcccggatgagagcagcagcgaagaggagacagtggcgacttggcggctgttgacggtcgttatcgatcagtttcaaccgtcaatattaccaaaatagaggagaactagtggtgcttgcaatgcatatgtttgttagaataataatattccactagtattaggtctactaaccttttgcagagaatgacaataaagtggaggagaatcgacatcaacacaaacgataaatcaatcggacgatgtcgagaaccagacttgtgtatgaatgggccaagaactcagaattgacacgacaaactgggccaaaattcacaagtctgcggagaagaacaacagaggaggccgccagccaaaccatgggctggttgggccggccctaggttcgaccgaacctggtggttcggccgaacccccctcatcgccgctggatgcagggtttcttctgaacggtgtggattagctcccaatgacggttggagggtatttctaactattccaaccgtcacaaccgtcattaggaggctatataaacccctcatcttctcacttcactcacacacctcaaggaagagctctctcattcctctcaagtttagtttagtagtatctagctggtggaatagaattagaataggaatcaggagtccggaagccttcggaagagttcgggtatggctctagtagcttttctttcctcttttgtaagctttgtacttttattagaatactcttctaaatacatttctggtattgaaatactttccaagtatacgagtaccaactttgcattatgttcatgttatactgaatatactactagcttatctgggagatgctttggtgcgcgtatagtgtttgcttatgcaattactctatatcatgacatgatattagagtagtatctggtagtttagacgtggtgtctagattacgggatatcattatttggggttatatattgcggatgagaggtgggccgctgatagtgacaggtcagtatgggtattcctccgcgcctatatataatcctaagttaattttctggggagggtattcctccgtatttagccccggttggatggtcatgacgggttgtcgtaaggaactcggcagtcaggggtggcttctcgaaataccaggagggcatcggaaagagggtattagctagtatatcagttaactagaatgtatgtatactatgtatattagaagtataggaatagattctctttttcttttctttccacctaacttagattatttattatgaggatgagtagtaatgcttgtgtgtcactctacccttggattatcttaacccctgcttagaatatgattatcacaagaaatatataaattattagttgagttctctctacatgatcttttcacgagataaaataaatacgatacccttggaatactctcgggtgaaatgctacaatggtatatccatgcgcttgcgaatgaactctgtaaccataatataccagaagtgtttctgcgccattgctgggaattatatttctagtaatgtcgttaagaaataccaacagcagcaccgtgagatcttcgtgctatctcctcttctgattcccaattcgattatgtttgattttatttactggctcgtattgatctctgttcgatcccaattcgaatatatccaattcgaccaggtccgtatctatccaagtgagcagagcacccctctatatatccatctctagctctccctttcttcattgaatggatgaagaacttgttcttgagtgtttgatttcgagttggatgagcgaagagaggatgaacataactacatgtgatagagagggagatcgatgaaggaagaagaaatgggcaatctgatctaaaaattttagaaaatacagtcacgagttaagtagtgccatctatcgaataacagcaaaattatagtgacatttctccaaatagacgaatagtaataaaatatttcaaaatcataaaagttataatggcatggttccaattaatcctaaacattaccagcctataatgagctagtagcccatataagtgcaatttgttggctgaagagtttggtggttgagttgatatctacaagctagctaggaaatcatgaaattttatcgttctaaccaattttaaatgcaaatttctaattacgttatgtccgttttcatatttataaaaagttcatatttctcaaaattattggttggttatgaatctacttttgactaagacgttttatacttcttttagatatttaggctgtgttcggctggctaagttcccaactggaacagtgcgcataaaaaacagagcgatccatttgcacgtggttaattaaatattagttatttttttaaaaaaatggatcaatatgcaattttcgtatagaactttttacaagaaacacaccgtttagcagttcgaaaagcgtgcacgcggaaaaggaaggagaggtgttgggaacctggatgcccgaacacggccttagtgtatcaagaatttgaaattcttaattaagacaaattcaccatctaaggacaagaaaattgttatagtatgtgtagcagtgttcttaattgtatacttgctctccctaaagttaactgtctttttgggatgtgtgcagtaccatgtttaaactttgacaattaatataatatcactttgaatattttgaattcaacttttttaaaattgtatgaatagatttctcttccaaaaatggtttcaaaatattataactttgctacacttttccatacctttttattttatactagtagtaattactatcagaaaaattcttttggtgacttgatcaaaaacatgctgcaaatggcataggtatgggaattgaacatattatattggtcacgctttgattcatacccctgatcgtacattacatcttaaaaatattcttcatgttacccaagccaaaatgaatcttatttatgcttctcgtctagctgaagataatcatgcttttcttgagattcaccctaaatattttttgttaaggattgggtcacgaagaacacaattcttaaagggtggcatcaaaggggcctctgatgacgctctctctcgtggcccgatcttctggtgaggggataactctcgctttgatcgagtgcgacgtttgtgacgtggctaccaattagaacatgtccagaatgccgtgcaatcgctaaaccacaaacgatgttgtaccaaccgtggcgcgcggttgatgatccctgcaatgcaaatgagagaacactgcaagaacaagataagatgcaatctaaatattgcgaataggtaattaagcacaaagaaatggttgcgattgaagtggtagatccaatcgacccgtcaaatcaacacaccgaatattgggggctctgaatctatagtcgccgactagtagagcgaggactagagacaaggtgaatagcacttagcaaaattcaactaaacaaaaccccattgtttttcaggatgtacaaagctatttatagagaaaaataaagctagggttaagtactaattcgtggaggtggagggagaaacttccgagatgggcctagtctattacaaggtccaaggcccaagttcggtttcagcaacaacactgttttgttttggtgattcttgttgactcgagatgaatttggacatcagaccagatgcatttgaaaggtagcgagataagctttccatgaagtccaagatcacccaaatcggagttggcatgaaggcactaggtccgtttgaagtcagtgttgtctccggaggccgaactggacttggacttggaattataattggaaagtgtgaagttatgtgcgtatccgatgaaatgatgtcctcatcatcctccccttcttgaattggagtcgtcctcaactcaatcccatcttcttgaccgtgttcactctgtcgtccaggggtcatccttggaggtatctcatcgtgaaaaacaccctcatattcctgcaaaaagttagtaatagcgggtagcaaagaatataaagtactaggagtagtaaccaatgtgggtatatgatctttgcaaaaaagagcatagtaacaagaatctggctcatctagagcgaaaatattatatttagaagctagcaaaacacccttcaacttaatttcattctttgaggcacttggttctattttactaggtgaagcaagattcttagtaataatctgattttcactgttagatttcttttcacattcaagtcttgcaaggtcatctttcaaagcagcggctgtcagggttacggataaggtataccctctacccttggatatacgtcatatatcgat

SEQ ID NO: 58739 - DNA, 6165 bp, Oryza sativa
tcaaaactctggtcacactcagctgtccatttaaatttctcatctttcttaagcaactgagtcatgggtctggcgatcctatagaaattttcaatgaaccgacggtaataacccgcaagtccaagaaaacttcgaatctgtgacacggtcttaggtggggtccacttggtaactgactccacattcgacagatcgactgccacgccctgagctgtaatgacgtgacccagaaatttgacttccgacaaccagaagtcacacttgctgaacttggcatataattggtgctccttcaacttctcgagtaccagacggagatgttgctcatgttcttcttcagattttgaatagatgagtatgtcatcaatgaataccacaacaaacttatccagaaattccatgaacaccttgttcatcaggttcatgaagaatgcaggtgcgttggtatgtccaaaagacataaccgtgcactcatacaacccataccgagtggtgaaggctgtcttgggaatatcctcttcccgaattctcaactggtgatagcctgatcgcaggtctatcgtagaaaacactttagctcctttcagctgatcaaacaaatcatcgatccgcggtaaaggatatttgttcttgattgtgaccttattgagtgcgcggtaatcgacacacattctcttcgtcttgtccttcttctccacaaaaatgatcggagcgccccaaggtgaagtacttgttcgaatgtatcctttctgcagctgctcatccacctgcttcttgacctctgctagctcgttggctgccattcggtacggtctcttgtaaattggagcggttcctggtgccaaatcaatccggaattcaatctctctcttgggtggcatggtagtgaggtcttcggggaacacttctggatacttgcagactacggggatatcttccaatttccgcgaactcttctcgtcggtggccacagggttttccacctcatgctaatttaaggagattccttgcttcggtgagtgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcaataatgatctaattataattgttaagagcttttcttgtttaaaaatccttaaattataaattgttgtttaaaaggaataattagaaatgatcttaaaagagaagatctaattttaatttgctaaatctcaatataaaattgggttagataaaattttgttaaatactttacttgattctatagttcctagatttttctgggatttatttgagccaaggaagtatttttaatcaatggaatatcatttcatgaataatttaaatagaaaaatgtttttaaatcctccttttggctttgggccgaaagccggcccaaaacctctctctttctctctccctccctggcccaagtcggcccacaaccgagccgccgctctcttctctctctctcccgctgacaggtgggccccacctgtcgggcccgtcttcctcctcgcgccgctgccggccgaaaccctagccgccgccgcttttcaatccggtcgatcctttccgtttctggtgaaattgtttgaggggaaataatctcctcgatctcctcttccttttctcttatagaaacttcggtcaataacgtttggaaatcgacggatttgagctcgattcggatcgacttttctccctccaaccctagctttccatcttgccgccggtcgccgtgggcctccatcgccgctcgctagcccctttataagcacccccgagctctcctctatccgccgccacctttgccttagcccgccgtcgcgtctagcgccgcctccgcgtagccctagccgtcgctgtagttgccgtcggttcagccacgccgcgccgccgttgcagccgccgtcgtcggtcgccgtcgccaccatcgggatcgcgaggtcgtcaccgtccccgtccacctcttcgccgccgcagaagaccgccggagcaccgccgtcaccgtcgacccgaagaccgtcgccgcttcttcctcgtcgccggcgccgtccgttgctcttccgccgtggttttggtcaccggtgagttcgccgtgttgtcctctacccgttggtgtcctccgtttgcgtcgttgcgccgtcgttcgctggcgagcgcgcgaggccgagccgtcgccggtgatgacgtcatcgctgacgtcaccgctgacgtcatcgtcgccttgtcccgtgaaccgcggtagatcaagttgatctcggccgcccgttttggatagaatcgatcacggccgttcgtttccttagaccgccccgtgcacctggaccgcctttgatgacgcaataattcccttttccttttcaaaaataattctttattgcgtcataattcaattaaaatccacacaagtgttttaatccgatttaatctttgaaaattcataactaattcattgtaactcagtttaatgtggttcaagttgcaaaagttgtataaaataaagatctacatattaaaattatccataaattgaattaaatttatttaattctttttaaatgggctttaattagatttaatcttgtaaaattcataataaattcatatgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgtgagtacgccggaagtattcaagaagattaattgaagaccgattattgcaaggcaagtcacacagatcctaaacacaatcctttgagcatgttgatcctgtatttaaattctctatttatttcaactgtgcatttattttcgaatgtcactgggtggtgtgaatctattcctttgttatggcctgtttgcattgattactttattccttgataccttgggttattataacttgactagttgagctatatatattggttcagctagatattagatatgattgcttagccatgcttagaaacattagcacactattgggattacttatgactcattattatttaatgatggcttaatgatagttcacgatggtcaatcgtgattggttaattaattacttgccaactaaaacttgataatggtggcttgtgagcacatggttttgagagtcgtgctcatgacaatttaggaccggttcgcgagctactgttgtgaaacattaaccgtgccaaccacaagccagcgtgggcaacggctttaccttttgtatagcatgattcattgcggagcaccagactgagaagtggcggagataagcccacaggggtcgctggggagtccatgccttgtttataagggggtgattatgatccaggaaaggtgcgctgtggtggattgtgttgtgcaaggggtattgtcacaactcctttccgaggtaccgtggtggtattgaggcacatggtgacatgttgtgggactgtgtcttgtgggtacagtggtacacctctggccaaagtaaaactattcgaatagccgtgcccgcggttatgggcgggttgagcaatatttttcatgattagtctcacacctctcacaataattatggatgttatacctggtaataatttgcttagctcctggtttagagttagatctgtacagccgggtatggttgttcaggatggttgggcctgtgcagcatgggtgtgttgttcagtgttgattaaaatttctgattaattactccactgttttatttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatctaggaggagaagacgtttggcttataccccagttgagctgcctgtgggagtggagccggagcttcgctagattttattttccgctgcagttttcttcatggtgaggactaagttcctcttaagtaagtatttatcgttttagttaatttgatgaatctgtatattaaattgtcagtttgtgtacctcggctgattcctggacgaggattttatgcacaaataagttcggaaattactagtgaattttcgggcgtgacagtgagactggtgacttgtacaccatggtttctcccttctcattggtcaaggtgactgtgcgattcacacaatcaatgacacccttaaacttggtcagccaatccattctaagaataacatctaggtccttggattcgagaagaatgaggttggctagaaatggtgatctttgaatttctattgttatagaggggctgaattgaaccgaagtggagctattccctggggtatgaacctgcattggtgtgctaagttcttctcttattaacccgtgtatcccaacaaacttccttgaaatgaacgaatgcgttgcaccagaatcaaaaagtactgttgcagggattgagttaacaggaaacgtacccagtacgacctctggtgctgcttgcgcctcctctgcggacgcgtggttgacacgagcctggacaaaccttggcccgggacgccttggcttcgggcatttgttagcaaagtggccatgctcgcctcagttgtagcaggaccctggctttgttccagtctccttcttggcttgggtggatggagctgactgtgctggtgccattggtgggcgcggagctgcattgcggttggggctgacctccctggtggttctggctgccactggcgccctggtggaaaccgcttgagttgaacgggcggtgctggcggacaatcatagtggtaggtccaccctgctgtccgggagtgaagcgcggtcgttggtggcttccttggttggactggaattgcgctgcctttctcttcctgtccattttgttgcgctgatcctcctgatggattgctttgtcaaccagcttctcaaagtcggcatagtctccagagattaactggttggttagctcgtcatccaggcctgctaggaacttctcctgcttctcggcgtcagtgcggacatcctccggtgcatatcgcgctagatgattgaactcatggagatactcagtcactgtcctgttgccctggtggagtgcccggaactccctcttcttctgtgccacaaccccgtctggcacctgcgccttcctgaagctgcgacagaactctgcccaagtgacttccgtgcctggcgggcgggtagccatgtgattgtcccaccaagctgacgcgggaccctggagctggtgtgtggcaaaggcgaccttctcctgatcattgcactgcaggagatttagcttcttctctatggcatggagccagtcattcgcctccatagggttggtggtgctagagaaggtgggtggcctgacgcgtagaaactccggcagtttggactgagggggagggggaccaaactgctgctgctgctgctcggcttgctgctgcatcctctggtgcatctgctgcatcatggctgccatcatcttgagtctgatgagccattacttgggccagagccggattctcggggagcggtagcggaccattgctggagtcgctgttgggatgcacaccgtcagtgcattcttcgccgttgctgccctcgcctgctgtacggctaccattcctggtgtagaccatctgaaggaagagcagacggaggggggggcaaagaagaaaaacagatgctccggaactaagctttattatataggaatgtaaactgcaattgttctgatttgacttaaaacacttaaaacgacaagcaaatccttattaagacagccatatcataggcacatgatatcgaccgtcgactgacccccaagcgaaaaacctaaacactcaaactaacagac

SEQ ID NO: 58740 - DNA, 3133 bp, Oryza sativa
cgcgggagctgacactggggcaggagctgggactggagctagagctgctcgagctgcgggaactgcgggcagaactggaggagctgcaggagctgcgggcggaggtgggttcctgggcgcaagctgaatgcgcacgggtgcagtcgttgacttgcggggcatgttgcggatccggactcctccgggaatggggaggcccttcaactgagcattctccttcttcaggcgtgcgatctcatccttcagagctatgatcctcatgagcttcccgtcatccgagtgcatcttgtccattcccctcatcacggcacacatatgacctaaggtggtgtcgttctcgccggctgtcggacagaaagtgctgatatcatcgccacttgctcgacgagggtggaaacggtacgctgtgttgcagaagatgtagttgtggcgctcacgtagtctagccatcatcaggtatgccgcctcctgacaggcgtgatctgcggtgcctccagatgcctcaaccaccatgttagcgaggcaggtacccacatagccatgaacctccagacgaacccggtgaggaaactcaccactgagcggcggaacagttgagtactctggcgcgttggggtagcccaccaccagtgtcatgcgagccaactctgccacaaaatcatccatgccttctccgcgatggttgggtgggtgatcggccatctagagaagacaaaggggtaggatcaatgcatgctcaaatccgacttaaatgaagcagtaaaagactccaattaaatacgcgaataagagcggaattttatgcatagatcatttttgcacgagggcgaataaataagatggacttacatactactaataataataagagcataaataccttgcaacccatattcctgagttaggacctaatgcattcctcccatcaaatcccgactgactgtcgaataaatctcaagtaattttactaaaaccctagactgacttgttttgacaaatctcacttaaacgagcgaccaagatttttcccttgaaccacaagaacaaatcccaatttttccaggaacaaatccaattgcaaagaacatatgcaatgaaaaggattcagagggctcttaggtttttccatttggcttgtcctacagtcaaggtcggctctgataccaacttgtcacgcccagaaattcccgaatagaattccaagcagaatgtgcattaaaatccccgtccaggaccatccggggtacacaaacgacaaagttgacatacagatccacgtcttacaaacattataaaagtcttacaaaaatgcagcggaaaacttaaaggataactggagctaagccttgacttggacttgcagcgggaacaccactccacaggcatcctcgacggcacgggcgaagcctactcctcggaaagaccaccatctgacgcatactcaaattctggggtttggggaaaatagagcaagactgagtactacccactgtactcagcaagtcataccggaataggggtatgatgcagggaattatcaagggatagctataatggttcatttgcataaagcgagcatttataaacagaagttgaaagcagtaaaacagctgtaataattaatcaatattaaccatccactgttcaacgctacaccacgttgcaacaggcccaaccatccacctgaactaatcagttccaacagactacactagggtgaagctaatcatggtgaatctggttgaccgcccataaccgcgggcacggctattcgaatagttttactctgatcagaggtgtacaactgtacccacaagacacagccccacaacacgttaccgtgcgccgacatgccaccacgacataccggaaagaggccgtgacaggatccttcgcataaccccctctaaccaagcacaccacacctcaggtttcacccccgtccccagtgggcaacgggcagtcccctctcgtgcctaggtgaatccggaagtgacagaggccgtcgcaggggacgccccactccatcacgcccacccttgcctggatgcgtcggctagaggaaagctacactacaagcccagccgttgcccacgctggcttgtggtaagtacaaggaattcttctagggtttcccgcgaaccggtccttaagtgccatgggcgcgaccatcaaaaccatgcacccacggcccaccatttattatattttaattaaccaacaccggagcggtgagcattaaccaacatcattcctagaatctgatatctctgcattaatgtagtcccccattgtgtgctagttgaactaagcaaagctaagcattccctagtccaatctctagtcatgttatatcccaagctaacaaaggaacatggtacaaaatagcatggctatgacagtaggtcaacatcccatagtattattgtaaaacaatgcaatatttgaagaaaaacaatagaacatttgcaatataggatcaacatgttcaagtgacaagcatgacttgccttgctctgcggttagagggacccggcgactatttcaaagtacaccggagcgtcggggaagcctgaatctaagcgacatacaaagcaaacaatacaaacaggctataagactactgaaacggagaacaaaaccatttttaatggattctacacatttttctttatttactgagacttgaatgggcttaaacggagctcggatgaattagatatgaattttagaagattaaatgtgcttttactataaacagaaaaatccttaattgatttattgcgcaataaataaatcccggggagagagagggggcggcgccgacatgcgggccccatatggcagtgactcgaggagggcggtccacggcggaccgggaaggagcggcgcaccacgtggtgcacacgtggcgccgacgcggcgcacacgcggcagccgaaccgacagccccgatctaccctacccaagggttgatcggacagcggcggggagctcgcggccggcgcgcgcgggcggctcaagctgacccggggccatggcgctgcagcgcggcaccggcggcgaccggcggacggcggcggcgattcggcagacggcggcggcgcgacgacggctaagcggcggtgctacc

SEQ ID NO: 58741 - DNA, 14583 bp, Oryza sativa
cggaaaaaggaaaagtgaggaggaggatgcggggatggattttataggggcggagaggtcgggaacggccgggagtggcccgattcgccggccgacgtggggaggtggaggtggagagagaggtgggatttgaatttcgaatcccggccgtctcgggtgcgggcacgggcgagagggatggggagtgggtgcgggagacgcggcgcatgcgcgggcgtggccgacgtggcccggaggaggcgggagcgtggatgcggcggcggttgcgggcgcggtggcggtggctggaggttgggggaggacccgacaggtaggccccacctgtcagtgaccccgggagagagagggaggccgccggctcagctgggcctcggcctgtcggccggcccagcgggagaaaggggtgggaagagagaatgggccggcgacctattccgaaaagaaaaaggagggaaaaagaaagaaaaaggaggaaaagaattttccagggaattaaatattgcatgtgctcaattttaattggttaaaattatttctagggctctgaaaattccactaaaaatcttgttagcaaatttcgacatgtagaactcaagaaaaattccacatgccaattccgattattaattgcattgatttattagggtttactcttgcttttacaccgatattttttctggtgaattataaattcaatttaggcttgggaaagaacttcagggtgtgacagcagggctcatcgtcgacaagcacaccacgcgatgtgtttgctatcggcgggaccagcacgtctgcgcgtgctgacgcggaagtggagaatcaagtggttacaccggcccagcacatcggggccatcaacgcaatactgagggaaaccccttatgatcccattctgaacgatgacctcacacggtggacagaatgactacgggaatcagtggccaatctcagtaatgcgttcgaggaggccactgccggagcaaaccagaacaaccgccagctagcggtgcaaatggtgaaccacctgagcagcggacatcacctcgacaagacacccctccacctcgcggcaccggcgatctttgtgaccatcttaatggccgccgagaagtacgacacgcgcgagacaatgaaaaccattcctgacatcgcgtctcatcacgacgtcgcgagaacgaggagcgaggaggacacccaagcgaaaaccgagaccgtgataaccgccacagccgccacgaacatgatgatcgcgaacagcggatgccaggcgatactggtcgaggacgccgccataacgatgatgacgatggagatcgtcgccgggacatcaacgggaggcgacgacaggattctcgagaacccggacgtcatcctcgtaatcgtacaccggaaccaagtgactcatcgtcatcgtcatcatcctcatcatcctcattgtcagacagaaatccacggaggacatacgatcatcgacaacccaccacccccagcggcagatgtaaagctttcaaccgtgctctacgtgatgtccggtggcctgagagattccgaccgggagcaatagagaagtatgattggagcaccgacctagaagaattccttcaggtctattccagagtactctacactgccggagcggacgacaacgcgttagcgaattatttgccagtggcgttgaaaggatctgcacgttcatggcttgttcacctccggccatactcgatttcttcatgggcagatctgtggcagcagttcgttgctaacttccaaggaacttacaagcgccatgcgatcgaagacgacctacacgcgttgacacagaatccgggcaaatcattgagggactacgttcgacgctttaatgagtgcagaaatactatccccgagatcaccaatgcttccgtgatctacgctttcaagactggtgtcagagatcgctataccacccaggagttggcgacaaggaggatcaggactgctcgaaaactattcgagattgtcgattgatgcgctcacgcggacgacgcactaagacgcaagaacaacaagccgaagacgggaggagagaagaaaccagccaaagacgcacctgaatcaagcaagaagaagagtcacaagagtgggaaaacgaaagctcaaacggaagtcctcgcggcagagtacgtggaccctcccaagcaccctgacccacaaggcaacgacacgaagaaaatatggtgccccatacacaagtcagacagacactctttggaagattgcttcgtcttcaaaaagtcgctcgcaaagcaactggcattggagaagggcaaacgagtacgtgtagtcgagaaggccgctgaggcagctactcaggacttggactcagcataacctgattccgatctccatgtctcgcaaatcttcggaggttccatggcgtactcctcaaagagagagtacaagaaaatggagcgtgaagtttgttcgacatggcagagggctgcgaccaagatgaagtggttagaacagaagatcgagttctcagatgaagaccaccccaagactgctgtcacgccaggacgatatccgattgtggtcgagcccactatttagaataccaaggtcgcacgggttcttatcgatgggggcagctccatcaaccttctcttcgcctgcaccttggacactatgggaatcccacgaagcgagttgacgcccattaatcaacccttccatgcaattactcctcaatcatcgtccaagccattgggcaagattatgttgcctgtgactttcggccaagcaaataacttccgaacagagcagatcacctttgatgttgctgaatttgatacagcatacaatgctatcatcggaagaactgctctcgcgaagttcatggccgcatctcactacacatatcaagtgctcttgatgcctgggccgaaggtgatgagtacacaactagctcggatataaccatgactaccttatatatgagtcaaccaaaggtgcatatgttctatattagatttacttgttatatatttgaacaaacgttgctacacattgtgtttcatgtgttttcgttcgcagaggtacttgcttgggggaaagaaaagagaccgagcgtaaggaatgcatggatgactgaagaagttgattggggaccaaaccaagaccttctccaagtatacttctacctcaccacgtcacttttggcctatagaagacaagagatcaagttgtacatgttttggattcagattcgggccttctgacagcatctatttcaaacggacctagccgctgatctagaaggagtttcggggcccatgagtacttgttggaaagcttatggagtctactttcagatggttttggtcccatgtcaaaattccaaccaagctgccggaaatctgcaaaacaagccacgtacctcatccagtccgaatctgatttgggttttgggccttgtaattgtcatgggcttagcccaatggggtgtgcgccttagggcaaccctaggacgtccctaatcacatttattcaatagccgtcatcgtttagagtcgggttttgcttagattattctgtcaagaacagtttcgccgctagattggtttgtggaaccccaaatctgagtgcttaatcattcatatgcaatttggttgcaatctatcttgttcttgcttgtgttcttcgattcgcatgcagggattagccttctcggtgaggtcaactgggtttcggcacggttgataaccagaggagacgtggtgctgcgattgcggggataagtagcgtgttcgtttagaagccggatcgagttgtgtcgtgactccacccaaatcgattgtttatcaatacctatcggaagatcgggacctaacatcccccatcagaagggaacaatcactgttcaagggaacgcaaagctggcagtgcaatgcgacaagcagagcctcgacatggtcgagcacacgcccagcccacccgccacagctgagccacccaggaaagtgagcaaaacgaacaagacgccgaaaccagacggcgcaatcaagatcgttccgctctccagtgccaaccccgacaaggccgtcaagatcggggcatcactgggcgagaaataggaactcgcgctcatcaccttcctccgtgacagtgcatatgtgttcacttggcagccgtccgacatgccgggggtccctagggaggtgattgagcacaaactcatggtgcgacccgatgccaagccagtaaaacaaaaactgcagagatttgcaccagatcgaaaacaggccatacgagaagagctcgacaagcttctcaaagctactccatccagagtggctagccaacctagtcatggtgcagaaggccaataggaagtggaggatgtgcgtcgacttcaccgacttcaacaaggcgtgtcccaaggatcacttccctcttcctcgaatagaccaactggtcgactcaacagctggttgtgagttgttaagttttcttgacgcttactccggttaccaccaaatcagcatggcgaaagaggatgaggagaagacagcatttatcacgccgttcggtgtattttgctacgttaagatgccgtttggactgataactgcaggaaacacttttcaacgcacggtccaaggggcacttaacgatcagcttgggaacaatgttgaggcctacgtcgatgacattgttgtcaagaccaagacaagcgactcattgattgacgatctacgggaaacattcgacaaccgccgatgatatcgcctcgtgctcaatccagaaaagtgcacgttcggagtaccatcgggcaagctgctcaggttcctcgtatttggcagaggaaccgaagaaaatcccgagaagatcaaggcaatcaagaacgtgaagtcgcccacaagactcaaggaagtacagaagctaactggatgcatggcggcactaagctggttcgtcgctaggatgggagaacgaggacaacctttcttcgctttgctgaagaaacaagacaaatttgtatggacacaagaagccgaagaggcattcatcgcactcaagcgctacctgtcaaacccccctgtacttgttactccccatcctaatgaagaattattcctttatattgccgccacgccatattccatgagtactgtcattgttgtcgagagagagaaggtgcaaagaccagtctactacgtcagcgaagctctccacgacgcgaagacaagatacccacagatccaaaaactgctctatgcagtaatcatgacgtcaagaaagctacgtcactacttccaagcccacagggtcacagttgtttcctccttccctcttggtgaagtcgtgagaaacaaagacgttgtcggcctcattgcgaaatgggtagtcgagctaagctagtttgatgtccactttgtgccacgaacagccatcaagtcccaggttctcgccgacttcgtagccgattggactatgcttgaaaacaggtcagacagtcaaaccgacaacgaaacatggacaatggcgttcgacggtgcactcaacagccaaggagcaggggcagggttcatcttgacatcaccttcgggagatcagttcaagcatgcaattcacctcaacttcagggcgaccaacaacactaccgaatactaaggactactcactgggataagagcagcagccgcacttggagtcaagcgactgatcgtaaaaggggattccgaactagtcgcaaaccaggtgcacaaagactacaagtggtctagccccgaggtagagttatccaagtacctcgcagaagtactcaggaagctggaaaaaagatttgatggaatcgaggtccgacacgtataccgcaaggacaacatcgaaccagatgatctagcacggcgtgcgtccagacgggagccactcaaacccggcacctctctggacgtcctgacaaagccatcggtgaaagaggcaaacgacgaagatagcacagttgcccccgacatcagctcgggggctacagaggcagagtgtgccattgccgacatcgagaccacagacggctagcggatcccactcattaaattcataagtagtgacaagttgcccgaggacgatgcagaagccgagaaaataacccgtcaagccaaaatctactgtatgatcggcaatgatctatacaagaaggcaccaaacggggtacttctcaaatgcgtctcgttcgacgatggcaaacatctcctcctcgacatacacgaagggatctgtgggtcacatgccgccgatcgcacattggtcggaaaagcttttcgacaagggtttttctggcctactgccctcaaagacatttgcgacatggtacagcggtgtgaagcttgtcaatttcatagtaaacacacaaagttaccagcgcaagcgttccaaactatccctctcacttggccgatctcatgctgggggctcgacatactcggaccattcccacgaggacaagggaagcgacctccacgggggaaatcaaggccgacagtgccatcaaattcattaaagagatattctacagatatggattgcctcaccgcatcataacggacaacggctcccagttcatcagtgccaacttccaggattactgcattaggctgggagtcaagatctgcttcgcttcggtttctcaccctcagagcaatggacaggtcaagagggcaaatggcatagtactacaaggaattaagacccgtgtctacgacagactgatgtcacatgacaagaagtgggttgaagaacttccctctgtactatgggccgtgcgtaccacaccgacaacgtccaacaaggagacacccttcttcctcatgtacggctcagaggctatgctccctactgagttacagcatcagagtacatgagtacataagtactccgacgaggatcaggaggaacagcgaaccgacgacgtgaatctactcgaggaacatcgagaaagagttgccgtcagagcagccagttaccaacaggcccttcgccgatatcacgagaagcgcatcagagcacgcacactttcgattagtgactacgtcctctgacgggttcaaagccaggcagggcgtaacaagctctcacccaaatgggaaggaccgtacacaatcacgcaagtcttgcggccgggtgcatttaagattgcagacggtgatggccgcgagttagcaaattcttaggaacattgatcaattacgtaaattctatgtataaatcaatagtatccatacttgtaagacatcttatagcttcaataagatttatttttaggtaaagattacaatcaaagtgttccttcccgacgatccctcaccacgataacacctagcattgaaacctaacctcatgtccctttacgccgtcttgacaaggcctccgaggaacctaagggaacttcggctggggacactcagagccgataaggccttgtcggatcatgaagggacaaaagaccatgtaagatcaggtcgtgtaagagttcttgccgcgcgtattaaccaagccgtgtaatcggaaattgggttttccaacttcactgctgggggctaggatcagtgcttgttcaaccaaggcaggtcaaaggttcaagagccttatcttcctagaaaaattctccgatgataaggctgggggctagggagagtgtatgactcaagtgactgatcgaagtcacgaagtgagaaaacactcatacacaacgcatctagagtaagaaaacttagttagatagatttcttttctatttcacaactacttcttacagttcgtaaatattccaaaatatattacatgtctccctgagatatttgtcacaggatataaagactaccaggaaggccaacgccagtccatggactggaagaccttctctgcaagcggcgcaatcgacttcgccagattatctatctctgcgggagtcctccgagaaggagaaaacccttcgtggaggaactcgaggtgcagctgcgggtggtgatactggatacaggccaacacgtgccctccagcatattggctcgatcgacgacactcctgcttaagggcctcatcgatacgcttgccgatgccttcaagctgagcacaggccccattcagccacgagatgtatccagccgctgactcctcggggtgcccgcgaggtactcggagttccctgcagactccggccatggccgtacaatagctcctgaggtacgagttgaaccacacctcgcgacctcggagtgcttctacggctcggtccttcttaacttctaccatagtcctctcgagttcagccacctcgaactttgtcctccaatattggatccgacgatctcggtcggccaacgcactctcgaggtctgctcaacagggaaatgactaagtcaagtcgtgcccctcttccgagaacacggcaaattaagtcgatccgaacaaaaagagcaaaggagatgaagaccaaagaacaaacctaaggaagtcgtcgccatgctcgcttccatggacaagttctgatctacgtagtcctgcagcacatatggctcgagcgcaagtgccgaaacgactaccggcgactcaggctgcccgcgctgctggacatcctcgacgtcgacatctctacgacgacaacaaagtactcaaaatcaacatgctaaagaaaacgaaggtgatgactgcatacacaaaagcagtttgaacctacgaaagttttacaagcgcaattgattaaggagtacaaggaggctgaaatcctactcttcaaaaagggggagacagactccccaagtcaccgtcttcttccatcacgcccttacgcgcgtagttagcagccccctgatctaagatcctctggaggtcgagttcagggtgcaccaaccttacgcacgtgaggtcgtggcacacctcggtgtagatcccgttggacgtctcctccccgatcctggccgcatgcttggaggggatctcctgtcacaccctaaaaatcctaaatatataaattgttgtttaattagaattattagaatttattttaaaagtctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaatgtttttaaaagtctcttttggctttgggccgaaagtcggcccaaaatcctctctctctctctccccggcccaagtcggcccagtccgcagccgccgcgcgcgcgcgttcggtcgctgacaggtgggtcccacctgtcggacccgtcgtctacctccggccgccgccgcccgaaccctagccgagccgtgccgccgtctccttccaaattcggccgcgtctttccttctccggtgaaatcaatagaggggaattgatcttcgggatctcctctaccttttctcttttggaatcaccgtcttattcgctttggaagttcgtggattcgaggtcgaatcggatcggtctctttcctccgaaccctaacctttccttcgcgtcgccggtcgccgtgggccttcgccgccgccctccaacccctataaaaggatcgccggtgtcgccgctacccgtcgccaccctcgccttcgtctctcgtcgtcggaagcgccctagcgccgtgtaacctcgtgccgccgtcgtcgccgccgctccagccgtgcttcgccgtcgctccagccgtcgccgtcgctcgggaaggtcgccatcgtggtcgccgtcgcgtcgccgtcctcgtccgccccttcgccgtcgctgtagaccgccggagcatcgccgtcgtcgtcaagccgaaggactccgccgccttttcctcgacgccgccgtcgtccgttcatcttccgccgttgtttggtcaccggtgagttcgccgcgccgcgctctacgtcctggtgccctccgtttgtgccgtagcgccgtcgttcaccggcgagcttgcgctcccgagccgccgccggagatgacgttgccgctgacgtcatcgggaccgtccgtcgtggcccggccgttgatcggttgatctcggtcgtccgttttggataggatcgatctcggccgtccgtttccgtgaaccgctgccgtgcgcccggtccaccgcaaaccctagccactgacgcaataattccctttttccttttcaaaaataattcattattgcgtcataattcaattaaaatccatataagtgttttaatccgatttaatctttaaaaattcataactaattcatattagctcggatttagttggttcaagtctctaaatttttctaaaattgagatctacatgttaaaaatatccacatgtactgttcatgcttgtttatatgctgttttggtgattttgcccttttctgtttagattccgatgtttccggagagtctgttttcacaggagaagaatttgaagagttccaaggccagcaaggcaagtcacacagatcccaaacaatcctttgagcatgttgatcccgcttaaagctactgtttctattcaactattacatttattttcgaatgtcattgggtggaattaacctattgtttgttatagccctttttgttcttgattcctttattccttgataccttgggttattttaacttgactagttgggctatatatattggttaagctagatgttagacgtgattgcttagccatgcttagaaacattagcacactattgggataacttatgattcactattatttaatgatggcttattgttagttcacgatggtcaatcgtgattggttagttaattaatgtgccaactaaaacttgataatggtgggttgtgagcacatggttttgagagtcgtgctcatgacaattaaggaccggttcacgtgtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaaaggtgcgctgtggtggattgtgttgtgcaaggggtattgtcacagctcctttccgaggtaccgtggtggtattgaggcacatggtgacatgttgtggggctgtgtcttgtgggtacagtggtacacctctggccagagtaaaactattcgaatagccgtgcccgcgtttatgggcgggtctaacaatgtctttcgtgattagtctcacacctctcatcataataaaagatgctataactggtaataatttgattagctcctggtttggaatggtatattcctggtttggagatagatctgtacagccgggtatggttgttcagaatggtagggcctatacaatagggtatgttgtatagcgttggattaatattgtttaattattacttaaccgttttattaaattctgaaatgtttattaaatgctgtttatgcaaatgaaaccctactatgccatcctttggtatcctgtgcacttgcatatttgctgcgtggcttgctgagtatgtcatatactcaccttgcaatcattcatcagaggaagagttctacaatgatgctgatggtgtggaggattaggtgtagccctggtcaagctgcctgtggagtggagccgtctgcgccgtttatcttattttccgctgcttagatctttattgattgagaggaactatctacctctgtaatgacattttattcacttattaattagagtaataattgtactctattatcaatttgttattgtgtgcctcggctgattcctggacgagggttcacacacatgtaagcgtttggaattttggatagaaatttcgggcgtgacatctcctccatcgccgtggccagttccgcgagcgaagacatcagcgagaactcattgggattcaccgggatggtggtcgtaacaccgcactgcccggcgagctggtacaggccggtgtatgtaacccgcagcgagccacggatctccgataggttgttctcgagctctgacatgtggtgctcgagcccctgccgctgccgctcgttgccggccaccagctccctcatcttctggaggtcctcgcggacctccgccaggtcacgcgtcagcttgtcagcgcgttcgttcgccgacgacgccgccgccgccgccttcacctcctcaatctcgcgccctatgccgtgagcatctgcctggaggatgcgctccatctcgatttggaactccccccaggtgaggacgtcagcgggcgggccgcaagtaggcacaaggctgccggcagggccgctgggcgtcgcctcacggctcctgggcacgaccacgacatctgtcgaagccgctgcaggagacgcgctggagtttcctccagacccgtcttgcaccgctttcgcccgcgccgtcctatgaaggatttccgtgatttccatgaaggcaggctaccaaagttttgtgaattaaaagacctcaaattcatctagttacttctcaccaagtgtcaccagcctttgccggcgctgaggcgggggagacgcgtctaaggcctaagtaaaatgagcatggtgtaaggtcaagatcttctgactacgcgataaaggaccagaaaagctcaccaatggggtaggcgccttccgacgattcccaagcacagaggagaacttcctccctctcttcggaatgttgctgccactcattgtagcagcagcagcagcagcaatgtcagatgcctccttggcaatgccctctttcaatgaggccgctgcctggtggtccacgagcggcccgatgacgtcagtcagagggagagcctgcacgcatgaagtctcagtacgatccagaaaagcagaagtaaaggagttctcaaatacactcacgatgatcgtagcctcgcgatcagccttccccttctcacaaagagggatggggacgttgcttgccgtcgtagggccgctgatcatcacctaaccgacgcggtgctccacggttttgctgtttaaacctgtaagatcgaggagtagaactcgataagtatggaggaacatgcaaataaagagtgtaatccgaaatacgagaaaaataccccgaggagaaacccaggtcgcgtcctccggcccagaatagtcaaaggctaggtgggctcgggcctagagcggctgaatccacctaccgatgaagtcggcagcgacttcataccccgataaccctcgtactcggaggtcatcgatgacatcgatgaaagactgaagggaaggggttagggcaggtttggcggcccattcggaaatcttatctggttgctcctcaggaacaacaaagactagatccgaattttctatctgaagataaaaccacctcgtccgccatttgctacgagaagaggggcactgaaaggggatgtatcgcgacttcaggccatctcgaagccggaaaccaacacaccggacacctttttaggttccatccagcgcaactcatagtagaagcgaaagagatcaagaaagggctctaccccaatgtaggcctcacaaagatgggagaaaatactgagaaaggcgatggaattggggttcaggtggagcaaagaaagaccatagatattcaagacgagaagaagaaactcggagggcggaggaagaaaaccacaaagaatatagtcctcaaccgcaaccatgcggcccaggacaggttcgggttcaatacctcctggttctctctccatggtcccgcgacaagggagagcgccgtcctcctgcagcttcttcatggacgcgctggtggaagtggacttgtcgagatcactgttagggttacggataaggtataccctctacccttggatatacatcatgtatcgatatggtatatctacgcatatacggacattctctgtacacgttaaggaaattcatcacggagtccacagatggaaggattcctactcggatagaacagggtcgtcactgtatcgtgtagggtccgatgtctccgagttctacttggagatcaacacgtggcctgggagatctgcttaactccagtgcaggtccaaagctcaccttcggatatgttagcgtgccagttgattcgatcctgtaatcaacaagaaatagaaacaaagaaatcgtggttaaatctataaatgatagccgatcggctagatgccaacggcatatcatttatctttgagccgatgtcatctgtgtatcgatcgacaatcatgaataagtaaagaagaactaaatctactcgatcggctatagatattaacgatatatactccttatatcgatgtatacttaaatcaagtgattgggatagatcggtcatcatgccgagacagtatgaatcacttagaccgaaatatatatcaataacaggactatatatgtttatagcatagccgatcagatagatctagcatgtatcggctaatactctgatactactctatatgggctgcagga

SEQ ID NO: 58742 - DNA, 1754 bp, Oryza sativa
ttatgcatatctgtatctggatcctacagaacaaacagataggatgagtagtatctgatgtaaatataatactcgagaaaaattcaagcattttaaaatatttataaatatgtatttcttctcttgtcaattttgatttccccgagcagatgactcattacgtttaaacactctgcccgactagtcatagccaccaagcaccgggagtcggcctaagcacttcccaaacatgcatatgagtgacatgagtttgtcattaatggaacaaagtttcacgggtcggagtttactactcgggtacttttgcaattattaagagcagaaaataaattatcttatctctatgtttttgatttattccgaataatacttagcaccttgcattattcggtccatccaacaagcccccggtgctaggaatcggcccaaaggcaactatccattggcaaaccaaacggaaagcataggaagatggaactccataactcgataggcatgtttgtactcagaataagtcgcaagcaatcaagataaatattatgaaaattgtttaaaaaatatggtataacatctgtagcccccgactcactagtcaacagcgaaccagttgatgtagtgaggcaaaggaaaaggcaaaatatcgtataaagaataaaatgaatgataacttagctttgtcatatttccttggtgacagcagaagtagccgatgtgggaatgaagcagtccatcaatggtgacaaaaacaccagtcggcgccagtggaaccaagccagtggtgtagatgatgaagcccattaacggcggcggagtccgccaaccgtataggcgaaaacaccagtcagtggcggcaaaggcaggccggcggtgaagtcgtagacgcccaacagtggcggcataataggccagccgtacaggcggaaacaccagtcggcggcggcaaaggccagccggtcggtgaagacgtggacgcccatgaacggtggtgtgaccaaccaaccgtataggtgaggacaccagtcggcagcgatggaggcaggccggcggtgaagtcgtagacgcccaacagcgacggcataatattccagccgtgcaggcagaaacaccagtcggcggcggcgaaggccacccggtcggtgaagacgtggacgcccatgaacggtggtgtgaccaaccaaccatataggtaaggaccaatcaacggcagatgaggcggcgttaaggcgagttgcccattagtcgtgctagagtcggccggatcgatctcttgcaatgaatccatcgcatatgcaaaaagaaagcaaacatatagatctctgttagtgagcaggaaaatatagatgctttatcatatactagaaaacatctatttaaagtatagcatgataaaaaaattttaatccacgcgtgttgattgaatcaacacatcgggcatgctttccagggagctgtaatgtcctggcctgagctttcctgtgcatggagtaggcatgcatggagagagcacatatatatccatattaaatcacatgcacgtagcagttggtcaaagcctggaagcatcagcatgtcgcatggttcccgtgaagacgtggctggcttacgacttggactcatgatgagtagacggagtgctttgtcttgcacggcagcagcttgttaggtagttagcgtccatcagagcaactcagccgccagtagtatatgcggacgtgcaaaagaagaattagaaaaacaatatcaatctgtgatta

SEQ ID NO: 58743 - DNA, 2445 bp, Oryza sativa
acatggagtagtacttatcttgctgtgctcctcttctgaagaaagactgaaggttgcagaacaccatgtgtttgccatttgccaaggtaaattgatggcaatgcttttcttgttgtacttgtttgattccttcccttgtgcagaatatatattgatagcagttggtatttttaatttttgtagatgtttgtaaacctgcaaagacagctatctatagagatcgagtcaccgagcaatagggatggcatagcagcaacagaagcacaaccgaatcagcagctagtaccaggtgaagtaaggggagaagagggccaagagggaaacccaactaaagccaccaggaaaaagaaatctccattgtgggatttctttgaagaatgcactgtgccatcaaagaagaagaaaggagaaatggaaaataaggtcaaatgtaaggcatgtgaaactctgctcaccaagaatagtagtggaactacaacacattggtggaggcatttagagcagtgtgattatcacaagcttcaacaaaaatccataaaacaacagaatatcaatttccctagccttgatgaaggtgatgttgatcttgatgctccttgtgtttctgtccctggttattatgatcctacaaagatacgtgagcttatttgcaaaatgatcattgttcatgagttgccattttgccttgtggagtatacatggtttaatgttttgctaaagaggttaaacccttcttacaaaaaggtctctagaaataccattagaagtgattgtataaggctttatgaatctgaaaaagaaaaactgaagaggactttcaaagatgttagaaagataagcctcacatgtgatctttggacctctaaccaaacaatttgctacatgagccttgttgcccactacatagatgctgattggtcaatgcattgtcgtgttattaactttcttgagttggagcctccacatactggtgtagttattgctaatgccatttctgattgtcttccttcatggagaattgaggacaagatagctagcatcacatttgacaatgcctcaagtaatgacagtgctgctaacctgttgcttgccaagtttacaaaacatggttcactttggttttatggaaaattccttcatatccgctgttgtgctcacattctgaacttaattgtccaagatggtctggctgtgattaagcatataattgacaaagttagggacactatcaagtacatcaagaaatcaaacaatcgagcatacaagttcagtgctgatattgattctctcaaccttaaaagtgacatgggtttggctattgattcctgcacaaggtggggctcaaccttcaaaatgctgcaatctgcatttttttataggtctgccttggatgtatatgctgcaggagatgcaaactataggtggctgccaacaccagaggaatggaatctatattgtgaagtcaatgatgccctttctgtcattcatgcagccactgaggagttctcaggttcaacctacccaacatctaaccttttttattctcacattgtcgatattaagagagtactaggtcagttgttgaagtccaaagacccaattcttaaagaaatggcaaatgcaatgcttgaaaaatttgagaagtactggggcccagaatgcaatactttgtttgcagttgctttggttctagacccaaggtttaagatgggtatgattaactacacattccctgctttgtatgaagaaactgtacttcctaagaaacttgcaaatgtggaatccacattgaaatctttgcatgcatcatatgaaagtgaactccagagcacatcaaaggaaaatgatgcaaccactcaatctactagtacatctctaggcactactagtagtcatttctctgctgctaaccaatttcatgagtatatgaaatcaaagaatgctgctagtcttcctaagtcagatttaaagaggtacttagatgatcctgttgaggatattcctgcaaaaagtttcaatctacttcagtggtggaggatgaatgaattaaagtatccaattgtggcaaagttggccaaggatattcttactattcccatcacctcagtctcatctgaatcagctttcagcacagggggtcgagtgattagtgtttatcgcagctctttactcccatcaacagtacaagctttggtgtgtacatctagttggattagaggaggccaccacaaaagcacagatttagtaagttcttatattttcatgtttctaaccaattaatagagatacacaatctaataatctgtgtttacttgtttgttgcatactaggaggatgatactaattctattatccttgtcccaaatcaagcttcaactgcaaattcggttgtgggcagcaattagactcgtttgtcaggtatatgtttgaggttatataaattat

SEQ ID NO: 58744 - DNA, 4264 bp, Oryza sativa
ataatatatcaaacaaaggtctaacatacttagatgcagtagtattttgatataagggcagatttaacatgtcaatagagcatatagaacaaatatagttaaatcagatacgatcggctgaaactctgatgctattctaatcggcaactagaaggcaggctagagattgatattctaagcacgacttaatagatcaaactcaactgatgcagcattaagtatgaaaagaagaacaatatctagacaatcaaaccgctagaagtctcatagaatggtagatatctcatataatctagatcaacatcaagatctaacctaatcggctgccttctgcatatagatgttagccgataataggttaggtggcgatattgctaaagattatgtaagatatatgataactcgacgaattatataaacaagattagagtatcataaagatggaagcactaatcctaagaacacaatccgtcataacgaattttacctcttgttgaagatcgaaattgatgcagctcaacccgaaagcaagaactcgtcgaaacaaaactaaagcaaaagggtggcgatgcgccaaaattgtattgaacgtgtgttgttaattacatagggctcggggtctatttatacccgagaattacaagatatgcccataccggacacgactattatctctaacaaactctaagataccataagtctttgcggcagacttttgcccacatttatctataaggaatttacataagatatcctaattaatagatacaattgccttcccaggactctatctatgcgtggcaatcatcttgaagtacattaacttgaacccgatatcgcgtacaagtcatattgtcgggatcggctacatcggcttacctagcccgactcagacccagccgatcttatcgtagccgatctggactccagccgattcctgctctgttttcaaactcgatctccgcttccgactttgcttcgatctaatcttctttcccaacgctgatgttaccaagtccgcaatatttggtaatgtttcggatttgctgtaaatcgactccgagcaagtttcgcactttaccgttttctgaccgttactgccgtgctttaaatactaaccgtcaccctcgagaaacctcacaccgtgacttctgttttctctttcttctccggcgactcctccggcgcaaaggcgatttctaggcgacttcctcctcgacgagatctccgcccgcaacaatgtcgtcttccgccagcccatctggtgcgccatcagccgaatatgctgaggtaagttctcatcggctaaatccccttctttagcagcagatcgatcttctcttatctcatattgctctcttcctctgaatctctttggatttgtagcacctctccaacctagttgcaattcccaacctgtcgcatgaaaaccactactttctcggcccagtcggcaatccagaccccgccgagttcactattggtgaaaccaataggatccccttcagattaaccaacccagatctaggtcactagaagaataccttcaagtcctggccgtctctagagaaagttccaccagaaaagagctggactacatggttcaaacgtgtatcagccggcaagagggtccactgggatgaaatcggaatcggccaagcacttgaccttactatagcaaagtcggccaaagatgaacccctgatgacagctgcttcttacttctggtcgaacaccattaaagcctttttgttcaatgaagggccgatgactccaactctcatagatatcagcatgatcacaggtctggatgtcaccttatcggccaaccctatgagtttgaacacaaagaaccaatatgacttcaagaccaaaagcataggaggttggtcaggctacgtaatggcatatatgggccagggctcggtcacccctcgggaacatgtgccttttttgttaatgtggctagaaaaatttcttttctgtggatcaagttgtggccccacaaccaactggcaatttctagctgaaactctagaaacaaagagacaattccccttgggcaaaattctcctcggctatctataccagatgttgaacaatgcatcggctaagatagccgtcggctcagtagttggagcaggtggaccctggtggctgctacaaacctggtcaaacctgctagttatgaaggttgtcaatcggccatccgtatcagaagctgagttcccaagactagagctgattgtaggagatgatggagaagagcgtactcatcggagatgcacatcatacggagaatatgcttctacaccaactgacactggggcaaaactatcggctgaactactcaaagattggttctgtagcttctatgaaggctttcaaaaaaatactcgagtttggtttctttatgaaaattctgcagaacttgaacacccattggacttcagattcgaagacatcaaccatgaagtataccaatcatccagggaaattttctcggctgcaatcagcccatgcatccttcctgttggcattcatcaaggaagaaacatccaagcttcttatgaattctatcatccaatgagctcaactagacaacttggaatgggccaactcccaattggcttattctttgccgacaaaatccaatgccgaggagaaatttcatcaaccctgatgatggatcggctgctcaaacttcaaggaccccctttgggcagtattaacaacatagaactgtcaacattcagaagcaaaaactttgacaggtggtggggcgaatggaagctgcatctattccaacaaccagcttcaatatatatgacagacctctttccagatgttgttcctcaagtaagtctttaactttgcttgatttcatttacatagttgtttggccgattaagctcaactaatcctccttttgatttgcagacaacagaatcctcccctcctcatcaaagcaacagtggcaaggacatccaatatgccccaggtttaattcctaacggaggtgggctatctcctccggttattggctatgatgcccccaagacctcagctcttcttcaagggctcatcagggaaccaaccgatgccggcaaaaagaggaaaaccagatcgtcggctgtaagcatcgcagctccaactaagaagaagaagaagacaaagaaaaccaagccagccgatgacctgcctaccctagatccatccattgaacaagctctggatgaagagataattgaagacgaagttgatcaggccgcagccgaagtaagcgatactaaaagaacaccatcggcttcgcctaagcaaacccctccaactccttttgctccggtccacttttcaagagtaagcaactttctttaattcctctcataattatttgtcttatagccgatcactcccaagttttataactgcaaaaaaagaagactgcggtgaagaagaaatcggctgcaacaacatctaaaccaactccaccagtaagatagttttaactttcattagttaattttcagctgattctgtctgacacttgtttcctttcagccttcccctcctcctgtacaacaatcgtcaagtgaccagaatgtcttagccgattgtggggtgtcatcacgtcgagaaagaagaacaaccagctgctcctgctatcccagtaagtttctttttgtctcaacaagcattcagatcggctatgactgtttctaactgcttctaaattgtcactgcaggtattagccgatcttttctcttttgacatcagagactatcttgatgaaggagaagaagataccacaagcaaagccttagcccctttatctgatgatgtgaagaaaactctaggaagtatcttgggtcggctagaagcatcatcgctagatagcttggtggttgattgtggctcaatcagggctcggctacatgagattcaggctctaatcccacatgagctagccgatatccttaccccagccgtttaccttgagcaacaccaattcaaattggagaaagccaagttaagactggcggaatggcgagagcgtaaggacattgaggccactatccaagccaaccgacaacttgtgtatgaagaaaaatccaagctcgatcaactatctgaaggcccaatcaagtctaatattgatcggctcgaggctcgcaagattgaactcttagcacaacttgaagaatgcaacgctgagctggacatggaacacaaaaaactagccgatctcccaaagtctattga

SEQ ID NO: 58745 - DNA, 1384 bp, Oryza sativa
ttcacattggcgtactgtcattgccaatagtggagtaaatattttgtgacagttgaaatttgaagtacgctgtgttagtagtataagtaatatttagatattagagcttttagatggaacatatgttgggaacttccggtgggctacttttgatgttaattgatgctctatgttctgtcaagtcattgacacatgatattgtaatgtttcttatggtgttatacacaccggtctattataaagtagtaatcctattatgacttatgcactactatgaatttgtaatctttctagtatatacctgtcgagaagctattatattctattatgaatttgtaatcctactttggcttgttaagaagcttttattgggagataagttcagattgctgaaggaaacagtcttaacgagcttctacgaatcgagctcgagtcgagccgagccttgatcgagctcgaactgagcctaccttcaagctcgaaggtaatgctgggctcggctcgagcctgtaccgagctcgagcttaggtaggtaagctcgctcgagctcggctcgttgacagccctaataaggaccattttacatataaagagcaactatatttgtctactatcaaactctctatgattgttgaagaaaaacaaataatgtcacatatgctccaaatctcattgaattcctttcacaccctagaattttgttccatccttaatgatgactatctctctcgtgacctgatcttctggtaaggggataactctcgttttgatcgagtgcgatgtttgcgatgtggttatcaactagaataagtccagaaccatgtgcaatcgctacaccacaaacgttgtcataccaaccgtgacgcacagctaatgatccctgcaatgcaaatgagagaacactgtaaggacaaaataagatgcaatctaaatattgtgaataggtaattaagcgcaaaggagtagtaacgattgaagtggtagatctaatcgacccgacaaatcaacacaccaattattgggagctctaaatttgtagtcgttggctaatcgagcgaggcctagagaaaaggtgaatggcgcttggcaaaattcaactaaataaaaatcaattgttctagagggtgtacatagacacttatagaggaaaatagatctagggttaagtgttggttcgtagagatggagggagacacttccgaaataggcctaatctattacaaggctcaaggcccaaatacagtttcagtaacaatactatcttgtttggacgttttccattgactcgggatgaaatttgatatgagaccagatgcatttgaaaggtgacgacataagctcccaacaagtccaaaatttctcaaatcggagttggaatgaaggc

SEQ ID NO: 58746 - DNA, 2287 bp, Oryza sativa
aggctatatcggccatccagcgatactaatcttaataatctttgtgtaataggacttagaatttttgtaatcggctaagacattctgatactttattgtcttaacaatcctttgtgccaattaatatgacttcaaaatttgctcaaaaattttgcactgcattttgatatatatgtgcccccctagttttacaatgtcaagagcattgataaaattataaaacaactaagggcgatataacaatatcggtcattgtacatcggcaaaccacaaccgattacaccatgaaaaacaactaagggcgatataacaatatcggccattatacatcggcaagccacaaccgatgacactatgaaaaacaactaagggcgatagaacaatgtcggccatcggaaggcgatgtaaacacatcggctgtcatgcatcggcaatataagtcgatcatgcattaatccaaacacttgggtaatatttcttcaaatatttgccattgagcgctcgcccataatcttcaccatcaagcccttgcaacatatatgctcccttagacacaaccttatgaatttggaatggtccttcccaattcagcgaccacttgccgaatttactatcacgagtaccaatcggcaaaatcagcttccatacaagttctccttccgaaaaatctttaggtaccactttcttattataatgccgagcaacacattccttatccttaataaccttcgcaagggctcgcaatcgtgactgaaccaaatcctccctcttatcagccataaggttgtaatactcatcggctgttaaatcgttttgcaactccgttcattgagagccatttctaacctcccatggcaaaacagcctcatgcccataaacaagtttgtaaggaggaacttgaatcgaaccatgacaagccatcctataagatcacaatgcttcggccaaccgagtatgccattgccgaggataatcaaaaattttctgcttaatcaatttgatcaaacttttattagacgcctcggcttgcccattagcttgtgcataataaggagaagaattcaacaacttgatacccacgctatcggcaaactgaacaaactcatcggacacgaagattcatccttgatccgtagtaataatttgaggaagaccaaatcagtagattatatgctcctgaacaaattaaatagcatccccataatcaactttcttcaaaggaatcgcctctacccacttggtgaaataatcagttgccaccaatataaatttatgtcctttactcgatgatgggtttatcataccgatcatatcaattccccaacctctgaacggccacggcttaataataggattcatagccgacgccggtgcttgctgaatagctgcgaacttctgacaatcctgacaccccttataatatctgaaacaatcttccagcattgtcggccaaaagtaccctgcacgccgaagcaaccacttcatcttgtgagccgattgatgagtaccacagatcccttcgtgaacttcgccaattgcaaccttagcctgatcggcactcaaccacttaagtaatactccatcaatcatccgataataaagctcatcatccaacagtgtatactttagtgccttatatcttaatttcctagaagccgattgagatggattactcaaatactgatgcacatcgtacctccaatcatcggctgacatcgctgcaatttcaactttaacatctttgatcattggcttataccccgatgccccttgagctaaatcattagcttcaagattttgttctcgagatacatgctttaaagtaaccagccgaaactctttcattagttccaggcacttctcgttataaaccatcaatgtatcgttcttgcattcatattctcctgccaattggctgattactagcaaagaatcgcccatgatttcaatggtatcggcttcaacttccttgagtaattgcaaccccttgagcactgcttcatactcagcttgattattggtcgcatatggtttaatagtataagcaaactcgaaacatgccctcctaggggaaattataactaagccgatgccacaaccatgagtacataccgatccgtcaaagaataaagtccatggcactatctcaaccgagccgattgaatcatcacgatgctctacattaaaatcggctatagcttgtccctaatcgctttcggtgattcataccgaagatcaaactcagtcaaggaaaatatccactttccaactcttccctttaatattg

SEQ ID NO: 58747 - DNA, 15331 bp, Oryza sativa
ccatttttgctaataaatgtcagccttggccgatcgcctggacctatgtctatttctcccaactcatcggccgacatgaaaccttgaccttgcttgtcatcgagatcatctactgtatccttagcatagacatttgaaccctccacgacgccctcaaagtaatagcttgggttctccatcttcgattggctgtatatcagaatcggacacttttagaaaatctccatcccagacttttccagataaacaatcaaggccatccatctcccaaagggctaaatcagcactggcaacattaactgacctgtcggctagcacgatctctatcttgtcgccttgccattgaatcaagcattgatgcatagtcgaagggatgcaacaattggcgtgaatccaatcccttccaagcaacaagctgtacgaacccttcccatcgatgacaaaaaacgtggtaggaatagtcttgctaccgactgtcagctccacattgagaacacctctggtttccgatggattaccaccaaagtcgttgagcaccatatttgtcttgatgagatcctcggcgttcctacccagcttcctgaacgtagcataaggcattaaattcaccgcggcccctccatcgaccatcatcttagacatcggcttcccattgacgtagccgtttatatacaacggtttaagatgccgattctctgtcccctcgggtttctcgaatactacatgttctggtgacagaaccaacttagtcgatccctcttccacttcatcgacatcggcctgatcgatcccgaattcggctggcaatgtaaagaccatgttaattggtgccgctacaacactcttcccttttgccaacctcttcgcctcatcggctgcagcatcatcggctataggaacctgattcttgacacgccactcctgtcttggctttggtttcctcagccgatgattgatttcctcttcaacctcctgaaaacgctccctattcctcaatctctggacccttcttttctgattcttcgtgaaaataccagaaggacaccattgattcttcttgatcacttcatcctcttggccacgatcttgattcaccggacccaaccattgataaacaggaagtcttgcctgtcttagccgattacccctattatacaatcggctcgagctctcgatgatatcactgcatctagggtagttttcgatagatggcaacctcatcccttcattccagcagaatctgaagaactcacaaccccaatggggatcaaaaccatcgtcgtattcttcataatgcccctcctgctgcttatcatacttcctttgatacttgttgataatcttagccgaatttacttgaaaaccctttgcacgggccctatcggctgcttgactagctgtatgcaccatattaacaggaaaatgattaccatcgaccttcatcggctttttggaatcaacaaacctaatctttcccccttcaatggcaacctggatttgttgtctaaaaaccttgcaatcgttagtagaatgagacccagaattatgccatttgcaatatctcttcttgcctaattcctcagccgatgggattgtatgaccagcaggaagcagaatctgcttttctcggtgtagtaaatcaaagatcttgtcagccttggtgatatcaaaatcatacttctcctcctttccaggactttttacccattggcatggtatgactttttttgctcctcacccattcggctgcagctatttcagaatcatcttcctcgtcatccgacccatacatgtatggacaaacatgattaactttcttagagcttttcctgacttccgccgacctatgctcatgcaaggttaccttctgtatcagatgcgataagctatcaaagtcttcggacgagaatttctcccttattggaggaatcataccctggaaggccaaatcggctaattgagcatcagtcaaactcaagctaaagcatttgttcctcatctccctgatcctctgaatatactcatgcacgggttcatcatgccgctgcttgatcgctgtcaagtcggacaacttcatctcatgaaccccactgtagaaatagctgtgaaattgcttatccaaatcggcccaactattaatcaacccatatggcaaagaagaaaccaagtaaaagttgatccagatagagataaccggaataacctaactttcaaagcgtctacagccgatgcttcaccgcactgagcaaggaatcggctgatgtgctcataagtcgacacgccctcttgtcccgaaaacttagagaaatctggaactttaaaccgattggggagagggactctttcaaaccactcaggataaggctgccgatacaagtttccattctcttttagtttaagcccaaattgttctctcattacatcagcaatcacatcggcccacggtcgttgctgagctgctccttgtggctgttgttgcataggctcgaactgaccatattgagatgcgaactggggctgagccaatccccctaattaatatggggcttgcggggaaggaggctgatattgatagctcaagttactgtcacaccctaaaaatcctaaatatataaattgttgtttaattggaattattagaatttattttaaaagtctagaagagaagatctaatttttaattaataaattccaatataaaatggggccagataaaatttcattaaatactttgcttaattctataattcctagatttttctgggatttatttgagctaaggaagtatttttaataaataaaattgcatttcatgaataatttaaattgaaaaaggtttttaaaaaagtctcttttggctttgggccgaaagtcggcccaaaaccttctctctctctttctcggcccaagccggcccagtccgcaaccgagccgctgctcttctctctctctcccgctgacaggtgggccccacctgtcagggtcgtcgtcaacctcgcgccgccgccgccgccgcccgaaccctagctgagccgtgccgccgtttccttccaaattcggccgcccctttccttctctggtgaaatccattgaggggaaatgtttcccgagatctcctctaccttttcctttttggaaacatcgtctaaatcgctttggaaattcgtggattcgagttcgattcggatcggcctctttcctccgaatcctaacctttccttcgcgtcgccggtcgtcgtgggccttcgccgccgccctctaacccctataaaaggacccccggtgtctccgctacccgtcgccacctttgcttttgtctctcgccgtcggtagcgctctagccccgtgtagcctcgcgccgccgtcgtcaccgttgctccagccgtgctccgccgtcgctccagtcgtcgctgtcgctcggggaggtcaccatcgtggtcgccgttgcatcgccgtcctcgtccgcccctccgccgttgctgtcgaccgccggaacaccgccgccgtcgtcaagccgaaggtcgccgccgcttcttcgtcgacgccgtcgccgtccgttgatcttccgccgccgttttggtcaccggtgagttcgccgcgtcgccctctacgtgctggtgccctccgttcgcatcgtcgctccgtcattcgccggcgagtttgcaagcccgagccgccgccggtggtgacgtcaccgctgacgtcatcgtcgtcgtctctcgtggtccggccgtggaccggtcgatctcggccgttcgttttggataagatcgatctcggccgtccgtttccgtgtaccgctgccgtgcgcccggtccaccgcaaaccctagccgctgacgcaataattcccttttccttttcaaaaataattcattattgcgtcataattcaattaaaattcatataagtgttttaatccgatttaatctttaaaaattcgtaactaattcatcttagctcggatttagttggttcaagtctctaaatttttctaaaattaagatctacatgttaaaaatatccacatgtactgttcatgcttgtttatgtgctgttttggtgattttgctcctttctgtttagattccgacgtttccggagagtctgttttcgcaggagaagattttgaagagttccaaggccagcaaggcaagtcacacagatcccaaacaaccctttgagcatgttgatcccgtttaaagctactgtttctattcaactattgcatttattttcgaatgtcattgggtggaattaacctattgtttgttatagccctttttgttcttgattactttattccttgataccttgggttattataatttgactagttaggctatatatattggttcagctagatattagatgtgattgcttagccatgcttagaaacattagcacactattgggataacttatgactcactattatttaatgatggctcaatgatagttcacgatggtcaatcgtgattggttaattaattacttgccaactaaaacttgataatcgtgggttgtgagcacatggttttgagagtcgtgctcatgacaattaaggaccggttcacgagtttcggttgtgaaacattaaccgtgccaaccacaagccagcgtgggcaacggctttaccttttgtatagcttggttcattgcggagcaccagactgagaagtggcagagataagcccacgggggtcgctggggagtccatgccttgtttataagggggtgattatgatccaggaaaggtgcgctgtggtggattgtgttgtgcaaggggtattgtcacagctcctttccgaggtaccgtggtggtattgaggcacatggtgacatgttgtggggctgtgtcttgtgggtacagtggtacacctctggccagagtaaaactattcgaatagccatgcccgcggttatgggcgggtctaacaatgtctttcgtgattagtctcacacctctcatcatgataaaagatgtataactggtaataatttgtttagctcctggtttggaatggtatattcctggtttggagatagatctgtacagccgggtatggttgttcagaaaggttgggcctatacaacagggtatgttgtatagcgttggattaatattgtttaattattacttaactgttttattaaattctgaaatgtttattaaatgctgtttatgcaaatgaaaccctattatgccatcctttggtatcctgtgcacttgcatatttgctgcgtgacttgctgagtatgtcatatactcaccttgcaatcattcatcagaggaagagttctacaatgatgctgatggtgtggaggattaggtgtagccctggtcaagctgcctgtggagtggagccgtctgcgccgtttatcttattttccgctgcttagatctttattgattgagaggaactatctacctctgtaatgacattttattcacttattaattagagtaataattgtactctattatcaatttgttattgtgtgcctcggctgattcctagacgagggttcacacacatgtaagcgtttggaattttggatagaaattccgggcgtgacaagttggtatcagagccaggttgaccctaggttatgccaaatggttacccatagaagccctctaaaaatattggaaaagtagaagtgttctcctccccttctcttctaattaaaccaaactaatagcacatgcacttcataatctcttttaatggttctcattcaaaatttattccagtgttattagtaccgtacatctattactgtactaatggcttatttactagcaaaagttttacaatattgttttatttaatcttgctgtaattaaataaatttagcatgttttcgtttatttcttttgaaaccggttgttcaaaagtacaaaatttgtgacctcgtttccaactgtttcaacttatcttgcaagcttggtttactttatttacttaccttttactttgattttctaactttattcaaattaaaaacttgtgctattaattagatagatgtcttaactccctcctttcacttgtctttagatgccgcgctacaagcctgagtacttgtttggtgttgagggatttgtccaggagttgcgtacgatgtcctttgccataggatttgggactgcccttttttatgcccagattcctcatgatcgtcacgaagagaagtgccgagtcaaagtcaccttgaacagtaatagtgaagatatcccctcagtgatgttcgaagctggaggaagaaactacatccatgcatgtcaggaggtggcaaggatcgccataggagagctccgcaatcgctacagtgatcggttggccgacactgagtatcactaccatcctcgtcaaccacagggaagtgaccgtggcagctaccttgagactgaaggaattgagaatgatgctaccacaaggcatttggttgagatgctgtgggctatgatgaaacccgtgcagagactgtgttagcagctcaagatcgtgaagaccggaatcgtggtaagatttgcaagctagaggacaaggtggatcgtttggagaaggaactagccatgttgaagggagaagcaccaccgcagaaggccagggttcgttttaccgcaaggaagagagctctatttgtccctcgctaccaattggcgccaaaggtccgtgtggtggagaaagaagttaccccagccctagcggatcctccggtcgtcaacgtaagtgatgatgaaggagaagaatccaagcgcacccattccaagatcgagtggggagccactcaagatgatgaagacgagccgaacgagccttcaatcaactccgatgctcggaagacctagaatgccttgtcaaaccgttgacttagatcgttgtgttagtttgcttgttttaagtttggttgtgtgtgtgggtcttgcgtgtgatttacatcagtggtgggatgtaagtgcatgcgtttgtttgctttcgagtgttaggtagttggtgagtttagtggtgtgagagtcttcagttttgtaataatgaaactcacttaagatcaataaaagtcaaattaatttgctgtcctaagtagttttccccggtttctcttcttgtgcttctgcccatgccagatggtgctcactcgcagcaacgggaatggccccaacaacaacaacaacaacaacaatggagagaatcccacacttgcccaagtcctggctcaacaggcacagcttatgaacatgatgatgcagcaactccagaaccagcagaaccagggaaataaccatgcacctccccagaacaagttagcagaatttcttcgtgtgaggccgcccactttctctagtaccactaatcctgttgaagctggtgattggctgcatgccatagaaaagaagttggatttgcttcagtgcaccgatcaggagaaggtctcatttgcatcacatcagttgcatggccctgcctctgaatggtgggatcacttccgccttaacaggacaactgctgaacctatcacttggcttgaattcaccgctgctttccggaagacgcatataccatcgggagtggtgtctctcaaaaagaaggaattcaggtcgctcactcaggggtctcgctctgttaccgagtatctgcacgagttcaatcgtctggctcgttatgctccggaagatgtgcgcactgatgaagagcgtcaggagaagttcttggaaggacttaatgatgagctttcttacccactcatgactggggaacagaagaaatgccggattgctcacttcaaggcacaacaggggaatagtcagaggccgcgtcttaccttaggaccctagaccatgccacagggaggttcttcgtctgttgttcgtccgcagcgtcagttcttcaacaacaatgctggcaacaacatccgcaatcaagctccacgccctattgcagcttcgacaccgcaacaacctgccaagagggagcaaggcagcaagcccggggtgtgcttcaattgtggagacccaggacattacgctgacaagtgtccgaagccccgacgtgtgaaggttgtccctgaccagagcaactctaccgtaccagcatcaaaggcccgtgtcaatcatgttgttgctgcagaagctcaagatgctccagatgtgattttgggtacgtttcttgttaacttagttcctgcaacagtgcttttcgattctggtgctacacattcattcttatctatgagttttgcgagaaatcatgggatggaagtagaagatcttagacgtcctttgatggttagtaccccaagtaatcaggcactctctttgcaacgtagcccctctgtcagaatagaaattcaaggagtaccatttctggccaatcttatcctgttagaatccaaagaccttgatgtcatcctagggatggactggttagccagacataaaggtgtgatagactgtgctaacagaaaagtaactctcaccagcaatgatggtcgagttgtaactgttcatgcattgtcttctgagtctttgagatcaaaactgaaccaaataactttggaagagattcctatagtccgggagtatcccgttgtgttcccagacgatttacctggtatgccgcctaaaagggatatagagttcagaatagatttggtaccaggaacaactccgatccataagagaccttatagaatggcagccaatgaattagcaaaagtcaagagacaagtagacgatttgcttcagaaaggatacatcagaccgagttcatctccgtggggagctccggttatttttgtagaaaagaaagatcatacccagaggatgtgtgtggactatcgtgcactaaatgatgtgactatcaagaataagtatccgctgcccagaattgatgatttgtttgatcagcttaaaggtgccaccgttttctccaagatagatcttcgatcagggtatcatcagttgagaatctgtcacgaccggaaataacccaacgggcgttccttacgtgcgtgcattattccttgtcccaggaggcaaggtacaccaagagttgatacagttcagagttcaacaagcggaagcgtaaatagttaatttactacatgggcggcgaaggcccagcacacacaaagacaaacgggaaacagcggaagactagggcgacgaccacaggcgcttgacggcaggcacgagctagacaccaaagccttcatcttctagggactcctcttctgggtttgggaaaaattgagcaagactgagtacaaccaccgtactcaacaagacacacccacaagtgcagaataaatgcagggaagtacaagggggttataatataaagggttagggtttgcagtaaacagcattaaaagacacttagttgctcgaagctattttgtaaacacaattctagagctatacaatattattaatcaaggccgtggacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggtgcggctattcgaatagattatactctgatcagaggtgtatatctttacccacaagacacatcttcctcacgtgtaaccacgtgccgcataccaccacggtatacggacggaagacgtgacatagtttccaacccatcctagccatagacaagagtaccgacccaaccccacctacggccggaacctccgggacaggtaggcaggattgagcccctagcagcaggacaccggccctgtgccatgacatctcgactactgggccgcagctcgtgtagccttcaattgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggaggtgtgaatccaattccacaataatccaacaattccctagtgtccaggtgataagagtattcccaaggtctagagttgtaaaaccacctaatgttgcctaattaaccagcgaagcatctacctaaaatcatactagtggtaccatgagtagagtgtccactagttggggttttgtttaatctagggtgaacaaggtaataataacaataataataataataaggtcataacaaaggtaaataggcatggctaaataaaacagtgataacgcgggaatttaaataaagcggtaatgcaataatttaaatcaaaataattttataaactgggattcaatatgtttcaggatgatgtgacttgccttgctcgctttcccaagcgtcggcttcaacctccgcgaagagacttcccctcccctcggcttcaacaaaaatgggttcttgacttcttaaggaaaaattagagacttgaacggtccaattccgagttcaaatggccaagttatggtcatttgaagtttatatgctctttaaatgaatatttgcgaatttcttcatttaaattttaatttaaaaagggtttattgcatcagccgaggggagggggcgcgcggaccgggtccacgggagtggggcccacgcggcagcctcacggtccacggtggaccgggtgcacccggctcacaccggccggcgccgtgggccccacccgtcagccacacccgagggcgcgggcggctgacggccgagccccacgcggcagccactcggcgcgcccgagggcggccaagccggcgcagccggcgggaggcggcgcgcctgtgccccgatggtcgccgccggctaccaccagcgcgacggagcggcgcccgagagaggggagggaaagggggaaacgaagcggcggtccacggctcaccccgggtcgacggcgacgatggaaacggcgaccggagcggaggaaggcggtggcgcggctcgggtcgacggggtcgacggcgttccggcggtcggcgagcgaaacagaggggtggacgaggtcggtgaggatgcggcgaagccgaaggaggcggcgtcgaggtgggaggtggtccggggcgacaacggcggcggaccggagctcggcagcgacggcggagagagagagcgacggcgcgagctcgattccggcggggagagagggcggcgagtggcggaaacggtggtggggagctcggggagggtttatatagggttgggagtgagagagggtggccggaggagggggaaatgggcgcgggagacccggccgccattaatggcgccggcgaggttaggggaacggtttccaaacgaatccgagggagagagggagggaaaaatggggggaaagggggagggaatcacggggaataattccccccactttatttcgcgcggggacggcgggaggcggcgggattcgcggcggcggcggcggcgctagggcgcgggcgaggcggcgggagcggcgggaggaaggggatgacgggtgggccccacccgtcagcgagggtggcgggtgggcccgcccgtcagcggcgcgcgcgcggggagaggccggatgggccgcggggagaggagagggagggggaaggagatgggccgagccggcccaagagggagagggagggaaaggggactttttagagtttttcttttttataatatcattttaactttgtttatttcttaataattattatttgtgctctgaaaattccactaaaatttatttacgcattttaggcttttaactttgcacattttaattgttggaggctttcacatggattttaattattctaggcaccatttagaggatatattttagggtcgttttgggacgtgacagaatcaaagaggaagatatacctaagacagcttttaccactaggtatggattgttcgaatgtactgttatgtcttttggacttaccaatgcccccgctttcttcatgaacttgatgaataaggtgtttatggaatacctagacaacttcgtggtagtctttattgatgacattcttatctactcccgaaccaaagaagagcatgaagaacatcttcgccttgcactagagaagctacgagaacatcaattgtatgctaagtttagcaagtgtgaattttggttgtctgaagtgaagttccttggtcacgtcatctcagcaggaggagttgccgtcgatcctagtaatgtggaatccgtaaccaactggaaacaaccaaagacagtttcagagattcgccgtttcctaggcctcgcaggatattatcggaggtttatagagaatttttccaagattgctaagcccatgacacgactgcttcagaaagatgtgaagtacaagtggtcagaagaatgtgagcagagttttcaagagttgaagaatcgcttaatatcagctcctattttgattttacctgatccaaagaagggtttccaagtgtattgcgatgcatccaaacttgggttaggttgtgttctgatgcaagatgggaaggtggttgcctatgcatctcgtcagttacgtccgcatgagaagaactaccctactcatgatcttgagttagctgcagtggttcatgcgttgaaaatttgacgtcattatcttttcggtactcgtacagaggtgtacaccgatcacaagagtttaaagtatatctttactcagccggacctgaacatgagacaacggagatggttggaattaattaaggattatgacatgggaattcattatcacccgggaaaggctaatgctgtagcagacgctcttagcaggaaaggctattgcaatgctacgaaaggacgacagttgccattggaattatgtaaggactttgaaagattaaatttgggaattgtcagtagaggtttcgttgcagccttagaagcgaagcccactctaattgatcaagttagagaagcccaaattaatgatcctgatattcaagaaaccaagaagaatatgagaagaggaaaagctatcggtttcttggaagatgagcagggaactgtatggttgggcgaaagaatctgcatccccaacaacaaagatttaaaagatgtaattctgaaagaagcccatgatactttatactccattcaccctggtagtaccaagatgtaccaggatctcaaggaaagattttggtgggcaagtatgaagcgtgaaatcacagaatacgtagcagtatgtgatgtttgtcagcgagttaaggcagaacatcagaaacccgccggtttgttgcagcctttgaagattcctgaatggaagtgggaagaaatcggtacggatttcatcactggtctacccagaaggtcatcaggccatgactctatttgggtgatagtcgacagacttaccaaagtggctcatttcatcccagtaaagacaacctattccggaagtcggttggcggaattgtatatggcaaggattgtgtgtttgcatggcgtccctaagaaaatagtgtctgatcgaggcagtcagtttacttcaaatttttggaagaagcttcaggaagagatgggttctaagctgaactttagtactgcttatcatccgcagacagacggacaaaccgaaagggtgaatcagattttggaagatatgttgagagcttgtgctttagacttcggtggaagttgggataagaatctaccttatgcagaattttcatacaacaacagttatcaagctagtcttcagatggctccttacgaagcactgtatggtcggaagtgccgcactccgcttttgcgggatcaaacgggagaacgtcaggttttcgggacggatatcctaagggaagcaaaagagaaggtaaagatcattcaagaaaggttgcgtgtggctcagtctcgccataagagttatgccgacaatcgtcgcagagatttgagttttgacgaaggagattatgtgtaccttcgtgtcacgcctcttcgagaagttcatcgttttcacaccaaaggaaaattggcaccgcgttttgtgggaccttataagattgtcagtagaagaggagaggttgcttatcagttggaattacctcaatttttggcaggagtccataatgtgttccatgtgtcgcaattgaaaaagtgtttaagcgtacctaccgaagaagctaatcttgaacagatagaagtccaagaggatcttacctatgttgagaaaccaatccgtatcttggaaatagatgagagaagaaccagaaatcgagttatccgtttttgcaaagtccaatggagtaatcactcggaagaagaatcaacttgggaacgagaagatgaattgaagtcagctcatccgcatctgttcgccagttcttccgaatctcgaggacgagattctgtttaagggggctaggtttgtcacaccctaaaagtcctaaatatataaattgttgtttaattggaattattagaatttattttaaaagtctagaagagaagatctaatttttaattaataaattccaatataaaatggggccagataaaatttcattaaatactttgcttaattctataattcctagatttttctgggatttatttgagctaaggaagtatttttaataaataaaattgcatttcatgaataatttaaattgaaaaaggtttttaaaaaagtctcttttggctttgggccgaaagtcggcccaaaaccttctctctctctttctcggcccaagccggcccagtccgcaaccgagccgccgctcttctctctctctctcccgctgacaggtgggccccacctgtcagggtcgtcgtcaacctcgcgccgccgccgccgccgcccgaaccctagccgagccgtgccgccgtttccttccaaattcggccgcccctttccttctccggtgaaatcaattgaggggaaatgtttcccgagatctcctctaccttttcccttttggaaacatcgtctaaatcgctttggaaattcgtggattcgagttcgattcggatcggcctctttcctccgaatcctaacctatccttcgcgtcgccggtcaccgtgggccttcaccgccgccctccaacccctataaaaggacccccggtgtctccgctacccgtcgccacctttgctttcgtctctcgccgtcggtagcgctctagccccgtgtagcctcgcgac

SEQ ID NO: 58748 - DNA, 1173 bp, Oryza sativa
ttatatatgctaagtctcacactcttatattgaatctctgacagtctgatatttactctctaatactctcatattagaattgtgatagtcatatatatatatatgcagagtctaatactcttatataaaatggctgctactctcatataaaaattgtgatagtcatttatatatgctaagtctcacactcgtatattaaatctctcacactctcatatttaatctctcatactctcatattagaattgtaatagtcacatatatatatgctgagtctaataatcttatattaaatggctacaaatgtcatattaaaattgtaataatcatttatatatgctaagtctaacactcttatattaaatctctaacactcttatatttaatccctaatactcttatataagaattgtgatagtcatatatatatatatatatatatatatatatatatatatatatatatatatatatatatatatatatatatatatatgctaagtctaataatcttatattaaatggctactaatctcatattaaaattgtaataatcatttatatatgctaagtctaacaatcttatattgaatctctaacaatcttatatttaatctctaataatcttatattagaattgtaatagtcatatatatatatgctaagtctaataatcttatattaaatggctactaatctcatattaaaattgtaataatcatttatatatatgaagactaacaatcttatattaaatctctaacaatcacttatttacatcacttgcctgcgcgaattccttcgatggctagctaccacttcggcttgagggacgacgccgacgtcttctttgcaacattaccaggaaaatgtattagtctaaacgggccaaattacatatataatcatatatgtattaccagtaaatcgtataagtagaaacgcgtttgttctaacacttttagtacaagtgcattcacgttcgtaagcatttcgtgcaagttcgttcgtgtttcgtaatcgtatcgttcacgttcgttcgcgttcgtccgcgttcgttaacgtttcgtgcatgttcgttcgcgttcgttaacgtttcgtgcacgttcgttcgcgttcgttaacgtttcattatgttcgttcgcgttcgttaacgtttcgtaatcgtatcgt

SEQ ID NO: 58749 - DNA, 11328 bp, Oryza sativa
  unsure (1)..(11328): unsure at all n locations
aaagatatctttactcccggttgttctcaccaaccgggactaaagatcttttcccgctatttccaaattctttttaaacccggttagggttaggaaccgggagtaaagataatagcagttctacatatgtgtttctataatagtaaataatgtattaaaattatttaaattcgaacaattaatgataaaaccttcgaaaaattattgttgtatgtagtagaatacgtggataatatataataagcacatgaatgatttaaaattgttaaaaattctaattaacatatgtaaatagcacatgcatgatttaaaattaatacaaaatctaatatcatatataactagcatatcatgatattaaattgttaaaaattctaattaacatatgtaaataccacatgcatgatttaaaacctttagaaattctaataatcatatatatgtagcatatggatgatttcaatttgactaaaattctaataatcatacataattaacaaaaaatctaataaccatatataactagcatatggatgatttcaatttgataaaaattctaataatcatacatattttacatatgccatacaacaattgattagtatagatattcggtacatccaacgtagtttacatcgtgtacagaacaattacggcaatacatcggcggtgacgggtgaccggacgtactttctcctcactattgttccttccttgtgatcgctacgtgagtaaggggtgtcttcatttgataggaggatgctagggtcaattgtcatcgtgaaagggggttgcccatcaaactaatcgtaatcctagttagtcttgtcctctactccgacgatttttttttttcccgggagaaccacgtggcgcttcgactcgtcagtcactttgcccttttttcctttgctagacatgttcttgatgtaaaaaacttgggttacatcattggcaaggacaaaaggttcgtccgagtatccaaccttgttaaggtcaaccgttgtcatcccactgtcatcaatcgttacgcctccaccagtcaacctaacccattggcaccggaacagagggaccttgagaggtccatagtcaagttcccatatgtcctcgatggcaccgtaatacgtgtcagtcgtaccatcgtgtcccatggcatcgatacgaacagcactgttctggttcgtgctcttcatgtcttgggccctcgtgtagaatgtgtacccattgatttcatatccctggaatgtcgcgatcgagctagatggtcccctcgccaggaaggccagttgttggttaatcgtctcgttacccatgagatgttgtcgcagccacgtggagaaagtatcaatgtgatgccttgtaatccatgcatcggacttaccgatgtttttggcgcgaattagagccaagtgctcttcgatgtagggagccaccaatgaagattgttgcagaaccgtgaaatgggctttacggaataaattgttgtctaccgtcattattgctttccttccaaaagtcccctttccccgtagtctcccttcatggcgtgattcaggtaccccgattgggcgaagggcttcgataaattctacgcagaattcaatgacctcctatgttccataccccttggcaatgcttgcctctggacgagcacggttacgaacatacttcttcagaacgcccatgtacctctcgaaaggaaacatgttgtgtaggtacacaggaccgataataccgatcactttgacaaggtgacaaagcagatgcatcattatattgaaaaagaaggtggaaatatcaactcaaagctgacaagacattgcaccacatcattctgcagggcttctaatctatcaggatcgatgaccttctgcgaaattgtgttcatgaaagcacatagctttgttattgttgcccggacattatctgggaggataccccttattacaactggtagcagctgtgtcatcaacacgtgatagtcatgagactttagatttgtgaacttcttctccttcgtgcttattattcgctttatattcgtggagtatccagacggtaccttgatgctctccaagcattcaaacatacttcccttctctgccttgctaagagtgtagctggctggactcaagtaatggcttcctttctcctttggttccgggtgaaggtcaccgcgttgttccatatgcttcagatcattacgtgcttctagtgtatctttcgacttttcatatacacctaggaagccaagaaggtttacacaaagattcttagtgaggtgcatcacgtcgattgcgtggcggacgtccaagaattcccaatagggtaactcccaaaatatagagttcttttttcacatcgccgcgtgaccatcttcgctctctataggctggctgccaggcccctttccaaacactactttaagatctttaactatagcaaacactgttttcccgctgcgatgtttaggcttcgtacggtggtccgccttatgttcaaagtgcttgcctttcttccgtaccaggtggtttgctgcaaggaatcgaagatgacccatgtacacaaccttcctacagtgtttaagatacgtactttctgtttcatccatacagtgagtgcaagccttgtaccccttgttggactgcccggataggttgctaagtgcaggccaatcgttgatggttacgaacagcagcgctcgtaggttaaactcctcctatttgtcctcatcccacacggagacaccttccttcttccacaacagtttaaaatcttcgaccagtggtcttaggtacacatcgatgtcgttaccaggttgcttggggccttgaattataatcggcatcattatgtacttcctcttcatgcatagccatggggggaggttgtagatacacatcgtaacgggccaagtgctatggccgctgctcatctctccaaaaggattcatgccatccgtacttaaaccaaaccgtatgtttcgtgcgtcctttccaaagtctttaaattttctgtcgatgtttcgccactgcgaaccatcggcggggtgtctcagcatcccgtcctgttgacgctcttcagcgtgccaccgcatcattctagcgttccccttgttcttgaacaaacaccttagccgtggtattatagggaaataccacatcaccttagcaggaattctcttcttcgttagctgcctgtcaacttctcctgtatcatctcgtctaatcttgtatcgtagcgctttgcaaacagggcatgcttctaggttctcgcactcctcaccgcgatataggatacaatcattcggacatgcgtgaatcttctgaacttccagtcctagagggcacactatcttcttagcctcgtatgttgtctcgggcaacttgtttccctccggaagaatgttcttgacgagtttcaataaatcgccaaatgccttgtcactaacaccatttttttccttccattgcaagaactccagagtggtatccaactttttgtgcccctgctcgcaacctgggtacaacaacgttctgtggtcctctaacatcttgtccaatttatgggcccccttttcactttcgtaatcctccttggcgtcctgcaacatctgaccaagatcatccgcaacgttgttaccatcagcatccctttcctcctcgcccgtttgatttccttcaaatccagcgtactgagcaaagtccggaatattgtcgtcttccacttcatcttcttccatttcaacaccttactctccgtgggatgtccaacaattatagcttggcatgaaccccgactcaaacaagtgaaaatgaatagtcctggatgcagaatactccttctgattcttacacttattgcatggacaacaaataaaacccttttgcctgttagcttcggccactctcaaaaaataatgcacgccgtcaataaactctttggaccaccggtcagcgtacatccattgccgatccatctacatgacatgaaaaaaaatcgtacacacataattattcgtacaataatgacagtcatacaataattataaaataattacaaactctttcaacagtcacacaataatgacatatcattattcatacaaatattatgaaacattacaccgaataattatatatttactatttataaagttttaaactaatattaatgtgttgtacttattttaatttttcattttactttgttttctattattcaagattaactttcactatattttccttctcaacttttttataaaacattctttaccaaataaactaaatttctatatattctttcttctccacacaaattttctctctcatcaactaacaacaaaattttggagacaaaaaagtgtgcaaaacatagctccaaatgtaatatgaaaaaaaaatattggaggatgaagttgctaaccttttaggcacctccgatttgtatataatcaacacaataaattcactagaaattttggcatgacctcccctcttttttgaagaaattttgaagcttgctcgggctggaggaggaagaagacatatatataggggtgggactttagtcccggttggtgttaggaaccggggctaaagatcgccgggatctttattcccggttggtaacaccaaccgggactaaagttatgatctttagtcccggttggtgttattaaccgggactaaagatcccgggggggctgacaggccctgacagcatttgaaccgggacgtgttaccaaccgggactaaagatcaaatatgtctgttaccctttttaaccgggactaaagatcatctttagtcccggtttttgttgcaaccgggactattgtggaattagcccgaccgacgaaagatggtttctccaccagtgatgatagacatagttgtatctctaatattgaaaacagcctaaaacgagtagaggcggtacatcataattaccttttggtgttattttctcttacagctctatatgtttgcagaaaaacttacagaaaataacatttctgggtaaacagcatgaaccgacacttagttgagaatgggtggcgataggaatacataccaaaaaaagatgtggctcgaggttagttacagaagagaacttagggcgtcatttgctgccctccatagctaaaaactactcgagaggaccggaaggatgcatcatgcatggttgaagaactctcttgtgttgctttcaagttgcaacggtggggatgggtggggatggatcatcctgttcagtcacacatacattcatttcgttgtaatgggcgtgttttcatggggcagccctcactttttgcttgcatgaagtaccgacgctgtagcaagctgcaccgaacatatgcccaataggattatttaccgtcttttctcattaatattttcttcgactttatgcttctttgccgagtttgatcaatctatgtgcacaatgagctatacccaaatactgtcaaacagagcggcggggttgcaaaaaaaataaaacctttatttagtaccacaccaaattatatatttgcgacttacatatttaactttttccccacacgttaattataaattatatatgtacacaaaatgaatagccagctgctatatgtaaggtatactatcagtatttctttatgtgctgtctttggctactcctaaagggaacacagaagaaagaaagctaaagctgggccaaagcttagccaatattactgcatactcgtgagtcgtgaccgcacacaagttaattaatggacatatttgtgctgttctccttttttagattttttattttttatgagtgaatttaggagaattaatttcttagctttttgcttggcagagaatgggtggcaccaggaataatcttatcatgttggcatctcaaaaaatggcaacagtacagaacgtaccaacaaaatagtcctgtgtacgtcctacatcaaaattatagcaacaagagagtacggtgtagcaaaaacacagttgtgatattaccccttatggctatagggatcttatatatcccttcatactacataaagttatcacccactaactgtaattatgatcctaaagctcaaatatcaatgctccacatcatcgtcaattctcagccgttggataagtagattagatcggctctaaaccgttggatggaaaaccgcagcatatgatcagattaaacacaacccaacccatctcacacacagccaccatgtgagacccatgtatagcttcgaccacgggaagcccatctcattccatcgcagcccaatttaatagtgagggatatagggttcagtggggtctctgttggaaatttggtcataattcggcatatttttatccaaaatattaagaaaataaacatggcatttgcaatttgagtatatctagtgacagtggtggatgtaaataacttgagcatgcttaatataaaataagcatcaacatagatatgagaacgcaataacattgcgcctgacagtaacaggaaacgaagaatgaacagtaacagtaaaggattgtggcagtattgtctccgttggtattgacgggaacctccttctccttatctctagtgttgttgttgtctccggtgttcaacatgttgatgcagaggaagaacaagagcaggcgaagacgaacaagaacgaacagtaggagcagtcgcgcgcgtagcgctccccaaaaacttgatcgcccgcctacccgtgcaggttctcaagcggacggagttttggaagcatgtacacctgtgcatgcaggtgaacggaaccggagaagcagtagcagcacaagaacaaaggagtaggaggaacctgaagtgcaagagtctgcgggaagaactgatgaactgccatccctctgcggagtttgtatatgagcgagagtaacgttcggatctgtttaattccgtaaccaacgcgctcatgttaacagtgaaatttagtaagcccctaagagaattatcacgtcgccaatagccggattcctgctatattcggttaaggaaattaatatgttaaaaggaatcttatctacaagtgatcgagttcaaggaggatgcggcatggcagtttatctattaattaggcagtatttgttagtttcgttttatctttaggaaagtgtgtttagtgtcctataaggactttatgttctcatttttatcttttaggaaagtttatttcttatcctacgaggactagtatctccacatgggtataaatatgtatatccgtggtcattgtaaaatatatccacgatcaatacaattcggcgcatcgccaccttttaccttttctacctttttatttatcatccggcgggacttagcacctgacgcggggctgcatcggcgttcgatctccggcgaaggggtaagtccaatgttccgttggtccaagcaattgtctcatctacgtcggcatcgttcagggctacatcagtacattcgacctcttggattgctccgatttggatgatatatgtgtctgcctatttatcatatgtcttagttaatttagtcttagtatctcaatttagctctatcggttgtctctcgctttaaggtttctaccggtatcggctaaattgttttactagattagattagccaaggcatctaccaccctaaaaatcagtcaacggcttgattctctagatattgtgtttctttttatacttagtgccgcatcaattaagtttgatctactaagttgtgtttagaccataatccctagcctgctttctgacagccaataagggtttcatcggggtttcagctaatgaggtatctagacgttgcattggcttacaaggattgcatataagttggatttagccgatggtaacaaagatttcaccgtttaatctaatatgtggattttatgacatcggacctccagccgatgtattctttaaccttcagatcaatacttgttctatcatatcattgttagccgattggtttctacttgattatattgctattttattacatcagtatcagccgagcgattgcctctatattgttatttacatcatgtcagaatctacattggatgtatagccgatagctcaaaaccctatcgatatcggctggactacttcatcggcttgtcagtcgatcggctcgatcagctcactggtcttgtcagttgtaggatcaaactgactggcacgcccgcacctcaccaagatttggacctgcactggagctaagcagatctcccaggccagtgtgtatttttcgcatcaacagctcgttaacacgaaatcaatccacggcgatctctgtgtttattgccgtccgttataaaacgagcgagagatagatagatagatagatagatagatagatagatagagagagagagagcagccgccgcctgccttgcctcgccctcatcggctcggctcgcgcgcgcatgtggctatccgctcaccatctcaaccggttaatagagattctccactatctccatatttaagttgaaacctcttcacttagaattccaagatagtattattacccatagcactaatgtgggccaatgaaatttattaggatttgattgggcctagcccattaatgtaacaatccccatcaaatttcatggctcacaggaaatgctcttgattctgatcctgtttgttataccagtgtttcggtggagacagttaagttgaacttccacctaggagaaattctgatcatgtttgttataccagtgaagaagcagtagcagcgcaggaatagaggagtaggaggaacccgaagtgaaagagtctacgggaagaactgatgaactgccatccctctgcagagtttgtatgcgagcaagtgcaagagtctacggcggagtttgtatgcgtgcaagtgcaagagtctacgggaataactgatgaactgccatccctctgcggagttacaaaacaagagagagccgccgccttgccacgccaagtcggcccggctcggcgcgctcgcgcgcgcttatggctgatcgcccaccatctcaaccggtcaacagagactctccactagctccatatttaagttgagacatcttcccttagaattccaaaatggtattagtacccatagcatttaatatgtgctaatggaatttattaggattattgggcctagcccattaatctaacagtctcctcctcccgagtcagagtggcagcggcggttggttctctcggtctctccatcggcggtaggcggggccgtagcgcgcaccacgcgtggtgcagcgctggctaagggtagcgcacaactcgtggctagctctggagcgccgctcatccgttcaggagacagctcggttgcgggagggtttgagcgcgcgcgctatggcgagccctggagcgacgcgccaatggagagacacgtggatgtttgtttctttctcggcgcagatccgtggaatgcctaatgttgagccacctatcaagccatcatgcagttcatgatggattgcaagttatggtctagactcatgaccaggccggtgaggtactttgtataaaagtttataataaagttggggggaaaactctaagaactgtttcaacaactagatcaaaagacgtttacacgaccgctatattcatattttctaaaaaaaccttgaaaacccatgatatattannggnnnnnnnnaaggggaggnnagaagtgatgggnnnnaagatgtgaatagtggagaattccngcccccttnnnnnnnnnnnaaaannatcaggannaaccnnncaattatgctatttcaaggcataagacttgactccgacatagttatgttgtgcctccattctattatggatgactttattcaatttggaacctaataatgattgagtagtgttttgctgttagccatggttctgtccaagcacttctggttgagatatcaaagagagaaacgatatgcaaataatgtgaaaagttttcgatctacggatgtttgcttagggatgttgcaccatgcgtgtgaagcacataaagccaaaggtattgttatattgagatatatataaggttctctctctttttctggttgacagtcatttaataaatatattggttacaacttcaatattgtgtgcattatattccatatctctttatttccttctctataggttttaaccattacatcttgcatggttggctacaatcaattttttatttaatttgtgatttctcatcattgaatatgatcgaagaaataatttataaaagctcttttacccccaaaatgtcacaaatagaacttttatcatgattgcttcttagttcttacaatttccgcaacaacgcacgaggtatcatttagtcatcttgatattaaggatccataattttattgggcagatagacgaaaacttttactggcatgtgatacttaataaataattagcatgtgattaattgagtattaattatgataaatttagaaataaattatttgtaaagaaactttatatattttatcagaaaatacattgtttaatggtacagaaaatatgatctaccactctaaaagactccaatggtggtggtggaccaccactcactatcacatgggtccttgttgcagtgtaccaatcgtatgttcaaaattcaaacaactttagagtgatcaatacccaatatacttatgcataacttctaaattttacatgattctccaagatagcaagtgaccgtcccctccgtaaggaatgaggtctcttaaaaaggtaaatgggttattttttagataaaataaagttttccaactataatatctatattgattaggcacatagtcgaattaaaactgatgtatgtatcaactaacaactctaacatgtcctagtcaaaactcctacgatttagtctataagaagacacatatattttttcttatagctttgctgggtaaaattttgcacttagtcagcatagattttcaaaatatttccaaatatctgaaatttccaaatctcattgtcctcacaaaagaaaagaaagaaacaaagaaaaccaaccaagccaaggatcagccacagaagtgcaaattaacaggcgcgttggcgagagaccagacagaggctagaggggataacggtcgccgaactatcctccatccacgtggcactcacctattggtccacgaatcggcaccgctcatccattctctctctctcacctcttcgctcgccgccggccaccgtcatggccgccgccgccgcagcagcagcagcagccggaggcctcctgcacctgggggcttctcgcgtg

SEQ ID NO: 58750 - DNA, 1031 bp, Oryza sativa
ataagtgttttaatccgaattaatctttaaaaattcgtaactaattcatcttagctcggatttagttggttcaagtctctaaatttttctaaaattaagatctacatgttaaaaatatccacatgtactgttcatgcttgtttatgtgctgttttggtgattttgctcctttctgtttagattccgacgtttccggagagtctgttttcgcaggagaagattttgaagagttccaaggccagcaaggcaagtcacacagatcccaaacaaccctttgagcatgttgatcccgtttaaagctactgtttctattcaactattgcatttattttcgaatgtcattgggtggaattaacctattgtttgttatagccctttttgttcttgattactttattccttgataccttgggttattataatttgactagttgggctatatatattggttcagctagatattagatgtgattgcttagccatgcttagaaacattagcacactattgggataacttatgactcactattatttaatgatggcttaatgatagttcacgatggtcaatcgtgattggttaattaatgtcacgtcctgataaattcatcccgaaataaaaatcattttctaaaaggaataatagaattaattaaaattcgaaaagaaattggcaaacactaaaatacgtacaagaaaaattcaaatgtggcccggagaatttttgttaaattctctttggtctaaaaagagccctcaaattttagtggaattttcagagcacaaataataattattaagaaataaacaaagttaaaatgattttataaaaagaaaaatcctaaaaagtcctttttccccctccccctcttgggccggctcggcccatccctccccctctctctcttcttccccgcggcccattcggcctgctccccgcgcgcgcgccactgacgggcgggcccgcccgccaccctcgctgacgggtggggcccatccggcatcccctacctcccgctcgttcccgccgcctc

SEQ ID NO: 58751 - DNA, 9950 bp, Oryza sativa
ccccctaaacctcgccggcgcatcaatggcggtcgatcttccgcgcccgtttccccctcatccggccgccctctctcactcccaaccctatataaaccctccccgtgcctccctccaccgtttccgccactcgccgctctctctccccgctggaatcgagctcgcgccgtcgccctctctctccgtcgtcgccgccgagctccggtccgccgccgttgtcgccccggaccacctctcccctcggcaccgcctccttcggcttcgccgcatccccggcgacctcgtccacccctccgtttcgctcgccgaccgccggagcaccgtcgaccccgtccacccgagctgcgccgccgccttcctccgctccggtcgccgtttccgtcgtcgccgtcgacccggggtgagctgtggaccgccgattcgtttcccctttccctcccctctctcgggcgccgctccgccgcgccggtggtcgccggcggcgaccatcggggcgcgggtgcgccgcctcccgtcggctgtgccggcgtggccgccttcgggcgcgccccgcggctgccatgtggggcccagccgtcagccgcccgcgccctcgggtgcggctgacgcgtgggacccacggcgccggccggtgtgagcccgggtgcgcccggtccaccgtggactgtggggctgccgcgtgggccccacccccgtggacccggtccgcgcgcccctcccctcggctgacgcaataaatccattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgcagacgctgcagcttcggaggatccgctcttcgtggaagttgaagccggcgtttgggaaagcgagcaaggcaagtcacatcatctttgaacatattgaatcccagtttataaaattatgatgatttaaattattgcattatcgctttatttaaattcccgcgttatcactgttttatctagccatgcctatctacctttgttatgaccttattattattgttattgttattattaccttgttcaccctagattaaacaaaaccccaactagtggacactctactcatagtaccactagtataattttaggtagatgcttcgctgattaattaggtaacattaggcggttttacaactctagactttgggatattcatatcacctggacactttggaattgttggtttattgtggaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacatggctagtgtcctgctgctaggggctcaatcctgcctacctgtcctggaggttccggccgtaggtgggattgggtcggtactcttgtctatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccaagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaagttcgtgcgggttaacgaccttgattaataatactgtgtagctctaggatcgtctttttaaaatggctttgggcaactaagtgacttttaaatgctgttttctgcaaaacttaacccctatatcattaccccttgtaccccttgcattaatcgtgcatccgccggtgtggcttgctgagtactgtggttgtactcattcttgctctatctttctccccccttcagtaagagaagctttggagaagatgtcttaggtggagtcttggcttacaccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtacctcggcttttcctgggacggggattaatacactagcgttcgggaaaatgcaattttctcggtcgcgacaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcttggttcattgcggagcaccagactgagaagtggcggagataagcccacgggggtcgctggggagtccatgccttgtttataagggggtgattatgatccaggaaaggtgcgctgtggtggattgtgttgtgcaaggggtattgtcacaactcctttccgaggtatcgtggtggtattgaggcacatggtgacatgttgtgaggctgtgtcttgtgggtacagtggtacacctctagccagagtaaaactattcgaatagccgtgcccgcggttatgggcgggtctaacaatgtctttcgtgattagtctcacacctctcataatgataaaagatgctataactggtaataatttgtttagctcctggtttggaatggtatattcctggtttggagatagatctgtacagccgggtatggttgttcagaatggttgggcctatacaacagggtatgttgtatagcgttggattaatattgtttaattattacttaactgttttattaaattctgaaatgtttattaaatgctatttatgcaaatgaaaccctattatgccatcctttggtatcctgtgcacttgcatatttgctgcgtgacttgctgagtatgtcatatactcaccttgcaatcattcatcagaggaagagttctacaatgatgctgatggtgtggaggattaggtgtagccctggtcaagctgcctgtggagtggagccgtctgcgccgtttatcttattttccgctgcttagatctttattgattgagaggaactatctacctctgtaatgacattttattcgcttaataattagagtaataattgtactctattatcaatttgttattgtgtgcctcggctgattcctggacgagggttcacacacatgtaagcgtttggaattttggatagaaattccgggcgtgacagttacccccttggtaattatgaagattcggctggatgttgcgcaccaagtgttcaggaaccatctgaggcatcactgtgccgtccggctgtgcatggtgaaccaaatgttctaggatgacctaatttacaaactgctgtataggctgaccaccaggtactgtgaacccggccgatgcattcactgaccccgggtgctgaatcggctgaacgatctgctgtctcaacggagtctgttggatcggctgctgaggctgctgccttggtggcgtctactgaatcggctgcagaggctgctgccttggtggtgtttgccgagccggttgtacgacctgttgttggattggttgtacaaccgcctggattggtggtgtctgctgaatcggctgctgctgcactggatcaacaatcggtggaggtggcagaaacaaggcagcaacttgatcttgggttagccgattcgtagcctgcccgccatgctgtggttgttcccttgttaacaaccaagggttcaccggctgttttggcgtcatagctagtgtaccaggcaaaggagtcgacgctggcgctgtcggctgggttgtgggtgcaacagagggaactgcttgaacagatggctgaacatcggtgatcaaagatcgataatttgggaagacacctccttgcaagtaaactgggcctgcagcctgatgctcagctatcaaaccatcggctattgtcttcatcatgtttgacaatgtattgactaataccccggactgattgatcaaagcatgatgcacagcgtaatcaacccgatcttggaagttattgaaaaaatcttgcgctagttcactattctggttaagatttcctccttgcggctcctgactaccatcaccttgaacgccatgaactccttgagaattgtcgccttgatcgctcggggagtcgtcggtagcacctttagtactcggctgagctgagccacctggagcttgtttcacttctccatctttggaagaaccagtcccaggactatcagcaaccacttttattttatacttctgaacaagtgtccccttgcgggtctgcatgaatgagttcagaaactgatcccgtgcctgctgcagcgttgcttcaaactcctccttctgctcaggtgtgaatttctctggatcgatcggcatgacgttgtcatcaatgatgtcagtcaatcccagcttcaacgccttgcctttaacggagcctgggctagatggtggtggtggctgtttctcggccatgaggaagaactgacgtctgacttcttagaggtcccaccaggcgtgccaaaagcgtgttgacagaaaacacgtggcctgggagatctgcttaactctagtgcaggtccaaagctcgccttcggatatgttagcgtgccagttgatttgatcctgtaatcaacaagaaatagaagcaaagaaaccgtggttaaatctataaatgatagctgatcagctagatgccgatgacatatcatttatctttgagccgatgtcatctgtgtatcgatcggccgccatgaataagtaaagaagaactaaatctattcgatcggctgtagatattaacgatatatactccttatatcgatgtatacttaaatcaagtgattgggatagatcggtcatcatgccgagacagtatgaatcacttagaccgaaatatatatcaataacaggactatatatgtttatagcatagccgatcagatagatctagcatgtatcggctaatactccgatactactctatatcaggatattaaagcaagaataatatatcaaacaaaggtctaacatacttagatgcagtagtattttgatataaagggcagatttaacatgtcaatagagcatatagaacaaatatagttaaatcagatacgatcggctgaaactccgatgctattctaatcggcaactagaaggcaggctagagattgatattctaagcacgacttaatagatcaaactcaattgatgcagcattaagtatgaaaagaagaacaatatctagacaatcaaactgctagaagtctcatagaatggtagatatctcatataatctagatcaacatcaagatctaacctaatcggctgccttctgcatacaaatgttagccgataataggttaggtggcgatattgctaaagattatgtaagatatatgataactcgacgaattatataaacaagattagagtatcataaagatggaagcactaatcctaaaaacacaatcttgttgaagatcgaaagcgatgcagctcaacccgaaagcaagaactcgtcgaaacaaaactaaagcaaaagggtggtgatgcgccgaaattgtattgaacgtgtgttgttaattacatagggctcggggtctatttatacccgagaattacaagatatgcccataccggacacgactattatctctaacaaactctaagataccataagtctttgcggcagacttttgcccacatttatctataaggaatttacataagatatcctaattaatagatacaattgccttcccaggactctatccgtgcgcggcaatcatcttgaagtacattaacttgaacccgatatcgcgtacaagtcatattgtcggtatcggctacatcagcttacctagcccgactcagacccagccgatcttatcgtagccgatctggactccagccgattcctgctctgttttcaaactcgatctccgcttccgactttgctttgacctaatcttctttcccaacgctgatgttaccaaattggttgttaacaaccccccgggaggacttaaggcatcgaatcttaccgccaacacatccatcacagcctacgaagccagagcctacaggagccgagtcaccgggtgatctagtcgaaccaactcaactacgatctcgtcggtattatcgagttccactattccctttgtaatctgtgatttccgtcatataatcccatatcaactggattagggctattacctattaagaggcctgaaccggtataatccctgtcttttgtttgcttgatgtcgtactacgtaaatcctcataccagcgtaccccaataccctctatatccggtctacgggtattccccgtcgacagcggcaggagtcatacaatgcaaaacaattcttttaccatcgaatataaatatatatatatattggtcctaccattgaaaacaacttctctatcatattgccatggtcggcccaaaagaataggaacaagcttgcatatgcacaacatcacattcaatttgatcatgataggagcccatagaaaaaggtattttaaccaaacgggttaccttcatcttaccatatgtattaaaccattgaatatgatacggatgtggatgtggatgggtagtcaagccaagcttcttgaccatctattcacttgctaaattgttgcagctcccgctatcaataatcactttgacagtatggcctttcacaagaactttgctttggaacaaattgtgatgttggttttgctcttcacacttctctttagcactaagtgctagcttgacaattaggctaggatactgatctagcgactctggatgcaaatggacttcctcgatgttatcgttatcttgtcctcctgcatggtcaatggcagctaaagcatattcatcatcacaatcactagcagaagtatactcaccatcaccattcacaaatagagctcgccgatttggacagtcgcgggcaatgtatccaatgccatgtcacctatgacatgtaatatcacgggtacatccagtggaagctactgaagttgcactcttggctagagtccgaactgaagcatttttgcttgtttcttgaacatgggatggcgtggaggtaggtggatgaatggcagtagtagattgacgtggtgttgactgtcgtgtggaagtagcacctgtaaaagaactcctatgcttgttgcatccctgcacttctcttttagctttgcaagcaaaatggaataatctattcatggtattgtattctttatattcaataatatcccgaatctctctattaagacctccatagaacctagaaattctagcatcctcagtttcttgcaaatcacatcgtgacaaagcaatcatcatctcttgacaaagcaaccttgtcttaaaagttgcagttgatttaacatgtcatgagcatagtaagaaggaacaaatctagacctcattgtacgtttcatatcatcccatgctctaggtctaagtcctctaccacatatatcattccaccatagagatgcaaaggaggtaaattcactactggcagctttaactttcttattatcaggaaaatcatagcaagagaattttttgctcaacagctagctcccagtctagataaacagaagactcgaacttaccatcaaaagaaggcatagtaaattttaccttagataaaagatcatctttggccctaactcgacatcgtcttctatttccaacactcttgtcttcctcctcatcgtcagcaacaaattgctcttcgttttcatcgtcatatctttggtgtcgatgagcagtggcacctgcaccttattcacctgcagtctcaagtaaaccaatgcgtcgcacaatattttcatgtccaatattcatattctgaatgttttcagttaattatttatgtgattgattcatttgctcaatttgatccactactttcaccaggctttcacttaaggtttttaaatgtttatatgtgctttccttgtatgatttactattacacattaactcttcataccaattttccatgcccttcaatttatgcgctagattctccagtgttggttcgtcggaacttgtacctgacatcattagcaagcaaaagaaactcacaagaaagtgttagttcttaacaatctataatatgtggagcttttgaaggcactcaatactcaagcatataccaaattcttatgatgttctcaaagaatgcaaacacaggtcaatcactgtggctggttcgtggcacaatgacacgcttgatgagtggagcgattgcaaagccggacctgtaaaggttagtagtatgtggatcttggtagacttaactatatcaaaaggaatagcaaaaatcaaatagatttgcgaaattgaataatagtccaaagtactgctcaacgttgctagccttgcctagactcaatcctagctcaagcaaacaaatgattaacactcggactagaaacaactggttttatcacacaactctctccaagaaagccaaagaaaatgccacactgttttctttttctgatatttttctttttgttccttttttctaatttttttctttcttttctattttttggtgcggcctttttttttctgtttttgcacctcgctggctttttccttttttttatctctctttttctttatcaaacagtggctaacggacggaaaaaaactgggtaaaaaaaaattaccgataccaactaactcaacggaacctgctaggctgcatgcgcacaggaaattttcacggaaattaaagtggcccgcgatccgcatgcacaaggaatcagcaagtcgtggatggaaattacaccggtacacatgcatgcatgcgcaataaagtaggagatcaatctttgacttaaacaggaaactcggatactttttttttcttttctcaaaccaatctacaaactctaccgggatgaccgcaacaaaactaaccgatgagacaaccagatgcatacccaaaccaagatgaaactagggctaagaccagatcttgacacgacagtagaccaaaactcaataaagcaaaattgaatgaaaattgcaaggttcaaaactaatgtttggtgaaggaaaaagtgatgcagcaatttgtagataatgggtagggaaaataaatctataaaactaaaatcctcaccaggcaaccgatgctctgataccaactgatgacgctctctctcgtggcccgatgttctggtgaggggataactctcactttgatcgagtgcgacgtttgcgacgtggctaccaaccagaacaagtccaggacgccgtgcaatcgctacaccacaaaagatgtcgcgcgcggttgatgatccctacaatgcaacgagagaacactgcaagacaagataagatgcaatctaaatattgcgaataggtaattaagcacaaagaaatagttgcgattgaagtggtagatctaatcgacccggcaaatcaacacaccaactattggggcctctg

SEQ ID NO: 58752 - DNA, 2634 bp, Oryza sativa
gagttgttacgtgtgcgcaggaggtggagagcgctgttcaggctctggaagcactgggaggtttgcccgatccggtgggtgcacggtgccttttcttttcatttgtattgtctgaattatactagtatttaactaggtaattgttgggtggctagagaatatagcagtagttaatattgaattaacgattttataaggcgaagattttaggtgaggtgcatgcatctcaatagttaacgatctgaatttaattgagaaacaagctgttttgcatcttgatcagtgcaaggtaagcttgagtttcttgctgaaataagttgaagctaaacagagaacttctggagtttgaatcgtaagattatatgataaatatgttacaagtgaagcttgccagttgccattgaagtgattcatagagcatagtagaaagtactttctgctgaacgagctagatggcatcttggacttacggtcagaaactccataaatgtgatgatgttagggtgttacttttacttactatgggaaagtatgttcttatcaaagtttgatatgattggcttatctacaaaattgaacatagctagtgctcccattatcatacatgtatttgacgtagctggaaagtttctatgcaacaaaggctgtcgtcttatctttcatggttcatatgcagaccaactcaagtctaattgaaggtagttggcagctcatatttactacaagaccagggtcggcatcccccattcaggtaaaataccagcagtatgccccactgaaaataatgttcagtctcccatttatctctattattttttggattttcaggccgaccgcatatagataaatgactgattttattcttcattcacattgcctgcagagaacatttgttggagttgactctttcaagatctttcaggaagtataccttagaacagatgatcccagggtgattaatgtagtgaagttttcagaatcaattggtgaactgaaagtagaggtattgattagcctacagtaaacttgcaagagatacactactaggaatgattgaatcaatagtatgacaaaaagagacacatgattagcaaacagaaattctgttgaccactcctgtttgttaatgttgtgcccatggattaacctagccagcacacagcgccagcaactcatcagattgtgccatgactggtctggaacaaagctattggcatgaaccgtgcatgaacagagtccaattcaataataaagtcctcttagtctacatttagcatgactcgtgcagtgcctctggttgtctcgttggttgttcaagtgtggatatgtttgcaggtagagtcttagttgcattacttggggcttgtttgtttgctaccttcaatctgcctgaggattgttttggttggtaccctgagatcctccctgaccaggcaacttcatctaacttccatgaagatcctccgttgcatcacctccatggacaagaaaaacctcacccaatttcagattctcgcaagagcactgctatctcactggtcttcttcgccagcactgaccacacattgctaccctgtcccgaagcacctccacctcagccatctttactgggaagttcgacaggtcacactgatccctgttcaccctttccttgatacctgccaatgagttgtctctgtcaccagtgttctgtctcagccgctgcgtgtaaccagtgaagtgtcaccatgcacctctgggagaagaccatcacactacaggatgcccaacatactgttgcatcctataggaatctgcctacatttgcgaaagggcatgtagcctaatggttgcagtgacctaagtagcaccccaagatcctgggttcaaatatccataggagtgaatttcagattgagttgtttgcggggctaagttcccaatttaaatggctgcatatatccggatggatgtagaggctaggtaaaatattacccttctctaaaaaaaataaaaaaaaaacatactgttgcattcctcttgttagggatacacttagataaatagagtgggtcatcatcagtaacaagttcttccaactagatatctatagcacactctctatttctctagtgatcctctaattgcctattgcttccccattttatagtgtgccctcctccagctccatttcttctcaagccatttaatttatcatctaataaatagtagttatcttgtcgggaacaaaaatcctgacgaccttaagactgatagttctggagggctgggcattatattgaagaacaatatattgtacattgctccgactacttggtaaagccgaaatcagaaacatcattggcatttttatcttttgggagacttcattgtttaattaatccattccatagtaaacatggaataagttggtaagagcagtctcttacactcctaaagagagttgacagaacagtgtgcttattctgtatgaagggggataaatacttctactagtcaactaacttcgattactgctagttgctaaatttatagtgcttttacaatgttctacatgactttatgatgagatttatttaaaatataccaggcagaagcaactattgaagacggaaagcgcattctttttcgttt

SEQ ID NO: 58753 - DNA, 731 bp, Oryza sativa
cctgggttaagcgttccaccgtgagcatagtaccagaacttcgatcgatccggccaattagcggtggccggttcgatacccctctcaagcaagctagcctccatctcctcccacttcggcttcgcgacgctatatccgcctgaccccaagtggtgatggtacttcttcttggcagcattttctttgtttctggccatcatcgcttgcccttgttgccctgtcttgtaagcaacgaactcgtcccaatgatcccttagctttgggaatacgtcgaagttcggtgttagtcccttcaggatgtatttcttgtagagatctcccttgaagctctggaactgttctgccattttcttcagagtccactatttcactaagttatccgtacccgcgggtagcgtgaacgtctcgagcattgtggtccacaacatctctttctctgagttcgggacaaagctgtcatcatccccgcgtgcccttgttctgcgccagtacaccgtgctgacaggcacgttgtccctcacaacccaaccgctgtggcgtacaaaattcttggctgcttctgccggtgcactaggtcagtcgtcttcgtccacctcagttatgatgtgccgaccctctatcttcttcgcggcacctcgttgtccgcgtgccctcttctgtccagcagagggctgacttccactagcctcctttgcatcgttcccctcctcgttcccctccgcatccctctc

SEQ ID NO: 58754 - DNA, 8820 bp, Oryza sativa
taatctcctatgaaaaatggagccaaaaacacaaaccgcacaacttagttaaattagttataacatgctttttgattttagtttgcaagccctagataaatttgtgcatcaaaacaattaatttataaatttatacgctaaattatacccacatagtaaattcgtatactgatgtactctatttaaatataaagcttgaaatttagtcctgctttactcgatagcagtcgtgttcaccactgttcatgcccttgtgactcgaatgtagctagccattagaatcttatctttttcaagatggcaactggcaacataagatcgagccaatagctagcccctcgctgtaataaggcagtagaattgcacctcgccgtaaggtgtaagctagcttgactgtatttggactcagagctatcaccgtttgttgtcctgcagcacctgtacctgttaccctctgtcatattctgcgattgtctcctatgacgcctgttagggctcctttaaatcgtaggaataaaaaaacagaggaatagaaaaaacataggactctgacaggaatacaattgtaaaacagaggattgcaaaacacaggaaaaatacaggaacgaccgtttgattggaccacaagaaaaacgcaggaattagatgagaaagatagactcagagaaaatgtttcaagaggttagacttcttgctaactttcctccaaaatgtgcataggattacccattccataggaattttaaaagattgaataggattcaatcatttgtttcaaatacctccataggatttttttttcataggattaaaatcctccaaaattcctacattttccctacaaatcaaaggggcccttaagattggggttcatttcattagcatgtgtgccttaaatcaatccattatcgaccaattttccccaatcagttcaagggcaaaagagtctaaatctaatttgcataataaagtaaaattcatatggacctaattaagtgacatcaacatcagtaaactttgcataataaaagctaaggaaaaccatatccatttcaaacgaaactaaaaagaatgttctagagtgttgtttgttcagttttgaacttttttttccatttgaaatgatcttcgagcacggtttaagaggcaatctaaataaatatatagttgtgtaattgtattgttaactagcatattgcctgtgcattgcaacgaggttttaattgattattaacctactattatcattgttttttaatacatcatcacttaaattttaaatacatttttttgatgggaaaattttattttattttttaaatatatttgtaactaatatgtggaccctatgatatcacaatatattttttcttcacacaaaagaaatagagatgatgggcagggatgaaaactgagcggattctttctatccgctctggaggaaaaacgaatatggatatctttcggagcaaataattcctcaaatagttcagatacgaatacgggtacatatattttctcccggatacaaatacaaatatggtatcggggttttcgacggatgcagataataatacgaatatccggcgaatagtttcggatatccgctgaagccatgagaccccatttctttacagctctatgaccttcaatatagctttttagattttaatagtagcgcacctcttaacactagtccacactattaatattatttaaacttttaaatattttgttaaattatactatattttatataaattgagctaattatatatgatgatgtttgtttctattagaagttgaggtggttttcgtgttccgagaaaaaaatatttccgtactcatgtccgatcatatttgatcctaattcgtattcgagataattcgtatttgtttcggtatctgagctattcatatttgttttccatctggcaaaaaaaaaaagaaaatgaaaatgaaaacaaacatggtatgagcattatccgtccgcatccactccgttttcatccttagtggtgagggtagttgatatctgggttctttggccccatatgtcttttattcaccattactattcctttttaaatgagtatagacatttctaaacaatgcaaatgtgcaggttaacaactagctatagacattccttggcaatatattaataatgaacacgcttttaaaacatttacttttagaattcggtataaattggagtagagaatagaggagaaaattgccccaaatattttgcgcttgtatagtatttttgttctggcttgttcttttgttttctgcttaaaggggcatgcgcttgagatcttaaggtgtgaaccaacatgttccacatcaaatagatttattttaaaaatgaacaactctgagattttcatttactaccattgatctgacatactattccctcaagttcttcatttcttatcattttggacatgatacccatattaattagggtgtatattatttattctacccatattaaataccttgaagtggtatatttagagatctgagagtgttatgtttaattggcttaggctttatttgttcgagatttttggtaggaactaaacaacagcacacaaaatatgaaatgccattatgatatgattaattaagtattaactatgataagtttttaaaatagatttatttgtttttttaaaaagttgtgtataaaaagtttttaaaaaacatatcgtttagcaattagaaaaatatgctcatcgaatatgagggaataactaagcccaaaaaactcagaagagcattactattggaatgaaaggcccagttccgatttaatgagaattttacaacttcgctgctaataggtttttttttttcactgcatggcgcatagttggaaataataacaccattaactacaaagggcaatctcgacctataccggccaccactaaaactcttcaacgacagtcgacgagaattctcatccaccgcaacaaagaaagcttattcaaccactaaattaagctgctattttttttttgtcttgtgtttatacttttcttttattcttaagtccaaagtcaaagtcataatcacttacagagcgtgcagaaaaaaaaagaggaaaataaggtggcctatcatgacttttgttgggaaaaattgacaggtgaaagagctgtgataaagaagcaagccgctgcagattgaattgctgggtaggatatttctaggctggggccataagacagttctgcaatcttcagctcgtgctgggtgctcttgcatctcggatttgctatcagcaaccaacaccatgtcctccagtacgttagtgctcctgcagctcctataccttattagccttatcctaccagccttctctgccaacgatgacaaccaattcgcctactctggcttctctggtgctaacctgaccatggatggtgcaactatcacatcaggtggcctcctagagctcaccaatggcacagtccagcagaagggccatgcattctacccggtcccgttgcgctttgtccgatcacccaatggatcagtgctctccttctcggcatccttcgtattcgccatcctatctgtctacactgatctaagtgctcatggcatggccttcgtcattgtgccaagcatgaacttctcagctgcgttgcctggccaattcctgggcctcgccaacatccagagcaacggcaatagcagcaaccatttcttcgctgtcgagctcgacaccatccaaaacaaggagtttggcgacatcaatgcaaaccatgccggcgtcaacatgaacggtctccgatcagagcagtcctactacgccggctactacgatgacaaggatggtaacttccataacttgagcctgattagccgtgaggccatgcaggtgtgggtggactacgatagcaacaacacgcagatcactgtggccatggctcccatcaaggttgcgagacccatgaagccattgttcacagccagctacaacctcacatctgtgattacagatgttgcgtatgttggtttctcctctgcaactggcacaatcaacgtgcggcattgtgtactcggctggagctttgcgataaatagtcctgcttcagccattaacttaggtaagctaccaaagctgccacgcatgggcccaaagccacgatcgaaggtattggagattgttctaccagtagcaacggcaagttttgtccttactgtgggcattattggtcttgtactcatacgaaggcatatgaggtatacagaactgcgcgaagattgggaggttgagtttggaccgcaccggttctcttataaggatctgtatcatgcaactgaaggattcaagaatgagaatctgctgggtgtaggaggatttgggagagtatataagggtacccttccagtgtcaaaattggagattgcagtaaagagggtgtgtcatgaatcaaggcaaggaatgaaggaatttgttgccgagattgttagtattggtcgtctccaacaccataatctcgtgcaattacttggctattgtagaagaagaggtgagctgttcttagtgtatgactacatgccaaatggaagtgttgacaaatacatacatagtatagagggaaaaaccattctaacttgggcccaaaggtggcatatcatcaaaggcattgcatcttgcttggtctatctccacgaagagtgggaaaaagctgttatccatcgggacataaaagctagtaatgttcttcttgatggcgatatgaacggacgacttggtgactttggccttgcaagattgtatgatcatgatgatgacccacaaaccacgcatgtggttggaacaataggatacctagctccagaactaggacacactagcaaggcgacccctcttactgatgtatttgcttttggcatgtttgttctcgaggttgcctgtgggcagagacccatcaatcaaagttcacttgatagccaaacgatgttagttgactgggtgcttgagcaatggaacaaaggatcactagtcagtacagtggatagcaggcttgaaggaaattataatgttagagaggcagttttagctataaatcttggacttttatgctctcacccttttgctaatgcaaggccttctatgcggcaggtcattcattaccttgatggtagcattccattaccagagatgtcaccaacagatttgagctatcatatgatgacaataatgcaaaatgaagggtttgacgagtacatcatgacaagttcatcgatggtaagcaatggcactgcatctgccatttcaaacggaagatgacatgaattatggtcatcagatatgaatgcactgttcttttcttactccttttgtaaaaactgctttccttgtatacagaaggatctttttgctaggtgagaattgtatgtgattgtaagtttttacaatatttgtgtaaaaacatgtaaacagtttgtttataatgaatttaactatttttatacataatagaagagttgctccaaacagcctctgtatgaatttaactcatagtagccaatataagctcttgtggttgcttaactgaagctcaagccatccgtgcatggagctgagatgtgaaagagaggtgattgtaaatcatctttagcaaaatgtctctgcataatacatatatagtttttctattgaatataaacatttatgcactattaattatagggtataggtaaacatttccattattgtttggacatcaccactataggtagattgtatatgcactagtccaatcacgtgatagaactgtcatggggcaaacgtgtcaagtatcgagagtgcccgtgctcacctcacacttgtacacttgtatcacgtgctctggacgtacttggactggctgtggaagttcaagcacgcaaaactagtagcatgtgcagtcgtaacttacaccactagactaccaaagggtgtgcacataggaatgacaataacgtcgccaaggctggtaggttcatataatgatgcatttagaacacaccattttggaattagctacctacaccaggcaggtatggggtaatgtccaccataagctgaagatttcgcatgctcctcctctggtgacctattattctggtggtttgattctcgtcgccttcttccaacaaagtccagttgcgctggctagctttgatgctgttcttattctgatttcgtggctggtgtggaaagagtgaaatgctcaggcattccagcagcacgtctgcaggtttgcgtcgcaagtggctcaagcgatctgggaggaatgggaatggtgcaactggcctgggaggatactgcagcagggctcctttctttgtgtagctagattgggtgcagtagtgcaggctttaccccttgttcttatgtaagtcaatcacaacaaccgtatttgttgtttaaacttcgtacatcctctacatttttttccctcactcttaatacaatctggcattccactggccggaccgacgaaaacaaaacattttggaatctgtacatttatttatacacacacatatataaaagcctaaagtaggtattaattaattataacttgtgaccgtacataatcgtaggtactatatatgattgtaatattttacagaacctcctcacatatataaaatatcatgtttggcccatatttacttaaatttcatgttagaaaagtgtccatgaaattcagttggtttcttggctaagatcattggttcaactcatattactttgaacaatatagctagtgattcagtatatgccaaattagttcagtacgccaaattcatattattccctccgtttagatcatatacccttcgtttatatcaataatctgaggatttaccctcctatgcaaatgacatatataggggggggggttactgacatgtgggtccggagggtaaatcattaattgcaatctaaagaggatatgtacaattaggcccctttgaatcgtagggtagaaaaaatagaggaatagaaaaaacacagagaattgcaaaacacaggaaaaatataggaatggtcgtttgattggagcgcaggaaaaaacgcaggaatcggatgagagagatagactcaaaggaaattttccaagaggttggagctcttgctaaatttcctccaaaatccacatgcaatgtgtgattccataggaatttcataggatctggaaagcttcaatcctttgaatcaaagggccaaataggaaaatttcctataggatttgaatcctatgaaattcctatataaatcctttgattcaaagggtccttacattttactttctacttctccagatatttgctgtccagtccttaaaagtttggtccctacatggaacagagttcctacaaaatatcaacttgaagctaagtcattgaagttacctcacgttaaggcaatatatctgaggtcaacatcgaagaaatcctgtcctactaactgaaaggaactcccgtgtattttttcccttttcgttgtcgtccatatacttattctgcaatattgacgtatcgaatacttttgatcaccgatgacatttcaacgccgtaagaaatatgttcaccttgggtgtgtttagttcacgccaaaattggaagtttgattgaaattggaacgatgtgacggaaaagttgaaagtttgtgtatgtagaaaagttttgatgtgatagaaaagttggaagtttgaagaaaaagttgggaactaaaccaggccccttttccatggaagaacacaactgagctgtccaaatcaagaaatcaatttccacaaagacaaaacctgtcacatggaattgaaggtgccaggtgaagtttcaaagttaggcagcaccttgtaagtcgcatggaatctgatggtccttttgtggtattccattctcgcaattaatttctatggaataatttgttatgtgatgtcaacatcttctacactagcacagattcttacatctgtaacgggtccaataaaaccgttatagattatgtcatctgtaacgggtgacattggcaactgttatagatgaccagaacattcttgagctgttactgaagccgccttatctataatggctcctaatcaagagccgttacagatgtaagctcctttatctgtaatggcttcctcattgccccggccgcacaacccttccccctcccgctcttccgtgccaccacagtccacatcatcattacattcctgcaacgcgacgtcgatgtgctgccgtgcagtggccatcggtagagcagggatggccggagtagcaggaggctagcagagatgaaaccagattggatgttttttgttctttctattataaatctccacatatgtaacagcttacgagtttagtttatattttttttaagctgaattttcacatatgtaacggctccacgttttgagccgttacagataactttcatctataacggctctctagcccttacatatgagtcttcacgtctgtaactgttggtctgtaatggttagtccaaccattatagatgtgatttttgagcccttacagatgtagtgttctgtactagtgtataattgtaccttaaaccactgtaatagtttgaataggtcaatgttttattaaatttgatttctctaaatagaaatttgattgtagatttttttagaagagatgcaatacattctaataattaagagtgttttttaagagttaccaccctttttagtacaaatttgtgcactaaggtggtgaccataaaaaacgtagtaattagatagtgtaaaccag

SEQ ID NO: 58755 - DNA, 612 bp, Oryza sativa
aagcaaacgagcattaacattgttacacgtcagtaattaattaggatgatgagatgatttgccttcaagaaaaaagatgacgagacggttatttaagctagattagtggattagtagattgagatatatatagtttcagttcaagcttagcaattacctatccacgaagctagttatagctgtacattgtaaatttccccttttgaaacttatcaaattcatagtctctctttttttttattgataaaggagagttttgtgaaaaagaaagaattacatggtgtttagggtccgatcctgaaaacaagcatgggctcctcatctctctgaattggaagctccgctaggttggtggctcccatcgtggcgccgtcccctttatctataataggatcattatcggtgtgcttgtcaattgttagaaaattcttaagttgtgttggttacactcaaatggtttattgcttgacttaatgcacatgtgggtcctgcactcatatatcattttaagaacaagaagataaataaaggaaaactacgatttttaacacgtcatgaacaagttctatctttatttttaataggtgatgatattgattttttgacatatcg

SEQ ID NO: 58756 - DNA, 641 bp, Oryza sativa
agctcggtaccctttggaattggtggtgcaataagttaccggaacttacaaatgtttggacagatcactaaataggtatcttgatcaatgattggatattattgccaattttgatgattttgctattagacatattgctaggcatgataattctcaagtaaatgatttagcacaacaagcatctggctataatgtgaagaggggagtatttttgatattagaagagcaggtgcttgattttaaacctttgtgcgaaattggcaaaattgtagaccagagcggtctgaccggcattgcacggccgttctgaccggtgaccaggggcagtctgaccggccacctcgggcagtctgacaggccttgcacggtcgatctgatcggtgttgggcagagagctggggggcacgatgcaattgattcaaaggccgaattgattataaattcggacatttgtgcccagaaaacagaagaaaattggagaattcctttgattagatatttgaaagatcctacacttaaggttgatcgaaagattcggcggcaagcactcaaatatacattgcttgatgaagatttatatcaccgaaatatagatgaagttctattgaagtgcttagatgatgatcaatctaaagtggcaa

SEQ ID NO: 58757 - DNA, 6541 bp, Oryza sativa
gggaccatagtgttggcgcgtagagactcctgtgatgaatcctcaattacaacaacatcatgatagactggtgtgccaagtgctgcaaagaaaaaaacaaaaactctctaaatatatatggcagtgatctgcatgaaaataaataaataaatatatagataaaaacaaagatacttacaggtatcatccgtcacagaatccatcatggaagctcctgggtattgctcttcgcttggaattggttgttgtccttgttttgaatcaccgctgctgtcgtcagtgtcattgttctcatcagcaccaccttgggaacccgcactgtgacttccacccgcaccatcttcaccatactcatcatcaacactgtcctccactttttcatcacctttgtcttcatcgtcttcatcttgtttgccatcgtcttcctctgtttgagccccctcatccatagcacctttatgagcagccggtgggtgaactttgccatccatattgttatccctcacattctgaacatcaaattgagatacctcatgagcagcaacagccccaattgcaatgacttctgcaaaatcagttgcatctacattgccactgtgccgcccaatttcctcagccttgtaattgcttctagtttcagctctgtatgcttgtcaggaccatggttaaagttgggagtgccaagtacagcggcatcaccttcagaagtacttgccatgcctttcacccttgccaacttctttaattttgtgctaaactcagaaagtatgtcgttgtctgatttgtccaatataaattcaagctgttccatgcatgtggagatgatttcagtgcgcctaattttgagtttctctttcatcttcattaacaactcgctgattacaggtggctgtgaaaaacacagtattttttttaaaaaaatatctacatgaaaaatcagctataataaaaagtgatgagtgcctggcaataacccaggtaccaaagtctgatacctggcaaaatacaggtaccatgtctggtgcctggcaaaataacaaggtattgctatagttgcctatcataatgtattgttgggtttacctcatcacatgcattatttggatttgcatcacaccctgttgattttgggtcttgaccaacttggccatcttgcatattcatttgttcttcgtcaccagcagcagcaggagctccctgggggtctggcgtatgttgtcctatgttcatatgttcttcgtcaacaccagcagcgatatgtccctggggatcaggtgtgtgttgtccttcatcaacgcaagtagcatcatcatgtactccttcctccacatcctgtctatatccaatggagagcatgtgctgtggagattcgtgcagtggagattctccatcgcgataaacagtggattctatatcttttatctaaaaaaaatgatatataaattgctagtctacctacatgatacaaaaaaaaggaggtatcattgagagccttatacctggatagaatcatagtcagcatgcttggatctgctggtagcaatagtttttacttcatctatatgggcagtggttatatgcgctatgcgcggtgtgccttgtggaacattgatacctgcaacaaaatccaggaagataacctgcagaaaaaaaatggattcaagcatttaaaaaaatgacaggaacatgatacccaaaaaaaatcagaaggggaaaactaacattaagtatatgaacacaacctcggacatttagatttatgcttgtgtttattctgaaatcatggatggcctcgaaaagataatcagcaacatggttgcaacaattcaggttcttgatgttcttcacatcactaatagctgttagatattccctatgaactgtcaagttgctacctgggacaagatagacacccaaagcaaccatcatgaaggacacaataaattcatcctcattatgttccagtaacatccgagaaatggctttatttaaagattggcctctgccaccttctatgaacttctccttcaacctatggtcagtatcttctgtcaacttcaaacgcatatgtccttcaggaattccaatcaccttcttaatgagtggtcttatggggattgataatccatcgaactccaaggtaccaagctcagtattgacatggttcaaaagccacaatgtcatgtccttggggaaactgcaaccctgtatcaacaatagttcctcaaaattgatgttgtgcacatagcggatctaatctggtgacagttgagctgctatcgtgctcatgttgcttgggttgcacctcaatttaatgatctgcacctaaaaatattgtaccaaaacataagaaaaatttcatttaatctctttttaaaaaaacttaaagggaactagtataaaacaatgaaaagatgaacatgaaaaagaaacttaaacagaattatggcaaaatgaagcacgatacctcttttccattttccgctctcttccttttcttgtttccactggtcgatgcacatgacttcttcggcagtgatgaacatgtcttcttcaacagtccaatatcagattgcttgaacttattcaaccttggtgagcaccgcacaccctttccctcaacatggacaaaatctgaattatttgaagatgtagccattacggctctacaaaaaaaagggaaaacatagcagttagtccgcttttcaaacattgttgataccttgtgaaaaaatcaggggacgaaactactaccgtacatcatttacgctaataatgcagtaaaattgcagcccctataaaacacatgtattgcttgatacctagtaacatccctcaggaatcacgcgaacaaaccacgggacaggaaaaatctaaaactctagcattagattgcagccctacaaaaacaaaaaaaatgtattactcgatacctagtaaaaatgaagtaatgccccatgggaatcaccctagaaaaaaaatttctgagaaatataaacatgcatcatccacacatacaaacgcgcggccactaaaaactattgataaaaatcaccttcattagaaaagtaaccaacctattgattttcactgaccctcaggaaatcaacacgaatcccatacacttcctgccaccccctacctacaaaccctagaacagaaaatgcaaaaaaaaaattgacgcctaattagggagtgatttggaagttataaattgagaatatcctgataagacattgtacttttgcgcgaggtaatcttcaatcagagaaactgggagtgagaaaggagagaaaaacgcatataccgatggtgggagagcgccggcgcggggtatcgctgcgtgcacgatatcaccgctggtgcagcaacgccgatgtggggacgcgcggagaagttggccggagcgcaagggcgccagcgaaggggagcggaggaagacggcgcgcggcgagcgccgagcggagcgagagaggaatgcagtgtggagagggtggggaaaagggaaaggggatcagatggggtgagagggtaacggtttgggcacattaatttctcccgtgacaacggaaccgccacgggacaccgttcagtagtttttctgctagaagaagggtgcgtttgcaaatgttacagctggtaggcgtgtatttgaaaaggcggcattttagatgtgtggttgggttgtgtatccttgacgacaatctttaccctccaggcacaatccaacggctgacaaggaacatatctagattttcgcggtattgatgctttcaccgtaccaaacaaaaaagtagtacgggagaaatttaactatttttcactattacatttggcatttatccaaatgccccttataagtttgcacatattttttttctctcttaagagatgccttcttaactatttatcacttttgctcacgttgcatgcttcactagtcagcctctcctctctccttcctctctctctctctctccagtccggcgtgctccgccgctgctccacctacttcactgccgctccgcgctcctctatcgtgcaaggagctcgtccgccgctcgttgctctgccttctccactgttgccctcctcctcctccaccgccgccgttgccactctgcctcctccaccgcagcaaggagtccgtccgccgctgcttcatctcttccatcgccattctgcctcctccgccgctccgcctcgtctaccgctgcgaggagtccgttcgccgctgttccgcctcctccaccaccgctctatctcctccaccatcgtgaggagcctttccgctgccgcgtcggttgtaggccagctcggagatagaagctcttctctggttgttttccatgacaaccgccgtgacaacattgttcatttccccagctgcacaagttcttgctgtcatcgcatgctagaccgaaggaagagaggaagaggagaggagaggctgactagtgggtcccacattggtttctaccctgcattgctacgttggcatgccacgtgggcaaaagtggcaaatagttaagaaggcatctcttaaagcggcgaaaaaatatacaaacctaagaggggcatttgaataattaccgaacctaatagtggcaaatagttaaatttcccagctttcattgttgagtattcagtcactctaaacgatttatattaatcgtggtagttatttgtgttcttaattttattagattgtaagtagtcttcttcctacattttttttattgaagtgatctctgtaactaagttgctacgattggtaatagttaagtgcaaggacagatccagttcatcggtatcattggtgtcatcatatgccaatctcacttaatacatagttttatcttcattggcttagcaatttatcaatagatttctctagaggtcatcgaggtcatatgaccacgatgaatacactgtatctctgcccctgattatgtctaacatcctaccaaaacattatcatacaatggtgaaagtggaacacaatatgcataatcacattgcttttaatttgttctcagccatttaagaagaggaagtttcgtccatccgttcttcccacacccaccataaatctgtaaccccctctctcctaggaaaactaaaaaaacacacattaactccgtgcatgacaaattatcaaaactaactttctaaaaggaaaacaagtaaaaagcaatcaaaaaccctagcaaaacaagttacacatgttccacttttgtaccactcttggcccctagtgtaggcagccctttgacaagtcacgtgccacctcatcaccatcttctttttatgacttaacccttcttcttataactacatatgcatgaatgcatgataagcaaccaacatgatctattttgtggttatgtaggaatacaatataacaatatatgaatatatattaactagagtagtgactttagatgtgaagcattacaaaagcaatggcattcttcaagaatgacttaacccttcttctttttctcgcttaagaacgataagctctttcctcctgcttaaggtgtttgtaatataatttgttttacctttttaatataatttatttactttgggggcttcccctagaatgctttccctcaaaaaaaaaaagcaatggcaacaacagttgatcattctttcttccttaatattacaaatttccttgttacagtgttaaaacagatgatacaattttagattaacaaaaaggaaattctcctcaatgtttttaagtaagtataattatgccacttatgaagttcgtggttatcatttcgtctccataggaaaggtttctaaaatttaatctttcatgatatatttggttcagttaatgtagtggagtgaatgcaaaataattaaagaactcaaataatttacttcatttataaatatcttctatgggttcccatacagcaaatatcaattaaatgtgctgctccatatcagtacattcatttatacataaaagatatagtaatgaaaatcttatagtatgatattattctacataagatgtttcattctatttaagcatgtcgatgcttggcagaggaacaaaactaatatttcgtcctacttttgaaatggagaaaggtagtataaaaattgcgatgctttatgtttatcttgttagtgtgataataggcggttgtttcacctatattaatgaggtaaaatgatattgacttaatttgttaagctcaatgcgttaaattctatgataataatggaaattgagtgaaacatggcgtacaagcatgtctagtttatattggtgtgtagaaaatatagattggatgaacattagcgacggtttcgtgttaattaattagcgcaacaatgcgcgagagtacatatatatgcgtatagaaacagatcacccgggatcctaaatacaaggaataacaacttatctctaatctaccgggaatccataaccatatgcataagataagattacaattagttgtagtttctaacactccccctcaatctaaacttcggatgttgagattgt

SEQ ID NO: 58758 - DNA, 1125 bp, Oryza sativa
acgtgggacagaggtagtacgcacttcattttagcaaggacccacgatttgtatattctctggagaaaaggatattttccctggatgcgtcgcttttggtaattgcagaattgttgggaaaagagtacagtgacagcagtaaaagcagccaggcagacttcaggtctttggattcgtctgcagtcgacgtgtcactgcacttacagatagtctgtaatatcttcggtcactatccattgagtccattccattgaacggattgttagcttaactggaaggagtccaaaccgggtagacggacaagggccgggtaggggaagatgaaagggctgtttgattgagtactttaaattacttaatatttttttattttttaagaaagatatattttacacctctacatccaacccaatccaaaattcgctatttaagatttaaacttaaaatctttgggtgctacttagatcactgtaaccactaaagtattacatgtccttttacttgtcatgattcttttaagctaacttatcaaagatgtggttaatcttacctagtgaaaagtaaatttcaaaatgctattaggatgagccacatcatcagataaacaataaccattgaatcgagaaaaagacaaaatagagagaagctaaagagttcagccattgattatagagggaaaaaaagacgatgaactaccgaagcattccagcaattcagaaatgagagagagaaagagcaaacaagaaaagtagctttgtaagagagtgggggcgttggctggcgtatggcatgtgatataattttgcactatacgcactcaataaaaattattttacaaataatcattcaaaattatttatatatatggatatacaattcttacaaccgactaatttccaaatactactggaactttaatgcacaaaatttatttttaccataaacttttcaataatttttctatgaatttaatggtttaactttggtaacctttttaaggtaaaaggttataaggtggccttaaaaatgagtggttcatttacctatatgccctaattcttgcaagtcatgggtgatcaattacactttttccagcacatacttaaagaataaacattggttact

SEQ ID NO: 58759 - DNA, 6209 bp, Oryza sativa
gactactatagggcgaattcgagctcggtacccccactagtaggcatcttcatcttcttcccagctgccttgtctgtcaccgactgattattttgctgccatggctacacaactttatcgctgggcgccttcatcttcattgctggctgacctgactgctgccgactggtttctttgccttcacggtagtgcaacttcatcacttttgattggtatcactatcttcactaccaccaatatttttgccacttctggtggacaatattatctctatattggtcgtcttgtctctatgccaactacgtcagctactatcaatggaccattgtaactacgacagaaggacaagctatatgatcaggggcttactaactcaaacacaagtatcataccttcaatttggacttattccggatacatgcaacatgaatttatgatcacgagtctattttctatgctaaaagactggactatttattattccccataagggttatcaaccgaatacttgcgccagtcgggattcaattattatatctattttggagcatcccataagggataatcacttagatcagaaactattgatatgagctacacttggtctatatcaccccgaagatttactactcggagcatgttatatgcgtcatcctttaaagggtgtcgaaggcatattttttggcctaggcctaatatgtttgcagcccatattttcaggtgtggcctgtcacgttcttttagggacttaggcatctttttgcttaggcaaaagtgcgcgtgattatgtgcccaataccttaaaatccttttataccacagttactcaactttttaggagttggtacaatgcattttaaaaggtgccaaacagtaatgctttatatagctgcccgctgaatttttttatataagtcaaggcgttgtttggattcataaagcaattgattggatacaatatcattgctttttgccacgtaagtgtgcacttttattgaccaatattatggcttaggctgattatatattttggtcattttctaggcggttagtaaatcctttatgagtttatttactcggattttataccacatatgccatatatttctaggtgtggtggaaccatgtgtcttctagggacttaagcacatctgttaaaacagtgtgcgcatggcgtatgcccaatactttggaaatttctttattcacaacatacaagcttctttatagctgttttgctatgtgaattttcaatgatgtagctaactttaggttacacttatcatatcttacaaagcagtcggtatatcactcggatcatgttatttagggattcacaccgcatatgctacatgttaatatcaagtcgcttgtttgactataattatcaaaaccactcggttggttggattatttattccttgactatatgcttggtttgttcaattaaccacatagtcggggctacacctattaggtgcatttagtcgatgcacctgactttatttttcagccctccacagtcttcatatttggtaaaagtactcgggagaccatggcgaagatgattgaagcactcggttttggggtaatctagttcgagagaagattatcttttcgactgtgaaggtctcaggggctactgtggagattatgggtaccccatacccacacggcgtggttatctgactagttataggggataacttatatctatggaatatgtaacagatcatgacttgggtattacgtttcctttatattacggaacggtctaaagtcctagtttaataatattgtaaagtagatttaggaaaccgataccatattggttaaggtttctatcatgtaatcctgccccccatcctatataaggtgggcaggagtccctctaggggtatgagacaatctgatcgtcagataataaacacccggtggattcaattccccaaacaggaatagggtattacctctcattgagagggtctgaacctgtctaaatccctgtctctgcatccatccacttttaggtctcgtacgctacctccttttcatattgccgaaaatttgtttcgacaaaaacacaatcagtaatctttttcagcaaaaggtcatcggcagttttgatgcactgcacagagctaaaagtcgttgaaactactcctctgtaccagatatctaaccaaaatcttttatattttagatcggatggagtatattggcataccgtgtgcccatggcttcgtttcaccggcctttcgtggaaggatagtgtgatcgctgccatttttgcattttgcagttgcaacgtcggtctcacagtcgtcccgctatatcgttgttgacgttgctggatgactactatagctacatccatctgtgcagagtaattggtaatttaaatgcctactatatattataacgcacaaacctctaaagtttggtggacgtgaacatgtttacacctgataattaccgtgttaatacgacctcagtagacaacaacttaaacaaaaaaaaagattatgataatagtgaaaacctagaaggtacaatcgaaaccttcgtatttgttgacacttgagcaatttctccactcctaaatactccctctatctacttttgatagttatatttctaaatctgaaaattttatttttgataggcatatttcaatccaacaacctatcatcttaatgactttctcggatttaatgcgtgactctttattcttccacacaagatttgctacatgggtatcgagaaatgtaaatattaatgaatcgcttgtttacgagaaataactagtcgcatatttaaatagatgataagtagaattacttatccttggtctgtgtgccaagatgaaatatgacttttaaaaatagatggagggagtatatctccacctatatagactaaaaaggagaaaaagaaagaaagaaaagaaacccatttcgattcccaaaattttcccatggaccatggttcaattcgtggcaacttaaccatgaagataggaaacatggaagggctactattattatactcaccgtggatcgaccataaaatccacggagagcgggagagcgcaggggttgtctcgcgctagcgcactcccatctcctcgtctcacctcatcttctcggcgctaataaaaagggaccctgagacttctccgtctcaggtcaaggcgacccgacgacgtgacgagagaatctctcctctctctctctctcgctctcgcgtgaggaatcctcgtccgtcccggtcccacgctctctcgctcgctcgctgacgtgcgggacccaccggtgctgctccgccagtccgcgtgccatccgcgggagccgcgaccgcgaccgcgaccgcgaccgctggcttccaccccaagccccccctccccaacccgtaaacccctccagcagcagaggcctttgcagttgcttcgccttctccatctctctgcttcttttgtttgtttttctttcccatctactccgctcctccgccgttgcctccccggctcgccgtcaccgggagacgcgaggtgaattccgctcatctccagtcccttctcttattttcttgcgatgatcttgcggtgttgcagaaaatagtttaaaacctgcgcctgttttcatctcatcctcctctcttgtggtttcttgatgagcgcaggcattgcttcttctcccatgcgccgccgcaatctcatctctctgttttttttttctgttttctgtttgcaaggtcctgacctttttcaaaggcgcgaaagattgtgtttttcatcgtcttggggggtgtcttctgtgatgtgctttcaagaaaccctcttctggtttcttgctccacggcggcggtttgagtctccgtctcactgataatccgatttggagcgcgattgcgattttggaggggtgaatgggtgcggccggggctgttgttgagatcagttcggacgacgaggcgattcctgttgctgccaagcgtcccaacgttcctcccgtgtcgtcttcacatcctctacctgaagactgcaacggagttgaggagggtttaggtgatcctgctgccttggtggaattcgtggcatctatgctggatgacaaaaggtctgcgcgtgatgtggctgctgctgatgatggggacgacgacgattgcgtgatgctagatggtgaccctgataaagcggtcctcgttgtcaatgagcagagacctgggcaaggtggcccagaggaagaactgcagatagtttcagagaaaggagaggtaccagtactttcttgcttatttccatttaatttttctagttgcacttcagaccgtacattgtcttcgtggtggtaagtcaattcaaggcctgtttagatccatttggaatggcaaatggcaaatgttttggcattgcaaaagtactagttggtgtttagatgcatgttaaagttttgccattctagcactaaagtgagagagagaaagagagagggagtggtcccaaagcactttttggcacaatttgctactatggactagcaaatgccaaatgccaaattgccaacttttgctactagtgtttagatccaaaatggcaaaaagtgctataaaatggcaaaacttttgccattttggaggatctaaacaaggcctcaaattgaaattttcaactagtatatgcataaccatcgttgtcttatggggtgtttgggagagaggggctaaacccctttgtcgactagctattgacatggcgggtcctaatctctattaacatcttggactcgtcgaatgtagctaatctatgcacaactgtggttcatttatgtaggagtttatttaaggttaagtcaaactttatttgttagcacaaattaatttcaatgttttagatcttggttttgttaaaacctcttcttttataaacatcaaatctgcatgatcgtatatcctgttgttaatcacttgtgcaacactcttattgatttatctggtccgttttattgaatttgtatgcataccaaactcatactgaagatggagcttttgtggaaggtagtactatagttgagtgatcgttttgccttgctgatgtatatcattgggggccttgtctgagtttccatgcacttattatattgtaactaagatggctgcaagtggtgtccatattactatatagtggtctctaactggacaatattgtactttcatgtcagatctttttgtcctgggtattggtcttcgaaacatattatattgttcttgtagaagctaactgatgaattatcaataacatgaaaacctaacttagaactgattaatcgttcctaacccaaggagttgctgatgctgcagtcattgctatggcaatatatgctttcctttcatcatctctatcgaatgttatactttcttagcattcttgattcatctaaaagctcagatgttacaggagagtatatgtaacctgacaatttccccccttttccttttttcagatagcatgcagggatttccctcatccacgccatctatgtgttagcatgccattcacaagttctcatgcagatcattgtgccatggtcagtaatcaatccctaccctcttcatattatgaaatgatatttcttggttcatataaaagtatatagtcaatagtacttactccgtttgtattttaatgtatgacaccgatgactttttgaacaacctttaaccatttgtcttattcaaaatttttgtgcaaatataaaaatatttatgtcatgcttaaagaatatttaatgataaatcaagtcacaattaaacaaatgataatcacatagtaatttttttaaataagacaaatggtcaaacgtatctcaaaaagtcaacggggtcatacattaaaatacggagggaatagtacatattacttacagttccatcactgatgcattggcatgaccttgcttatttcttcttccaaatataaatgcagtgccactgttatgtttgcgactctcctgctccctgtgccttttggggcaaaggtacagagcctactgatcattgtcatgctacggacaagaatgcaaaatggacgaaaatgaggcagtcattgaagcgcaaaaacctgccatcatctaaccgtagaggtatcaagaatcattttcagccaatctcagcaacagcatccttgcagttgcagcaatatacaggggatc

SEQ ID NO: 58760 - DNA, 1041 bp, Oryza sativa
gccacggggtggcgtggtattccccgggagaggttgtgtggcacacgttacacgtgtgatgggcatatattaaaatttccgttctggctgtcctactgttctagcagcagtatgggaagcctggttggatgatacaaatttacacacaccaccgtctttagctgtttctttcaactaaatgttgctgttgtttcctttgtgtatgttttggtgaatgtttctgcattttgagtccatttctctatataccacttgccttgcctgctatgactatctgaattttctgtttttgattcatttagcatatacctttctgccttaaatcataggtgcttatcgattttagaatggaacatcaaatattgagtattgaacatcaaatagggctcgctacttgatgtggcaacttcacattgaagactctgttttctgtcatcaggtcggtaaccgcatcatcaggaagaggatccatgtccgtgtggagcatgtccagccatccaggtgcaccgaggagctccgcctgaggaaaatcaagaacgatcagctcaaggctgatgccaaggcccgtggtgaggttatcagcaccaagagacagcccgagggacccaaacctggtttcatggttgagggtgctacgctggagactgttacccccattccgtatgatgtggtcaatgatctcaagggtggttactagaatgcttgtttcttgaactggagaatccaattagcgtctatgcttatcggaatgttttggtactgattagccctttttgttgtctggaatctgaacctctatgtggttaacattaaagatttgctatggttgaattcatcctcgttatggtattgcctaattcgcgatattgtcttgttcgctgttgattcgattcagaattgcggcgaatgatgccatgccattttgcatttcaaggctccatttgctcgtagttagtaatgccctgaataatggtgaaaatgtttgtagtgatggtctgatggatcaacccactttttgaatggaaaaacgttctgatcact

SEQ ID NO: 58761 - DNA, 569 bp, Oryza sativa
ctccagacatttccgtcgcgactttacacgaaagaatattcccaaatacagaaaatgtgtcatagagagctttgttatctattgacttgtcaagattctgttaacaacataaactgatgtcaaaagagatattctttgttggctatctatgaaatgaatacataatatgaatgtgctaccttaataaatatgtttgctgctccacttttacgtgagctggggtcacggttagaatacattatcctgataggcttcccgttaataggagtgaagttcagcatttccaatgcccttgcagctgcaacagattttaaagtaagaaaagaagcaagttgcaattctagtttgataaacaatcagaacttgtttgccaaattaatgtacatcatgtgattgaaatatattatcagaagcagaacacatatctaacttaacagttacagaagagcaaactctcacaagaacttcagaggcaaatgacaagccatgcttacaaaattttggaaccaattaaaagtaacttgattatgtcgaatactatggaaggacctttcacatcaacgatcccc

SEQ ID NO: 58762 - DNA, 5768 bp, Oryza sativa
tggatcgattggtggcaatgggcatgcatgcacggggctcaagtagatgcagacacacgggagcttccaagagatgtgcacatgcatgtcgcatatatgcagggttcttcagctagctgtacatcagtggctgcaagctgctatagctgctgctgcacttgcatactactacagctgctacacctaagcactagcagagcgaggcatatgcggcgagtcagtctgctgcatactacaactctgatttctgatcgatctacctatatgtccttcttatattcagctcgaattattagtgtactgtacttcatatctttcataattgacgaactcgatcgatcgatcgagatcgaccgatccatcgtccatcgttcatctctgcaatagtctctgcaaagccgcatgcatgacctagctagctagcaggttaattagctaggtttggtacatttgtgctatgcatggtcctcctcctcctccatctgacagtgtacgtgaatgttgccagatcacaacacaagatccaattcagagttagaatccggacagtactgcacatatacgaaacatatcccgtcttccatgcgtgatcgatccattgattttgatcgtaaatttgaagttagttagtactcgtaaacgtgaaggcaaaggtattcaactaattagcaaaatggcttaattaagcatcacatcgatcgtatctatctctctcctttgctaattactgatatatcacgcgaagtgcacgaaaggaacgggagtgatctaaatgctgacaaaatcatggcattgcatcgacagtgtgatcatgatgtcagtgtatattatgcgtgtaattacttgattaattaattgcttgattgatttaatattccttgatgcttctttcgttttgtcggctagcttgtccctttctctttttagcgcaaattacggcctcttgctttgctagctgtttgcatttgtgagaagttctgtaattaatattgctcttactaattatgtactacgcgacactgccattaattcttcaaatgttcataccgagtatgattaattagactggattttatcccttatagaccgtatcctacgcacaatgcaaacagattaattattactcctaaattacatgaatggatcatgtgtagaggcttaacacagtaaacgaattgtcgcatctattcgaagagcattgagcgtgcattagtagtgcaatgatatgtaggtaatggtatctagctaggctttgaaagaaccatcaaaagataattataaattattagtaagagacactaaaccttccaaatccaaccatctattcgtccctaattaacctatacctacctacctagcttctagactctaattactgttgtaagatttcattcaccacacaaaatcttgtgcatgaatcatgatagcgacgaattctaattataattatatatcccagctaatacagtgcttaatctgcaaggaagatgcatgcacacgtcttactgaaatttggtgatagatgatgcatgtcatctatctcgtcgtcttctctgaacaataatccaactgctcctctcctcctttttttttcacgaagaaattattaacagtctgaagattttgcgtggttgatcaaccggacagtagtgtgttcagtttcgtcagacacactaaggggatgtttggatcctgccagattggatgtttgacactaattaaaagtattaaatatagactaatgtcaaaacctattccataacgcgttcgcgaaaaaaacctattccataactctagactaattcaagagacgaatctatttagcctaaataatccatgattagtatatgtgatgctacattaaacatgtgctagttataaattaattaagcttaaaaaaattatctcgcaaatttatgcaattagttttattagtagtctatgtttaatacttctaattagtgtcaaacatccgatgtgacatttagtccatgtatccaaacatcacctgagaaatcaagatgatgttaatttcaatcatctcatgatctcgagagagatatgatcgaatcgatggatggtatggatcaaggtgtccctgtcccaatgatcgattcatatatatattattacggttgcttctgatgatcatatgttgactatatgggctagtaaagatagcatccgaccaacttcaatggttgccaattcgtaacgacaagcttaggttgatccatagccatggtaggctcctgtgcaatgcaagagatgagcaagcaactttgtcccccagacatctgggccctaccaccaatatatacatatcagtcacattgacctatagctgcaaaaagaaactgaatatttattatatgtgttcacagtactctcatgagctaaccatatgcaactgctaaaacttaggtatttaataatacatatataatctgaagtagttaattactgccaatttgactgaaagaaaattagtaaagtggagagccccatacaagaagaagattagtgcgagatcaagtgattaacacttttaatttaaagggctttttttttattatcttggagaggcccaagcacctttgacgaggcccttttagctgaaagtccggtgcgtctgattgagcccagagcccagtcttagtctcagctggtgccggccgcctttaaatctttattatttaattaatcaccttgtgatgatgatgatcaccatgatgattatgattccttaatacgaccccatgattagcaatgccatatgcttagcacatgaacttgaaaagtaggcggccaaaagccgctgttaatttgtctcttctactttgcatttcttaatttccatgttgaacaggcgactgaaagtacgtacagaaaatttaataccttaatttagtcgaggataacattgttaattacagcaattatctccttggctgtgtagtgcactaacctgcggtgattacatttttaaacgaatatacattgaaaatgtgaaattttcgtgtaaattcaaggtgatgtttatatagaattttcgtccaaattctggtgatgcttatagctttccgtggtactgaaatcgaaaaaagaaatgcagtagctagcatggacgctgtccagcgattattaatgggccagagttaagcccaaataaggcccacacatggtttcaccgtggtatgggcccacgtgcaacgaaggaggcggagcgggccaccttggttgcgcgacaaatcggcccacggaagttaactctatcgggatgagcgggctttcacccagagtgggctactgagcagtaattgttgggctgtccagcccaaacaacagccaacaacggcgatctcctcgccctcaccggcgccggcgagggcgagcttgctgattggccacggaggtaatcttttttttttcctcaaaatcgcaaaagaattgtgcgccatttcattaagaagagaacataggaggtaaaaacctccccaaagagccaaagaaaaaacacacaaataaagagaaaaaaacaacaaaacacaccaagatgacacaagaccaacaacaaaatcccaacaaaacggactaagcgatataccacaggtgtaaataattactcggacagcagcagccagtagcccattaatgtatttgagctgtatacataataattaatcctttgagctaggtaactctctgatcagtagcttgatagtcaaagctaataaagcaagcgtggcaaataagtgtgaaattatccaagcacagttgcacaccacgcatacataatacaacatcatcagtaactggtacaaaatgtcaagagacaacacacggtttaaccgctggatcatagccacatcaagtggtttggtaaatgaaatgaagttcttgcgttgatcgataataatgcatgcgcatgcaggtaagtaacacgagcactgcaatttattcgtcggcttgttatctagatcgagcgatgatacggtgtccggcggccggccggccggcgacgagcaggccgccggcggcggcggcggcggcggcgatgatatatcaaccgaggcgcaggtcgtggttgccgccgtaggccatgccgtgcaggttgggctggctgggcaccacgcggaaggcgaacatgtccgccgccgcgccggcgccggcgccgccgtcccacccgccgccggtgttgtccacgaacccgaacgccggctcctcgcgcaacccctgaattaattcaaacattcatccaacagtagagttcaatcaaattagctagcctgcattggagaaactaattaacaaataattttctggctataactgaaaaaaaaatgcttgataggttaccagctcctgctgcagagtctcgtacgcctcgtaggagtgcttcacctgcattatatgcatgcacacaccggatcaattaatgtagaaaccaatctctattagctatagacagacaaattatatcatgtgcatgcatgtatagacacagggtccagcatatgtgtgcaagtaaaagtagagtgtcactgcaatgtgtatatatacatgtttgcatcttcggacagcatgctatagcacacaagaaacaatcgtcaagtttatttctatgaacagtcactcacataaaatttaagcaagttatcctctcccatatcacaatgacaaagatatatatacagattcaaagtcatcttctagctagctccatatcaaagtgcagttctttgttcagagtttatacactactctctgtcagctctctcacgtaacaagaccaaaggagtagctaatgcagcgaaattaaacacttgaaggtgattgtgaatttgtgatgtgctagcttatactatatgccaacatgcatgcttgaactggttaattttcacctcagccgacaacacagttagatatgcatgaatggttaacaatcccctcgatgcaatgaattacttattcagctacatatatatatatatatatatatatatatatatatatatatatatatatgtttaattctgaccagctaaccgcaggtaaaactacaaaacaatgaacaaagagtactccctattaaagtcgattgaatgtaaagtcaaaagtattcgcttttgctcggttgttcaagctgagtaattaattagtagtacaccccactaaagattcagtaagccagcggccgtaatggtttggtttccaaattcttgcaaatcataaagcctcaatgccgtcccttatctaccaaaaggtatcacgccgcgatgcaatctctcataaaaatccgtgtttgacatgctactctcctaaatagccgggggaccaaaataagcatgcatgcttcatcgtctctaggtacagctagtttatatagctaccgatcctggcttagttgtttgcttaacaggagatacatatacgcatatatatgcagatacatgcccaattcatactactgtcctttgctgtttgtcatgagttctagcttgcaaaaaagacagagaaaactgcatcgcagatcgcattatattgcgtgcgttgttcatcatgtaatgtataggaatgcacatgacaatgcatgctccaattaacatcgatgtacatctactgatggctatgtgtatagcttagactagatgtgtagatcaggtagcctcgatcaaatatattgatgtgtagatagtatggaaatgcacagacacgcatggtaatgcacactgtacattagcgatgcatgtttcggttgagaggcg

SEQ ID NO: 58763 - DNA, 613 bp, Oryza sativa
tttgttaattgaagcatcaactcctttacaaaagaattgcgaaacaaaacttgctttatgctgaaaatgaactacatattgccttcctttgatatgccttacatgtagtatggtaggattgactggtgcttgccaatacattaacttgtttaatgtactgactcttgctgttgatataaccttttgtttgcgggtttagacttagtctttgagtgatgcgggtcccgattgcttcttctaggatgagaacttaatggggtaaacccctagtcggtgtgcttgtgattgggtaatcaagcttccgttgttctctaataagtctatttggccggtcggcctatgtaattattaagttgttgtaagtcttaagtttctttcatcttagttgtgtttgctatgtataatcatgcttaagatgaaagtgtgaatctagtgcacatcctgggaactagattcacatgagtatgagttaggaatatttgagaggttgtagatctttagccatttttgtcaagtctcctgaatgtgtaacacatctggtcgctgccttcgagtggtttgacgggcacatctcaggctgaagttgactggcaggctaagggctcagcaatgt

SEQ ID NO: 58764 - DNA, 18217 bp, Oryza sativa
  unsure (1)..(18217): unsure at all n locations
caacctcgcaggttcagaaatggctattctacatgcttgctgtaacagttactgatcgatcgacgtgatgggcgacctgtgaatctgtgatgcctttgctacggaggagaggggatgggcagctcagttccataaatgcaacggcgacgaggacgacacggtcaatcatgcgccattggacacaagtggaaacactcgctgcaactttctagtccaggcaccacttaatgcccacatactatcacttccagcactttgtatgtgacttgtcattgcacaaactacaggggtgagtgacaagagacctgtttccatctaggagtacctccttttcttttattaccagcagcaacgatacttttttttttctcttctctttcgtgtaggtttactccaatactcaatgggcattcatatgcttccattgactaaggtaggagtgcatacatatgtgatccaaaagaatacatattgttggaaattttgggctatatattttggtcaacgatgcttacatgcacaaaggtttctagcttgcattccttgattcatgccaagtatcatagcaattactacatcaagtaaaaaattctccagaaaagaaaaattccaatacatatagagaactttttacaatccttgaggggagacatagaccaaatcgtggccgtctattgagcatcatcaaatggctgagaatcatttcgtatctagtagcgtcggtgcctatcccaccgggtaccaagcctntcgacaccctataaaggttatgattaattttcttttcgcaccacccactccatgttcctccaatgcattcgtccttaacatccttccccgacgtatcgccgctgtcacctagcggccatagcgatgagcttagtgcggtggatgcagcaatggaccggctcgatgaccttttgatctcctccaacccggtactagcaccacagacacgacgaccataggggcgggtgacagaggccagcgtaaatctcttagagatattggatgccatggagaccgagcgaaaactagatagggaagatatatcaagccaaagttatgaccatatataatatcatgacataatagttcaacggttagatttgaatggtaactatactcaataccttaattacctggtggtacctccttaataatggtaaaaatcatcttatatatattgctatattgttacccgaacaactcatgtacaatcttataccaaactacccttgaagaagaaactagctactgccgtgcacaatattaccaagcaactccctaagaaacaacccatcccatagtgcaaaaactttataaaagtagcagtagccaagccacagtgcgccttaatttacactaggcaggagggcactatatgcacacccacctaccgtgcaatgctttcacctgctagccacatacatttcaggtatgacgctgatgtgcctttccaacggttgtacgagattgagacgttacagtacacatcctgcaattacactgtactcctacctgctgatgactttgtgttactgagtatatactttggttcagagatgactctttcaaaatggtttttttccctggtccttgaaagtacttattgagatgtcatcctcatattgtatatgtatttgtatcaaacatcaaagttattcagattccatcaccatcttgtctcatcagaattacatatgcatatacatttcctcaccaatctattgatgtggaggagatataatataagtgaaagagtaaaatataataaaaatattctagttgattagggttagagcattcgttatttaaatcattgcaaggcttaactgttgtatttatccttaaaaactcatcgaagtaatattgttactctgtctcttaaaagactataatttagtgtttagaatttatcccacaaagaaagtttttttagagtggagttttttttatgcaaaaggtggagagtttaccttgtaaccattggtggtcaagagttacaaggccaaatggccgaaacacagcggaaaacagaaaagagtgatatagaacacaaagaaagaaaaggaggcaaaaaaaaaaaaagggaaagaaagcgaaaaaggaaaacatggtgatcatcgtgtgggctaatccatctttatcgcccaacaacagatttgcgcatgaatatttggcttgacaagatgctaccagagctcaacacaatctttgatttgatgaggaggtgtacaatgttcgtatttccctccctgaatgtcatagcatttcgtgctttaatttcaaagattgtgtgagcatgctgcaaagcagagccaagttcactagacttctttgatattattttaatattatttaaaagttttcttctcattttagccgctgaaccagtgtgcatatccctcttattttatctccgcattttataaagagctagattactagtattttaactttgtgcttaatctatcttcgacgagctagaatgataatagttctttaaggatggagggagttgtaataaatttgttagcacaatataatactctcgattataagtcgtttttactctggacaaagtcaaactgctttaaatttgactaagtttgtagaaaaatagtaatattttcaggacaagcctaccgctcgggcgaccgatttacgtgcaaaactactctaaactgatttttctcctaaattaattatccaaatcatgatccgattgcaccattaaattcgttgcaattaaatcttcaaaacaagaccacacattgatatattccgacaaaaaaaattagcttattattgaattatttttaaatgttgcacgatgttccaccaggcatatcgggaatgtttcactaagtagatcgaaaatgtttcactcgtttaaatcgggtgttgtttcaccttatataaaaacaatgtttcagcaaatagcgaaagaatgtttcagttccctgcaacattagatctatatatagtgaaacattgtgagtacactatgcgaaacatttttggtggaacaaaaaataaactaaattcccttaatagagagtttccaaaatatgttgattttttgttgcaaaagaatattttaattcactgcaacattagatctataaatagtgaaacattgtaagtatactaagtgaaacatcttttgtggaaaaaagggagagagaagtaggtgggtccagcatatacggacgtgggggaggggcggtcgctcggagtagagtattatcgatattttcaactcaagacaaatatattatggaaatatattgaactatagatttaataaaactaacttggtgttataaacattattatatttatccacaaatttaattaaatttgaagtagtttaactttgaccaaagttaaaattaacgacttttaatttgaaacggattgagtagctagttaaacaaaaggaaatagtgaagagaagacgaaatggttgagaaaattagagaggaatgtcaaggagagacgacgacgcttctcctttgtccccccgattctcaagcaccccatgcaacgcaacccgccggcgagttgaggccccacgaccaccggccaggcgtggccccacatgtcatcctcacacccggacgcgcccccgcctcgccgggatcaccccacgctcccgggagctctgcgcatggcgcgccacgtcacccaccaacacaaagcctaaacccgcgccctcccgcactttactcgtccttgtccgatcaatggcggggcttggccggagctcgcgcggcgcctccgggaagcgcggcgccgcgtcctcctcctcctcctcgtcggtgtcctcctcctccgccgccgcctccgcgtgcgtctactacgccaccacggccgtgctcgtcacgctctgcgtcgccggcgcctacttcctcacgtccgcctcgtcggcgtcgcttgcgggctctgtcgtcgatggcgacggcggcggcggcggcggcggcggcggcaccgtcacgacgacgtaccggcacaccacgcgctcgtcgttcgcgtacgaggtcagtaggcccgagaggaaggcgcccccggcgccgccgcgcgatgtcgagcgggtcgatgacgcggcggcggcgcgggggagaatcgctgacgaggagggcgccgaggaggagcacggcgatggcgacgacgacccgcgtgggaagcccgatcttgatgaccatggcgccgacgaggaggagaccaagagcgccgtcgcggccatggacgacgcccagcgacgcgaggaggatggcagcgtgtcatccagcgaggccaacgccgaagaggaggaggcggcggcgacgactggagcgcgccgcgtccgcgtcggggaggacgaggaagaagccgcgcgagaagagagccaagagctgcacctgcagatgccgctaggagagtctcgccctcgcgccgccgccgccgtggaggagaagagcttggacggcggcgtcgaggaggagagcaacgccgggcagcggcagcgcgaggaggagcagatcgatcatggcgtcgacggcggcgcgagcttgcgccgtgaagcgcaggaggaagggcagatcggtgaagggtacgtgatggcggatcacggcgaaggcgaggagatgctgctcgagcagcagcagcagcaaccggaggaggagcgtggcggcgatgcagaggcggcgcgcacgtcggagtccgacgccggcggcgaggtcgacccggaggacaagccaaccgtgtcagagcggacggaggagatggtcgacacgctccccggcgaggaagaccgcgcggaggtgtccgccaccggcgtcgacgagcagaacgcgtgggcgacgcaagccgatcactcccaccaggagaaagaccggcgcgacgaggcggctggcgtcgacgacaacatcgccgacgccaccgccggcggcggcggcggcggcgaggagccggagtggcggctgtgcaacgtgaaggccgggccggactacatcccatgcctggacaacgacaaggccatcaagaagctgcggccggagaactaccggcggtacgagcaccgcgagcggcattgccccgacgagggcccgacgtgcctcgtccccctccccgccggctaccgccgccccatcgagtggcccaagagccgagacagggtatgcacgccacctgttcgatcgccatccattgcttaattacacattttgctgctgcttcgtgtcatgtcaatggcggcggcgtgcaggtttggtacagcaatgtgccgcacacgaagctggtggaggtgaaggggcaccagaactgggtgaaggtgagcgggcagtatctgacgttccccggcggcgggacgcagttcatccatggcgcgctgcactacatcgacttcctgcagcagtcggcgcgggggatcgcttgggggaagcggacgcgggtggtgctcgacgtcggctgcggcgtggcgagcttcggcggctacctgttcgaccgcgacgtggtggccatgtcgttcgcgcccaaggacgagcacgaggcgcaggtgcagatggcgctggagcgcggcatcccggccatctccgccgtcatggggtccaagcgcctccccttccccagcaaggtgttcgacctcgtccactgcgcgcggtgccgcgtcccgtggcacgccgacggcggcgccctcctcctcgagctcaaccgcgtcctccgacccggcggcttcttcgtctggtcggcgacgcccgtgtaccagaagctcaccgaggacgtccagatctggaaggccatgaccgcgctcaccaagtccatgtgctgggagctcgtcgccatcaagaaggaccgcctcaacggcatcggcgccgccttctaccgcaagccgacctccaacgagtgctacgagacgcggcggcggcagcagcctccgatgtgcagcgacgacgacgacgccgacgtcgcgtggtacatccgcctcaacgcctgcatgcaccgcgtccccgtcgccccgtccgaccgcggcgtcgcgtggccggcggagtggccgcggcggctgcgcgcgccgccgcactggctcaacgcctcccgcgccggcgtgtacggcaagccggcgccggaggacttcgccgtggactacgaccactggcgccgcgtcgtcgacaggtcgtacctcaacggcctcggcatcgactggtccagggtcaggaacgtcatggacatgagagccacctacggagggtaggtcacaccatcgccattgctgactttggtcaaactgttttatatttgactaaatttatagaaaaaaatattttcaatctaaaataaatttattataaaaatatatttaattattgatttaataaaactaacttaatattataaatattactatatttgactataaacttacttagaatagtttaattttaaccaaagttaaaacgtcttataacttataacttgaaatataacttgaaaggctcaaacggtggtagtacttaccacgaagaagaagactatgctgacctctccttgtcaggttcgcggcggccatgagagaccacaagatctgggtgatgaacgtcgtcaatgtcgacgcggcggacacgctgccgatcatcttcgagcgagggctgatcgggatgtaccatgactggtgcgagtcattcagcacctacccgaggacatacgacctcctgcacgccgaccgcctcttctccaagatcaaggagaggtcagccgccattgatgctcccttcgatcgatcttctcctatctttgctttcgccttcgccatggccggcgatcgatcgagaaatgttttttggtatctttgtgttcaggtgcgccgtgctgccggtggtggtggaggtggacaggatcgtgaggccggggggcagcatcgtcgtgcgcgacgactccggcgccgtcggcgaggtggagaggctgctgaggtcgctccactgggacgtgcggctcaccttctccaagaacggcgaggcgctgctctacgccgagaagtcggattggcggccggagttgctcgccgacccgttgtgatgatctccagcgaccggcgcgcggcgtggccatctcatctcaggatggcaaagcagcactccccaacacaagattagatagaactcttctcctcttttcttttcttctttttttttgtcttttttttgtctgcttctttgattggtagcacttgacatagttctgtagtggttattatcctacaaacacaaataatgcagccatcagcaacaacaatggtagtatatgcatggttttgtcactgttctagtatagtatgtgtaccttctgagcactaacacaaaagtacagaactgagatgtctgatggcttgggctctgttggtagtttcatcagttttatcccatattcttaatttgtatatttcaaacaattccacgtattagaatttatatgacatgatcaaacgaaactggtgtaaaaatgaacatgattgtagtggcaaccatagacaagatcacagatgacaatttcaagtaaaaatccagaacagaccaaatctgcaccagctcaaccagcaagcagctatcattctcataaaaaatcgaccgtatgcggaacattacaataatgcatgcaagtatagaattagttatacaccagttgttacagataataaggtgatcgtagtagttgctcaaaacatgctaactgagcaacaggtaaaaatgattactcaaaacttcctttcttatcaggaaatgtgatgttgcactacaacaatgatgtttcgatgtatactgatgtaagttaaaaccaagtgctttgttgctaaaatcttggttgataaattggtaagctatatgttgaatgatcaaaattggaaggtgatcatcaggcgttgcttgcagctagcccatttgatgtagtctgtaaagcattattgtttctgtaaagcggtattcctccaccaagatccttcagcctctttaccatatcatgcaaccactcgaaagtgagcttggactgagcattgagttcctccctcacttgaggatgcaccctaaaccagtcccctagcatcttgtgaacatgggatcgaaccattctccatggaacagggtactgctcgcacagtttcaaatactcaatgactagatcagcctggtctaagccactagcttcatcttcatcaccattttctttccattcctttgtccggaaaccagcaaacaatgctggattttctagaagagtttcagctgaaagcacaccatcagcaccagtatgttcaaggcaatccttcacatcatccaaatggcgaatgtttccatttgcaagtacaggtatcctaagagcatctttgacagctttaatggcatcccagtcagctcgaaatttcttcccatccttctcatctctagtccgcccatgcacagctaccagagaagcaccagcttcttcaagcatctttgcgtaggccagtgtgtcctccagtcgcgggaatatgcgaatcttgcatgatactggaacatggaggtttgctgatagattctgtacaagggattttacgagaggaaggttgttcatgagaaacgcaccatagtacccccttctagcaatgcgctgtgggcatctgcaagatttcagagaggtggtatcgccatttagaagagcatccagaacaaaacatggtatgaagtaatgcttatttatcgggggaactgacatttcaattaactgagcagaaaagggggagatctactaaacagtaaaatgccaaataagtcagagcagaggaaattttcagcatagagtagggaatacaacattacccaaaattgatatcgacatagtcgcagtacggttccacaatctttgctgcttgtaacaaaatgtcaggatcatttgcacaaaactgaacaaaaagtggacggtcctcctgtataacataccaccaattgtcacattctattttcagtatgttccataaccaatacaaagaacgattaatggattacagaggtaacaggacaataaaagctagtaattatcaaactactatctaaaataaaagctaattatcaaactactatctaatcctttgtgtagtgatatgacagatgtatcgctcggaattttctcggtaactacgaattatcaaagcatcatcaaaattattactccagtgaagaattagcttaaactactccgggcgctctaattgaaggatccaagaattgaatagaaaagaaatcgtataaaccaaccatcaaggagaatttaccttgcatgtggtgaactccatggccctgtgcttctcgttctcggagaagatgcgggagtggagcatgggcgtgtatgccccggtcgccccgtagcggcggcacagcatgcggaaggggagctccgagttgtccaccatgggcgccaccaccatcttcggggagcccagccgcctccagtgcgcccacgcgcgctccaccctctcctccgcggacaccggcggcggaggggcgggcaagggcggggcggtctcctccgcgggcgcgaccgattcggtggtgaagcagaggtcctcgtcgggatcggaggcggtggcgaggtgggcggcggccggcggcgacatggcggcgaggctagggtttacggagcggaggaggcggcggcggcgcgggttccggaggatgggagcgaatcgcatgctagtgatttgcctctgggctctggtcctggtgtgtgggccctacttgtcagtgggggagagacaagatggattccagttatatgggccttttcggcccatgaatatttatccggcccatgtagagagtagtaaaatttcatctgatctagtctgaactgaacaatttctgcaacacatgtctgaacaatttctgaaactgaactggtgtcatttcaaaatttctgcaacactttcaatttagagccatttcgaaaatgaaatttgcaattgagtaattattgaacccaacttggtgacagatgtcttgctgaattggagcttggaagcatcttgaagaaagaaaagttcatgaaaaattgacagtaattctgatgtgctcctttcatacccttgtggaaaatctatatggagtatatgtttagatgatctggattctaaagcttacagtttccaaagctttttaccagagacatttatggaaatgtttcctaacaaactggcaataaacagtacatctgtacatcctttctgatgatcagcattcactgttgatcaaactgaagttgcaacataatgttcagagctgtctggcgtcttcttaggtgggacattcagttattggttaggagatcaactttctctttaaaaaaagacaagatgtcctttccagatgggacaaccaattagtttgttttaatttatttacaagatatgttaaagaaagtactgcaatttgcaatgtgtagggacttaattcagctaccagaattagataggacaagcaacctgattattttgtgaaagtaatagccctaccaagatgcattagatgtagagagccaagatcacagctgtctgccaaattaacttgtcgatcttgtcggatctcacaatggtacatcaacacctgaaaaatatagttacatattcagaatggtggctcccgaggtaaaatgctttttttttttttgcttttcttaacatatataagtagcattttttttatctcaactggttgagatgatacatgcataatccctcacaattttagagtaaattagtcgtgaatatgatgtgttgcccaagttgctaccttgatttagattcagaggatcttgaacaatgacaacagcagctactacccataattattcctcggttactttttgtttgtgggagataaataagaatccttcagctcagctcctctttgcccaaatggccactagagctggctttgcacaaatctaatgagttttaaaacctactttgtgcttgagaataattctaaaaggcaacttggtgataaacatttttgctccatcggaacttgggagcatcttactgacattccaaaaggaaaatatgcatataattttccttttatgatgaaagcagtatggccaagttggtactatcaagtatattaattggaagttcttattcgaaaaagtatattaatggaagtgaataaacaaaaggttcagaaataactccagtatgcaacgctgcttttgcatgtgtagtttgtgcaattaattcaactttaaatcaaaccattgtcgtcagcatcggagagatcatttttacaccaataagtagcatcaattagtattatacgtggcacataataataatgttttattcaaggaatatgattacaaaaataaacagtgaactgttcagtctgaagattggaagaaggatccagaacaggtgcagatttttttagtagaagagaaactgaattagggtcctttgaatcgcagggtagaaaaaacggaggaatatgaaaaacacatgattctgacaggaattgaagtgtaaaacagaggattgcaaaacacaggaaaaacacaggaatggtcgtttgattggagcgcaggaaaaacgcaggaatcagatgagagagatagactcaaaggaaatttccaagaggttggagcttttgctaaatttcctccaaaatccacatgcaatgcgccattccataggaatttcatagaatttagaaagcttcaatcctttaaatcaaagggccaaataggaaaatttcctatagaatttgaattctatgaaattcctacataaattctttgatttaaaggggccttagcttttgaagtggcatgcatgtgcttagaaatgacatctaccaatctctgttgcatcacagaccattagtggtaattgagacagaaaatccaagaacatttctccacgaaaacaagtatctaccattctactccaggttagagccatcaggctatatgcacagtacagtcgagcttgacactagttgcaattaacaattgcatcacctcattaagacagtttggttccagaaaaaaataataattaagattcaacaaaaaaacaattaagagaaactccttttcgatcaatgcatgcatcattcttcagaaaatgattaatgatataatactatataatcttagtatgcatcaactgggtgtggtttgagctggaactaatcaattaaggatgagatagtactccctccgtattttaatatatgacgctgttgacttttcgactaacgtttaaatatttgttttattcaaaatttttgtgcaaatataaaaatattgatgtcatggttaaagaatatttgatgacgaatcaagtcataataaaataaatgataattatataatttttttaaataagacgaatagtcaaatgttgaaaaaaaagtcaatggtattatatattaaaatatggaaggagtagtagcttggctagctaagaaaagaaagagaagagcctaatcgtgaagccaatccatccctatctggcttaattaaaactggttgaaaaaaaaaagaagaaaaaaaacgctggagcgtgtgccgcgtggtgacagtgaccgcctgatcttgggcttgatcgccggcgatgagtggccgggaaagcgccggagatcacctcacgcttttgggttcgtgaccggcggtgagagcgatcgaaatgaggcggccgaaacgtaactgtgctactgcctggctaccaattaaggccgtgtttagttcacatcaaaattgaaagtgcggttgaaattgaaacgatgtgatgaaaaagttgtaaatttgtgtgtatagaaaagttttgatgtgatgaaaaagttgaaagtttaaagaataactttggaatgtaagctgcatttgggcatggaagtgagcaagcccggtgccacttccacctgccaaactgcatgcacattgcaaagagaagcttctggaattcggaaacagttgctactaccagcttcgaaatgcttggcacaacatgcagtttcttttaaaagagaataatggaatctatttcaggctttgctttaaaatgctacggcaaattatacagaggttctaggtcgtcgaacgactacgaaatacaaaatcaccgttttgttaaaaacaagaaaactaatataaatactcgagtaaagttatattgaacatctattgctaaacttttatctatggactattatatggttgatgagaatctgcattaattaccgttgatttgttcagcggtttgcaagttctatataatccttgcgttcctacaaaatatcttagtaatactagtctctgtgctagtatttcagtgattcatgatatattgaagatgatggttaccgagttaaaggcatcttttttgccaaaaggagactctcaagaaggtcaagaaataaagttaccatcagctgtgtactaaaagaaaattaaatctctttcaggttggcctgcatgtatatatatcttagaaacttgaacaaagctttggcgatatcagaaaccaaagttctctttggtgacagtggcgtctgtatctgtatcctatctaagatgacggtatgcagaggcgcctcccttaatagaacgacgcgcaagtcttttgcgtacctccaaagaaaaagacgacttgcattgtagaaatggtgcagatcactgaaaaaactgtgttggaattatgcttgcgtgcagcagctaagatattactacttccatttcatattattatataaatcgttttaacttttatataaattaaacatttttagatttaactaagtttataaaaaatatagtatttttaacacaaaataaagaaactatcagaatatgttcaaagttagatgtaacgaaactaaattggtactataagtgttattatatttttctacaaactttcgacttaaaaatgttaaaacgacttataatatgaaatagaaggagtagcacacattcctctccctttcactcgtgcccttttcattagctactaccaggaacatgcctggatcatgggatggcatctgccttggcattttgatcactagcagcttccgtttataaattcataatatctttggtcatatggtccccagaggccagattttcttcattcaggatgacacactaccctactttattagcatgcagaaagttagatgacaaaacaagggtaggaaacgaggagaattttactcaaggactccatatagcaactacagatatcaatctatttcgtgacagattttccttaccataattaactgtttgaggtttatctagccaaatttacgatcgtaatctataatttgattgatttttttttaaaaaatgatatgcaacatacacatggttgcttttaatccagacgaatttgccgaacgctcatccccatcttataaactagatgaaacttcgcgcctttctatgatagttttgtatgaaaatagtaaaaaaaaaaaacaaacatgtaacatagctagacgacataactttgtaatataggttgatcattcaaatacaaaactaatacgatgtggtgcaatgagagaaggaaaataagaaatataatacagattaatcgtccaaaggcaaaatcaaagtgatatgaatagataagagaagaaaatggcggaaataaattggatcatagatcaatcatcctaggactaaaaataattgagatgatgtggcttaatgagaaaagagaaaaatagcattaactatatttagtggtgatgaattttatagatatataggatttggctggggcaattctgcagccaccccattgaaaagagataaaattttcgccctagagtctaagttagcaaccttaacagtatattttaaattatctagatttgtttaatgaatattgtataattacatttttcattacatatgctttagtaatattgcaaatttactatgatgtcttaatgtaaagctatgaaaagcaattatcaaaatcactcattagaggcaataaaaaggttagaaataccaagtaaaaaaagaaaagagtactgcacttagatacttacaagttaggaaaaagtgcaaataccctcctaaactttagatagaagtccgtctagcaccctgaactttaaaaccggatatcaaacctcctaaacttcacaaaaccgttcatatattaccctctatggtgttttttacagtggtttttatctaattagtatataaattggatgaatttgatcacgtgacatacacatcgaacatatatattaaaatctccacctaaatctttctttttatcaacataataatagtacggtatcactgtataagtataaattgatggcttacagttgatgatatgcaaatatattatattagttatttaaagttgttcgtttaagcttttaaaacatgcaaaaccaccattcaaaaccactttagggggggtaatatgaacgtttttgcaaagtttaaggggttgaatatccggttttaaagtttaaggtgctagatggacttccatccaaagtttaggggggtatttgaactttttcctacaagttacaatgcttcaaggtgtgtgcaacatgtaaaaaaacaaactttggtgcataactggtctctcagaattataatgattttacagatggatgaatagaagactaacaatgcaaaatccaactagttaatgtggagggaataggagttgactgcttatgtatggagttgctgtacaaatccaaggcagcattaaccaatgagataggaaggggatgatgcgtttgattcagcttattgcctgagtcgcctcatttgttaatgctgcctctccgccgcctgcctcgcccgcctctccgccgccgaccgcgccatccgccgtcgtcccggcacagccgtacgtgcgcatgccgagagagagagaggaagaacgagagagagaagagagagaggaaaaggggaagaggagtatgataggtgggtcccatattttttaataaataaaatgctgactggattgccacgcgtacgccacgtatgataaaaccgctctggattgggtcgaggggggtaatttgtccagtattgaaagtttacgggggtaatttagttgaccacgatagttcgagggggagtaattcgtactttttccttataaaaacgattttgatgtttcacttgcgacaaatttttgaacctctatctttcagtttttcggttgtaaaatcttacattaagattcatatttatgtatatccaacctacatctacactaagtaacattagattttacaacaactttttatctctcttttaaaaaaaaattaagacgggctatatctattggttaaaatttctgcaagatttaaaactataaatatgttgaaagatgaataggtgcagtcccttgtaataaaaatgatgtaaaaaaagcttgtttccattttgttgggtaatggaacccaggtacaatgggaaaaaaataatgagaaaataataaaaaaaatctctcaccatcatcctcttcctctgttttattagcagtagccagtagctagctgagctgagcctgagcttattatatttccctccacttcgtcctcttcttcctcctccatccccatcctccatcggatgcactagtagctggccttgtaccctacctagcttagctacccacccatgtcctcctcctcgtctcctctcgctgtctgcctttgacttggagacctagctcgtcgatcgccggccatgcgggtgcagtgcgacgtctgcgccgccgagccggccgcggtgctctgctgcgccgacgaggccgcgctctgctccgcctgcgaccgccgcgtccaccgcgccaaccgcctcgccagcaagcaccgccgcctcccgctcgtccacccgtcctcctcctcctccggcgacggtggcgccgccgccgcgccgctgtgcgacgtgtgcagggagaagaggggcctcgtgttctgcgtcgaggaccgcgccatcctgtgcgccgactgcgacgagcccatccactccgccaacgacctcaccgccaagcacacccgcttcctcctcgtcggcgccaagctctcccccgccgcgctcgccgaacagccgctcccgtcctccgactgcagctccgacgacgacgccgccgccgccgccaccgaggaggagtaccactcctccgccgcatccaccggcgccgcagtgagcgcgcctcttgacgcctccagcaacggcgccggtggcggaggaggagtaggagggagcagcatctccgactacctcaccaccatctgccccggctggcgcgtcgaggacctcctccccgacgacgacgccttcgccgccgccgccgcggtgagtactaccaacccatcgctccgccgtgttcttgctacgtctccatcgatgaagccgagactaacctacgattccttggagcagcaggcggggaaagagaaggacgagcgcgtgccgttcctcgacgccgacctgttcgacgtggtcgccggccggccggagaagaagggcggcgcgtgggcgccgcacgtgccgcacctgccggcgtggtgcctcgacgaggtgccggtcgtcgtcgccgcgtcggcggcgccagcggcgacacctgtaaaggcgaagcagggacacgtgcgggacagccactggagcgacagcgacgcgttcgccgtgccggagttctcgccgccgccgccgccggccaagagggcgcggcccagctcgcagttctggtgcttctgaacgccgccgccgccgtacaatctggccgccggcgagctcgacgaacacctcgatggatcgatcgaacacctgtgtaatcactcagctggtcactactacaagtagcaatcagcaagcttgatgtgccactgttactagctgctgctgtttaattagtgagtactaagctactactagttaattttggtgaaaactatgctactttgttactatataatgaagtatgtgtatcaaactaaactgagatgttggtaattaattatcgtattttgtaatgtttcatcttctttagtttcttcatctaagatcaacaagctagctagtcttagtcaacccatactacaacatagatctgaagagaaaaagaaaatgatatataattaaccaggggagctaattaaattgtggtggttgtaagaaaatagtgctgtatacttgtttg

SEQ ID NO: 58765 - DNA, 16691 bp, Oryza sativa
  unsure (1)..(16691): unsure at all n locations
gacttatcttcatgcacaagctgccgattggcttggattgtggctttgatgtccttgcgctcccgacgttcggctagtcttagcttagctttctccagcttgaattgatgctgctcaagatagacagctggggtaaggatatcggctaactcatctgggattagagcttggatctcatgtagccgagtcctaatcggcccacagtttaccaccaagttgtccagtgatgatgcctctacccgatgagagatatctttaagcgttttcttcacatcattggataagggggctagggctttgctcgaagtatcatcttctgcctcattaagataatctctaatgtcaaaagagaagagatcggctaaaacctgcagaaacaatttaggaagattgagagctaagtagatatagccgatctaatttcttgcatcaaggggaaacttactgggatagcaggagcagttggttgtacttcttcctcaatatggtgactctccactgctgatggagattgctgtacaaaaggagaaggaggaggaggaggctgtaaaagaaataagtgttaggcaaaatcgactgaaatcaactaataaaaattaagaatgtcttactggtggagccggtttgagaattgttgctgccgatttcttctttgcagcagttttcttcttctgtaactataaagtctgtgagcaatcggccgaaaagagaaatgatcataaaagagatcaaagaggaaattgcttacccttgaaaaatgggctggagcagacggagttggaggagtttgcttaggagaagctgatggagttccctcgctgtcacttacttcatctgtggcttgatcaacatcttcgccgatttcttcttcatccagagcttgttcaatagatggctctagggcaggcaaatcattagttggtgtaggcttctttagtttggccttcttctttggagcaggagctgatacatctacagtcgatgatctggtccttttctttttgccagcatcggctggttctctgatgagtccttgaagaagagttgaagtcttgggggcatgaaagccgatgacagggggagatggtccgcctccattaggaattagacccggagcatatttgatatttctaccactattgctctggtgaggaggagaagattctgttgtctacagatcaaaagaaaatttgtcaagttatgaatcggctgagcaattatttacacaaaattaaatcaagacatacctgagggataacgtctggaaagagatctgtcatatacatggaggccgattgatgcaataggtgcagtttccattcgccccaccatctgtcaaatgttttgctcctgaaggttgccagctcaatgttttcaatacttcctagaggggatccttggagatttagcagccgatccatcatcggggttatgagatttctcctcggcattggatcttatcagcgaagaacaagctgattgggagctgacccattcccaattgtctgccgagctcattgggtgatagaactcataagagaccttgatatttcttccttgatgaatgccgacaggaaggatacatgggctgattgcagctgaaaagacttctctagacttttggtatctttcatgggtgatatcctcgaatctaaagtctgatggattttccagaagtgctgaatcttcatagagaaaccaaattcgagtttctttgagaaagccatcagataagctgcagaaccagtccttgagcagttcggccgagagttttgctcctgcatcggttggtgtggaggcgtattctccataagatgtgcacctacgatgggtgcgttcctctccatcatcgtctacgattggctccagtcttgggaattcggcttctgttatagatggccgattgacaaacttcatgacaattaaattcagccaagattgtaataaccaccatggtccacctgctccaactactgagccgacgactatcttagccgatgcattgttcatcatttggtacaagtagccaaggaggatcttgcctaaggggaattgtctttttgattccaaggcttcggctacaaactgccagttggtcgtagggccgcagcttgatctacagaagagaaatttctccagccacattagaagaaaggctacatgctctcggggggttaccgaaccttggcccatatatgctgccacgtagcctgaccaactacctatgcttttggtcctgaagtcatactggttcttcgtgttcaaactcatggggttagccgatgaggtaacatccaaaccggtgatcatggtgatgtctactagagttggggtcatcggccattgattgaacaagaaggcattaatggtgttggaccaaaaataagaagcggctgccattaaggtctcgtccttaggtgagttggctatggttaggtcaagtgcttggccgattccgatttcgtcccaatgaactcttttgctagccgacatgcgcttgaaccatgtgatccaacttttctcgggtggagttttctcgagagatggccaggatttgaaagtgtttttccagtgacctagatctgggttggccaatctgaagggaatcctattggtttcaccaatgatgaactcggtaggatcagggttgccgactggaccgagaaagtagtaattttcgtgcgacaagcttgaaattgcactaggttggaaagatgctacaaatccaaaagaactgagaaggggaaaacaggatgaggggctagaagatcgatctaatgtgaagaaaagaaatctggccgatgagaacttacctcagcgtactcagccaacggcgtggcatacgggctggcggaagacgacatcgctgcaggcggagatctaattggagatgaagtcgcctagggatcgccttatgcgtcggagaaatcgtcgaagagagagaagacaaagttagcttcggcggtgaaaacgcaagaagacggtatgaggtttctcgggggcaacgattagtatttaaagcgctggagtaacggttagaaaacggcaagagcgaattttgctcgaaatcgatatatggcaaatccgaaacattaccaaatattccggacttggggggcatgtgttaacaaccaaatttggcaatatcagcatcggggatgaagattagatcggggtggaatcgaagacgaagatcgattcgggaacagagtaagagtccgagtcagactgggtcaggtggtacagccgattccgacaatacgacttggtgtatgacatcgggttgagttgatatgcttcaaggtgattgccacgcatggatagagtcctgagaaggcaattatatctattaattaggatattttatgtaacttccttagagatatgtttgggcaaaagtctgccgtaaagacttatggtatcttagagtttgttggagataagagtcgtgtccgttatggacattatttgtaatattcgggtatatatagaccccgaatcccatgtaatcaattaacacacacgttcaatacaatttcggcgcatcgccaccctttttgctttagtttatttcgacgagttcttgctttcgggttgagctgcatcggttttgatcttcagcaagaggtaaaatttgttatgatggcttgcgttctcgggattagtgcttccatcattatgatactctaatcttgtctatgtaattcgtcgagttatcatatatcttatataatctctggcaatatcgttatctaacctacaatcggctaatatctatcaatagagggctgccgattaggttaaatattgatgttgatttagattatatacgatatccatcactctatgaaatttccaatggcttgattgtctagacattgtctttcttctcatacttatagctgcatcagttgtttgatcttatgagtcgtgattagaatctcaatctctagcctgcctcttgcttgccgattagggtagtatcggggtttcagccgatcttatctgatttaactacatttgctctatatgttttattgacatgttaaatctgccctatatgtcaagatcttattgcatctaagtatattaagcttttgtttggtgtattctgcttgttttaatatcttaacatagagttgtatcagagtattagccgatacatgctagatctatctgatcggctatgctatgaacatatatagtcttgttgttaatatatatttcgatctaagtgatttatactgtctcggtatggcgaccgatctatcccaatcacttgatttaagtatatatcgacacaaggaatatatattgttaatatctacagccgatcgagtagatttagttctttattatctatttataactgccgatcgatttacatatgacatcggatcgaagataaatgatatgtcatcggtatctagtcaatcggctatcatttatggatttaaccacggtttctttgcctttatttcttgttgattgcaggatcaaatcaactggcatgctagcatacccgaaggcgagttttggacctgcactggagttaagcaaatctcccaggcctcgtgtttttcatcaatagtgacccctaggatatcgcagggattgtccccgagctgagccatcgtggccaagggctagaagctctcaatcagttcatgcggatctcgctctcctttttatggagggccacgtgtcgacccaaggttgtcctacttcatgttaagtagtagctgactttaagattttaagctttactgatttcatttgcgatttttgctccgacaaccttaactccttctcctccagctccggtgaccagtgacggccgaacgagttagggtttagggtcctaggttggtgggaggggagagggtagatgagggagattggtggagtgattgcaatgagaggcaatggcctgacagtggacacgggcgggagacgaagtgctggcggaggcatctatgccgtgaaggatggaggggcggtggggtggcggtagcggtagggacaaagcgaagaggtggttaggaggcagtggacaagggtggtggatctagtggtgcgaagccacaagagacaagggagacgatagggtgggggcacctgaccgctgcgggcttgaggaggaggaggaggcttgctgggggacctcgttggcgttgttgatgcattcactactacagaaagggtaaaaagtgccggttgggaaaccctaataggtgccagttttcccaactggcacaaaggaggcagcactgatgatacttgtcatcagtgccggttttagaactggcacctattaggtaataggtgccggttttgaggttaaaagcagcacctatatgtactaataggtgcatgttttaagacaaagagtcacgtggctgtcaaataggtactggttttgacctcaaaaccggcacctgtatggtcctaataggtgccggttctaagccaaagagccacgtggctgtcaaataggtgccctttttaggttaaaaccggcacctatatggtcctaataggtgctggttctaacctaaaaactggcacctacttgttgggtaaaaaaaaattacagtaaattcatccatacaactccaattccatataaacccaaattcatccctacagccccacatccatacaacacattcattcacattcacattcagattcacattcacgttcacaacaaataaaacattcacattcagattaacattcacattcacaacaaataaaaacctacaagactaagtcaaaattcggtaagtctaaaaattcgtaagtctaaaaattcctatctttaaatcctagaacatttgcatatatatcttgacggctgttttggtactctcctattcctacattttggtgcacatgtgatgggtatagccattttccagatgggccattcaaggtgagatatggaaactgaaccttctgatcttcatcaaaggttcagttccctctaatcctcatttcaaatggcacatataaatatggtcctagctgctaaaacccaacactagctgccaatctgttcatgtgctgcccaactaaagtattccatcaagcaatcaacctgaaggtgagatattggagaaaaacaatctgaatattaattgtttgccacactgttgcaagcatcaaccagcaatcagtttgttttcctccaattctcacttccagtgcctgaacaagcacagcatatccaacactgaagctagtaactactctgaagcgctagaaattgtaaagcagttgggttcaggacttcaggtagagagagatttatagccgtggttgatagaacacaaatcattcagattcagcagcagcagcaacagaagcatctgtttctgttacacctgcccttcatgccaattgtgtgttgtctgtgatgaagaacctttctactcccattttcagaggactagcagtacaggtaatggccaaaaaaaaaaacaaaagcagcttcagaatgtgatgggtgcatagtggctagtcactagtgacatgactgccctacacataggtgccagttttgggtctaaaaccagcacatttctcttacacaggttttaggtgtcggttttatttaaaaaatgacacatatttggacattaaggtaccggttttaaatatttggcgagtggggctaggtacatgggtggaaaatacattatactattataggtgtcggttttagattttccggcacctatagtgacgacacatatttatcttttttaatagtgattttggccagccagcgaggtcgggtgttggtgcgctggagtgctggatgtaggagggtgcagcggcacactaggcgagatctagagaacttcaatgaaatcgatgtgcatcggtcggtgggggtgagagcataaggtggaatcactaagcaacacagatcttaaagtaactagcatggtggtcagcgtagatttcgcggctagcatcattatattttctctcatataatagcatatatgttttctcattatattattaatatatattaaaatgacaacataattttaaattttgcaataactttacaaaactactaaagtgtaatattcatattgtattttatatacgtgttagttattaattatttttaatatcaaattttagttatttgtaaattatatatattcctatatggactctagacttgtctttaaatttttgtttaattccgaattttctgtaaattgtatttctatatagactttaggctcttcttccaatattatttatttttatttctgaatttttattatttctaattgtatttctatgtgggctctaaactcatctttcaatattctttaatttttaatttcgaatttcagttagttctaaattgtattcctatattgactttaaactcttcttcctatgtttttcttaattttgaattttagttatttgtaaattgtatttttatacagactctaaaatctacttttaattttattatgtttattccgaattttagttagttttaaatttctatatggactctatactctacttctaatattccttatttttaattctaaatttctattatttcctaattgtatttctatatggactctatactctacttctaatagtccttattttaattctgaatctcagttatttcctacttgtatttctatatggactctagtctccttttctaatattctttactttttaattctgaatttcaactatttctaaattgtattttgatatggactctagtctcttcttctaatattccttattttttaattccgaatttcagctatttctaaattgtatttctatacggactctgctttttctttttttcgattaatgtgagaatttctaggccgtatttctatatggactctgttttttttctttttctccgattaatgtgagaatttctaggccatgagagcgaacatggaggctcatttttctattcctttaataatataatagatagacagattagacggtccgtgatatgcaagattctaggtttttttgtgtgagatgatatttagacagtcccttaatcaaaatttgacaaagagtcgaacataggaccactggttgtcttggtcgaaatcacataccgaggacacataccaagggcctgtttaaatcacacctaatgtttttacaacatttcacatcaaacgtttgaacacctgcataaatttataaatatagacttaaaaaataactaattgcataaattatgaataatttgcgagatgaatctttttttggagaattacacagtacaacttagacactcacaatgcgcgcatactcacccatatgaacgcacgcacgcaaatcctacccctatgagcatattcaaagactggccggcaaatcctggaaaattctctctcggtagagacgaatctttcaagactaactgctccatgatttaacaatatggtgctacagtaaatattttctaatgacagattaattaggcttaataaattcgtctcgcgatttaccgagatattctgtaattagtttttttattagtaccgaacaccctatataatatccgatatgacacgctaaaactttagaccctgatctaaacaccccctgacatatctctgtcactacgggcgaaaagtccagttagatgtccaagatcagtacgtaagtgaggactgaagacctaacaccatcgacacatcaattagttctgattgattttaccaacgaaatgacttgaaagtatgccgcgccttccgtctcctctgtggtgtgtgcgacttgtgagagacatccagcgccagtggtaaagttcggccattattatatcaaaagacccgcccatatatgaaggcggcatttgcgtttgtgatgcttgcctgaatctctaccttacgcccatgcatgcaaccatgttaaagagatcggtgcttccgagtatggcagagcccgggcaccttgcccagctgagcgctctcacgacgacggtgatcacctgcctgattctcatcaccccaacaccagccgccgcgtcgggcgcgagctgcgtcgcgagcgagagggacgccctggccgccttcagagcgagcctcctggaccccgcgggccgcctcgcgacatggagcgggcacagctgctgccggtggcgcggggttcactgcgacggctcgaccgggcacgtcgtcaagctcgacctgcgcaacgacctcaccgtccacagtgacaccgactggatcttgttctacgaggtccgggttgacatcgacagtagctgggtacacagcgcgttggccttgcgaaatacaggtgagatgatctcctccttggctgctctgcaccatctgaggtacctagatctgagctggaacaacttcaacgactcgagcatacctctgttcatggctgacctgaagaacctgaggtacctgaacctctcagggccgagcttttcggggagaattcctccacagcctgggaacctgtccaatttgcagtatcttgatctctcatatggacctactccctccgtttcaaaatgtttgacaccgttaatcttttaacacatgtttgaccattcgtcttattcaaaaaaaaattgtgaaatatgtaaaactatatgtgtacatgaaagtatattcaacaataaatcaaataatatgaaaagaataaataattacttaaattttttgaataagacgaatggtcaaacacatactaaaaagtcaacggtgtcaaacattttgaaacggagggagtactatttcttcagacctgtcatggttgctagggctgtcatctttgaggcatcttgacatgagttgggtggatcttagtgccgtcagggactgggtccataccgtcaacacgctctcttccctgaaagttcttcgcttgaggggctgtaaacttgagagtgccatctctaccatgtcacatttcaacctcacacgtcttgaggtcctcgatctttcagtcaacaaattcaatgcttcgattcagcagaaatggctttgggatcacaaaggcatcaaggagctctatctgacagaaggccattggtttgggtccattccggacgcatttggtaacatgtctgcacttcaggttatggatcttggccacaacaacctaatggggaccataccgacaaccctgcagcatctgtgtgatctgcaggttgttagcctatatgacaactatattgatggggacgcaacagaattcatggagagattaccgaggtgttcatggaataagttgcgagagatggacctgcattctacgaatttgagcggtgagctgccggtttggataggaaagttgagcagcctggattttgttgatctctcacacaacacactgactggtgagctgcctgtgggttttggagcacttagaaacatgatttacctaaatctcggttggaataatttcaccggacagatttccgaggagcatttttcaagtttactgaacttaaaatatttgtacctctctgggaactctttcaagcagatggtcttcgaggaagattggattcctccattcagactgaaggtagcacatttgcggtcgtgtcgattaggtcccaagttcccatcatggctaaaatggcaaactgaaatcagggtgcttgatgtctcaggcacgtgcataagtgattctttgcctgtttggtttaagaccgttttttctcaagcttactcactgaacttgtcggacaatcagttatgtggtaccttacccagaactccagaggatatgttggcaatggtgatggatcttgggtccaacaatttgacaggtcaagttccacgcttccctgtaaacatcacctactttgatctctcaaataattctttgtccgggccactaccatctgatcttggagctcccaggttagaggagctgcgtctttacagcaattacatcacaggcaccatccctgcttatttctgccagttgcgtcgattggtatctttgtatctgtcaagcaatcacctgacaggagaattcccacaatgttcagataactacaaagcactaccaccggatgatctggatccgttcttctcgccttattttggcgccgcatgtctacaatagacctgagcaacaatagcctcacaggcccattcccacagtttcttgaaaataccacatatttgcgttttcttgatctctcacacaacattttttctgggaagctgccaacatggatagcaaagagaattccgtactcacggtttttgcggttacagtcgaatatgttttctggccacattccagaggaattaaccaactcttttggccttcattatttggaccttgcaaacaacaacatatcaggaataatacctcaatctctagcaggcatgaaggccatgaggcgcactactccggatgggaacaggggcgatgtctacgagggcagcatatcatcgttcaccaaaagccaagagcttcactacaccttcagcaactacaatctggtcgtcctcctcgatctgtcaggcaacagcttgacaggacagattccagaggagatatcactgctccttgggctcaagagcctgaatctctccggcaaccacttgggtggaaagattccgaacacgatcggcgatttgaaggggttggagtcactggatctctctcgcaacaggttgtccggtgaaataccgtcaagtttgtcggaattaacttccttcagctggctgaacctgtcctacaacaatttgtcggggagaataccatcagggcatcaactacagacactcaatgaccaagagtacatctacatcggcaatcctggcctttgcggccctcctctccgcaagaattgtgcaatgagaggaagacacgatgaagttgacgatgtgtcagatgatttagcagtcctgtatcttggtatgagcatagggttcgtagtgtctctctggttggtgttttgcactttgctgttcaggaaataatggagaatcgcatactttgtgctctttcataggctatgtgacaacatatttgtgcaggtggcgtgcaagctgggcaataagtcgagtgttacaggtcccaagaacaatacttaagatcaactgataggaaacttgggagtcattaatatatgatgttttggacaagtaaatgaacctaagttgtttgtcctagcaacaagtatcttttggacaagagtatgctgcaaatcggttgtcatttcctccttttttttgtgtgttttccttttggggaaacttatacacggtactgtagatgcttcagctactttatatcaagccatgtacttctgcaacacagtttttgcgtgcacttaccccctcatgttgttccatttgctaaatacatattaaatctatgatcccaatttctactaacaatatattcagatttaggttagttttctaatagaacttcaagtcttcccacattagaagtcttatcttttatctccgatatatatctcttgtaaactgcataagaacggtgatattccattattattccctacatttgtagccaaattctcaatagtgatcattgttgtttggcgcttgtggtttttcccgccagaggttttcatgtaaaaattcgtgtctccttaattttgcgcgtttggagatctaatgcccagccactggcgcttttgtccttgggcgaatccatctgtctgaactacggtaggtgcacatcatcgatctgttggccactgttaggggcgcaactgccaccaaccgtgagccacctctaggttagattgtgcctgctccaccatagttccaacgggagccacaactttaaattctaaacctacataacccaataaactagtctaacagatgagtattgtttgtcatacatcgggcctaacaatatcctccgtcatatcaacacatctaaccctgaatatttatttcagtgccaagcctacaatctcacatgtcgcatcaaagcccatgcgatcggagacacttgttaccaagctctcctaccatgcgacctagggctctaatatggcttattagctggatttttcacattttagtccttttgaaaaacttatttcgcaaatagacccctggaaaaacttatcccagaaatggtcctttttggggcatcagagtggctggcgccgttgtccaacaggacggaaccagcttttctggcaccgtccccctgccgacgtggcggggcgatgctgaggtggctagggggagcgccagagtggctggcgccctcctccctcccccccctcgaaattttttatttttcttttatttttttgatatttttttcacgcttagggatacacaagaaccaaccatagaaaaaataaactcaaatggacgtaatatgtaacctgtagaatttttcctcttctctcctctctctccgaactagtgcagaggagagagatgtgcaacttttttatttttattttatttttttgatatttttttcacactcaggaactcaaaagaaccaatcatttaaaaaataaacccaaacggacaaaatatgtggtctgtggaattttccaaagctctaccaaaaaacttctctcctcgaaaacacaatcttgaaagctgaatttggaggttttaatattggctaagccaggaagaatcggatgtaactttttctgtagatatccgtggatatattatttgtctgattctgagtccgtatgagaaagttacgcctattttaataaatgatatattttgtccgtttcgctagagctttggaaaattctacatgtcacatattttgtccgtttgagtttattttttctatggttggtttctatgttctcctaagtatgaaaaaaatatcaaaaaaataaaataaaaataaaaaaattgcatctctctgtactgtttaacttataaacttatagctatcatttcatgtggttatattttgaattagattaagtaatttcatatagtggtagagtgcattatgtttaacatgctgatcaaagggttttactaaaggagttatggtctaattttggtgaaggtgcaaattaggctaagtggtatgctagctatattcagacttagctaagtggtagttcgagtttaaattttttttgtggtgggttgtatcgtgatcctaagtgtgaaaaaacattcaaaaaataaaacaaaaatgacaccgttgcaacttcatacagagaaacaggaatanaggcgaggggtgggttgggggatgacgcgccctcctccctggggcggcgccagccatacaggcgccctcctcctaccacgtcggttcgagtgtgccacagtggcaggaggtcggcgcctggcacgtccccgttgaagnacggcgccagccactctaacgccccaaaaaggaccatttctggaataagtttttctaggggtctatntgcgaaatagtttttcaaaagacccaaaatgtgaaaatcccagggcttattagagtgcaaacctatgctttaatacatgtaattagagcgcacagtcctacccaccaaccttaggcttgctccaccttagactcaactagagccataactttaggtgatggatctacacaacataaaatatagtctgatgagtgatgatagccctaacattttaaatcgtgctctttcatcataatttttcaatgtgggacaaaaaccaatatctgcttggtgcagctaacctgaaatgatgtcggatctccaggctctattacataaatgatttttttgggcgaaccccctctaacttgcaggtgggttataacattgtctgcctatgataattttgccccaggaggaagataaggccaacggacctcttaatagacccacctgtgaaaataggtttattttcacaggcgaacatattaagaggtctgcctggcacccagccggctgccccatccgcttcctctcttttattttctcatctcttaaaatatctctccccactccactcctcacccccttctcccccgtcccctcctcccctacctccaccgcagccatggcgacgggagctgccctgcgacaggtggatctagcactagctaatgaggtgatgacaacgttggcggcaagccgcacggtggcggatccctggccccggccccaagaggggtggatctagtggtgctggcctcgagagcggcggatccaactccacagacctcggcgatgatgacaacaatgacaacggtggctagggtggcgacgacaatggcagcaagctgcgtgagggcagatctggcggcgctagactcgagactagcggatccccctctgcgggcctcagcgacgacgacaacgatgatgccaatggcaccaatggctagggcgacgacgaagaccgtggcaagctgtgcgagggcagatccggcgggactggtctcgggagcggccgatggtgatgagcgtgtcgatcgacgggtgcctgtgctccgccttgtcgcgcctcgggtcctcctccaccaccgacgacctcaggatgcgggttacagttttggggatgcggtgcggcggtggcaggcatgcgggctagggtttcacaatttttcagaattttattttattttttgacaaaattctagtgcaggttggcggcttaacatgcctgcctgctaaaaacaatttttgcatgagggcgtggtgcccgcatgtggaaatcttcatttttaatacacgtagttgcaggcgagtggagccgtgcctgcgaaaattgaagatagccacatgtaaaaaacattttttattagtaggaccagcgcgaaggagaaaaaatctatgcacatagtctacaatacggatggatatcaagctggctcgacctgatctggctttaatttgatttgttatcctaaagaaacatagcttggctcgacttgcttaccagcttgtttagcttgcgagctagcacattaataacatgacggcagtagcgtatgtgctcgctcctcatactccaatgccccggcatcgccatcttactcgtcgagccctccaatgctcacacgacccggacgaaggatggcggcttatgactggaaggagagatcgagaaggggacaacagtaggcggcggcgttgcacacgcacaaccggagagactagaggggggaggcactagctaggcggcgtgtggagcgccgacgctgcacatcgccgcattgcatgctcaagcgcgagtgcgcgactactgcttggtcgaccactatgagctgatgtgcatgtggctgcgtcgccgttgtgttgtggttccggcttaggctgtgttcttctcccatttttctaacccatctctctcctttccacgcgcatatttttcaaactgctaaacgatatgatttatgcaaaaactttttaatatgaaagttatgttaaaaaaatttattaaaataatcatattaatccaacccctccactagaattttgtggcctgagggagatgtacggctttactgtgttggtgtgggacttatatggcctaggaaaaagtacaccgaaggtccctcgacttatcatcgattttaaaaatcgttccccaaccgcaaaaccaggtatccagcatcactcaactaaccaaaaccggtgacaataggtccttaggtggttttgaccccggttttgtcctacg

SEQ ID NO: 58766 - DNA, 2597 bp, Oryza sativa
atgccgacctagtattatctacagatttaaatcaaaaggagtagcactatatttgaggatgtttagtgcctgtgccacaacccataatcaaacaaaagcttttttgcaaatgcagggcaaagcaacagtgcaaaagtccaaatacttgaaaaggcaagtgtactcctcttccataaatggaggtattgggttttttgctggtaggtttgctacagtagcatccaaaaaggagcaggcaataatcaatctgatctgatctgatctgatttgcaagtgtatgcatatccctgcctttacacattgactcctcccccattggttcgtcggttggctggttgctccctactttttcgcacatacatcatccatcaattctcatcgtccctccgtcggccggcggaaaagtctatgtgtgattaactaaaaagtctatgtgtaatcgctaaacacacccgaccatttcacatacctgagcttgattcgttgtattaaactgagggaggagtagatagtatactctcccagtctaaaaggttaccgttttaaattggttatcatagattaaagtttcatgagaaataatataaaacattttattaaatgacatgtggtaaggatggggttaggagaaatatgaatgagagataattgatgagacaagtactttagagtgccaatttttgtagcacaaattttattttattttttaaaaaataaagggatggagggagccgtatatatcaaacgagaagggaaaaacaaaaggaggaaagaatgtgaatgtccaaattcagagagcagaaagttgctttgaatgggatctgctccaccatcgaatatcccaactcagatatgtcgaatcagattgtgttcctatgctttaccgtgaattcttttccaaattccaaagggtggcctgccaattatttttggcctaaaatgatcccaagattgttatgattatatgccagtcagcggcctgttctactataattcattcattccttttagattataagattattatagctgatagattatatgcaaattattcatgcccgttttctcaaggtatgatttctccaaaaatctttctgcacctgcattgcaatctcgagtcgtaggtaagtgtgtaatttgtcaaagaaatcagactcatagaattctaatagtactttcccagcgttgaaaatttgctgtatgatgatagcacaacgagaggtccaaagtgcaagagcagaagagaagatacaggggagatcccgatcgtgcagcttttgagtcacagaatgaaaaagcatcagcagcagccaaatgagattgtatatgtgtaccagctgctagctagagttcgtcaactcgatcgttttacagcattttttttcttcctttctggtggatggtgaccacgcaagttaactgacgtgtagttcgttttatgttgtcataaagtggatccatcattgcacagttgtgcactagctttgttatccttaatttgttaatcacagctgacgtacgggttaattttgttgcagtctgcactaatgacgcacttcctctatccatcaatcaatataaggttcctctgcactaaggttaaaagtgaaatcactttgatgctcatagaagtttgcctgcctagaagtgatcatgctcagggacacatcaataaatacatggaattattgggagatgttggactgggaaaatagtaatagagaaatatttgaatttataaataaattttggatgctagaaaatacttatatttatagatatagatgacttaatcacagctgaatgtctcgatctcgcattgtagacgtaaatagtgaaaactaaaactaacaagtactaccccctccatcccagaatataattatatctaactataaatctaaacaactatatgtatcttagatttataatataaaaaaatatattgcggaagaacaggtaatactaaatgtgcttcctctatgctcttcgactctgctctctcttccgtctccgaggtcgtagagtccattctctccaagggtcatctgtggtcgttagttggcgttgcttcttttagaatttcttgggagtatagtgtactctgtctctctcccaactgattagagttgcgctcaactgtcatagcattctcttccctttttcttggctgtgtgtttttctcttcccttggcaaaagccaatctggctgattgcgtcgtgcaacagattttttttataatatattaacatgtaattcttttaagcgttcacggaaaaaaaatcctcgttttcttttgctttttgcaacgacgaccaacgctataataatttccagctagttcgatgagtgatcctgagtcccctgatgcatgtgtacacgtcgtgcctaaaagctagccgcatgggcctgtgcagctgtgctctgtacattgtgtggaggcaacggcgacccaacgtcgcggctacccgcgttgcagcctggctgtacatacatgttgctgctgtgttagcttcgcttagcaccacacaaacacaagctgaccagtgacctctcctctcatgttcccatatctatggccgtatgggggaggtgg

SEQ ID NO: 58767 - DNA, 1576 bp, Oryza sativa
ttagcacttgcgcctagtaagatttttgtttgattttccgctatcgttttagagctctctaaattatcaacccacacgctgaatacatattgcaagaagaaaattaataatgtgtctccagtgctaaaccataacttggactcagcaaaaaaaatggtagtattttctttgatccttggtgccattactgccaatttactgcaaatttctcaagagtatattcacattcagtctcttgaacggggtggcctcagcagccttgagggagtgcctccgagacaactccaccaccttctactccctgacaatgaagtagaccattctaggttccagcagctgcaagtaacaatcattaatcctccttttcaagttctattagttgggagctattaacttgattgtttagatagcatcagatgtttatcataggtaatgatgactgtcttcgctaatgcctactggattgcccagatttgtaacaaaaaaagattcaaggggaaaaaacagaacccagggaggatatatatgtcatataatcagttttatcaaaaaaaaagcacttgacaactatgtaaaggatgccgatgttggtcatactcaacatggacaccagggtagttgaactatcctttcacttggtagctgtcagtagaagataaaaaatagttaattattcagtgctctctaatctgatactacctaacaaagctgagtacaaagcatagataaaccgttgatttgatcacaaacagggaagcaactaaagagaaaaaagggcgagtttaattggcagtaataaagcaatgtttaaacaactaaacattcacctacagaaaccaatatcagattatatgagaatctttttaggtgatggacgaatgaagcatgtgatgctaatttccacccacagattatcattgatgcattttacttgtcaaaaggagaacaaatgaggaaacattctgcacaagatgccaactctctgcttctatttagaaggaaaatattgaacctccatcctggaatacaaatcgttgtcccacagcttatataaatctcttgcattagatttaaagcacagtgttgtgctcaggacaggctccttctgaaatttggttctactacaagttcagtccaagtagaaaattaagctaatcctggttttctatgtgaacttatatctagcaaagaccctcatcttgattttataatctccttaacccacacctcatgcaccgatttttaattttgaccttagtattatgttccacaattctgaagggtagttgccacaaaaaaaaaaaaaacttacccaacttgaacacaatttggaaccatgatgccatagattaaggtaccattattgtcctccatgaagacatgaaagggagaaatttcgttgtctcacatccaaaatattaatatacaccgaatacatccaagtttctgaaaacatcatgaactccccaactatgttatattttgtgcatgattgttggatatgtgaaaagaactgttgttaccattattgtcctccatgaagacatgaaagggagaaatttcattgtctcacatc

SEQ ID NO: 58768 - DNA, 8911 bp, Oryza sativa
caacctttccggattaattgtaccacctcgcctacgcacatgcgtccgcccccaatataatactgctcctgctaccgccgtgctcgctgaagcaactcgggttcctcctctgatatagtagtattgcgaccatgatggccgcggctaagcgcccctactgcaagccgccgccgccgacgacgaccacgacggcgatcacttcctcctccggccagaatcacaagcggctccgcccttcgctaccagctgctgctgccatggacggcggcatggaagaggaggcggtggcgccgccgccgccgacgacgatgacgaccaccacgccgccgcagccgctgctccccgggttgccggaccacctggcgcagctctgcctctcgccgctcccgccgcgactcctgcacgccgtttgccggccgtggagacggctcatgtacgcgccgtcgttcccgccgtttttgtctctgtacgcgctcctcgacgacgcggatgccgacgccggcgtctcgtttgccgcctacgaccccttggctggacgctgggacgcgcttccctcgccgccaatgccgtcgccgccgcccatgctctggcacccctccttcctcgctcgccgcctcccgctgcagtccgtcgccgccgccggccgcctcgtcctcgtctcgggctccacgcagtccctgcaccctgcgctctcccgcccgctcgtgttcgacccggccgcgcccacgccgcggtggcagctcggcccgcggatcccgctatccccgcgccgctggtgcgcggccggcgcggcgcgcggccgcgtgttcgtcgccgggggcgtcggcgccggctacgacccggccgtcgcccgctccggcgcgacgtgggaccccgcggcctcgccgccccccgccgccgcgtgggagccgatcccgccgctgcgcgacgggcggttcagccgcgacgccgcggaggccgtctgctccggcgggaaggtctgcatggtcaacctccgcacccccggcgccaaggagggcgccgtgttcgacctccgcgccggccgctgggaggacatgccgcccggcatgctcgccggctggaagggccccgcggcggcgtcgcccccggacgacggcgagaccatgtacgtcgttgacgaggagcgcggcgcgctcaccgcctacgattggggcgccgaccgctggaggacggtagccgagtccgaccgcctcaagggggcggcggagatgaccgtcgccggcgggaaggcctgcgtggtggcccccggcggtgggaaggtgttgatcgtggacgtcacgccaccgccgccgccgccaccagcagcgaggagggaatcgtgggcggcgccgccgccgccgccgcgcatgtgggaggtggcggcgccgggcgggaagcgggtggtgtcgctgcacgtgctgcccaggatgacacgccccgagtaggcgaagctcgtctccgcatggatatgcgattcggtacacgtaacacagcacagcactgtacaaaaacgagagctcttttgattttgccgcagattgaagctcgattatttttttatattgatttttggagtaaattccccccaaaagctttgaatcatgcatgcttctgttcatttcaatcaacaaaagaagaagaagagatggatcgatggagcgaagaatttgtttttgtcgatccacacacacacacacacaaaaaatctgaatgtgaatgttcgtagcgtttttggataccgtggtccattttatgttgttactgctttagctccaaaattaggttctattctattcgtcccaaaagccatgaccaaagtggtagggatccccgtgggcgatggcaacggcggcggcgaatgaccgatttgctgctttcgccgtcgatctccggccatgcgcgcgcgcgcgcgaaggaacctcgcatcttttcatctccctttttgtgtggatgctgtctgtgatcatcatatcgatccgctcgtgggccatgcgtcgatcgatcgatcgatccggcgaactttttttggttggtcgccaccggcggtggcaggtatgggcgaatctacagtattaacatcggtgtcaaacgataccgacgactttcgataaaagttatggttaaactgcttgttcatatattacaatactataattataatatcgatagacacgttatgataccaatgaattatttttctagatcggccactgcagatagggtgtggttgccgtggttccaacggaggaggacccggctgtccaccgaccagtcctattcgccgtcatggtgacggcgacattggctggctctggtgtcctctttgtcttgttgtcggttataaataacgccgcaacgatagctcgaaaagtaggcacctgtcgtccatgccaacttgctctcgcttgcatggtcacacacaacacaagagagagaaagaagaggagggggcaaaaaaaataaaaatctgggtgtgagaaagtttatagctcattcattgacgaaaggcgggagagcgacgcgcgcgcggtggccaacgagctatttgcgtgtttatagctcttccccgccgtcggtcaggatggaacaaagctagcggacggtggaaacgagccaaaaacgggcgacccttaattgcggcgagatgcgatgattccttgtgtgttactggtaactaattgcgatggccactcgtccggcaagtttcgctcacgcctgatgtcatttcttctttctggttatctttacatcgggaaagtgattttatccctccatgggatatctgctcgtttcgtgcatgccacctaaatagtcaataaaaaatatgaaaaaattggcaacatagattaatatgaaatatataacttctataagttgtaacaaaaataacaatataattgcgaatgtgcgataactattttcagttaatttgttatttttgttacaacttgtataagttgaatttggtcttgcatgtttgtggagtgatatatttcgtattaatctatgttgttaattgtttttaaaattttttgataactatttaaatttaaatgacatgtaaataatgaggggatatcccctcgagggatgaaaatccacatccctctacatccttcttcacttgccaaattcttcaagtcccagatgctctgaaagtgatggcttcaggacggcctgattctcacacactttcagacaagacttcttttttttttccctttcatttccttccaaaaaggagaaagcttttcagacaattgtgtgacagaaactaagcaatggtactactccaactatcatgaccggtttcttggccagttaagtgccaacttgatttcaatcagatttcaggcgtttctcagagaacaacttgagctgcttgctgtgtaggagtatgttggtagcttgcagagagtacagtgcttgcttagaccatgtgccatcaagtaaaataaacctagaaagtgaaatcttcattttgttagctatcacctagaaaaaggtgaacgcaagaactgtaacaagagagtgatatttctaacaggacactcaaaaaaagactaaactgttatagtagtgaagagtaagcaagacactaaagcctgaaaatgaaatcctcacctggctcaagtctcaactgtgactgaacagccaaccaatatatgctaaggcaaatcatttcccaacactgccgcacgatgctgctacctcaaccggcctaattagcgttcctgaattaccatcatccaaatcaaaattaaggttaggaacagtcactttcttacacggttacacccactggcttgcttgaccgatagcagtatactaccaacatatactccatatagcaatggcaaccgacaaaccgataatttctcttgctcagcaacttgttcgtgaccttgtctagatcaaccttaattgtagcaattagctacaattaaggcatcttctagactgtctggacaagtttgtagtctcgtccatccctagacagaccggcgttataattgggattcggacgtgcggcttattgcaagacatttggggcaccagcacaccactacagttaatgattatgctcatttggatacattgcaaaatcactatagttaatgattccgctcattttggatacacaacttctcgaatatgctatattctcacgacattacatccgagttggctttcttacagttacagtttccaagcaaattgttgataggttacaacttacaagcaaaagacagctggggaaacagacaacatgtccactctctaccagcagagtgtgcagagtttctaatctggcaaggcagtccccctttcaagattgttcttgatctcaagagtatacttgccaaatgccctctcaaccttcttgttgaagtgttcgttccggtcattgatcgagtcaatgtccttgtcttcatggaacttgcgcctcctgctgaatgctttccgtttctcatcccgttccttaagctcattaaccatcctgtctatgttttcttccgggaccttagacacctgttcaacgcacaagccatcgataaggactccatgacagaagggccttaaattcaattagtacaaagtttggtacgatggcaagtaccttcccatattggagacttgaagcgtcccgataaaattcaggatcggcttcctttgctttgttgtatgcctccatgtcaacctcaatgttcttggtcctctttttgtatgcatcatataaggtcttctggttgaaaactgcaagtgagaacacccccatttatatagaggtacgaggtttaaattaaaaagatcaaagggagttcatggccaaactcaaattgtttcaaacaacaagctataaccatgggcctatggcggctaccttgatgctttctgatttctgactataacataagcatcagggatttccagatataaagaatcatgtaagtagacatctcatggtgccagacattcaatgcactatgtaacaagaaatgctaaccagatgttgcattgctgaaggctagacgcaaaaattatagggagcatttgtcaagagcatatataacatataatcttgtttaagaacatcagtaatttacacttgcaggtttaatatttaaatgcaggaaaaacagaaacatatgttggtaaagtttgcaaagcacaggttaaacttataaaacaaagaaactgatatgacaacctagaccctgatgggaaaggaacaacatgccatatactactaggtaacaaactgacaaacaattattcaagtaacttcagaaaattcatttggaattagcttaaaacacgtataataaacaccacaacgacaaccggccatgagagacagcaatatgaatacggatgtgtcgaaattcaccaaagctacagaatatgcctctgaatataaattgaatgaagaaattcgagagatggaactcaccatcccaaccatatggtgcaggttccttttcccacttcttgtattttgcttcggccgactcctgtgtatcgagcatgtaagactttgtcatgtccaggccatttgagtcaagaagctttccgatcttcttttttctgtcttccagccacttttgtttagaaacacctctactctcagcgcgaggctccatctcttcttctctgccaccatcgcttgctgatttgccttcctagcttcattctgcagcacgagaaacagcaaagagatgaatacccaagactgcacagacaacagctatgacaaaacaatggaattgccgatgaccgcaccatcttcagccgcaactcaaatagcttcttctgcttctctgtcatctgcgggtaaccgtcgtctgagccggcgtcctcctgctccgcatcatcatcaccaccaccaccctcagcttgggcagcgtcggatttgccagcgtctgcagaaggcggttcttgctccgcacgctccaaccctaaatcgaagccaatgaatcactccataagcacccaatacaggctcaggacgaatcgaattactcctagcctcgaattagaattaccactatagtatggattcatggacatcacccatggcgcaaattgctccgatcagaaaatacgtacagaagcgagaggaggaggcggggctagcacctgatttggcgtcggcgatcctcttgaagcagtactcggagcagacgtggtaggggttggaggcgttgatgcagtcggggtggacggtgcggtccaccggcggccgctgctcgtcctcgatgcgctccttggcctcggcgatcttgcggaggcagtagtcggagcactcgtggaacgggttcgacgagttgatgcactccggccgcgacttccccgacgccgccgacgacgacgacgccatcggcctccgagctcgggattcgtcggaaccctagaagaggattagctccgcgtgcgaattggggattgagaaggcgatggcggcggcggcgaggtgaggtggtgtggtgggcttcaaaccgggccgaagagacattggcccacccatttcccaaggcccatgcattccgcatcgcagccagcccatgagacccaggagttagttcaaaggcctaagatactttcactttggtccaacgatcaactcctacagaaggaaaaaagtttatttcggatccctcaaccattggctgagtttgattttcgtctctaattggcaaaatcgagcacagcgaatcaatttacctccccacaccgttttgagagagattttgggactgcctatacatttgtcgataaatttttcctcaaaaatttgacaaatgtaattatagcacaatcgtagtgtaattacattgtaacttgcgtgtaactacagcgtaacttatatgtaagtttcacataattttgaatcgttagatctattacaagatttgttttggtgaggaagaaaacaaatcatagcacatacatatatgaaagaatttgttcccacgacctccattttaccgaaataacatgttacggagagatttttaaaaattacatacaagttacactatagttacagtgtaattacatgcaagttacagtgtaattacactacgattgtactgtaattatatctgtcaaattttaggggaaaaatttgtcgacaaatatatagcaaaatcgacgtggtgtctacgcgacaaaacaaacagtagagcccacgtgtcaccatctcccccccccccggattgcggagtagtcggatggcgttcagctcaaagtctagcaagaggagactctatggttggtgtaaaaaaacagtagactatatggttctgttcttttctctagcaaaagttgttcttttctctaacaaaagttgaatgaaaattaaaatttctgtggcacgtttttcaaactgctaaacagcgtttcgtgcgaaaactttctatatgaaagttgctctaaaatatcatattaatctaattttcaagtttgtaataattaaaacttaatcaatcatacgttaataccacctcgttttgtgtaaaaaacttagtcttcatcttcggaagaaaagaacaccacctatatatgcgaaaataaaggatccaggtccaaaactcccaaagaacttgagcaaaagttcaattcctctccgaaatcttgaaaattgcaaattctatgccaattcttcgacgaactgaatgtagaagtaccgtcactaccctatgcctaagaatttaagatcctgttgcgaaacataaataagaaaacatggataatgattccgttcgggccaccgggcgggggaggaaaattcgggcgctccccccccccccccgcgcgtgcgcgcatgcctgcgctccacctagcccaccacgtgtccacacacaaacagctctattgcaaaaaaaaaacccacatattttggaaatcctctattaaggaaatttggttttttttcaaaaaaaaatgtttcatctagtgcattcacaatgtttcactatgtatagatctaatgttgcagtgaactgaaatactccatcacggtcgtccgaattacccccctgaaccacaaaaaaagtacgaattacccccggaactatcacggtcgtccgaattacccccctgaaccataaaaccgggcattcttcaccctcaactatgcaaaccggacgaattacccccctcgacccaatccgcggtggttttggtctacgtggcgtacacgtggcagtccagtcagcattttatttattaaaaaaatgtgggacccacctgtcatagtctctcatctctctctcctctctctctcactcatcctctctctcgctggtggcggaggcaagcggcagcggcggtgcagacggcaggtggtcggcaggggcgcgcgggtcaagcggcagcggcggcgcgggacgggcggtgggcaggggtgggcatgcgagcggtcgacgcaaacggcgcggatgggcgctcatggcggcgcggggacgggcagacgggcggtcggcgctcatggctcttccgccccacatggacgccgcgatgcacgcgcacgcgcacgaggtgttcgtctcccgcgcccgaggcgagctcctcctcgtcggaacatgtgttcgcggtgaaggagcttgacgcggatgacgaggagaccggggagtgcaccggggagcgggaggccgccatggccagcatctcactctaccgctgcaacctcatcagcaccgtcggcattggctcctcgcccgctcgacgcccgcccgcagcccgcagccatccccgcagccggccgcccatcggtgtcggctcctcgctagcccgccgcccgcagccatctccgccgtcgtcgtcggcagtcgcgccgctcgctctgcctccactgccggccgtccgctccgcctctgcctcagtcgcccgcctcgccgcatgcgcc

SEQ ID NO: 58769 - DNA, 8058 bp, Oryza sativa
agaagtaccaggattggaatggaacggtacagaaccagaaatatttgaagacccttctcctgcgtaagaccccgaggtgcaagagatcacggttctgaggtgcctagagtgcttaggagccacgactccaagtccaaagatgagaacaaggagaagttcatggtaaccgtcttcaaaggggataaggaacgtgccaagctcagagatgatgacccccagaaggccgctgaactagccgggccaacatacttcacaactcatgattgcccggaaaagtacgaacatgggaaagcactcttgcttgaatgggcactgaacgaaggaccatgggagatgaaaaggttacataccttctacatggaggccagcaagaaaggcttggcaatataacagctcgatcaccggcagactgtttcggcgaagaaggttacatatggctatatttcttagatctccatgccatatatcatcgggataagatggacgtcaactatgtcggtgtttggtgcatgtgagtatgagttttaattaattatatgaaaaatatgtacaatacaaatccatgtgattgttactaacaaacttcttctgtaggatgcaatacatggatgctaagaagaaaaaagaacctatcggcttcttggatctaactcggatttgccaaacacagcatactatgaggctagcaccagggtctgaccagctgaagggcaagaatccaaaagagatagctaaatacagaagggcttgcacaaggagaaattgattactgtcgcacagtacattggacgagccttcttgcactttcaaaataagagagtcgtcatggccgcttataattttaagtaagtccggcacatttatcttgtacacatgtgtcttattttagctggtactaactaactatgctgttgttaatatgtagtgatcattatatctgtttactcatccaccctgaagacggaaccgtggtagtcttggaccctctcgattatagtcacaagcaatacaaagaatttctaacaatcttacagtagtaagtgattatgactcttgcatttttatatgaatgtattataaataaatatcctccttaatgtgaaacggtacgacatccatacagtgtgtaccaatactacaagttcaagggtggagaacagacccgaacaagggagaagctgctagtacgtacgtattggccggtaatactccactcacttaatgtattccaattgtttcactaattgcaaattttaactatttttttatgatatgtcctgaagtgtcacaagcaaccgcgaggaacggtcctttgcgggttttacgcgtgcgaattcctaagggttaatgggaggtacaggactaacccggaggatgtaagtctctatactatgtgctaaacagcttcacatatttatgatactaatatattgtttatcttcaatgcatgcagttgccaagattagaacatcgaacaagctttgacgatacaggcatcaaaaatgtccagcgtgatctgtgccacttcatccaccatgagtgctgtcatgtgaaagtagatttcttcgacccagagggtgccttagccacaagtaacgaattcaaggatcttcgggagtggaacagtgctatgccataatgtattaactagatggcgtatttgaagtgacaatgtaaaaaaaatattggaatatatatatatatatatatatatatatatatatatatatatatatatatatatatatatatatatatatattgcaacacttttgagttatgttatatatgtacatttatcagtaccaaatgcttgataatcttccaatatatgtatataataatctacctgcaagaatttctattaaataatttaaaagtaatttacgggcaaattattattaaattttaatattttctacctatcttcgtaggcggaattttttttttttgcaggcggccggttcctattttcgtaggcggaccggactagccaacgttcgcctgcgaaaattatcttcgcaggtggacggccaccccgcctgtgaagatcggcgatcgtcacagtcgttggcttacaagcggacatccgccccgcctgcgaagaccctttttggccgcttgcgatattgcttttctagtagtgacatctactatgtttaatctaggaaattaatgtgctccagcgcaaatgtcttggccaacggcatgttgtcgatgatgaagcggcttgacaaaggacgctgggtgcggtgtttaattattttcttcgcggcggcgcaggcttgctactgttgctacctccctgttgctagcgccggcgggctttggtcttctggatttcctaatctaccacctccgactctccgagtttccagcactcgggatgatgagatcacgcattaattctcctgataaaccgacgcacagataagctaatccatcgacgtgctggagataaaagtaaaaccaaccacgcgtaccggagtccggagataatcatgaaattatctctactaatgacagtggccccacctttaatttagttggaactgcatctgtgatcgctaccaacaaatcaatgtaatctatacctagtactagtcaatctcctttgtttgaacagctcaaatcttcaaaccatgtattaaagtcgaaatccatttgcaccattattttctattcaaaatatgcagcgaaacgagtctaatattgattatattatcgtatgatatttgaattttccgtgcctaaacgtcgtaaagacacgcttcacatctattttgtaaaattgggctgcaaattagtgcccaatgatttattattttttctatgaacaaacaaatgatagaattgagatatcaagtaggcgaattatgtcaatattgtagggttcatgtgcgaagcaacaagactcgactcggcgaaatgacaaaaatgagcccaatattgtatgtacattgacatcatttattacttatacttttggtccacatgtcattgagccttatatgggcccaagaaaatattatttgcataagagaatgatgccaaataattttagtattatttaattcgatgaatttttgcgtacaacgacaatataaaagcataacaattattagtgctttctaaagcttaatttgtaaaagtataccaatctagtaagcattcaaaacgtagagctcctgcaccaagatagaagattgtcacttgacgagtgaatttttggacgacgacaatacaaaagcataatactccttcagttctaaaatataaaaacatttagcactcagaatttgtcccaaaatataacaacttctctactagcattctctttccaaccaatcacaaccatgcaccattcacttttcctacctacctttactactcatccaatgacaaccctacaccattcacttctacctactataaaacttattatattctgggatagaggtagtaattattagtgctttctaaagcttaaatggaaaagtataccacatcaatctactaagcatcaaaaacataacatgcaatcataaaaattactaacatcaacaatttatcacattctaaaattcaatatacacacatgccagcaaaatcatcgtccccacaccattttcacaatattctaacccaaatccatccatcatttctaccacatctaacatataatcattcctatattttgcaacaaaacgcgggtgtcatcagttaatattgattgtggctaacacataagttgtattttcaaagactgcgtcaatgtccgaaactacttaatttgtgatgggaggacgaaccttgcacagccactattttgtcccggccactctgctccaagctttgtgggctcgtgggccacagaacctatcgcgattggaactacagttggcacctatccgtagcgggattcccggtggcgcaacgtgtggtctccgccgcgcccaaatccaacccaaaattctcgcccccgcgcccgcgtcgcaccaccacatcacaggacagacaaacagatcaccgatcgatcacgcgttcaccgccgcgccacccgctcggtcaccccaccatggccgccaccacctgccgcctcgccgccgcgccgttcgtcctcgcaccgctgcctcgccgccccaccacggtcgcctttgccgtcgccgccaccggcatcaagtacggctagacctcgcaccgaatcgttggctcgctttctcgtgttttattcgcaaaaactgaatcattggctctccatgtcagtaggtctcagggcgtcgaggggcgtggcgatcagggcggccgacggcaccggcagcgagacggaggtgccggaggtcgtcaaggcagcccaggacgcggtcagcatgcaatccttatcttctgctgctgctgctagctgctgcttctgcatcatcatttcagtctcagtttctgcttcagttagttgtgaggccattcctgtgcaatgtgcgtaactgtgaccaccgttgtgtctaggcagtgggccaaagttgaggacaagtacgccgtcaccgccatcggcgtcgccgcgctcgtcggcctctggactgccataggcgccatcaaggtatacgacgcgacacatatgcttccatgcatatgatctcttgctccttcaagttcagatatgatgcttaatttcattttcttggtaatctgcatatcggattaggccatcgacaggcttccacttttgcccggcgtgcttgagctcgttggaatcgggtatacaggggtaagttataggcattcagttgcaaatttcgttgtcacatagagagtgaggtagtgtaagattgcttctcttacgagctccaattaactgctgctttgtgttcatgcagtggtttacataccggaacctcatcttccagccagacaggttagacatcctgttttaatttttgctcttcacatccggttctacagtaacatgatactgcaccgttgttacagaactgacaatttctctggtttaaactcgtagaattttacatgtataaacattgtggagaggagttctgttttgcaatccgtatgaatgacaatgatttcgttaagactgaaatacttggtaaccgttggaatatgtgttatgtgtgatttttagtccttattgataaatcaatatactcaattgacttagattggaagttgaaccctgctaattaaaaaaaaccttatgttaaagaaatgaggagatacatggttctatctatggcttcgaatatttgacttttaagacaagatttggttgagcttttcgaattgagaccaaatatttagaagtgatggctcaagtccaagctcaatgttttattcaataatatccattaatactggcttgagaactagacaacatgtaaatacacttcaattagtaacaaatgttcataatttggtaaccttggataaggttatgcctcaaatatccttttgttctcgtatataaaattactattagcctttcatattcttatcatgtttggcactctaatggatttgcagggaagctctggtgagcaaaatcaagagcacctacaatgaaatcaccgggagcagcagctaatttcataccattttcgagaagatttctgtaaatcagagagcagcaggactgcatctgtcggcagccatgccagtgaagaggaggttgctaacgttttgagactggtccctccattatttccatcttatcccctggctcaaagcagacaaaatactattattgctgatgagctgctcatgtacctattttaattcaacaataatgaaatatgttttcagtttccgctccagacaactgcgtactacaaacatcattacatcaatgtggggttcccaatcacctgtattttcttttatcgaattcaatttgaagccgttggcatgagaagttaatgataattaagaaacactctttgttgtccaagctcgacgatactgctgacctaaccatctctctgatggaatccttaactctgtaaataccataaattgttgtagttctacatggttgtttggttggttcctattacttgtttaagttgtcacgccttaagttatacaaatttgactgacttagatggctgtttggttcttagccaatcttgtgacaagatttcctctcttattctctaccatgtagatcctacattttatcgatataaaaaaagtgtggcaagagtgactcatgttagctaaaatgtggtttcaattttactagcctatgatatcgcacgtttgcacgactttaaccattgtgttatatgtgtgtgtgtgtgtatatatatatatatatatatatatatatatatatatatatatatatatatatatatatgagcatgtaatttaaattggcatcagtaaacaatgttttattctgttaagtatgtgcttgggagaagtgtaattgatcagccatgacctgcaagcatatagggcatataggtagatgaaacactcactcttaaggccaacctattaacttttacactaaagaggtgaaccaaagtaaaacattaaaatcatagaaaaatttattgatatgtttatgtgataataaattttgtgacattaaagttacagtagtaatttggaattagtcggttgtaaggattgtatatacatataatataaataattttgaatgattatttgtaaaataatttttactgagtgcgtatagtgcaaaattatatcacatgccatacgccagccaacgcccccactctcttacaaagctacttttcttgtttgctctttctctctctcatttctgaattgctggaatgcttcggtagttcatcgtctttttttccctctataatcaatggctgaactctttagcttctctctattttgtctttttctcgattcaatggttattgtttatctgatgatgtggctcatcctaatagcattttgaaatttacttttcactaggtaagattaaccacatctttgataagttagcttaaaagaatcatgacaagtaaaaggacatgtaatactttagtggttacagtgatctaagtagcacccaaagattttaagtttaaatcttaaatagcgaattttggattgggttggatgtagaggtgtaaaatatatctttcttaaaaaataaaaaaatattaagtaatttaaagtactcaatcaaacagccctttcatcttcccctacccggcccttgtccgtctacccggtttggactccttccagttaagctaacaatccgttcaatggaatggactcaatggatagtgaccgaagatattacagactatctgtaagtgcagtgacacgtcgactgcagacgaatccaaagacctgaagtctgcctggctgcttttactgctgtcactgtactcttttcccaacaattctgcaattaccaaaagcgacgcatccagggaaaatatccttttctccagagaatatacaaatcgtgggtccttgctaaaatgaagtgcgtactacctctgtcccacgtagaggcaattcctaacatccgagtgcaacactaaaggagaggataaatatccaaactaccccttattattagtaaattagtattggtgggtagatatgtaaggggtattgaaggaataaaaatttttaatttacgaaccgagagtagataagaaggtagaagttgatttattttgaaaaaagtttgaatggtaaaagttgatttatttttggacggagggactacacagcaaccgagcaccaaccgtcggttcttgctaaatggcagagaactactgtactgtcgttagttaagtaaatatcgctactgcttgtctttgctaataagtgcctaagtgtcagtcacgttcaaatgctcttttttttggacttgtcgatacacaccctgcttttggtcgatcgatggtcacgtcggagagagaggagacatgaattaggatattgctatgcacgcttgtgaggaggttaccaacacttcatgcttgctggtgtaatggtggtcaccggtgagttaactaagacattttcgacgat

SEQ ID NO: 58770 - DNA, 5437 bp, Oryza sativa
  unsure (1)..(5437): unsure at all n locations
ttagtattggtgggtagatatgtaaggggtattgaaggaataaaaatttttaatttacgaaccgagagtagataagaaggtagaagttgatttattttgaaaaaagtttgaatggtaaaagttgatttatttttggacggagggactacacagcaaccgagcaccaaccgtcggttcttgctaaatggcagagaactactgtactgtcgttagttaagtaaatatcgctactgcttgtctttgctaataagtgcctaagtgtcagtcacgttcaaatgctcttttttttggacttgtcgatacacaccctgcttttggtcgatcgatggtcacgtcggagagagaggagacatgaattaggatattgctatgcacgcttgtgaggaggttaccaacacttcatgcttgctggtgtaatggtggtcaccggtgagttaactaagacattttcgacgaaatttttaagtcgtatgatagaagagaaaagtcttgttaaacggctgttaaaagaaattagaccaaaatcttacacatttttaatcttagcatttgattcacgattcatgcttcaatgaacccagctcatcctctagctgaggcgagctccgacaatcaatgacagagcgacaagttatggtttaaagttctgggttaggataaaggtgagacgaggagggaaggaagattgtcgggcttagaaggatggcctaggagacaatgacatgacatgccggtgggtggcgaggcgctanaggtgtgtgtgtgcgcggccagggggaggggctaggatagtgtgggtggcagggccaaagcaatgcttctagtttgaacgcggtgttttgtgatggtgatccagcagaagggaaccgttaaagacgaagaagaatgcgggacgggggcacctcgccacagttagcttagggagggggtaggtggtggagaagggaggaggcggccagcttcgtcagctttgttgagtgttgatgcctttcggccggtggtggcgcagcggagatggcaagacaattttttggtcgtttgactcatgccctctagtgtgatgtagtgactacgactaggaggtaggagaagagtaaaggttattgttgagagtaaagcaccaatctaaaagcaatataatggtatgaaaattttttctgagatatacgtttccaattgaattacttatcagtaagacccatataactagttgtaagtctgttagtgtcatactgtcatcgacatataatattccctgcatcatcttataatataagatctagaactgaatgtgacattgtattatgtaatgctttattcgatcctatgtatatgtagggattagggattgtttgttactttgtacgtctcctaatataagggattttgacattttacttgtactgtttgaccattcgtctaattcaaaaaattttgaaattattattatttttaacttattttattatccaaaatactttaagcataacttttcgttttttatatttgcacaatttttttttgaaaaagacgagtagtcaaatagcctaagctacagagagggttttttttttgtgcgccccaatttccatgtacacgtagcagtttctcccaaaaggttccatagaaggcccaagcgtcggcccccacaccatggcatcggataagattgccattcctttacttcggtaaacaaacaaaaagaatagttcaataataataaaaaatagaaaatgctcagcagaagaaacgaacggacatggcatcgcatcgcatcgcatccatctctccagaggcctccatccaaagccgcgcaaaacgccaccacccacaccacgctgtactcgcgacgcgagggaccccgccggcggcggcgcgaggaggagaaggagaaggagagagagagagagaggatgatcctggtggcgatcgtggcggagctgctggaggagtacacggcggcggtggcgcgcgccatggagctcctgctgtcgcgggcgccgccccgcatcttcccgcgccgcgtccgctttctcgtcctccggagcctccccttcgcctcgccgccgccgtccccgctctttcccccgccacccttcaccgtcgccgccggcacccgctgatcgatcgatcgatcggtccatgacggctccacgtacgtacggcaaccagcaaagacagtacgctggctgctgaagtagtctcgccttcgaatcatgaattaacctgctcgcgcgtgtgcatagttcaactcgtgatgtttgtagcagcgtgctagattactagctagttgttgtgttcttgcagcttagtaattaattaatcatttgcttagcttctgatcctgaaaaagcttgcatgtagttgtagcccagcgactgagttacggtcacgggctcacggccagttgactcggagcgagaagatgtgtgtaatctgtgtgaggttttgaattacttgaagaaaatttggagatcttgtttgtttttggctgctgatgtgttaaattggatcaaattcgtttgaaatttggacctttttctatataaccgcgcttccgcaggctggcgattcgcaatttttttctcggatcatttcatttcccagcacacaatcttctgtgctagtactaccgtttgcagaattgtgatcagtgtgggcccaccctctctgaactctgattcactagtatatttttgggtcgacacgttgaaccgccgattggacttacatgtgtgtctgtctggtgtggtggcggtttaactttaatcaaatactccctccgtaccaaaataaactaactcctatgatttaaaatttattctaaaataaaccaactcctactccctccgtcccattttaagtgcagtcatggttttccgtgcccaactttgactatccgtcttatttaaattttttctgaaaaaaattaaaaacataagtcacgaataaaatactatttatattttatcatctcataacaacaaaaatactaattataaatttttttcaaatatgacggacgatcaaaattgggcgcgaaaacttatggttgcacttaaaatgggatgaagggagtaccttcttacctaccatcaatccgcaaatcgagaaattttattacttcaatacccctcacctactcatcgagcaatacaaattttacattaattaagggtaatttgtttttttgtttcttttcttaatagttttgtgagattctaggattttattttattagggacagagagtttgattttattaagcccagagggagagaccccgatggtgatttatgcgatgaagttgagaatggacactaaccttttctttttcccgccaggttgcactggtgaagaaaccctttgtagtcccggtttgtaaccccctttagtcccagtttccaaaccgggagtaccaatccgggactaaagatcgagatgaccttttttttttgcatggccctgttgctgcatggtttatatatatatatatatatatatataaaccatgcatatatatgtttcaatacatatatacgcatacatatatatatatatgtatatatatatatatatatattatattatattatatgtatatgcatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctacaaggcagtggcaatacttgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcagaccaaatgacggaaccgataccaagccctacatggagtttaaagctatgattcgtagtagcaattaacataccaagatttcttaattaacaaaggaacttatgacggtacctgtctataagttcgaaaaccatgtcaaacgtagactcttttttatccattaagtcatatacgttgacggtgcaggcctccaggtcgatgagtaaaagcacccagtggaatctgcaatgtgcgtgggatgcattacatatgaaacacttagcaagttcgtatgggaatgaaatttggtatgtaggaagacagtaaaattaaactaactctgtgttgtatggcaacagtatgaacgtattgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggaactaattaattaaaggagacgtataataagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtaggtagggactgcagcagctcaggcttgataagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctacttgacagatgcagacatacccctgaagaagtttctgacactggggtctataggaatcttccttttttgacttcgaggcttgaattgcctcttgacttctgatgc

SEQ ID NO: 58771 - DNA, 12264 bp, Oryza sativa
aaaccaagtcctactacaacattttcttcaacaacaatacaatttcaaagtttttgaataagacgaacggtcaaacacgtttaaaaaagtcaacggcgtcaaatatttagggacggagggagtatatctgtagaccaggtcccatattgattgcatataccaacagtgcgaatgtggaagacttacttcttttacccaagccatctccaccatataatttgagcagttcacctgcaaatgttaaacccagcctattagagatcaaattcatagatgatggaagacagcctaatggcagctatttgttaatatatatctatgcactatgcaacgttccattatatggaatccagcaaacacagtcaaaacaatggacatgaattcagcatgaagatcacactacgacattgccctttttacctttccatcttccactgctcgagccatgatcattgaatccccatatgaataagaggttggaataacattaagtgcatgtgccatagcatagctagtctgcaaaattcaatagttgtaataaagtactttgtccattacattggtatggaacgcaaaaatatgccaaatatgtaattattttgagtcaagaaggattacgttctctgcaaaatgaagggcattctcttgcttgatctcaggtgggtaaacaacagggaggtactctacctgtaaaaagtatggttcatgtaaggaccttattgtgtaagtagttattaccaaagacatgaagattttacattctaggctgaatggaatgagagtgtgcacctccatgaaattgtgaaactgggtaaacatcttgaacatgagctttcctaatgatatatttcccctgaagcagaaaatgaacataaataaagcattgaggcaacaaataaggatttatttctgtacagataacttaccatgattgatcaaagtgcacatgtggatagcgcacaataacaggttgaacagggtagccaggtatgaatgcaccatgttggaaagaaatcagaaatcttccatttgttgtcgtgccttccgggaataacaagacacgtgggaagctattgcaagccgcctttctctgaaatcacatcctagagagtatgtaccatatgaacaagataacaaaacagaaaatcatgctttgcactattctaggatgagttgcatggcattgcttcctgaaatcaactgtggtgtatttgcatattgtagatgaaagaggaagctacagaaatggtggctgcaagcacaagtttgtctttgttcttttctgcctattattctttctaccccagaagtccactgtgtgcagtaatgataatttgacagcctaacagctataggcaacagaaagcaacaggataacttgcatatcaccaattaaaagatgcctgacaccatgagaccatcactttattaaggaaaaagcacatgtaatttgatgcagttaattaaaagtatgcagagcaacagtggggtcaagaggaatcattctaacctttatttcatttacagcagacttccttgaagctggcgagaatctgtcaacatatataacctatgcatttgttgtaaatttgaaacttgaaagtaacttgcaaaatagtgtcaaagaaagtaactgggaaaaagggcttttaaaacataatggatatacctgcattgctcggataattgttccaacaaatggtatggaatcatgagaatctgaagaaacgattgtcgggaacagctcatagaagaagtatatgggttctatgtatgatacatgatttgagacaactataggtgcaagctctctaggcgcgggttttcctttcctccttatccaatggtatctgacagtagaaaacaagtggttagcaaagatcagacagtaaacagttgtattgcaagaagaaaaaatgacaaacagtaggcactcagtcaggatatcccagcatagacaaggagcaaaagtgagttgtttcaaaatttcccattaaaatccatatgtgagattaaaaaccaaaactccagatcatggcccaaaggaaaactttagtataaaacaaaatccacatccaagtggtcttcgtcccctgaagtttgaacaaaacgttcatttctgcaactgcttacagaacacgaccaccaacactgggcagttcccttctcaagttctcattttactgcatagaagaactattggcagagatgataagctatgtgtgtgctttctcagcattgaccactcaacattcgctcgcagttttcaccattcttttcacaacaattgaaacttcaaacgtctcaaaatttgtgtgcagagtgtccaattgagcaattcccaggtgaacagcaatccaatttgaactaagtagcagccacattttcgatccaaccacacaacagcccacctgattagtgcctcaacttaattaattatcagcgccaaaggccaacaattttcagaatactttcaggaaggctttcttactctttctcactatcttcccaaaccacctagtagacaaggcatcatcattcatcgctagtccatctcgtttcgatccacaattgtagtgaagctaaccaaaggcgccgtgcagagatcagtctctaacctcttctgaaccaccgtggtaccctcccctcgttgtcggtctcttcccagccgcaattagtgcagagaaaacgaaacaaacaacatatctcacacacggacccttcacttcaccttccatacgctacgttgcgcccacctaacaaatgattgcagcaaagccacgcccacacacacgtgccccaaaaatcaccaaaccccaaaattccgcgaaaccaatcgcgccaccgaatcaatccatccacagatttcgagtgcttcgtctcaccacccgaatctaatcacctcaatttcattctataaacttaacagcggctaatccatcatccgatgcagatcggattaaagtttttttgttctaatttctgatctgtcatcgatccagactcgattctgagtgcgcgtttggtgagagggatgctaatccgagcgacgaacagcggaaactagaactcacccgaaggagaagaggatgcagcgcgcggagatccgcgtgatccacatgaggcggcggcgccacgccggcatgggcccggcgccctcctgcgccgcccgctcccgcacgtcgacccacccgcggagcgccacccacgtggcggcgtaccccaccgcgatggagagcccgaacagcaccagcctcgccgccgccaccggcgcgcacacgagcgccctcacgagctcgtacgccccgcaccaccccggcgtcccgttgcggaacgggtcggccggggacaccccccgcggcgaccaccacgccggccgatcctccgataggaacgcgaacgggtccccccctcctccgccatcgccgccgcacaccgttggcgactcctcgtcgtcgtcgtcgtggttatggtgccccgcgtggccgttggtggtgggcgtgggcgagatggagtcggagaggagcggcgtggagagggaggcggggctagggtttcgagaagccatgggtggcggaggcgaggcgagaggaggcggaggcgggaggccagcaatggaggagagggagtaatggcttttatgaaagcgaaagcttatagcaagaggaggaaggagacgttccttttttgtggtcgtaaatctatttaatttatttctttaatcgtcttcaaataaatcctttatttatttttgcgttctatccctcgcatttctgggtttttttcttctcgcgttgcctatagtcaagggagtggtcggtggctgctagtactattttttaaaagaaaattattggtctcttttcttaactgatttataaaagttttttcttctcttcacatgtgtttataaataaataattgaggtccttattaagttgaattgagaggtttaaagaatgcttatatgtgaaggttgaattagctttgattgtgtggacgtggatgctctagtcttccctcttgtatgctaaaggattaatttagatgaaattagtctttcaacacgtaatcctaatagcctttgaaagctgacattatatgatagagcctgttgttttaccaattactgcaacgttgccgtttgtagatttttgtgcagtttataacatggagtaaatcaggaagttttcgatgtgacatgctagattaactctaaatgtgggaataatcaaatgtgacaaagggtggaatagtaagaatgctaacgtgcctggtaaaaaagagaataatacatatgctatacgtgcttctacggttcaaaaaatttcaaaattaaccactttatttttgtcactgagttccatattctagaggacaatatatttaatcttacgattgtatttcagattgcattttccgtattccaaattttacaagatatatacgtacacttaaaagaagacttataaagcacaagcaacagcatgcaaaaagaatatatgtgtaagtgtttattgtcattctaatgcgatgctctgatgggtttctctttattattccaaaagatcagtggagtcggctatgttcttttcagctgtactccaccagattttatcttctgcattgcttagcttagatctaaactatttgccaagtttacttcgcctacataatccactatgataatcaggtcaataatctttttcaaacttgtagtacttggaaggaaaatagagcaaggggtgttggtgctatttaccaccgggccgggcaccaaacagcaaaatcacaagacaacaagcagtccagtagtcggacactcggattgcggtacgtgggggctcctccaccgcacccgcgacctggcacccactcgctgacatgcggccccacaactcctgagcccacctggcgccactccgcaaaaacgcgtgtttcgtggaatttttttcatttttaattttttttaatatttacaaaaaatattataccgacaaaaatattttgaaaaaaaagaccctgttgtccaagtagagggcagcaaggtgacatggcacacggcgccgatgtcaaaatgcaattttcgccgcatgcaaaattcccatgcccgctcagcgacctctagcgcttgctcacacacgtcaccctgccgctctcgaggagcgcggatctatttctatgaatattttcacccgtataatatttttgtaaatattaaaaaaaataaaaatgaaaaaaaattatgtttcgtgcggtggcgtgacagacgacgtgggcctccggccttcgggtgggacgctcgctacgctacgagtgcaaggcccgccgcgacgagagacgacgacgacggcgacccgcgcgccgaagcgatgcaagtgcggccgtgtccaatcgtcgtctgccaccagcccaccactagcttcccttgtgcaccagcctgtctgattctgatctggtcgaccactatctatctcttctagctcctcgtcctgcactacagtccactgcactgcattgcgctggactcatggtctcatgctatgctgacgaggctcgggtaattggacgccttccttcttgattatttattttttttaattttaaaaataaatacttttgaaacttattttcaaaacattttgatcatgctaacccacctagcgtggcaaaataatactaacgccgcacatcgcggggcattacagttttgtattgctatgatggttagagtgacgtggccgaataacgttgtcatgccaaccagatcgacgtgatagttttgtcttgccacgtcatccaaggtggtatggccaaataacactgacaccagccagaccggtgtgaccaaataatgttgtcatgccagctagattggcgtggtagtgttattttaccataccaattctactggcgtgatcaatgctcatatcttagaaataacatttcaaatggtttatttttaaaatttaaaaataaaaaatctaccatctcttctaattaaaatacagattttatcttaacttctattagcatatcttttaaaccaccaaatgttatgtttcctgtacaagttgttttaaaatatcaaacaaatataatttttaaatttataataattaaaactcaactaatccatgtgctaacaaatttcttgttttgcgtgcgctcacttcatttccattttaatgtatcacaagcatcgccttaatcctccgatcacaacctaatacaacactcctatctcttatggagattttggaattgtcattagcggttttcttatataaaattcgcccatggttttcacgtgaattggtaatttgatataaaaccctccctgtcaactcacgcctaaatctcctgttcaccaatatttaaattgctaattaaatttttaagcaacggtcaaaatgttctctccctcccacttgttcggttctctagcttgcgtggtcgtatacatagaatgttgattatatggcacgcccttctaatattttgaaaacgattgtatatgacgcttttttgactatcaaatgggcagatcttgcgttatttcacactcaaactgaatctgataattattcttgttttaattacgagaggcgttgattctgcatgtgcctaaagctagctaccctcacatgaacgccgggggatattctactgtatttgtgtaagatcaggatctggctttgctgtgcacacgacggtatccttgctggatccactggagtactagtttgagtgatgtttaatcttttttaagtcgtactgtgtaattaagtaacaaaattctcgccgtttcggacaggtagtccactgaaattgcacgttccccttggctctctttggacgtggtcacgttggtttgagctgttgttcttgaggtctcaattggcaggatctcgatggcgtaatctcttcaaaatttttgcccggttatctggttttgagagccgtggttggctgaccggacagattctccattcttcttcagcgtatagaagaattgctagtgttcttggcgtgaacaggtcgcggaaaaggaagaggaattgaacccgatgaaggcaccgccaccgtaataatccgatgaataatcggtcgtattagtatcgtacagcgacttttttttattaataacccataacctttatttccatttcagaaacagtgtacatgtttttatcgtacagcgacttggctaacgcttggcttagcagttagcacctgttcatgacgtgttttgtttagccgaccaaaacgccgtgggcgggcggcgcgaccaccagatttcgcgcgagacggcgagcaaaacaaccgcccacgtcccactcgccgacacgatgatcgctgtcacgcgcaccgcgtcaggactcaggagccacgacacaagcaacgttgtcaacttctcgtagattcaatcaaccatgaaaggaggcatcagttcatcagcaagaaataacgttgggaaaaggttaaattgagaagagatggtaattctctttatattccaacacttctctttacgcgaggcctcttcaagcctttagtgtgatatagaagtggattagcctttagcgtgaaatagaaatggactataatttttatttagttgcacaccagccataattcgaactcgaaaccttttactttaccttttactttgatatcatattaaattgcatgcaccgaacagtttaatccaaaaatttaagctgacgaggaaagatggaccattcattttttattccaacaataacacacagtaatcaatctgtgaaacaatttggcaccatatttttgacagcagcaggagaggatcacaacacgaaaatgacaccgaatcgttggtcgacacgaacgaagttacagaattttgcaaggtaaaaattgccagccgagatgcatgtctgatgcttcctagtgcgcgctctggcgcgcgccctcctcggcgccggcgacatcctcctcgtcgttgtcgttgtcgtccacccacttccagtaatggcgcttcacggtgatggcggcggcggctccatcgacgacgacctcgtcctcgtgctccccgccctcctccgtgtcgaactcgccgtcctcggggacgccctcgaccacctccgcgtccaccgcgtggagaacgtacctggcgtggagccccgggtaggacgccgagtcccgctcctccacgcgggcctcctcgccgcccaggatccggacgcggacgcgctcgccgagctcctcccggacggcgcggacggccgcggcctcgggggtctcgccggggcgcatcttctccgacagcgggcggagcccgccgcgggagcggagcgtgccgtcggagaggagctgcccggtctccatcagcagcgcgccgcgcccgttgcggatccggacgctggcgacgtggacggcgcggacgacgggatgctgctgctgctgctgcgatggcggcgccgcggcggcggcggcggagatgaggacgcactccccctgtgagagctcgaggaagaggttgaggagggtcttggttcccggcgccgtgccccaggacgccagcgccgacgccggcaggcgcgagccgaggaacgccgccagcgagtccagcgtcgggaaggccagcggccgcggcggcgacggcggccgcatcgcgattggtcagcgcctccgcctctctcagtggtggtggtggtggtggtgggtggaatcgcgattcgctacgaacgcaaatggggaagagaagggatcgcgttgcgtcacgtggagaaatttccaccagccacccaaggccgcgtcctacggcccaagtgcgagtatgggccataggaaagtacaccgaaggtccctcaacttgtcatcgagttacaaaatcgtcctccaagcgcaaaaataggtatctaacgtcccttaactaaccaaaaccggacacaataagtactttaggacaagtactataatatctcatatgttgcccctaagaatgccacattggattgggtgatgaggtggaggagagaagtggagagagagaagatgagccacccctaaatcaagaggcaacctccacacaaatttcaagaagtgtgtgagagtattagagatattggtatttgtgtgttagaggtgatacattgtatgtgttgcctcttaattcatgagtgaataaaatagataaatttgaagatggtagtcacatctaccatagcacttggcctaagtggttttgaccccggttttatgctacgtggcggctgaattagcatggacccacgtaggccccacatgtcaggctgccacgttagcctcctctctctctcccttctctcccttcctcatccctctctctcccttctgagtcagctggcgggaggaggagggcgtcggtggccggcggccggtgacgggcgtcgcggcgacggtgatggcggcgacggccgacgcgacggcggtgggtggagcggcgggcgggcggcaggaaggggcggcgcgcgggcgggcggttgggaggagcggcgcgcgggctccccccccggccgccgcccacgaggcccacgaggcagcggaacggcggcgacgactcggcatcgtcctcgttggaggtgagcgcggcggccccaccctcgtcgaccgcgagtcgcgcgcagccgccggggcgctgaagaggtaccccgccgcggcgtcgtagtcgggattaggagatgccgctgagaagcatcgtgccgatggcgagcggcttacggccgaagcagtcgaggagcaacgcaaggagcacgtaggcgggcatctcggcgagcgagttcaccgaccgccttgcagacgaacggcggcgggcgtcggcggcgatggtggcgacgggcgacgcggcggcagtggggggaggagctgtcggcgggaggcggcaggtggtgctccggaggacgacccgggcatgccgatggcgacgcggcacctgagctgaatggcgagggcgagagtgaacctcatgccccacgtcgacgtcgacgagccggcgaccgtgagggcgctgctcgagcaggaagaggaggcaccggcgtggccttcctccgcctcccctcggcctcctccgcctcctcttggccacgagccaccgcctcgccgctccacgctgtcctcctcctccgtgccgccgccgttcgcgtcaccggccgccgcgcaacgtcttcctccgggtcggcctcctgctccagctcgacggccagcgacctcgcgaccgcacgcctacggcctctacaaccactgcggagggcgcgagcggcggggggaggagctacgcgtggacggcggccggcgggggagcccgtgtgccgcttcccccaccgccgccgcgtcgccgccatcaccgccgacgcccgccgcctaggcgctgccggccacagagaagggagagagagatgaggaagagagagaagagaggaaaagagagatgagggtgttgacgtggccagctgacatgtgggacccacgctgactcagccgttacgtcggataaaaccgggttcaaaactaccgaaggatgtcgggtgaccggttttatataattaagagaactcgcgtatctggttttgcggttcgaggatgttttttaccctgattacaagttgagggaccttcggtgtacttttcgctagaataattaggctcatgcgttgtgtccttattgggatgggccaatttggatcgtatttacaatgggcctatgctttctattttggtgggccaaatgagaaaaaagatttggaacgagagacgttcctccaaacatttttaaaaagaaattataagtgtgtttggattgaatacgggatcttagagttgaaaccgcacacctcttaccattaccactttcatttgtgctgaccaaatttcatccgatggttgctggtaactcaaagggattcggtgacatgtacagtactacagtgtacacagccagcaggcatattactgaacaaagtcggacagatgattaagcatgttttatttggacagtacagaattaaacaactctgattcaaccgaggaactgatcgaccggcgaagaacagcaatctacagaagaaagaattttgccaatacaatcctatgtacttcctcatcatatagtagtgaccaactagcaaacttgaaactgctcttctggatcttaattactactgcgccatgatcgtccaccagatgaagctgaagcctaccaaggacgatgcactgatcaagctcaggcgatgcgttgcgcctccgctcgccgttggcttggccgctgcaagattcagcaaacaaaagagaggctcagttacaaattacagctacatgtctgtgaatcactggaaatttctaagcaagcttgaaatgatctcatacagagaggttttaatttggctgccagttcatactgtggaaaactgaaacataatctgaattgtgatgttctgagttgacagcgaaaattgttgttctaattaagcacaggtacctgtagatgcagcgtttccagtggaagctgaagaagcagcagtgctacctgcagtgccggcacctgcaggaattgaagagagttcagatcagcatccctctgtaaatgatcatatcagttttttgtgatctgattaaaatgccagagatcatgaattggaggccatgattaaattgtgatccatgattaatttgcgatctctcaattatcaggtgcctcggattcttgtgagaccggagagacaactgcatgctttagctggcactagctagctagagttggtgcatcaaacgacaaactctccagcgaggagaggagcactgttagtgttaaactaagcaataattcagaccattattactctagctaggagaaacaaacaaacaaacaaacaaacaaaagcagtagcagtcaaaccgcatcaaccactgtacgtatgtccactgcaattagtagcagcaatctagccgcatggatcacgccgtgatcgtcgacgagaggaattaattaacgagatcaaaacattgaggaaattgatggaattatgtgtgttaccggcggcggcggcggcggcggtggcggaggaggaggcggacttggcgcaggcggaggcgtcggtggtgacgccgcagcgtttggcgaggaggaggccctgctctggcgcgacgccgaacgcctggagcgcggccttgttggtgaggatggcgcacaagcacgccgtctcgttggcggcggcctccctgagcgggccgcagcacgacgccggc

SEQ ID NO: 58772 - DNA, 691 bp, Oryza sativa
tgtgattagagccatagtttctagtcggattcgtggctatgggcaaccccgttatgggtataaatagaagaggggttgaggctagaagatattgactctttggagagaaaagttaaagtttgctcaaggttccaaccctaatttaaatgcactttgtaaaacacatattgatacaataaattttatctactttcaagaattttatcgatacatgtttttcttggtcttgacggtcaaatcggcatatgacgagcggtccaaccggtggcagggaggcggtctaaccggcagcaaggctggcggtcagaccgatggtgtgcaagccgccagaccggtgggagtactgtggtcagaccggtggtgatgtactagtgtgaccggtatagcttcgtcaagtttgcgggtaacttctattttcgctaaaagttatttgttttttttccttccattcgctcctctctagtaggcttggttctgtattcgattctacaaattaatccttgatttctttctcaaatcattcaaccctgtcacatactcagaatccattcctgtagaacattatttatgcttgcttaattgtccctagttaagcatgaagagatacttgatgttgcagggaaattggaaaaaggaaaacactacaaataagcggacggaaagttttaagtacccaagcaacatacctcga

SEQ ID NO: 58773 - DNA, 3756 bp, Oryza sativa
cgccgcctgcgccgccgccgagctcgaggctgcgcccacgaataaggccgcgacgacgaccaccaccacggcgacgaacgcccgcgccgccataggtgatcagagcgatcgagtgaggtcgcggtgatcgagcgagcgagtgagcgaggtggtgtgggtagagtgtacgtagaggcgtttgtgtgtgggttgggttggcggttggtgcatgatatatgggacgtgtcagtgtgacactgccagggaggtttagttggcggcttgtacgtcggctagctggagtacgtttctttctttccacagctaattaagctagttagatactccctccgtttcaagttataaactttgataaaagtaaaactattttaagtttgattaaatttatagagaagagtagtaatatatttttaacccaagacaaatttagggcatgttcactttgacgtcaaaaaaaaccttaccaaattttagcaacttgccaaattttggtaggatttcttatatagttaccaaaatttggcaacaaactaaatgtagccacttttttgacaactttatcaaaatttagtaaggttgaaaatgacatcaaagtgaacaggcccttaatataaaaatatattcaattattgatttgattaaattaatttagtattataaatactattatatttatttataaacttagtcaaacataaaacagtctaactttgaccaaagtaaaaatatattataacctaaaacggaggtaatagaactcatgcgacgagtaagttataggcattacgctgccaaataaatatttcaaactaaatttaaaatttattgatagttaaagttttacccatttgattttagtcattttttaaaaagtcaataaattatggaaatataatatattattgtactctctctaaagttgaaagtatttaacccatcttgtcgaccgacctgtgtgtttggaaaaatcttaaaaaaaaggtcgatcggaatcggaatggactccggattgggcttagctggatcatcacagaaaaaagcccaccttgttgctccaggcgaacgtggtagagattgtgcagtttttacggccggcgagcagttgaaacttgaaagttgcagggcctcgctcgtactttcctctattctaaaataagctcatttctcagcttacctacacatatcaataaaaaagtaaaaaagataaaaatatcattactgtatttaatcttaatgtaatgattcctttctttatctactttctctgcatttattcagtacttatacaaattctaatataatgattactaaaataaaattatttaggacaaacggtataggctaaaagaacttaggatgggggagtataccgcgggtagccactaaaggacctgttgaggttgtagctaaaatgaaccttactaaatttttgacattgctaaaattttagcaatttaataatattgctatgttttggtgggattttttatgtatttttcaaagtttagtaaaaaaaattaaatgggtgtgcatatttgacaattttattaaaagttgataaagtttatttcggcttgatcaggcccctaaagctgcatattcgtttggtcgcaggctactcgcgcgtgccgggcggtcgtattgctgtccagtacagtgcgacgatctcgatcactgataagatgagcatgcatgtacagtagaggatggttcgagaaacaccacacgcatgcatatgatcgatcgatagcgtcgagggcacgcgcgtaggacgtactctgatcatgcatgcatcccctatcggaaggacaacacagaccagctacggcatcacatcggaatccaatgcaaaactggagtgagtacacctcggcggtctcctctgcagtcctgtatgtactctctctctcttctataatataatggattttagaagaatgtgatacatcctatcaataacggacacacccattagacagggtgggtcggctggtccagctatggtctatgtagtcccacatctccaaaccttattttagtcctatttctaacacattagttgctagtctactattgaataatcaggtaaatcaagtattttaagtaggaacaaaaatatttatgaaaattcgtgtataagtagtaggatgtgtctattcattgtactaggatatgtcacatctacccaaaatttgttatattataggaccgaacagatggagtataatattgttcgacgaaacatggatatgtgaggatctgtagtaccttttccgtttcatattatacttcttctgttctaaaatattgttcgatgatacatggatatgtgagaatctgaagtactccttccgattcatattatactacttccatttcatattacacatccggtcaaaatctcttatattttaagacagagggagtaagtcatttgattttttccaaactttattaagtttgatcaaatatataggaaaatacagtaatattttcaataataaataaatatatttgttgaaggcatatcatgagaaccttcgaccaaggctgccaaaacctggtgggctcgatcgggcgaagcatagggggttcactaaaggccaagacacttttgccacctgagggcccataacaaagcccatcaaggagcccaaggcacaatagactctagttaccctcacaaatgcccatatcataagggtattcatgtaaattctccttactaattaactctagggtacatgaaccctgtactcattaactttaggttgcatgagtttgtactaaagctataaatagtccatagggcatgtaatgggggattcaaaattccacaaatcaatacacattgttttacttttcactgtgtgaaccacgtctttcgacgtacacagttgtcaatcgacaataatattatcaagatatattcttagttaaatataatgaaactaatttgatattgaaaatattgctaattttttctataaacttagttaaatctaatactttctccatctactcccttaatctttatatttcatcttagcagacggaggaaacggaggatttttgtgtcagcgaggccggcaactcgcctggatcgtcgcatggccttgtcgccgcatgcacgcacgcagctgggatcatagtctcaactgtacacactctcttaatttgccggctgcagtagcatgagtcctgttttatgtgctcgtttcatgtgaacacacacatgcagtatatgctctccagttatgctcctctaactagcatgagttctgttcagattgcaacctgcatatccaaagatgcactgttattaatgggagccgtctatgtcagagctataataatttcttaattaaagtctacctatacttccatttggtggtgcttaatctcaagttaatgcacgcagctgcttctgtcctttggagtccccactatatatgtatactcctatcaagttaggtttggttcacatttgctgtaatcaactaatcttgcatcaaacttacacagttacacataacacatcagttgctagagctatcagctatgtgattcagatcaatatccattgcgtgccatggtaatggcagttcagagctagctagagcagatattgatccattatattggttaggcgcccattattccacttggtaataatatcacaagccatagatggacagatcgatcgatgcatacatgcatagatagacacacatacagctagccttcatgcccatt

SEQ ID NO: 58774 - DNA, 2267 bp, Oryza sativa
tgtgtgcccatgcgttcatcaatcttccttgccacctcctcttgcatgttgagtttgtagctcgatacccggaactctaggtctgcaatcttggcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctctcgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctctgaatatgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttctacttccgttatgatgtgccgaccctcaagcttcttcgctgcacctcgttgcccgcgtgccctcttctgtccaacggagggttgactaccactagcctcctccttctggttcccctccacatccctttccacgtgcccctgctggttcccctccgcatccctctccacgttcccttcctcgttcaagtactggtttggatcctcgttcccctcttcttcattccagtactggctgcttccctccgcgattggatcggacaatatctgttcctcatcgcggtcagccatctgtgatacaagaaacatctgtaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataattttatattaaaaatcaaataatattacatgctaagactaaaatagtcatgtatatgctaagtgtttcgtgcgtatatgctaagtctaattaagactacaatagtcaattgctacttgtcgcaccaattccgttgtcaataattacataccaagtctaattacaaataaagtaatattatattaaaactcaaataatattacatgctaagactaaaatagtcatgtatgctaagtgtttcgtgagtatatgctaagtctaattaagactacaatagtcaattgctaggagtcgcaccaattccgtagtgaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaaaatgtattaggataaatgcgaagtaacatatatatatatatatatatatatatattgcatttcacgttaacgttcgtcctcgttcgttcgctcgttctcattcacgttcgttcgcttgttctcattcacgttcgttccctcgttctcgcttgtcttcgttcgatcgttctcgttctcgctctcgttcgttcgatcgttcttgttctcgttcacgttctcgcggcaacgtacgttgacgtgttcgttctcgctctcgttcgttcgatcgttctc

SEQ ID NO: 58775 - DNA, 1785 bp, Oryza sativa
ttggtttcattgtttcctgctctacatgcacagcacgagccaatcaagcatacaactacacaagacaagcgcagttcttccgaattcagacactatatgcagccatgcaggcaggataccctttgcattgcaaccatggatggatgggtcgtgcagtctgaaaacgatcgatgcttttcgttcgattaattgcttcatttttggtactacaaggctgctagtggctagccaagaaacaaatgagacatactcaaaccatcttataatataaggtatatattataattggaacagagaatcagtttaaattcatagtaataagatttgtcctatccaagcctaatatcttatattttaggacggatggatacatatataccttatttaagctctccctagataattactactatctccgtgtttcaatgtatgacgccgttgactttttatttaacgtttgatcattcatcttattcaaaaaatttatgtaattatcatttattttattgtgacttgaatcgttattaaatgttctttaagcatgacataatattttcatatttgcacaaaaattttgaataaaacgaatggtcaaacattgattaaaaaatcaacggcgtcatacattaaaatacgttaaaatacggagggattacagcttgcttgcattgcaggttctgtacatagccaagaaaaactcaaactgcaatgagcgagaagtgagaacatagcttagctagctataggggaatggtcagctgcgctacttattgcggagattgaggtatatatcaggctcttgaatgaatcttgattcccggcgccgcgagttcgttcgtcaaagcgtgatactaatccagaatcctaagtaaagaaccaactgataaacaaatcacacggcatacctaagaaaaaggtatggccatgtatcttctgtagtaaaagctagctcaacgcatgtaaaagtacatgctttagggcttgtttgatttagtgtcctaccaaagtattggtagtgccaaaacttacgtatgttttggcactaccaatattttggtaggatagcattttaggtgaatggatttggattgataccaattggaagccaaatttatattatactcaggaaagttctagaattataccaaattaatcatggtcattaccattcacttggcttcaaaccaaaccattacattcactattcaaactacgaaacaaactggtagggcacattttggcatcaatccaaaatggcccataatgcttatacagtaatatagtatagttacttttttagatcataatatagttactttctgaaactttgatgctttcacttcgatcatggccatgtttagttcacccccaactactctaaacttccaactttccatcatatcacatcacattcaaaactttcctacacatataaacttttaacttttttccaaacttttaacttttcccaaacttccaacttttttcaggaactaaacacagcccatatatcatgtactaaagaactgtgttcggatgctacttttcccaacctctctctctcgtttccgcacgcacgcttttcaaattgttaaacggtgtgtttttttaaatagtttctatacgaaagttgcttaaaaaatcaaattaatctatttttttaaaaaaataacaaatacttaattaatcgcgtgctaatggatcgtcccttttccgtgcatactgtacaccgtttccatccaccggtagcgaacacaccctccttcaagaaagtatagaaggaat

SEQ ID NO: 58776 - DNA, 2309 bp, Oryza sativa
aattttctgtttaggtcccattcttgtcacaaatgtaaccccttgccatgctctagttatgctcggccatgttttgtaataattctggttaggtcccatgttttgtaatttttttaaataaaatcataaatataaagttttaatagaaaatgtaccgtttaatagattgaaaaatgcatattcatgcatcatttctcactcttccagctaggatattgataacgtggatagctattcaacctgctgaatgttattgtacatgctcttaagagagaataaaagcctatcggtaaaaaagaagtaatgggggtaaagtagtttatcaaatttttttcacactgagctgatgcatgttgtggtccctttaacaaggtagattatctttatgcccaattgtctatctatagccaacatcagcatggagcaataaccgctctaggtcaaataatagccttgcaaattttaatactcactaaataactagacttttctagaaaaatctccaccatgtcatagtacaatgtctttatccatgcaaggtccaaactggaaaggaattttgtaaaaaatattaagtatttccaacagttttttccctctccttataaaagttggtgctggtcagtacaaaacaatcattcaagtgaccaagcaaacacacaaagcgccactgtgtagctcactgctcactcatcaaccaacttcctcaataatgtctcgctccagcctcgccatggcgctcctcctcgccgccttcgccgccgcggcgacggcgaacagcggcgcagcgccggcggctagcgacttcatccgcaagtcgtgccgcgcgacgcagtacccggcggtgtgcgtgcagagcctggcgtcgtacggcggggccggggcgccgccgccgcggagcccgcgcgagctggcgcgcgccgcgctgtcggtgagcgtggacaaggcgcggtcggcgtcgacgtacgtggggcacatatgcggccctggcggcggccgcggcggcgccggcggcgcgggccccgtgcgcgactgcctggagaacatggcggacagcgtggggcacctccgcgacgcggcgcaggagctcggcggcaacatggggcgcgccggctcgccggggttcaagtggcacctgagcaacgtccagacctggtgcagcgccgccctcaccgacgagaacacctgcctcgacggcctctcccgcggcgtcgacgccgccacccgctccgccatccgcggtaagatcgtcgaggtcgcccaggtcaccagcaacgccctcgccctcgtcaaccgcgtcgcccccgccaattaaacatctactcctcctataactaattaagcttttgttcttggaatcttggtcgagttcatcttcgtcatgggttaattagctcagttaatctcgatgcgtcgtcgttgctatggttgtaacatatactgtactgctagttaattatcaagacttaattaaaagagtcgatgtaatattgtaatggttgagtctttacaccgaagatggtgaggaaattaatccgtgttttgcttgctaggtacaattatcgattactgtttgattgattgttttgctgaatattattgtcacatgaggaggaacagaaacagatgagagaaaatcatcatcagcatcaccaaacagggaaatgaatggatcttgaatcgatggggacttagaacaggttaaggaaggcgacgtttctttcttcttgcgtggattcatcggagtttcttgttcctggttggatgaactgtaccaagattggatggagatggacaccaaccttgctgtcctggtatgctcgatcagtaaatgaacggagtgcatttgtctgctctgctccttacctatacgtgatgaattgatgatgatcatgtggtgtggacgttagggtttaattgcagagcagagccaaattgaatgtttgtcggattgaaccaaaaatctcgtgcaaagttcgcaaaaaccagttcgctgctgttcttctttggttgtttggctacaagaaaactgctggtcccatagacagaaatgcgagaaatttgcatgatttttttttgcctccagaaccaacagcaagatatgtatacagatcagaaaccattgtggcattgtacatctgtactgtagtgtactgatacgtggcatgggcgttggccgttggcctgccaattggcgacgcaattatgccagtcggattggtcggtgatgtccttatctaaattttagattaaatctctgaataatccctcgcagaagaacagtagtatgcccaaataaatgggacctt

SEQ ID NO: 58777 - DNA, 2105 bp, Oryza sativa
tttcccgctatttcgaaattctttttaaactcggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattatgaaaaactctaatatatgaatgatagttttaaaaatatattaaatttaatacttttaaaaattctccagtcaattataattagcatatgaatgatggtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtcatttaaaacttttaaaaattgtaagtatcgcatataactagcatacacattatttaaacttgttgaaacctctaataatcgtgcgtaattaacatatgccatacatcaattgatttatatgtgataatcaatacatccaaaatagtttacatggtgtacacaataattgcggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctggtcagtcttgtcctcaactccgacgatttttcttttgcctggagaaaccacttgacgcttaggctcatcaggccctctgcccttctttcctttgctagacatgtccttcacgaaaaagacttgcgttacatcattggcaaggacaaaaggttcgtccgagtatctaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcaattgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacacggggaaagtatcaatgtgatgccgtgtaatccatgcatcggacttaccgatgttcctagcgcgaactagagccaagtgctcctcgatgtaaggagctaccaatgaagagtgttgcagaacagtgaaatgggctttacggaataaattgttgtctaccgtcgttattgctttccttccgagagttccctttccctgtagtctcccttcatggcgtgattcaggtaccccgattgggcgaaggtcttcgacaaattctacgcaaaattcgatgacctcctctgttccataacccttggcgatgcttgcctctggacgagcacggttatgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagtcattgcaccacttcattctgaagggcttctaatctatccggatcg

SEQ ID NO: 58778 - DNA, 9877 bp, Oryza sativa
  unsure (1)..(9877): unsure at all n locations
ccagagtggtatccaactttttgtgcccctgctcgcaacctgggtacaacaaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacaccgtcaataaactctttggaccgccggtcagcgtacatccattgccgatccatctacatgagtaaaaaaaccgcacacaaataattattcttacaataatgacagtcatacaataattataagatatctttattcatacaaaaatcataaaatattacaccaaataattcttaaaaactatttgtaaagttttaaattttaatgtgttttacttcttttaattttcattttaatttgttttctattatttaagattaactttcacgagagttttccttctcaactattttataaaaccttatttagcaaatgaactaaatttctatatattctttcttccccacacacattttctctctcatcaacttacaactaaattttggagacaaaaaaagtgtgcaaaacataggtgtaaatgtagtatgacaaaaaaaaaacattggaggatgaagttgcaaaccttttaggcacctccgatttgtatgtaatcaccaaaataaattcaatattaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtcccggttggtagcactaaccggggctaaagatcaccgggatctattaccaaccgggactaaagttaagatctttagtcccggttggtgttagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcagtcgaccgatgaaagatggtttctccaccagtgttggtggtaaagatccacggtcagtttatgaaatttggaataaatttggagcaataataataaacaacccacctcctgcaaaggagatgataatgggtctaactaaaatttccacgccatccagaatagaacaactgccgtgccaaaaacataacggagcacttttaacgaaataagaaatgaaataacgaaacaatgtagaaaagacaaaggcaaaaatgtacgggacaatttcgttcttgcccctattttgatgttcaatattgattttgcccttattttttaggtttttgtttttacctctacttttttttttgaaatgaatcaaccgtttgcccctattcaattcttgttagcggtgttaaatgtgggtgtaaaaagacaaatatacccttagatatattccggtacttttgacataatcaaaataaaaatctattgatgccatactatagcaataatttaattgtccaaattttgttaaagtttaccaaaatttgggtcaaaattgaaagtagtgtacaaaagtactggaaaatatctaagagtatacttgtcttttttacctcacatttaacaccgttagcaataattaatggactatgtgaaaacggtggtttcatttcaaaaatgtaggggcaaaaacgaaaaccctaaaaagtaggggcaaaatcagtattgaacatggaaataggggtaataacgaaattgccccaaaatgtatctatggtttattaaaaaaggaatatcgcctgttacagaaaagaaaaaaaaagaccgttaaaacaaatcagggattccgggcggctaaaagtagaagcttgaataaacatgagcctcagaaaagagagaaaggatgaaaaccgcctaagcaaaaaggaaaaaaaaagactgatcagaccataatctcgcgatcgatcgccattagtctattgatcacaaacaattatactatgtatgaattactattggaccttcttatgcgttcaaaaaaataagctgtaaatctgcaatacgtacgtacatgtaaattttttgcaacaacattctccggtgaatttgcggtgggctcctgcagagatttctctgggccgtaaggtagtgtgaggctttatttgaagatgtggcccttccaaatagatgtcttggagtccaacataactggtaaatgtccctggcccaaacctaacacccatagcaggccgaaagctgaacttccaaacgggcccttaatctatatgatccatacgagtaattgtcaaagactcaaaaaccgagtcaactttatacggactaaaaatatcaaattaattagttgtagtttgtatctagaggacataattaccatcttcaaaaaagtttataattgtgtgttcatgcaacgtatagcgcgttttgacacaggatttttcacacgatagtggactataaaagtcccaggttattacaagaagtgttttatgctcaaataacttggagactttctgcttgacgaatcctcaagtcgtcaggaaattttcgttgctcgcaattcgtagaaactctctctctgcaagaaaaagaaaaggactacaagttgctcttgatagatctcctgacgaatatatatatctccaaggctccaagcacgttacgtcttgtgccatcgataagataaaaaacctactacctcatattttttaatatatgacgtcattaactttttttttcgacgtttgaccattcgtatttaaaaaagtttatgtaattatcatttattttaatgtgacttgatttattatcaaatattttttaaacataacataaatatttttatatttacacaaaaattttgaataaaacaatggtcaaatattagtcgaaaagtcaacggagtcatacattaaaatacggagagagtatcactaaagtttaatattgttgtgcatatgcttaatcatgcacgagtccatgaattcatcaagccgacaaattaaacaagtcccaggttattacaaaatcctccatctatacacaactccactatataaactggtggaaaaagtacaccgaaggtccctcaacttatcatcgagttacaaaatcgtcctcaaaccgcaaaaccagatatcccgtgtctcttaactaattaaaactggtcataatagattccttgacggttttgatctcggttttatcctacgtgacgactgagtcagcatggaacccacatagccccacatgtcatgatgccatgtcagcaggccgacctctcccttcctttccttctctctctcactcaactactgggcaggcctgccggcggaggggatgaggtcgtcggcgtcggcagggcgaggtggcgtcgtggagggcgaggaggctcccgaaccctaaccctaaccccctccttctccttcaggttcgtggagggaagcgtgtgcagcatctagccgcgcccccgtcgcaccagctgcgctgctccggggtcctcgtcccctccccgccaccgatgcatcaggtcagtaattgcccgtgtccctctctcctgttttttgcccaagctgcgcttgatatttgagttggtttggtttggtgtggagcggtgtggtgtggtttgattcgggagtggaattgaacggatcacctgatggaattccgtgcgtgattggattgtcgcaagctgctgaggtggattttttcctgaacttgttagctgaaatggaggggaattggggagattaggttgcgtgattgatcgaattttccatcctgctcgcgtgattagtcccagattccaaatttccagttgttttatcacttcatttccacgaaatttcacccataatctgttccttcatcctacgcatgacctatatttaatgcatttttacgaattagcatctgatttgggactaatcagagaaaaaactgcactgatgcaggtatgctacccggtcccctttcccaactccgtcgcactgccaccggagctcgtagtgtatccctctgtgccaggcctgccgccttcagccacgccgccgccgtcgtcgtccataggctccagcattgccattgtcgtccttgtcgtcattaccacgaccatcatgatcgtctccattgttgtcattcgatgcagctaccgccgcgggttgatccacgggtcgtcgtcgacaccggtggtcgccgggcacacgacgctacacatcttcaccacattctcacgccatcgccgggtcccagtcctcggggtggtcggtgagccaggccgttgactttgccgccgagggggagcctctcggagccggcgcgcatggccatgttggaaataagagaggtaatgaggtggcatcctggtatgtggggctcacgtgagtcccacgctgactcagccgccacgtaggataaaaccaggatcaaaaccaccgagagacctattgtgaccggttttgattagttaagagatgcgagatatctggttttgcggttttgcggtttgaggacgattttgtaactcgatgacaagttgagggaccttcggtgtaccttcctaaactggtagccaccttagggaatagtacacgcaaggtccctcaacttgttagccacatacaaaattgtccctcaaccgtagaaccggacatccggcgtcccccaacttacaaaactggtcacaaaaggtccctcggcggttttgaccccgattttgtcccacgtggtggctgactcagcgtgggacccacgtgagccccacatgtcagtaagccatgtcatcacctctccgctcgccggcctccccgcgcttccgctgccccgcgtgtggctccagctcggctgccgcggttgcccgccgctcctcctcgtcggcgagcacggataggaagctgacaccgccgccttgctcctctcaccgccgccaccgccgccttgctcccctgagccaacgccgacgcattcgtcccgtctcgactccgacgctggcctccccgtgcctccccgctgtcgtcaccgtgttcctcccgcctcgccgccggatttggacttgggaggagcacaccggcctccccgcgcctccgccggcctccactgctgctcctcctctccgccgcttcttccccgtcggtcgcgccgaccctcttctccaccgcgtnggtgacgccgccgccgccgacacacgataggccctcctcttcgcgtcagttatgatggccacagccgcgcgccgccatcgccgaccgcacgagggggacggggaggccggcgaactcgcacctgcctgagcccgcgcgcccccacccgggagccgccgttgccggctgcaccacctttcggccgcgcgcaccgccgcctgtgcgagagcagagagcgagaggaaggagagaaatagagaaagagagatagggtgctgacgtggcttactgacatgtggggtccacgtgggtcccacgctgagtcagctgccacgtgggacaaaatcagggtgaaaaaccgcgagggacctattgtgaccggttttgtaagttgggggacgccggatgtccggttttgcggttgagggacgattttgtatctggctaacaagttgagggaccttgcgtgtacttttcccgccaccttacggcttcgttcggtttgggtgtaaaccggccttttccccggccctttcgggaaagcccaccacgaggggaaagaattcctgggttgtcaaaaaatgcattcggcttggcccgggaaggtggatatcccggcccaatacccccaaaccctagggatattggtccaccaccctgagcaacacaccgctgcctcttctcgactggagcggcgcccaagccgccgctgctcgtcccgtcgcccgccggcgcggcacaccgcatctgctcgcgccggcgcctcacgtcgcttcagcctcctcctctcgccacaaatgacgccgcctcctctcaccgtagatgccgcctctcgtcagatctgacggagctcaacatcggtgcggccttctccgttcggtctccaccatccggccactgcgtcttccccatcaagaacctcaaggacctcgtcatcttctactaccttgtctaggtatgtcaaattccatccttctcctgaattgattggtttggtggttgggaaggtgaactcttgggctagatctgatcgattatgttgcgggatagttaatcttgggctaggtaatcttgtgctaattttacttgtgaaatctctaggcattatctatcacatcctgttctgatctctctgttttttttttcattatcaatctgtgcacggttagcttttacttttcctttgaggtctatacgctcagtatggatttaggatattaattttgttcatatacattaattagctctgtttttcaatgcaaacgatttcctaagttttgttttctgtgtgtttttattcacatgttttatactctgctccaaaaatgccataaatggatggtagcctgattttactactctgtcattgtttccttttaatctcaagtactgattcctgcagttacatactgttgagtttatcgttgagagagtcggtgctgcttacaggtcataactcatatacgtagtttgtttttgtagggtattttctgaaatactccagagatttatgtataaaaatgaatttattttgtgacatactaagtagtatatatataatttttgcaggatattgaactgtgccacctgctaaatttgtttaggatacgtatgaaaatcgcctttgctcagtatggatttagtatatatatttagcagccatcctaaaccttgctttttcattatcaaaggagattttacatattggtttggtggttgggaaggtgaattcattggtatggatttctgaaagaacatacatctgttctggcatgatctatcacatcctgcattatgagaaagtgagctgcacgcctgggcattagtgtgtgtttgggttaagctgagtggccaatagtgatcagctccattatatatatctgaatctgatgagtagtgaactagtgatagatcactagtgtgagtagtcagtgacatacatatgatagaatcttagctgggcatgcatatgctgctactgttgtgctgttgtctgaagatatgagtatatatagtagctgtagtgtggtgtagtgcgcgcgagtggggttttaattggttaaagcatgttggttgctggtagctaggtgtcaggttctctcactagttgagtacatgattcagggctttttcgaaatgcatgatgtttaaaacataggaacaaaaggaaatacatataattaaaatactctatggattgaaaaaatgaataactgtatgaatgatcatttaaatggagcacaggaaaaaaaaacacagaagattcttttttatggtgataaaaagatatactctgctgtttatctttttaatgctttgtaatctaatctacagaagtacagaacagccattactacctttgacattaactgcaaccttctgttatctgttaattttttgtagtttggtgcttagaagattcttttttttttgttaacatttgtttgcttgatatcacacttttatgtgcttagaagtcatctcacacatgtcaacagttcctggaattaaaatgggttcaagggctaatcattaacatgtcagcacttttatgtgcttagaataacatgtgtttgttcagagtcattagctgaaattggacagcaagtatattccagtcagttagcatagaatctgatattgttctgaatttttcctttaattctgcagtttgggtgtctatcaactgctttgaccattggatttgttaatacaacacgtgttaatacaacatcaattccatctatacactctgaatgtgcttgtgtttcttgcccactgactgcattagtggtgtatatgttggggacctgctgaaattgagctcaattatgaattctgaaattctgaaattatggttcaggttgaggagctggctggctgacagaaacatagtaccatggtagagactgaatttaactgtactatttagttcttgtgaactttgaaaattataggatctcttctggagattgatattttggatatatgaattagctagatcgatcaactttgttaaggttttagctagaaaatgacatgtttgcattagtaatagataataacatgtgtttgttcagagtcatttgtagagcaagtatattctagggtcccatcgtttggcttttcttttaataagccaaaacggcttattagagtaaaaataaatttgtaggtaaaatttttatatatgtgttctcggtgacttaaaagccaatgctgaaaaaaaaactacgttgaaaatatctcaaaatcaatgtcaaaattaagtttgaaaattcaaaatttggctttttctttgtctgaataggccatccgatgggagccctagtcagtatatgctgagtttgcatatctgaaaagaaaatcattctttttcttgtttgaatagtaacaaaaagatctttctttccatgtacttgtttgtaaagtgtctccattggcttcttgcaacatgaatagcatgatgataggtggtcagcctcttttcatttctcttgtagtcctgttgagctcacaatgctctttttttgtgttctttggcattgattttaatattttcttgaggtcacaatgctcatcattttctcctcccaggtcatggagctactattatttggtgaagatcgaatggtggcaaagataggacaacaatgcatgcagttaccatcttcatttcttaaatttatggacaaatcagattttgggacctgggaacttagtttgtggttgtactcaatgttctaggtgttgatgtcctttgcttccgattttattttaccttactgtggtgatgtataagaaaaacttctcagtgggctctttgctaaacactaaaatttaaatgcttgtaatattgtttggagggcacagattgacttaccacatgtgaatttgtcaactgatacaatgcatagcagtgttaattatcgttttaaaaacttggcagtatttttattttctttatttaatgaactgttttcttaattttggttttcttctatatatgccattgtagaaattagttatcagcttttctttttgaaatttcggattattttgtgtgatttcgtagtttgattctatttctaagttgagatgtgctatctatgctcgtttttgctcagtttttattcaaagagatgcgtttaacctgctttttcccctgttttccccagccgaatagcatgggagtttaacacccaacgtggaagtggattgggtggtgggtggggatccacctatacctggccaaatgggccgtgccaagccgggccggcccaagcacgaccgcactgtagaaggcccaggcccg

SEQ ID NO: 58779 - DNA, 684 bp, Oryza sativa
tgaatgaaatgctgctgttgctgtttgttgtgagcttgagaattatagaagggaggagccctcatggataccattgctaaagaaagaatggggggggtgaaaaaaaaaagattgaaaggaagcatttgccattgattgcaagaaaaaaactagaaggcacttttgctgcaacttgaaattgaaatgaggggaagaaaagggaaagagggaaatggtgatgatgataaaggagtggatgggattcagttcagtgggaggattgtcttgtgtgtacctgtacttgggtgtggtgtggagacctgacactgatgagagtgtgttttgctgttgcctctgtgctgtcaaggggattgtgaaaaaagaaaaaaatgctggttgtggttttgtagaggggagtgcatgtaggagagagaatacaaaggagtgctgtgattggtgggctgtgggtgaggtgaggatactggctatcacaagtaagatagagacattcacacatcacaaggggggatggcagggcagggtgaggtgggtactgggtaggccttgtccatagattttttttttctgtgctactgttatatagttttataccttgttttgttgtgcttggtttgatgcttgaactctagtagagccttgctggcctcatgtttgtttattgcttttttttaaggcaatgagttt

SEQ ID NO: 58780 - DNA, 2083 bp, Oryza sativa
gagctgcagctcagccaaacagtttcagctccaccaaaattgggagtggagctgggtggagctctctcacaaaatgaactagagttgtggagctaggtttaggcagcttcacagctccactccagacctaactcctggagctaaatttaggagttggagctgtaccaaacaggcccatagttatggtaggaaacaaacacatcatactacaagtggcaaagtgtgaagttcaaccaaacaaatatatactttctctgtcccctaaaacatgtcattttaaggtttctcacctagattaatgtctactaaaactgaccaatttaccctcattaatttgattcatcactactgtgcacgcactttagaagaacccaagaataatagagattgtagttaaatagtaaatgaaccacaccttgactgccatgtgggatttgcataagcacattggagccatggccataaaaattacacatgagaaaacaatcagtaccatagtttaaacatttaaattagcctatggaggatgtgcttcggcgcctaggagtgcctgtccatttctgaaagtgggccacttctttgattacggctatgatgatattttttctaggatattagttggacgggagaacgtctaatttttttaggacggaggtagtatatgcaccaagccaaaaaccactgtgctaagatagttccttcatgtcttaggaccaagagccgcactgtcagggatcctttgcgtcgaaccaagacacactggcacactgcagatgatcatgtgtggtccgtctcaatagagtagagtctactttctccatccaagaaaaaaaatcaatttctagagataaatcttaacatgcatttatctacattcatcttcaaaaactattatttttagatagaggtagtacatcgcatcaccataagctggacccatgtgcccttcaatccatagcaaccttgatccatatcattattgcaagtgccaacaggatgcagctgcttgatctagttcggcttcttctgtgaaccgctccatgtaccacacgtctcgtcgctcactctaggtcagcccgaccactattgctgagttgggccaagttgcgcaagtctctaaaccaaacttttaggacgccatctttgaataggttgcaccgagtcaggtcggtcaatggaggccggatagcccttgtttgcatggcccacctcatctctctccctcttttcttttttcctcacatgccattcaaatgtgatgatctcccccataggatatccattcataatagttttcagaacatatttcgcaaacctcatattagttaacacacatgtttatccgcaattctccaattttctataaaaaaataaaccaaaataccacttgggttcacagatgtttagtctatggaagtctaatgtggttcattcttttgcttggatgatggatttggttccttctagaatgatgatggtgaaaccttcctttctctatctttcttcttctggattatcaaacaaatagtttatcagataatttgtatatattatgctttaggatagacaaaattcgtcataggatattcaaatattatagtctttgctaatagacatcatcataacgcgacttggcttgagaacacaaaatatatggtaatttaattattttattattttcaacctgttgtgatgagggatgttaggtcccgatcttccgataggtattgataaacaatcgatttgggcggagtcgcgacacaactcgatccggcttctgaacgaacacgctattgagccccgcaatcacagcaccacgtctcctctggttatcaaccatgccgaaacccggttgacctcgccgagaaggctaatccctgcatgcgaatcgaagaacacaagtaagaacaaaatagattgcaaccaaattgcatatgaataattaagcactcaaatttggggttccacaaaccgatctagcggtgaaactgttcttgacagaataatctaagcaaaacccgactctaaacgatgacggctactgaataaatgtgattagggacgtcctagggttgccgtagag

SEQ ID NO: 58781 - DNA, 13911 bp, Oryza sativa
aatggtggtgatcatgtgctgtttagtagtagtgttttatgccctaattgcctctaatgctgctcccaagaataaccacgccatcattttgccactccttgcttgggagtgacctatgcatggttgaattgatggattctcatgtactactgtatagtaacagagatttcttcatttgtttatgtgatggcaatcatctaaagcttcaggtagtacaggaacatgtttatgccctgtgtaagacatgtagcagcacaagccaagaatgcgtacagaggatacagccggagtggagtctcctccagtgctggcatcaaatcatttcagaatgcaatgtactccgatcctacaacacaagcaggggtaatatcactgataagctcataatctttttaatttgcagcacagcataattaggttatgcactatatatatggttcaggaattggaaaggtggtagttgtacctcacagtgaagattttgtggttcagagaatttgaagcacccgcgttcccacacacattgcttgatgaacagcgtgtcacaaaccgcgattcattgatgcatgtgcaatgttccgcgagaccacatcaatcaggctatcaatgtttcgactccacaaaacacagagtcaatcaacagctgcgccagcatgaatgcgtgatgtaactccaagggaacaagttcatgcacacgtgcgcacggcgaaaacatctgtagctgcggcccccagaatgagcggaccatgtcttcactttccatagtttgaactttgaagcatacagttggtcacagtccctgaattatttgcagtgcatatatcggcagccgttttcatctgccaagaagagcaaccatccagtgagataattgtacatagtgggagatgcacagtcaggctgtcagcagaaggatttggcgagtaaaacagaacatgggagtgtctccatcaatctgaacataaaggaacctggtcgacacctaaaatatatagcatgccatgccacttactgattggatcatgtttaacaacactaggaattacagttctagattctaattagtggtgctcgaatccggtttctggaacctgttgaaactcacctctctcttccctgtcggcaagcagtcactacatctttttttttcttggaagaaacgtctttttttaaagtttaaaacaaagacggaagctctgccttatttcataacaacacgaacccaagaaggggggcacaccaatcacctgcgcaccctgaccaaaaatatgctgtgagctggttctgactaggttggttgaaaggacgacatctttaacatcccaagttcaaaatgtgtagcatagccacagaacatatccagaataaaaacttggaattgatattggaaagagtactgtgagcaggaaaaaatcaaaagaaagtgaccaaataaaaggaagttgagggaattagctagttcggaatatttgtgcaacgatgaaagtgccagagcagtacaagactctgaagtttgtggtacacagagcacagatatgttgtcaggattgtctaggttgttttggcatctatagtgcaatatgcacaataaaaatatagaacatttctagtagaattctagtgaaaacacaagatgtgacaatattataatgatactagtttcatgaagaacaataactatcaacacaagatatctggttttagtgtaaagactgatcttgacagtgtccttaacatagatttcttttattttagaaggtcaatagaagtaccaaatctcaacatatgcacagtagccaaacagttttcaatgaaggaagaagacatgctatgacaccatgatatcatgctcacgttcaactggaaaaaatacatgatcaggttgcattcgttttgcttcatggaacaaatataggagtctatatttccgataaaaaaaatataggaacctacatgtaatatgtttgcatcctgtctaaatggtgcatcgaacaaattggcatcattagctcctagtacaaagtgtatttgtagcgctttctggcgaaggaactagacgcacatacttccaaataaaaagctagagaactagacaaattcctgaaggagggatgatcaatgatgataaaaccaagtgacggggatttcattcttttggaaatttctggtttggttacccattcctaatatgctgaaccagtatgctgtttgaagcaagagaaatcacattttgggattcataaatcataaggaaacccagcttatccctagtgaacttcacttcacgttacgtatccaactattccattgtggccagctgtaaagtcatctcaagacttgcatcttgactatttagatacatgtacatcttttatgtttctgtctatcttgaaaaaaatttattggacctttttttatgggaattactgtcaggcatttgcccaacagtatagctttataaaagaataatatttacatcatacaaaaggacatgaaaaccgtaaaggaaaaaattacaaagattgtaaccaatcaaaaactaattgtttaaagggatccttcattctacacatatgcagaagaagcaaactcttgattggaccttgttcagtaaaactcttgattgctgaacagaaccaaaccatgagacaactttatgatgatcgaaccaggaaaataagcaacataaagagaatagtttatgcagtacacttatgtgacaagtagacaagtaaaaattaatcaatttctaagaccaacgattaagaaaatcaatgattaacggactaactagtatgttaataagttttgatcaactagagaggtcatcatactccataactcatttgtctggtagaaatcctgaacacctaattatttgcttgccctgttagagatatcatgattcttaaagcacgttttactttacaagtgatagtacttatgattaagagctggtttctattggtttgtaggccgtggccctgcttgaaaccagacacggaatatcacaatacataatctgttgatgcatgtctccgacggttacaatgtcaaaatctccatgtggtttagtaatcaaatcatacggacatgtgccctcatggtggtaacacgcaaatcgttcagcaatcaaatcatatggataaatgcaactcgtggtggcaatactaaatccatcaatccatcgtgtgtctccatgtgttactactgaaaagtgacaactacatcgtcttgagaaagctagtaaaatgaattagatttagtaaatagtaccatgcctaattgagaagttcagagatcaagcaaaagcataagcagttcagaattgcaacagacctgaaacgatccttgtgtgcgcctgattgaaacatcagcaaggtataatttccggcaagcaaactcttcaaaaatggatcaaatccctcgctcactctctccacagacatcagtaccggatcaaagccaacaaactgtcacaatggctgtaagggcactgcatgatcgatcgattcaaggcatattgcacgttaatccgagacaatgcaaaaacctattcagattggtatatcaacaaattgcatgttcctacttcagaagttcagacaggtattcaggctggcccgggggcggagtacgaggggagaaggtacctcagctgctgccgcgacgagcagggcgccgtcggatcctctatgaagaaccgctcgaaccatccggtgaggcggaggtggagggcgcgtgccgtcgaggagcgccgctgcggcggcggcggcggcgcctcgccgatgagggagcggagcccatgggcttttggactttggagacgacgaggctggcaaattgcaatgaggtccctccagttacctgtatttgcattttttgcgtggggaagcagcatctggtaatagatcctggccgttgatctacgaatgaaagggcaaggacaaaccacaaatcattagagagcgagagagagggggggggtacagatgtacggagtacaatagtggagtatcacttaaaatttacaattagctcttgtacacgtgttacaattagctgataatccatctattttaaaaacacaggcctaagaacaacattagctacacaaacttttcagaatttcatttatcaggtgagaacaatcacaaaaacatacaggcctaagaacagcattagccacacaaacttttgagacatttcatttatcaggtgagaacaatcacagggttcatcattcttttctgaagaaaagaaaagatggttacagataccacagagggctaatggaaaggggggctagaaaacgaatgtgggaggcaactacatacataagatacctatagcaagtagcaacacgaacaaagaacatctgaacatgcaatggaattactgttgttcctactatatcgaagtctaacaagggggcttggttccaagtcccactagctattcatcactgaaagaatgaaatcactccaggaaaaaaaaaagcctattgactgatcttgcacccacgaacataggtgtgctcgtagttgatgtactttgtccagtatggtcggtacttcgacattgcaatctccagccatggcttcatgttcccgttgtagtggatgacggcggcgttatctatttctgagcgctcgatggatgggttgtaccctaagccaagaacatgccatgatttgtccaggggatgtgttaacttgtagaatgttaggagacctggcggcagtgtcccaagcttccagagcagcctgttttcattctgtaaaaagaacaaagtgtgaagcacagtagtggaatttgtttagtactgtatgctactgtttgtgatatagaatgtgcatctcacaaagtgcatattatgcttttactagttttagaagctaagagggtgcatgaactgttgttagtgcagaactgcatatactacatttgctagtgaaaataataggaattgcagaaactgaaatattgcatgttatagcgaaagaaatttgccattgaaatttctacagaaaaatggaaacagtaatataaaccttatttcaacttaccatgttctgccatttgtgataaatgccagtaatgtccttcttcttccattcttccaaatcaaacatattcattccatacgcccagccacaagcattaggatcgaagttctgagcaatatttggatttgaaaaattgaggtacttgtcaaaacggtgaaaactctccccacatgtttccacagcaccatttacattcccatttagatcaacctcccagagtcctgtcaaatccttctgaacaactatgtcatcatccaggaaaaggatcttattcaacttaggatacacttgaggaaggtagaatcttaaatggttgagcatggaaagatatttggggttcctatatttcagattagaagaaccagcagagagagtttttggacggtctgccttaaaatagtactctttcatggccacagattcaagctgcttcagaacagggcaatatgaagagttcagccatttgaagtcatccacgttttcaacatggattgtcgcatctccaggtggattcaacaaaaaccacatgttcattgctccaaagttcagcttgtcagtaacaagatggaatacatgtttctcaggctcctgcatggtagaaaaatgagcagtttttaccgaatacatgtttctcagtcattgccaagaaattgcaattccaaattgaactctagattgcacttacctttgcattcatgatggttgagttcaccacaactgaagctgccaaaacattgtccgaaaaaagggcatagtgataaagatcaggattttctaagttctcactcttcggaaactttcttttctctggggagagaaggtaatagtctatcgttagccgcatggacaggcaatggatgccatttgggattgtcttcgccgctaactggcttaggaaggtgctctgcttctttaagctcctgacctgctcatcagctgactgaagcatcgctcttaaccgctgagtaattgccttgcaatcatataattgatctcttgcttttgctagtaactggcccattactttgactctctcagaagcacttcaaataagtaagaaaaattagtagtgcaaaaaaaggaaaaaaaaagacctaaagaagagtttaaacagaaattacctcttgggaagttcagcatcagcagtagcttccccaagggagcgctggctttccttaagcctggaaagtagatcctgatgaagatcgagcttgtccctggatttggcaagcacagaatatattctggccatgatcatttgatcacgcatcagacgaacctttgaatctgctttttcattttcattctcacgcctccatatgctatattttccaaggacagccgaatcaacggcttttgaacgttcaattccagcattctcaagcttaactagtgcttcatcatcctgctgtactggttcaatcttcttctttattctggttctctcccgcaatttctgtagtaaggaaatataaaaaaatgcttaagaaacataaggtctcatttggaaacaagtagtaatgctaaaagaaatggcataaaaaggatggacacttctgttcggaattgtaatacaagaaaagctagaatatccctagttaatttgcaagggctttaagtagaagaaagttaccctgtgagttacttcttctggtcttaccagcagctgaagtccatctgcattgagaaataaagcacccacattgaatggattgatcttagtagatgcaatcatatagaattatagatctgtcattgttcactaattatcaccttcttcagttaaggagaaattctgtagtttaatgttggcttgactactccagtccagtacctagtatcacaaaattgtggcagtaagaaaacatgcttcaataacaccaattaaagatgtagaaatgaaggataagtcttcaaacctgtttactagaataaagtgggtccacttgggctgcacaaagcaggaacacttattagaatgacttgatgggatatgctctaaaaccatcacgagtgtccagaaggtgattggatggcttaggtataatgaggaaacatttcatgagaaaattgttcctaacaagctaacacaagcgtataaattgtgaacagaaggggtaaagtttatttatcaatcacttccaagtccaaccccaaagtaagttaaactttaaacagagaacttaatagaatgatgaagggacattatcttcttaacaggtgagagcaatattcaaaaactgagagaattgattgcttccaaaactaaatggcaagcaatgccgtacagaaaaaatgtaatgataaggtaatgtggtcaggtcatacacgaatcctatatgtttgagtaaactgattaactttaactctgaacacaagaaaacgcgagcatatatataaaccctgaactttgtcagcatatgtcactgggatgcaacatgaagactataaattgcgtggagtataacaaacacttatgtctaggataaaattatatgcctgaaattccagcaaaatgttcctaggcattacgaagatgacaccagtagttattttccctataaatatcatgttctcgttggaaacagtgatggcctgacgggtatggaccctaaaacttgtcagagcatgctgttctagaaaaaggtctagtagacccatataatcaattggtaaggccaaatattcagtaggtgctttcactaaattatctaggcaatgccggatggctgggtaaaatgcaatccacctggtgaaacaacaatgtaggcaccatttggatacccaatttataaaggcttacttatgacacagccatgttgatggacacaaatggctcttcctagccattgtgcaaatgtcatcaaccgtcacttccagagcacagtaacgtatatctaaaatgttgcgtgtgaagtgtaaactactacagctagttcaatatgtactgtatcactttatacacaagataccgagtaaaaatacaattaataccaagtgtttcccatgcatgacagagagaatggtaatcacattatgtctatcaacagatattgcatgacaaaaattttccgctctccagtctccacttaaatttcaagatattctcaatatacggtcgcatttggcagctgttaaaaattagagtagctgagctgcggacagatcaacacatgcacataaaacgcgaattcaccctagcctgacaatcgaaagccaaaaatttccacattccacaaggagcaagataaaagtgcagcagcatcactgtaggtgttaatctgagcatctcatctagagaaacaaacgctggaaagaaagaaaaaaacgaaactcctcacctccggtgacggcgacagggaaggcggcgagggcgcagagcgcgacgaaagccatcgcgcgagcccccgccattcccggcccaatctagctcaaaatccacgagaccagccacgcactggccccaaaacgaaaacaaaatcgtaagtaaaaaaacacgcacgagattaaaacgagattgcccacacaatcggcggaaatcaagcacggccagggctgaaatcgacggaccggcgaggggagggcgcggcggcggaggtagatcggcggcggcggcggtggcggagggaggaggggtcgcgctccgcgatccgctccgggatgtcggtgaatcgcctcctcctcctccggcttttggagtggggactgcgagtgtgcctgccagccaggggtgaactgcattctgtttctgtgtgcgggtttcgttccatgggccattgggcctaaccatgctccaggcctgcttaaaagcccatttactcggtatgtgaccgacaattaggcccatttcaattgcaggggaaaggaataagttctcactttaggtcgctcactcaatttgtcgtcgactttcaaattcaaccttaaaccgcaatacctaaatgacgcgttactcaacttccaaaaccaaaataagatctcaagatggtttagatggttgtttcagctgatgtggcatctatgtaacatttgacgtgacatttaaactaaaaaaaactatgggacccatgtatcagtgacggtctggttaattttttttaaaaaaaaatacaatggacccatgtctccctgtccaatctcctcctcctccccaacatgccaccatatatgcaaagccgcagtcagcgtcgtcgtcgtcgtctgccagttctatcgcaacgaacctcgtctgtcggttctacctaaaacgaacctcattgtggcctctcaccggcaagtgccacactcgcacgaacagccaacctgcccatgttgatgctcgacagtggctgagcgagcatcgcctttgacatcacgaaatatagctcccccacccgaagcgactttgccgtgggccagcgccaacaggtggttttcaaagtagagcgcatcagagttgcgcatgaagaaggacgccgtgtcagcgccatcgttgtcactgagcacagctacacgggaggaaaccggggtacacattaagggcttgtgttaattactaacttaatttaacttatcagcgccacacaaaaaagatagatcattagcacatacataatttagtactgattattatatttttttaaaaataagtttatttaattatttaaagaaacttttataaaaaagtttttaaaatatactatatttaatagtttaaaaacatgctaacgaacaattagaaaattatagttttaaaaaaacgaagccttaagcttagctgaggtgtcgacttgaactttctgttacgagtgcgtgtgattaaatctttagcaacttgtttggagctaatctattaatcattccaagctgcctgctgcgattgtcggttcggtcatgtggttaggtgtgtgagtgtggcttaacttaattaccgttggagtggttgcttcatttctcccatcaaacaaaaaatggctggtttagtaatttgactgctcgtgttgccggtcaattcgacgataatttggttattttaatcacacacaaaaaggaaatttgattattttacttgctgctagaacgacgcatcgagatcgcgtggtggaaaagaaattgaaaaaggggtggtcacgtgctaagtgctgtactctttggctcgacggccggatcgtgtggtggccggccatcggacggctgagatgagagatccactggtacttttgcactatgctacctatgatctctcctatttacaactagagggcagaagcgtcggttaatacaaggagggaaaggaggtaattaattaacgcgctaatccaacgaaccactccaagtaaacgcgtgccgtgttacttccatgcgaagtattgagaatctatccgaaaacgaatgtgtgcgtgtgcgttgttcgacggttacgaagaaattgaacgcgacaacgagtgcatgtcatattcagctgttatatcatgtcatattatctatttttaagagggtatcatgtgttgtgtccatgtcctatgtggctatgtgtatatacatatgtacttatttaccaattcgagctatatgtctctatctacatttcattattgttatatctgcttaataaatatgcttttgacgtcgatagagtggttatgcgttatcagtttgcatatacaggattatgtaaggacactttcagaatgcgacaaaagttttcaaataagtagaaaccaaacgtctcccgttaattttatctatgttcatttaatgtttctgttggaaataattcataagttgccagaaaccggagattaaactatttccattattaagaaaaataattcctaaggttagtctggatcactttttaaattcgaacaaagaagttgacttttcgtaaagaaaatattcccacactactttgtttacatgtcaacgttgcaaattaacagttgagattcaactgccacaaattttatgtaaaaaaaaggattgcaaacagcaaccccatatcgttttcgaaatctttcgtctacttcaaaattcaaatgctcactagcacaaagtacaatcactagtatgctgtaagacaaagattaagaatgaaaaaaacacaattcgtgcaactacggggaccgaatcgggaaaaaaaaacaacgacataatctgcagtttacttgtacccacacccactgtctcgtattctattcctcattccttctctttttttctcgctttgtttctcccgtcgtctgatccaccaccgcaacgcacgcacgcacgcgcgcctcctcctccctccgcggcggcgaccaccgcgcgcgacgccatcgccgccacctagggttagggttccggcgacccccacccccggcgatcgcgcgagggatccatccgtcctctcctccatgtccaccgaccagcctcacctcccgccccccgcgcccccgcccggcgccgcggcggcggatccccccgagtccacccccgcgccgcctccgccgccgccgctcgagccacccgaggtgatgcacaagacgagggccgtcgacttcctcggccgccgcaccccaatcgtctaccagaacgacaacgggccgtgccctctcctcgccatctgtaagaatccccccaccttctagattcccttcgggtttcaattcgcccccgcgcgcgcggcgttgtgatgtgtggggttttgttttggttgctgcaggtaacgtgatgctgctgaagaatgtgatcagcttgaacccggacgcgggcgaggtgtcgcagcagaagctgctctcgctcgtcgccgagcgcctcatcgactccaacagcaatgtgcaggttcgatcggtccccgtggggttagagatgggggttgtttgttgtgttgccttgtgaattggttgtggggtgtgattcgcagggtaaggacgaggagtatgtgcgcaaccgggagcagaacatctcggatgcgattgaccttttgccgcgcctcgcgaccggcattgatgtgaatgtgatgttcaggaagtgagtccatggttcggtttgtcggttagcggtttgttgtttatggtgctctatatgttctgatatgattcgggctgtgggcgttgcaggatcgatgactttgagttcacccgagaacgtgccatatttgaccttctggatatcccgctgtaccatgggtggatagtagatccccaggtatgcatctccttatggcatgtttgtttggtttagccatgttgaacttctgtatctagacaactggatcggcgtgcgggttagagtttactgtacttctttcgacatggaatacaataattcttgtgcttggagataacttcatgtgtataccattcacagtttctgttatttagaacagagaccatgtgttcatgcttaccatcgcaacaacactcaataaaaagaagtgtaatatgtatgccagtgtacttgtccccccccccccgatatataccttatacgggcaatgtttaccattgttttgaaaactcgtttgaaagctctatcaagtagctacgtggtgattctatttgataactggtagcactcacagctattgcttggtttcgcaaatatgtatcacatttaattaagctagttttctacattgtttcccaactatgtactagttaagatcctccaatttgcaattcagacagtgcggaacttcctcgtcacaaatatatgttgttttctatgttgacgcggtcttcaaactacaacttctgatcactaatttcttttatgagtaaaagcaagacaatcactctacgttgttttccaactttttactagttaagatgctccaacctgcaatccagacagtgttgaacctcctcgtgtcacaaatatatgctgttttctatgttgacatggtcttcaaactacaacttctgatcagtagtttcttttaggagtaaaagcaagacagtcggactggctctatggttgcgttttgatttgagtattgtatgtgatgctccaacaaaaagcgtatacttgtgtctagacatgataagtttctgtagcaaccaaaacttaatataggatttatttatcttgtgcaatacaatttgttaagatagccagaaggatgctcgaacagcatagtcaatacctccctacatgctggatgcataagagatttcgcttgcctcttacgtctgcaattctcacctgcatgctaattctgattgtttcatatttttaggatactgacactgctacttccattggatcaaagtcttacaatgctcttgcatctgggcttgctgaatttaagtcgggggaatcaacaaaagagaatagacatgtacaggaggaagaaactgttgattttgctgctgcaactactgcagcactaggggttccttctcctagtgtttctcgaggtatatcatttgatgaaaatacactcactgacccagttgagttgcacataagacgaggcgatcgtgaggaagaagaggaactaaggagagtccttagtctatcaaaagctgaaaatgctaatgctgttgatggatctggttcctttgacacttcacagtctcattcatcctcaaatatggaggagacagcacacactgagagcttccaattagaggcagtcgaggcgatggattcaacaaataaggaggaacatggcaacagccatgctttgagcgatggccctatgttacaggacaccacaaatgctgctcctaatattaatgaagttgggatggaggaatcccaacaggttttgacgtctaatgaactagaagacgatgggaaaaggaatatcttgccagagcactctgatataaccattcaaccttcagagtctgtgcttgactgttcctctcat

SEQ ID NO: 58782 - DNA, 2613 bp, Oryza sativa
aaaattttgtctaaaatcaaaaatagtttgtgactaaaaatagtgcatacaagaggtgtaaagccaagcaaaggtggtaagaaagaagtacgtcatatattcagttttatgtattattttatttcatgttatgcgaataaatattctgaaatttgtttatgttgttttaaattttcagaatggacgaatcgaacattccatcgttcacgttaggtgatttcgaccctaactacgtgtcgaggtcattcccaactggtaagtatgatgccaccggatcggctccaacaccaccagttatggagccaccggcgggttcagaagcatccggcactatgagtgggagtgtatcgacgaacaccggctcaaagagatcaagaacttccggtgtttggcaacatttcgatgaggtggccatgacaggccctgatggaaggcaggtaacattcgcgagatgtagaatatgcaaaaataagttatctgcgaaatcatctggtggaacaggacatttgaagcggcatgccgaggcttgtgcaaagaagcaaggaatccaactacgacagcaacaactactactaaatcctgatggtacggtacgtacgtgggagtatgatcctatggtagctcgagaaaatcttgcccgtttaattgctagacaagatttacccttgaactttggtgagagtcctgcatttgaaaattacataaaaaattctcataatcctaggtttcaagctgttagtagacaaaccacaacccgtgatttgaaaaatgtctatgacaaaggttatgaatcactgaaggaattatttagtacatgcaccttttctgtcagtgtcacctcagacatatggagtagtagggctaaagaggattaccttagtgtagttatacatttcattgatgatgattggcaaatgcaaaaaagagttcttggcttaaggttaattgatgtttcacatactggtgaaaatatagcagagagaattcgagaggttattgatgagtttaaccttgcagataaaatttttgctgtaacaatggataatgcatctgcaaattctagggccatggaaattctacaaccattattttgtatttatgctcaatcatttcttctgcatcagcgttgtgcatgccatatcattaatctaattgttaaatgtgggtttaagagagttaatgtacacatcgacgctgttcgtcaagcaatcacgtggttaactgcttcaaacccacggattgcacagtggaaaaggtattgttgtgcatcgggtgagcccccacgtaagtttttaaccgatgcagaccatcggtggaatgccacttattttatgttaaaggttgtattaccttacaaggatttacttactgttttccttcaaacacgtaatggcccaaaaaacagtgacggccagccaatactgactgatcatacctggcacattgttgaaaggttcaatcaatttcttgaaacgtttcatgactgtactctcttctgttatctcaagtatattatccaacagctaatttaattttgcataatattcttgaaattgccactttgttgaaagagtatgaaaatgatgaccttttaatgcccgttgtctttaatatgaaacaaaaatatcttaaatattggaaagacatccccatgttgtattcttttgcatttattcttgatcctaggggaaaattacggggattcctcaatattctttcacttattggagatattattaatgttgattattctacctattatgctgatgtcaaaactaaattctatgaggtatttcgaaagtatgaattaaagttttagtgagatcgcttgcaaagacccccacctgtccttgcagcaggtaagaaaaaattacagtggagcagaatttggggcggttcatcttctagccatggtggtggtaccagttcatcagcagcaagtggggacgctagatcgcatggtcctgccgaagagttgtccaactatttggatagtgatgccatcaggcatgaaacgtcagacttcaacgtactcgggtggtggaatgatcataagatgtcatatcctgtgctatcaaaactagcacgggatgtgttgacggtgcccgtatcttcggtatcctccgaatcagccttcagtctatgcggaagaattatcgaggataggagaacaagtctgagcagcgatcatgtggaaatactattaagcgtcaaagactgggaacttgctgcagaacatgcccaatacactgctgacaaccaagaattggccgcacagttcgaaaacctttatttagatgacgaacaattagggtagctagtttatattttttaagtattgacctgttggctgtactcttttctttgtcatggttttctcaaatatgagtttttacatgacaaagtttttaacgaggcagcatgtatcatgtaaacatcaataaaggtcattactctttttccccatatttttctaatatttttctaagtctaattatttttctatttttctccaactatctattaattttctcttagcttagttaactttcggacctttctctttgatttgaattgttccactgacagagtgacaggcgatagacacacgga

SEQ ID NO: 58783 - DNA, 1187 bp, Oryza sativa
aagtgatcttgtcccaagccgaaaaaatgaaaacgggccgagggtgaaaaaggcgacaaagactacattccctctaaaaaaggggtaagtacacttaatatctaaactgtttgagtgataactgttagcccaagctaattataaactttgatacatactcatagaaaacggcgccatggcgatcaaaacagcagccgaagaaaaaagataagtcaaaagacgacgaggtcccagctaagaccaccggctcaaagaaaagcgaaccgtcatcaaaggcgaagaaaagaaggggcgagagaagcgtgaataaaaaggacgaagggttttatgttgttaccaatgttgggcctaaaggagagtcgctcgcccctcaaactgcacgtgccaaatttagttcacagtgtggcataatcgtaagggaaaagatccccatcacggtcaaggactgggatcatgtgtcgaatggggataaggaagtcctatggaaagagctgaagaaaagattccagttcccggattgagcagaggcagttgtgaggaattgtgcactgcaaacactggacaagccctggcgtggttggaaaaacacattgaacaacaaatttgtgaagacgggtcgtccaccttttgcgacatttgccaacataaccccgaagtagtgggacgactgtgacgttgaagaactccctggaagaaattgaagggagcaaaaagtatgcagagttggccaagaagaacagatttcctcatcacttaggctccggggggtacgcaccaaaggtggagcggtggtcaaaagaggaggaggaaatgaggaaggcggggcttccagtaccaatggaggaatggaaccagagatctaggaactgggtaaaagctagaactcctaagatcacagaagaaggcaaagtatcgtttgaaaatctggagctacagggggttgccgataaaatagagactttatccagtgcatagaagataggatcttttaagcctaagagggagaaagatgtgctaagtacggtgctgggtactcctgatcacgggggtacggttcgaggtgtgtcattcaatctgagttggaaggaagggttcaaacatgacccccacaagaaacgtgaaacctacaaggataaactaagggacgaaggggctcaggattttgaaaggaaaatgatggatttctg

SEQ ID NO: 58784 - DNA, 2529 bp, Oryza sativa
cgagagagagaatgagtgagagagagagagaggagagagagatgagagactatgataggtgggtcccacatttttttaataaataaaatgctgactggactgtcacgatcaaaaccaccgcggattggatcgagggggtaattcgtccggtttgcatagttgggggtgaagaatgttcggttttgtggttaaggggggtaattcggacgaccgcgatagttcggggggggggtaatttgtactttttccttttggaaatcccctattaaggaaatttggtttattttttgttccatcgaaaaatgtttcacctagtgtattcacaatgtttcactatatatagatttaatgttgcagtgaactgaaacattctttcgctatttgctgaaacattgtttttatataaggtgaaacaacgtccgatttaaacgagtgaaacattttcgatctatttagtgaaacaattccgatatacttggtggaacatcgtgcaacatttaaaaaaattcaataataagctaaaaattttttcgtcggaatatatccatgtgtggtcatgttttgaagatttaattgcaacgaatttaatggtgcaatcggatcatgatttggataagtaatttaagagaaaaatcagtagttttgcacataaatcggacgctgacgtcagcacccgatttcacccgctccctgtccggcgagcgacgcgtagtcgcgtccagaaaacattgtcgtgacccaaggtcacagacaagattggggatagacgggaaaacccccttttcccgcctatcctgagaaatgagcgcgaataccaaatgaacacacacactaagtgacaagacttttagtattccaagatatcctgcctgctacaggctttttgtctgctttatatagttcacagctttacatgtgagattacagttgcgccctttgttgggcccacatgaaattacaattatgcccttgctatatcagctaaacctaagggcattttggtacattatggaggtcattatagtcttttggtgccagctagatgaagtggttgagtggtcctcaggaatattctcttggcatctttgttgtctaagtcgccttcttcatgatcaagagtcttttccaccaccatgggtcttctcctcgaccgagggtcttttccaccaccatgggtcttttccatggcaaatagtcttttccagttcgaccacccttttcgacttatccggtagctgacctgttactgacttaggaaacattcaaaacggataataagacttagtgacaagaatttactcgaacggtattttccgactcgaatagtgttttatcgtttccttgttcgaatggtcatttccactcggatacttacaataatgactcaatctcacccaatctctctctacagtgttttgggccgaatatggagggacggtggtcaccccctgctacaacaaacatatctttaagaaatgctgataagaaaagtaaatttcatcctataccatacgtatcaaattatagtatcaaaattgtacaatagaccttgattcctattttccctcaattatatatgcttctctttgtctaatcaaatgagggcgtgagcaacgacaactagagatacgccgaggagatgaataaccaggagtgcacacacagcagctaccacaaaccgcagaatcgtcgatggccgcacccgaagctcaaatactagcttctgattctctgtcactgtcatcttcaggtaaccatcgtcgtcgtctgcggcagcgtcctcctcgtcgtcgtcgtcagtttgggcatcatcatcgtcgtcagcttgggcatgaacagcttcggacgcatgcggctcttgcaccggacgctccaaccctaaaacgaataacacccagtgagaaactacacaagcacacgatggatcgatcgatacaggctagctcaggacgacgatccgtggcgcaaaattgctcagatcagaaacaggatcagaagcagaagtaattgatcagaagcagacgatagatgatagatcgatacagggtcaggattactacctgaaggtgagggtttggcgtggatgatcctcctgaagcagaagttggagcaggcgtggtaggggttggaggcgttgatgcagtggggatggacgcgcgaccaccgatgattatcttccctggacttcacgatctgccggaggcagtagtcggagcactcgtggtacgggttcgacgagttgacgcaatccggccgcgacttccccggcggcggcggcgacggcttctccatcggacccacgattagctccgccttgccctagatgacgattagctccgcctcgccctcgtcggagaccgcaacgcgtgtgaattggggtttggattgagcgaggtggtgggtttctctatttgacttcattattagtattattctcctcctcgtttgcgagtaagattctaactgggccgagcaggtgatgggcttgcgggcgaggcccatttatttttctcgagccgttgggccaag

SEQ ID NO: 58785 - DNA, 6865 bp, Oryza sativa
acccgaaaccttcctccaaagtgagcagccatctctgatctgagtaagcagcggcgctagttttttttttttttttagcgagttggggtagaggcggagagaaaggtcagggcaacaggattttatagtctggtaggaggggaggaggggtaaaccctagtccaattcgggatttctgttgattttatttatttatatactttttttattgaaaaattacaaaaataaaaaatagaatacccgtttcggaacagctatccatctgctgacagattttgtatggcttagtcttacacattttttttttacggtcggatgtatttgagatttacgctacgctgagattcgtgcatggcatgagaaacaaaaactcttacacgtaccaggactcgaatccatgatttttaactcatccctttcactgagctaacttgtttttatagttacttacactataactatatattaattacatatgtaattttagtgtatttatgatgtaagtctgaaaattacatatgtaattttagtgtatttacgatgtaagtctgaaatctacttgcccatttgagcccacgtaagttttagattgtccacgtggctcgtttgtttgtttttttgtttgttgtttatgtatattgatgccatccgttagatgttaatctaaagggtaagaaatctgcatgacctatatctgtctcatgatgtatatacaggcagtccctaaaagttttgcatacctatactctccttccgtcctacagtaaggatggagaagaatatttctgtaattttttttccattatttgtttcctaaattggcggaaggaacatttttttttaaaaaaaacattcattctattatttatttttgaaatttttaacagaaaaacatttaataaaaatgattccaatttcctttcagccgcagcccgggatccctgcctattatccgagagacctgccccaggcaaaaaaataatttcatgggccaacttttcttcaattttgctatatatttgtcgacagatttttttcttaaaaatttaacagatgtaaccaaagtatacaactatagtgtaactacaatgtaatttgcatctaactttcacgtaattttgaaccgttagatttgttttaagatttgtgcaagtggagaagaaaaagaaactcactgcacgcacataagtaagaggattctgtcaatgaatgatactcggggaccggatgagtagagtactagggtacgttggaacaagggtctacgtagtacgatatcaagcagacaaaagacaaggattatactggttcaggcctcttgtcaggtaatagctctaatccagtttatatggtatttatgatgatgagaacagattacaacgagagtagtcgaattagatgataccgacgagattgtagtcgaggaattcgacgagatctcccagcgacttggctccgcgtactccggcttcgtaaactatggtgggtgtgttggcgatagaattgaatgcctttcaccgctccctggggtcccttttataccgtggatcatcttgaccccaagaaagatttgtggatatttgatctggtacggtataacagaagctctatccctttcgagtaggactttggaaagagatattttccataatttgaagcggattccatacgatattcatggggatgatctgtgtatgtgaaggtatatcttatcggtatatttcataagtcgtaggatagaaggtatgccttatccgtaaccctgacatattcgtttacatgatctccattttcaccgaaatagcatgttatgaagagatttttgaaagttacatgtaagttatagtgtactatcacgattgtactttaattacatctgtaaaatttatagtaaaaaatttatcgacaaatgtataggtgatcccattgtaacgggatatactattattttcaactactattgtgtattattgttatatataatatgtgttctaaagggtgatatgttttttttctttcacactccaacttgctcgacttgtaaacagatggtcgtaggaattttgaccgaatttacagcagaattatttttacttttatatttttattaaaatatttaaaattatttttgtttcaaaaacttacaaatctaaacgcctcacgcagtcctagatggcttttaagaaaaacaccctttcgaaaagcgttaatgttctaaatgtagctttcttcgagtcttttcaccattcaccaaagtagcctcatgcgtcgtacactcaaacataacaaatctcttaacttgtttgtcctgtttgctaatgctgaaacaactacaaactacaacttgctctcttttttttctcgttagtacgttttttaaactgttaagtagtagattttttgagaaaaaaatatgtataaattgtttaaaaagatcaaataaatccatttttagtttataataattaattaatcatgtgctaaaaagttttctcgttcctaaagcggttgaaggaacgcagcaattggcattgctatctctgtttccagcatagatttatgcgtaattctctggcatatcttatactttttatcataaaataaatcaatttttaatctagaaatcttattactcccaatatcccttatatatagatacgcccatattttcctataactaataccgtacccaatttgaataaacaaggaggaataattttataaagttggttttttatctagttcattggtggtatcattttacgttggaacatttttttagagtgttttttttaactcggagaagtgcgaggaccgatgcttaaattggggaagagaaggacgtcccttatcatagcaaagataagagatactacagttctttttctctcaccattaaaacagtcttgggatgaagggtttgattgtgtatgtttggaaaggaagttttgggtggataagatatggcgtcccctttttttgtgtgtatgtgtttggttggtgggccaggtgggatacaatggcctgaaagggaatattcccattggatgcaaccgggcgagcgcggtgagcggtcgcgtcaccccatggagaggggggcgacaacgatgaagatgtgttgtggctgatgcgggaagtgagcgccacatcagcgggaggagggagtagcgtcgagcccggagatccggagcaaaagatgagcgtgacggctgcaacaacgacgcccgaccggtgcgacgacgacgatgctagcccggcggcgacgacaacgattcactgctgctggtgcgggaagaggacgtggcggtgtgcccgaagatctggcacgagagatgagcgcagaggcgacgatgcgagcccggccgatgacgacgacaatgatgacgattcgttgtggccagtgtgggcggcgagcactgcattgatgggaagagggagcagtggtgagcctaaagatttggcgcgggaggcttgcggcggtggcaagcccggagatctaccctacttttttatttttccttttatttttatttttcttgttttcttttttctctgtgtatttataatggaggtagtggtgtaaaattgttgggaggagtttgatgggggtatatcaccatattaagtgaaaggtaaccacaccaacaaatccaccttactctctccaaccaaagaaaaatttggatcatcaaatccaccttcattccgttgaccagacaaaaaaaattcaccatatccatccaaccaaacaaaaaattgaatcaccatatccagcaaaatatgagcggccatatcacatccacttttgacagtgaaccaaacgcacctaatcatcaattgttgtcgagctggcagcttggctgctacagtacgtgattggatcacttgtcgtggttaaacttgaagataaacgatctcatcttttcgtttatacttatgcatataagctaaaatttaaatttttaaccttaaatttggagttgattttagggttttttcatcgtagtttatttttcggcttttgcttttagattgttatgaacatgtacgtagaagttttattcagaaattatttttgctttgtaaataggttgttgcaaacgatggggctgaaaagtaggggtccggacccctagagttaattccaactccagcaggtagatttggccaaatctctgccatctgctgttctctgaggctgagatgaagccacctcaatttcaactattttttttcttctgagaaattatttcatctaatctttataactaacaattagttgtccaaagaaagaagatatatagtgatttttggcatagtgattccagttcccggccaacatttttttttcgcataagaatggctttatctctattatataaaaaagaaatattgtatactattaacaaggttctgttaacagtgaaatttggtgtttttgcatcaacaggttctcttgtgttattatatgtatacgaggaaacattccgttggcacattattgttaattttgaagaagagaacatgtatactccgttaacttggttgcaacgttatcattgctaaatgttaagaaaataatttttcctttaaatccatgtgattaactgaattaattaggagacgtggcttgttatcagccgtagaaaaaaatagatggcagagatttagctaaatctaaccggtggagttgaagccaactctaggggatcaaacctgaaaattaggattttaccgaggaagaaaagatccagtgaagattgtctgcagtactgctgatgcagtagcagacactgacgtgtgggcccggacccatatgtcagccactgctaccgctcacctacaagcattctcagcgctgtgggccacacgtgcttcacgtccatatgttgcaattgacaaaaagtcactcgctgatccaaatgctccacgcagagagaggttctagtttcattgaatttgctttaggctcgtaattcgactttcatcgttatggattggtaccaaaccatgattaagtcctaggtaagcggactttggggagattatatgagtaaatgcctgaaccaaaatatgtcattgttatgggagcttgtactattaagggggaatattcaatacggatttgttggcaactttttgtaacaagttgacaaccacgatcgcagcacctaaagctttgcggtgatagtagagtcgccaaccaccctaatctagtaagcactagatcaagatgggttttgataagctaaaccggctagcaaagccgatctagatgaaaccgtagataactacccatctgtcaagggataaccctctctagcgggtggtcgtgagaacctcctttgtgagttcggccggtggaccgggcacaacgatcaggagcgtgactttgctctaggtggagtgggtgaagtggaaggcaaacgaattcgaaacgggggattatccaggttcgggctacagagaagcgtaacaccctactcctgtgtgtggattatcttgaagtggttacaagggagctcaagctcaagagaaactatcagctagtcttctcctaaggttcaagcttctgggagtcgtccccctgctcggtgggcaaggtcctccttttatagtccaagggcataccacatgcaccgcctccatacgtctctttcccaaaaaggggcctacctcaacctggtgggaccgctacccatgccttaggcaaaaagtaaggcggccacgcgatcccaggcggggcccagcgtcgtcctccgcctaacacgggggacattccttgtcattccctcataaattcatggagacttttgtaggcttggtgcgtgggatacatcggtccaacatcgatcccctgccatcgatgggacggggcatacctgccccctgtaacatcctgaaaattcaatacaataaaaatcactaaaattttgaactttttaaaacttttgcatcatgctggttgttatgattgctattgcttgccaaaccataaatgatcacaaagaaagtaaagtaaggatcgatatttaagcaatagatataatttatgagaatatatttaatcctacaaacaattatgcacaagatagtaaagtcaaatattaatttctattacaaattacaaatcaggtattagatattcgaaccatgattgatagcttgatgtcacaattagctaaagaaatagtaagattaaatctaattcatttgaatcgaatctcacatgaaatataagaacacatgaaatgatgatcaccactatagtgatcgtgtttataaataagtaattcaccggaatatatagattgatacttgcaacatgtcgccgagttactcatgacaggaaaatcactcatataaaataatggtcatataaataaattaatccttatatataaacaagaatatgtgagtgtttaaaattagattaatgttgtaccgagtcttaatatactatttatagaataaatagattcaacctatccgtgtaaaatatattgctataagttcattcaatgtgctattgtaataataagggccacactaggatattttagaaccctcaaagcctccaaaattatctaggctaattttagaattagacctcatttaaataatacaatagaaaaatatatataagaataaaatatgggtaatattaaaatttggtaaactttcatctaaattaaaacatatattgggtaaacctcatttatgtaaaattaggatttatagaatgaaatttatacaagggataaactaaaatcgggttaaatagaaaatggcactgttcattgcgcctaaggtgttcgatgtgggccctagccttccccctcctcttccacctctttccctagcc

SEQ ID NO: 58786 - DNA, 577 bp, Oryza sativa
gagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatctaccttaacttaatgatttttaccaaaatcattaggggattcatca

SEQ ID NO: 58787 - DNA, 583 bp, Oryza sativa
caaaacctcaccccttctaattatttgatattatgtcattttctaatattcgcgtctgttttgttgtcatcgtctttctaagcgtgcgtgcttgcaaaggaaaggagtagagagagagagaggcacatcagcagatcgagagagagaagctggtatgacaaaagaaaagaaaagacagaagatgactcatgcacacttgcgaaatcaaaccaaaagagaatcaaagcgaggcaatatgtacgcgcagaagcaatgatgaagcgaaagccgaaatggtgctaaccgttgggcggccagccacgcatgcagcgaatcggtcgatcgatcatgcagctgctaacacacacacaagagaagacgagacgaaactcagccggccggtgattcgatcgagagtaggtgacacagccaagcaggatagaggctatttttaggagagcttctagctgctgcaacttctctcagaattagaagctccccaaacagtatatcttttggttcatattctaagaagttgtaggtgaagaatccacaaagtgaaccataagctagaagctgaaaaacctagcttttcaatattctc

SEQ ID NO: 58788 - DNA, 1582 bp, Oryza sativa
ctcgcgccccgcgccctgccgcgccgcgtcgccatcacatcgccgcgtcgagccccgcgccacgccaccccgccgacgccatgaggccgccgcccctcttccctcttccccattatctctttccccttcccttatataatccccccctattcccactctttccctccatcctcacctcctctcctctacccactccaccacgtcgccgcgtcatcgcatagagccgccgcgccgtgcgtcgccgccttgcgccgccgtcgccgtcgtcgccgccaccgccgccgccggtgagccgtctttctccccccttcacctcgcgcccaccgccgtcgccgcccggggaggcaaagagccgagagagaaagagagaaaccgagggagggagaagccgaggaagagaggaaggagccgggagggagagaagaaaagaaaaggaaaagagagaaaaagagaaaaagaaaagggaaaagagaaaagaaaagaaaaaggaaagggagaaaaaggaaaaggaaataaataggaaattagagggagattagggaagtttagaaaatttaaaataattagaatttaattatagattaattatagtcgtagaattgcaaaatttaatataaattatggattattcttggtaatttctacaagaaatcaattcgcggtagtaatttagacgtaattaataactaaacaaatagatgaattcttatagattattatagattatttttgggtaaaccctataagtaatcgattcacggtagaaattcggatttaattactagggattttagccgtgtattatatttaatcatttagtcatagactaaattaaatcatataatatttctaggatttcgttcgatatttagctccgatttgagtgaaacttgaacctaaattcatctaaattcataagctttccaatgatatataattcactatttgataaaatatatttataaatattaaataattaatatcaagatgatgcataatagtcaacttaaaaatatgttaataaataaaattagtattgtacagtagactagatgtaataatatttgtctctaacatgtcttgccactataacaaccacacaaactaattttatgtgatgtatcaaatgaatggatgtataggaaaatactagtacttatttaatattcgatggccatataattaaatccatggcttataggttatttaaatcaagtgtagccttatgattatgcaactaaaatataaacacacatagatgaatctttaacctgtttaggagaataataatagagctagatgtggaggaatcactaagtaaattaatcgacgcaataccatatagaatagcttatatatgcctaaattgattaccacttattagtaacccaatagaaccagtgcttaaacttgtcgcatcacatatacaatatcactcatagaaactagctaatgtatattaaactacaatatattcaggaatcacttggagcattgggtagtacactttctaaataagctcatgtacagtaggcgaccaaaaccttatacgttgtagaacacatatattgtacatcccatt

SEQ ID NO: 58789 - DNA, 706 bp, Oryza sativa
caaatcctgaggataaatctgaacatgatcatcatgtctagtttcatcatcagaatttgattagagttaagaaaccctcttcttattccttttaatttgggacaagaacacagtcaaatttcaagtcggattcgctcgaggaaataaatttgcattgtttgatcttgacatgtttgagactgatttgcccccacacttaatctggggaagcttcaggaaaatctacgtacgaataacctggatcaacatgatcgtcaaaatagggttggctagcgaattgattaagcccacctcattggtttgattgaagaacacgtcggtatcgtcaacgctgctaattaaactcccataatcatgatccttcttcctttctcctccacaggatcgtcgctcacgtcccgaccatcagaatcttccacgacacctacatacaactatttatttgattgtggaaaactgtttaatctgaatctatcaatggattatttctctatacttaaaaaatatatgtttttttttgtaaaaaaaatgctcttatgatgttttgcttagaccacttgttaaattcattttttactagattaaatggatagtactttgcaacaatagttctctcaataatgtaaatcaaataggacatccaattggctgttaaagtttttatcgctcaacataaaccaaaaacccaaaataaaattgtgctagt

SEQ ID NO: 58790 - DNA, 1137 bp, Oryza sativa
aataacgaccgtcaacagagaccccagggttgtactccaccaggttggagcacaccccacatgagccctacttagactgaggtcccaaacaaagttacaagcccaaaggcctatgacaggtggcgcaacatcttgtttctctatttgtcgacggctgactcagaatttggagatgagactagatccattggaaagaggacttcgagagctttctatcaagtactcatgggcccaaaatggagctcgtatgcaaatttgggggctgtttgaagtcaatgctgctgcaggtggctgaatttgattctagaacttgtgtggcttgatattgctgtctctcggttggatatgagcaacggttgtaccaatagcggctaaccatcattgaacgattaactatttttaattttaatcggtattgcagcattgagaagcgagataattggtgcactcatgccccgccctctgagaccgcttgcaccggcagggcgtgtaatctcaccgtagcacccgacgagaacgctctacgtgtttgcccaccatcctgcgagaccgctactgtttgttcgcgataaccagatggtatacttttgcacttttatcccaaaccagtattttcttacaaatctgataaaaacatatattttcaattttttcctaataatgatttttccataggtccatcaatgacattgaaaatgccattgaagaggcaaatgaacccatagaatattaggtagatacaaaagggacatgcacctcaatttgacgctccttgtaatgttttatacgacctttgtgcataatctacaattgaaactttaactcaattgcctattgttgatgtaaaaacgcgaggcttaggagatctgtttaactccagtgcaggtccaaaacttgctttgggtgtgtgagcgtgccagttgatttgatcctccaatcaacaagaaacaaagacaaagaaaccgtgattaaatccataaacaatagccgatcagctaagtgccgatgatatatcatttatctttgagccgatgtcatatatgcatcgatcggcagtcattaagaagtaagaaagagctaaatctactcgatcggctgtagatatcaacggtatatgggtaccgagctcgaattcgc

SEQ ID NO: 58791 - DNA, 1579 bp, Oryza sativa
atgtaaggtgcttgagcctttgtgctccttttgtttgtgaacatgtgtgtatgaactgagcttgtttggtcagattttctgtggctgcatacacccccgttggtgtagaagccaggttttataaattcccattatctaaaaaaaattaatagcaattaattttgacacctatttacaattgtaactcttacatattcattttacgactttaatgatttatcaccatgactcgcatgaaaaaaatatgtagtacttaaggtttaggatagctgaaattaatgaattatataatttatgtgatagctatttaagggtataaacaaatgaattgacttataaaaagttagaatattgtttaaagaagacactatttagaaacttggaaagcgtgcaaacaaaaatccaaaatatggaatcgagaaaaaaataaagggccttaaactccctttatcacccttatcacagtaagagttctattaatattcgtcaatattacgctcacatttataacataatgattcctttcacctttacgaacaaatagtacaaaatccaaatacgacataacacaatacattataattattatgtaatcaactctcggtttcaacttaaacagagctaattagtgttgagaaaaacacaacccatggtgcttaattattctctcgctgcatcacacctttaattttcttttcatgttattaacaacattaatcatctccatatatgatttgatatgtggcaaagcggtagctttacagcggttgtgatcaccttatatgtctcagacactacaccttgtcacacatgcgaaaggtaaaggtgcagacgtgcattgtgcagcgggcaaaaagagaattttggacgctttatttattagcaaacaatagatccgatgattataataataaatccaccagttctagtgtaagtgtacattagttaatatagattttaaattgttaatttaatgggtacacaatataatggtgtagaccttattttgaaacagtgcattacttaagaataatataccaatgtaataaaaagtagatccgatgatttatataatggggccatcagtttaagtgtacgtataaattagttaatatagatattgtttatttaataggtacataatataattgtgtaaaatttattttaaaatagtgcattatttgaaaggaagattttttgttatatgatggtagattctttgttttgtaaaattatgattatttaaaaaatatattcaatatatatatatatatatatatatatatatatatatatatatatatatatatatatatatatatatatatataaagttaattggaaaagtactatcataatcttataaactcaaactgaaaattcttatttaaatattaaaaaaattatcattgggagtacttatttttcttttttataattctctatagttctctattcgccaagcatgcacacgcctagtataccaagagagattttcttgatggagtttgatacgtgagaaacaatctactgcagttcttttattatttttcatgcgactggtatatggggcgtcagg

SEQ ID NO: 58792 - DNA, 506 bp, Oryza sativa
tacagatgcaaatggtcattaattcctcatgatcagtgttggtagactgatacttaagatcgctcatgtacgactgtacgagctgtttggtgtaacgaagaataacaacacggtgaatatacaaaccacccattgctaattgcatactaactattcccctgtccatagaaaatcaagccaatctggacatcagcattatcttcgaaatgcaattttgactgcaataatttctattgcaacaatgtctgtgtaaaatcaaatgaactagtacaatactacacaaaacaagactgcactttgtagaaatcaaatctacacatctatgtaactcgcatgtgtccaatttttaaatgttttagaaatagctatgcataaattttaaatgtgcccacatttgatttgacaatatatacctagctggtgcgcttcttcttgggaggcctggaggacgttcttggcggcgggggtgaacttgatctccatggggaccatgccggggcccctcc

SEQ ID NO: 58793 - DNA, 595 bp, Oryza sativa
agtatacgactactataggcgaattccagctcggtacccaaaaaaattcaaatgtggcccggagaatttttgttaaattctccttggtctaaaaagagccctcaaattttagtggaattttcagagcacaaataataattattaagaaataaacaaagttaaaaaggtttataaaaagaaaaaccctaaaagaagtcttctttcccccccttcctctcttgggccggctcggcccacctcgctctttccctctctctcctccccgcggcccactcggcccctcccccgcgcgcgcgccgctgacaggcgggcccgcccgccaccctcgctgacgggtggggcccacctgtcatcgccttcctcgcgccgctcccgccgcccgcccgtgccctagcgccgccgccgccgcggattccgccgcatcccgccgtccccgcgcgcattaaagagggggaaatcactccccgtgattccctctccgtttccccccgcttttccctctgtctctccctcggattcgctcggaatctttcccctaaacctcggcggcatcaatggcgcccgagatcgccgcggccgtttccttcccctccgg

SEQ ID NO: 58794 - DNA, 7429 bp, Oryza sativa
actacggctccggccgcggcgtgtacgaggaggacttccccaacaagccggtgaatgccttcgtcaaccccaccggcgacaacggcggcaggcccttgctaacgaagcgcggcaccaaggtgaaggtggtggagtacggcacggtggtagaggtggtgttccaggacttgtccagcgagaaccatcctatgcatctgcacggcttcgccttctatgtcgtgggacgagggtccggaaccttcgacgagcgcagggacccggcgacctacaacctcgtcgacccgccgttccagaacacggtctccgtgcccaagtcaagctgggccgcaatccgcttccgcgcagacaatccaggtgagttattcggatttcgatcggattgtggtattttgatatagtactttcatgtgcagttttttttaaaaaaaaggttcgtgtttattttcattgttcaggtgtgtggttcatgcattgccattttgatcgccacgtggtatgggggatggacactgtgttcatcgtgaaggatggcaagacgccgcaggctcagatgttgcctcgtcctccaaacatgcctgagtgctaatgaccgtggttcaaggaaaataacaagagtgtgcaaacacaagcaagcggaaatttgtttgttttgttgattgatttagtggtttatttttttttccttctttcgctgaaaaggaagaacgtcctgccttgtaattgttagtcacttcgttctgtcatgtaagtttggaatttttgttattcaatttatttttttgaatttttgttattcaaattatgaatataactaaataatgtatttgcagtggatcgttattatgacatctttctttataaacacacacacccttgctatcttgactattaattcccagtgttaaattgtgttacactgttttagtttttcgcaactgtgatgaccttagagcaaatttaatagtatattaaactatagctccaaattatctataatcaatttaatagttaattcatacgatgggtacgtatgaacttatactatactattaatatattaatatatagtctcacacagtggcggaaagaggggtagggcagcatactcctaaacctaaatattcattaaaatttacatttgaaaacttcaaaaatatgaaaaataaaaggtaaattatgtaaattatgctggttgagccctagacttgagaaaattcttgctacgccacagatctcacatgtcatacacacattatattttagagccagtactataattggctacaaatctatagctcactactcttctctctactcttttatcttcttgacatgtgtctattgctaacttatactccctccgtcctataatataagggattttgactttttgcttgtattgtttgaccattcgtcttattcaaaaaaaatttagaattattatttattttatttgtgacttactttattatccaaagtactttaagcacaacttttcgttttttatatttgcacaaatttgttgaataagacgagtggtcaaacagtgcaagtaaaaagtcaaaatcccttatattatggaacggagggagtagtttattattgtacccactcttgcttaggccctgtttagatcccaccctaaaatttttcaccctgtcatgttcgaacgtttgaacacctacatgaagcattaaatatatgcttaaaaaataactaattgcacatattgtgactaatttacgagacgattcttttaagcctaattgctccataatttgacaatgtggtgttacagtaaacatttgctaatgacggattaattaggcttaataaattcgtctcgcagtttaatgacggattctatagttagtttttttagtagtgcccgaacatcctatatgacaccctatataaaacctaatgtaacacgccaaaactttacacctctggatctaaacaacacccccttagtctcacaatgtttttgtttgagtgaagtgcacatgcggtcattaaacttgtacggatatatcttctagttccttaaactcttaagatgaatttttcggtccccaaacttatcatgagtgtcgtatatgtttaaacgggttccaacccgctccgtgagatgacgtggagtttacttcctccgttccataaaaaaacaacctagtacgggatgtggcatatcttagtactacgaatctggacatacatgtgtccagatttatagtactagaatatgtcccatccaatcttgggttcgttttttatgggacgggggaagtacgtgtcagtggatccaacgtgtcagtcacgtagaaaaaaaataaatttaaaaagagaggagagagaagaaaatgatgtttttaattttgaaaaaagtaaatgataaaagagaggagaaaaatatgttcttaattttttccttactatccgtttgaatctatatacacacgagacaagttgagggaaaaaaattatgagagtttaggatctaattatacacccacatacatttagatatcagccgtgcactttactttttttttttttcgtgactactagtttctggagtaactaccaccaaagctgtgctgctgttgtgcttccagtggcaaacacagcagatagataatacagggcccgcgacgtgggcgagaaaaccgtgtgccccgcgcggcgtggcggctcggcgctggcgaaaccagggcggcgcgcgctcccggttcgccacttgcccccatctcccgacacgcacgaacgccatccccgcccccgcgccaccgatgttctcatccaaacacatcacctcctatctccaccggcacgcatgccgactcctattataaatgatccctgttctttttggcactgatcccaattcactagtcgtgccattccaatcacctcggcgagatcagtccaaactccaaagaaatcaagaattcgcagatgaaggtgcttgtggcggtggacgacagccgtggcagccaccgcgcgctgtcctgggtgctcgaccacctcttcttccccgccgccgccaccggcgacggcggcgaggaggagcaggtgccgcggccggcgccggagctggtgcttgtccatgccattgagccgctccaccacgtcatgttccccgtcggcccaggtcagtcagtcgtcgtccccgtcgggccgccgcaatgcgcagctgtctcgaggggtgattgcttacgggtgttcgcgcagggtcggcggtgtacggcgcggcgtcgatgatggaggcggtgcgggcggcgcaggcggagaacgcgcggaacctgctcgtcagggcgaggctgatctgcgagcggcgtggggtggccgcggcgacggtggcggtggagggggagccccgggaggcgctgtgccgcgccgctgaggacgccggcgccggcctgctcgtcgtcggcagccgcggcctcggcgccctcaagaggtacgcacacgcagtcacgcacacaccccctagctgttcgtgtcagtgtcagtgaccaggactccatggcgtcgcgcagggcgttcctgggcagcgtcagcgactactgcgcgcaccgcgcgagctgcccgatcatggtcgtcaagccgcctcccgacgccggcgacgaagacgacggcggccactgcacgagcaactgaactgatgatggatcgccattacatccggaagaccagctttcgagggggaaagagaatcaagagagagacacttgttttaccattgttgttcctgctcagtgctgaatttgtccttccaaagttcctaccctgaagcgccgtcaataaacatttttactgtgtgctgccctgcgtctcatctgtgcttttgctataccgttgcacatgtttcttaattttgcaaaaaagtttttgaaacacggtacaaacgacgcacaggcgcctcgctgcaacgactatcactgaaggaacaatgaaggaacaatgagccgtaaaggcatctcgttatcgatcggttgttgacggatacatgggctatcattgaaagaataatagcctatatcacaaataaccctaactaattaagctatactcacttcatacaaaactctaaaattaatcggtggtgaaatctctaataccgatttcagggctctatccctggttagagaagcttttcctccccaaaaatctgccacgtgtctctttgctccccaaaagttcgctgcgatggaccaacgaagcttgattttttctcgcaaaagcacttgacccctactccacccatccctcctcccgatgcacgcctcgccgcccaccggatcctccgccacccgcgcgccgcagcggaccacccgctcatgtcctccctcaaggcgcgggctcgtcttcttcaccaccgcccggccacctcgccctcccttgcgctccccaccgccatgctgctgtccttccttgacgcgcggggctgtcgtcatgctgcaggagtcaccacaagcacgcgatagtcgtcgccgatacaaacttcggcaagatccgttgagcccaatgaagagaagagcggcggtggtggccgtcgacccggaggccggatcaggagaagggagggggcgctagctagcagaggagaggaggcggcgtgcacgggtgagtggtggcgtcgcgccggatcctctgccacctgcgcgtcgtggctatgacgccgcggcgaaccacccgccaacggcccaaggagcaggagggattgcaggaggtggaggatagggagcgcatcgcagacttctcctcgctcatgttgacggcgctacttcgatcttgtagacgcaggcgccatcgaatttcctgcaaaggaggccatatactgtccgttgtcgcaacggcatcgcggcgaagatggagacgccgaggagcaaggagcagattgaggaatggagactggagagcagcggagtcgttgacaaataggagcggggactggggactggggactgggaaggacaaaaaaaaaatgactttatttagctgcaagcctacaactgaagacagcgtacgaacggctagatcaatgtacagacggacggctctgatttttttcatgacgttgccatctaaatgaaaaatcagtgagcattacattcagatagtgtagggcagaaaaactaaagatcttattatatcatttgattgtgctctcagttgacacttacaggctcctatcggatggcctaatcagctaaagaaaaagccaaattttaaatttttaagtataattttgagatattttcaaagtagtttctttttcaacattggcttttaagtcaccaagaacatatttataaaagttttatctacaaattcatttttattttctaacggcttattagaaaataagccaaacagtggggaccacagttcggctgcacatacaagttgcaatgggcagataaggcctctttgcaatcatttatccagggtataattttttgagggagtatccaggatataattaagtagtagaagagaataaggaggcactggtatcttttgctttagcttgagctcaacgcaattccaaattttcaaacaaataattaattccttactcttctttattgtgcaaatagaattttttaatgttatgcacttttagaagataaaattattttttaaaaagggattttcttgatttttatagacatgtggaggcaggggtgaagccacacctggctatcgcaggtggccgcgcaagttcaccaacaaaaactccattaaatttatatgttattgaatgaattgatgatgaaatttatataacaaatactagaagtatagtttgcttgggctcaaaaaatctttttagctccgccaggagataaaatgaaaatactccctccatccaaaagtccaagacctactccctccatcccaaaaggactcaattcttggattttcgtgcccaacgtttgaccgtccgtcttatatgaaattttttatgattactatttttattattgttagatgataaaacataaataatactttatgcatgacttatctttttaaatttttcattttatttcagataagattgatggtcaaacgttagacacaaaaacccaggaattaagtttttttgggacggagggattatttcttttggcaccaagaccaaggagtaattaatttatttacaatgtgacaaaaccaataaacatgcaaccaataagtaataaaatggtttattgggttctgatcaataatttaatttaacacataataactataaataggacttaaacttttggaaaaaccaaagaatggaataagttttagactttagaagaagggagtaagtagtttcattactttggtttcgttggaatttggaatttgtgcgcatatattcgacttccaacttatgtatatgaattcaatgtcttgctgctttaaattaatatatgaataaaagagcatagtttccttaattttaggcattaaatagataaagaaattaagtgtacttatcataacatatcatttactccctccattccatattgattaccatataactttttcaccaagaaaaaaaaagtattaactttcctatatttcatttaatgtgagtatgtggtagggaaaaatcaagaaacatgcacactttaactcctcttaggccccatacataagatcaggtctagttataaacacatttcgaggagataaaacagaaaagagaagagcaatgggctatagatttatagccagctgtagcacagactgcaagatacatgtgtgtatgacaggtgcgaccaagtataaattgtgtagtaatgtttataggagtatatgaatttcctactaaattgactatagatgatttggagtcagtgattggctatattattaaacttgctctaagaaacgatagctttactacctcgaattcctacatacatgcatgcatactcaattgtcatgcttaaatgcaataatattacacgtcaaacgaaggggctatgataatatgatgatcaatttgaaaatttcaatttatgttaaatgatcaatataaaacggatggagtatttcatactggctggcctattatgcggcaaagccgcgtttattttctagttgtaatcctaataaactatcaggtacggagtcagattctttaccgggaaaaaaaacagtgaccgtcaaaccaacgttttctttttttcttgaatgactacaacgtcgcgctcttttttatgttcttgttgttttgaagaacagtcaagatattttgccgtctgtattcaactattgatagagtagggagtttacagggcgctatctttcatgtttatgttgtggagccatctatctatcttatattatattattaaaacagttttgaaaggaggcaccacgttcactgtgggggttagaaatttacatg

SEQ ID NO: 58795 - DNA, 15859 bp, Oryza sativa
atctaggaactgggtaaaagctagaactcctaagatcacagaagaaggcaaagtatcgtttgaaaatctggagctacagggggttgccgataaaatagagactttatccagtgcatagaagataggatcttttaagcctaagagggagaaagatgtgctaagtacggtgctgggtactcctgatcacgggggtacggttcgaggtgtgtcattcaatctgagttggaaggaagggttcaaacatgacccccacaagaaacgtgaaacctacaaggataaactaagggacgaaggggctcaggattttgaaaggaaaatgatggatttctgcagcaagcacatgcttttgcctgatcccgcaaccaaagaacctgagccagattaccccttcgatgacctaaaggagaatacatcctgtcgattgcatgttcccattggacgctccggaagaactcttgaggccactacaaccattgctatccctaggagaacatataataaagagtccatacccgatgagtatgcaaaagtgcagctgcaagtggtccacgaagggtttgagtcgtaagacatcgacatccctagtccagatggtgtatccgtacttggggatgcggttgatcttataattctttggcacaagaatgacaaatcctttggattgggcaccgacgccacgcgaaaacccttttggccaaaaccgggggttccaaaacctccgagaaattctccaaagaagcaggtgaatgataaggcggacaaacccgagatgcctaaggaaatttcggtgccggatgtcccaatggagagtgcagcgccggaggtgcccatggagatttcagtgccggatgtcccaatggagactacagtggcagaacaagatgtgcaaattgtggcttcagtcgggacagatatagaagatgtagcaggattagaatgggacggtacagagatagaagtatttgaaaacccttctcctgcgaaagaccccggggcgcaggaacccctagtctctgacaaggccactgacaagtctgaggtgcctaaagtgcttaggagccacaactccaagtccaaagatgataaaaaagagaagttcatggtaaccgtcttcagagggggtaaggaacatgccaaactcagaggtgatgacccccagaaggccgctgcactaaccgggaaaaaatacttcccaactaatgattgcccagaaaaatacgaatatgggaaagcacttttaccggaatgggcacttgacgaaggtctataggagatgggaaggtttcataccttctacatggatgccagcaagaaaggcttgggtaatataacagctcgatcaccaacagattgtttcggcagcaaaggttacgtttggctagatttcgaagatcttcacgccatatattgtcgggacaagatggacgtcaactatgtcgttgtttggtgcatgtgagtatgagttttaattaattacatgaaaaatatgtacaatacaaatccatgtgattattactaacaaacttcttttgtaggatgcaataaatggatgctaagaagaaaaaaaagaacctatcggattcttggatccaactcggatctgtgaaacacatcataccgtgaggctagcaccagggtcagactagatgaacggcaagactcccgaagagatagcttaatacaagcagataatgattactgtcgcacaatacattggacgagccttcttgcactttcaaaataagagagttgtcatggccgcttataattttaggtaagtccggtacatttatcttctacacacatgtcttattttagccgctactaactaactacgctgttgttaatatgtagcgatcattatatctgtttaatcatccacccgaaggacggaaccgtggtagtcttggaccctctcgatttcagtcaccagtcatacaaagaatttctaacaatcttatagtagtaagttattctgactcttgcatttttttaatatgaatgtattataattaaatatcctccttaatgcaaaacgatacgacatccatacagtgcatacaactactacaagttcaagggtggagaacagacccgaacaagggagaagctactagcacatacatattggccagtaatactccactcacttaatttattccaattgtttcactaattgcaaaatttaactattttcttctatgatatatcgtgaagtgtcacaagcaacctagaggcactgtcctttgcgggtattacgcgtgcgaattcctcagtgttaatgggaggtacagagttaacacaaaggatgtaagtctctagactatggactagacagcttcacatatttatgatactaacatattgtttatcttccatgcatgcagttgccaagaatagaacttcgaacaagctttgacgatacaggcatcacaaatgttcagcgcgatctatgccacttcatccaccgtgagtgctgtcatatgcgaggagaattcttcgacccagagggtgccctaactacaagtgacgaattcaagcaacttcgggagtggaacaatgctatgccataatgtaactagatggtgtatttgaagtgacaatgtaaaaaaatattgtaatatatatattttgataacacttttcacttatgcaatatatgtagttttctcagtactaaatgcttgataattactaataatcttcctgcatcaatttctattaaataactaaaaagtaatatttgggcaaattattattgtatcaaatttcaaaattttctacctatcttcgcaggcggatgtttttattttttgcaggcagccacttcctatttccgcaggtggacctgactagctttttatccacctgcgaaaattgtcttcacaggcggacggctgccccgcctgcgaagatcggtgatcttcatagtcgtttgcttacaggcaaatggctgccccgcctgcgaagaccggtttccatcaccgatgataatgctttttctagtagtgaagataagtattgttatcacggagtggttaggtggacttgcttgtcgtgataaacacacggggtatcatatcttgcatgatatatatatcctagcgagtggtcatcactgtacacaatgagaaaatactgcagcaacatttgaagaacctaacatatatagtctagaatatttcagtaggaaatggaggcactaggtagtaattcacatcagaatcaaatatatttcggcttgtgaatttgtgtttagtgagcccgtagttatccttggaattgactccgcttatgggaaggagacagcatgagcatttctgtaagtcgacagcatgtgactacttactggaagatcggtaagtgttgtgtagggtgtgtggggggggaggggggcattatatcttaactcttcaaaaaagaatcccaaaacagaacaagaatgagccacattatccggtgaataatagccgttagatcaaccagcagacaaaacaggtagaataaatctcaaccattggataaaaaagtgtgttctaaaactttccggtgtctctccttcatatgtgagaaagagatatagaacatagaagacacataagaaacaaagaaaaaaaaggaatgtttgtatgatagagagaaatgataaaaacattttttaaaaaaaaactaatatatattttatatatatttcacaacaaatttttcagtaacataatattagtaatggattattcttaaacacctatagaaaaagatagtgatagtcacgcaaatgcgcgacttcatgcactagtatatggtgaacttttctggtgatgcctacatattggctccgaaaaagctagaaaccacatcattcatattatgaggtatgactggtacactagcacgggataggtcatctgaaacggacgacaaacctcgtctatctaaatatatcttgataagcaaagagtactacattgagaccatcagcacagcagaatttgactcttttggatttgcacgcctatttgagagtatggatccataatatagttgacttctattcactgaaacaaacatgagtacatgcaggtccagaggacttttccccaatttgaacagcctaggttggtctaccgggggagaaagcttggtatctggattctggaggctggcgctgtgttatggccatcagggtccaaaacttgcagctgacaacagggggaaaatcgcgtttccgagctgagagattggagtagcagcagccaaacaactgcatatattgctatgcggcgccggccacgatatggagcagccggtggacggcgatatccaccagatgatggacagcatgtagcatctccagctcgccagaggcgcggcgtctctgcttcttcgtcgattgactctgtttggctcatctgtgcagcaccgcctgcgtcgactctgtttggctcgtatacctgcctcgtctcctcgccagcaaggtgctgccgagctgcacactgcactgcattgcggctgatggccacagccgaggtttaagttttcggtttcaccgaaattttgaacaaatgctggtcaagtttaaacaaaatattatcaaattcacaaaaaaaaattaaaaatttggccgaaataatatcatatcggggggtccgaaatttcattccggaattttgaacccgagcctcatccccccccccccccaaaaaaaaaaaattttttgttttttttaggaaatggctactggagtattactccatgctagagagtttcacatctcaattgtgtgtgtttctattcaccaacttgcacaaggcgttagtgtttcagtttacaaagctttttccttgcctcagcttctcccgcatggactaagctgttgtggaaggtgctcaattgatttttgtatgataattatgaaggcaaaatcaaaagcaattttcctaaatatatacactagaaaaaatgctaatgcgttgcaacggatgaaaactattttaatcttattattgttatacggtttagctatggtgaacttgactgtgtgaatttgcttggatatatttttcttttagaaattcatgagctgcaattaggagtctgactttcatctcaaattagtatgcgaatttttttaaagagatttcttatacgactccttttgtatatctaaaagcaaacaaacttaaaatctgactcaaacataaatatgtattttcaaaagagagcgaactttaaaacctactcaaatacgaatgacgtaccaaaataccgacaaaaacatttttaatttttataatagtagagatgtggatgacagaatcttaaacaaaaatgttgcacattttatataccatttaggtgttgcacataatgtgcgagcctgtgctatattaaataggtacattagcggatcagttatcttgttaccttctcaatgttttttatcagcaaagttcgtctgtctctctctatatatatatacatacatatatatatatatatatatatatatatatatatatatatatatatatatatatatatatatatatatgatagaatccaaacagagagaatgagaatagtccttcaaaaatatttggtttatattggtgagccgatatataggaaagggaggcaacagggaatcatgttgatgctctcatcactgtcttttccattcactgtcaaagcacataactgtttgtcaaacatcgtgtttagggtaaaacatgcatccgcagcatccggggattattagggaagtacgctgcctgaacttatgctatatcaaagatgggagtgtaatacttcaatgacatgctattgttttttctctatggcctatgactattgtgacgcagagagaagacaattgtgctgtattggtatcaagtatagtatctacatagagctttagtaatcgttccaagccagggtggatccagtgtgagtgtcagggcgactcaactccccaataccccgctagatcactattggtagaaggagagagggaagggggaagaagagggagaggaggaaaaaagagatgagtccccactataaatttattttagattaacccctgttccaagcagaatatcgttacaacttacgaagtgaataggaaaaaaaactgtgtaggagctcatgagcagggttgcatgcatggaagagatataatagattggataggtgtgcataaataaatttttatttacagtgggcctcatatctagggataagagaagtatcaacacactaatgtctaatggaataatgaccggttccaacctctcactattagttactatttcaagcagttccaaaaagattgtgatttatatttttcccattcacaaaaaatgtaacgactttaaaaggtagtatggcccattaagataaagaaaaccgattgtacacaatcgtaagcacacatctaggctgtgcaaatttcagttgattgacaaatagcaaagtcaatatatttctaacaagtgaaatatagcaaaacttacattttatgtgtttgcatgcagtttaacttatttcagtgtgaacattcttgctgcatgggcttttggatggctggacctgtcaatcaacattgaaactaacgtacatttatagttgtacacaataacattgccatgtgccatcatcaaagcaatgacatagttacattctgtacgtcaccggctcaccgcccagctgattcgaagttcaattctaattttaacactacatttacgacatccagctatcggaccaatatattcatttggaaggtgagcacaaaaaaatggctagctagattggatgccatatgttttctagctattctgaaatgcgatcgataacaacaccaatcatcctttctcatctctagaccctgtaataagtttgtccatctcttacaaagttaggataccaaatgccaacatgtgtgtagatcgactgtatagaacacatgcatgcagcccaccataggaaagggagacaccgagatatctggatgtgatgcacggttcatgatgaaataggacataaagtgcctcatttgcttgcacggcaggtgtagctaggtttaatttgttcgggtcaactagccacattctacaacacctcagttgccagaagcaaaagatggcactttgtgcagcatggcagaagacatgctatgccaaatgccacccctagtatgtataggtagacaccagacaatgggaaggaattgaaggcatgcatggatgaaacataaataatgtttcagcatcatatatgctacaaattgccaaattgcaggagagatgttaagcatgaatactggtttgtgcagggtttgcaagctaggcagaaccatctacaacgacttagattgaatgatggtgaatgacagccaatttaagactaaatatggtgttcatccaacaggctgcggtatagcccggtagcaagagataagaaatttagaatttagttcaggattcaccaatttgcactagcttctcaaactttttctttgttctgcccatcacagatgacctattgtcttgtagcaacggtcgacgcgttgagctgattttgtggaaaatatgtctgcccattgatttcctggttgataataaggtatcaaggtgaaagcagatggatagtgaacatatacataaattgatgtacatgttatagtggtaatttttacaaataatggtctctaccgacagtagtataactcataaggtatggacatgagtatactttacttaagctacaattttatttcacttatagacatagttggtgaatcagttatgttcaagcttaagagccatgatagatcctgtagatgttagataactcctggtcaccctttttatattaagagaaattaataatagttcagaaattacacaagcctggccggagctagtctccacagtgttccgtcaacatgatgcgcttggccacgcatgctgcactctgaatgtccatatcaaaaggtaaagttcatcgccttatatatttatgtctactatacaaaggcactcttaaaagcccccacatcaatcagaaaaagaactgaacgatgggcaccgtacaaacctagttaattaatttttgaagctaaattattatttttggaaagtacctcatcactgatgagtcataaacaaacaacgtctcagatgacctcagctatgatggcattggtatattagaccgtcataggtgagtcacctgtgataggtgtcgaagtagattcatcagagatagggttacctcttattggatcgtatgctttgaacccgtcacaagagaatcacctttaacgggccgataacaaccacacatgggctggtggtgagcctcacctttgacgagcagcggaaacacagcccgtcgtcagaggtgagtagagttatcgttgaccactcatctctaaccagggttgaacccatcaaaggtaaggctttgtacccgataaagatgacttgatccagcgtagtgcctcgcgttacttttgccattgtatatctgtttggatatgcatgggctcattcaggacgacaggacccttcggtatggtggattgacaaaacatttttcgaggattcaactcctagaaaaaattttcctgtaccaatttaatatattcatatatgttcaatgctgttacgagtactgtttgatgacatctatattaagcatcatctcctttatggatactccatgaagaaaaaccataggacaacatttaatatgaggaaagatgtgaatgaagagcaggtagtcacagctgtggaagcttagggtatgtgaaatggaggcactaggaattcaagtctctgctcccatctccacgtacgttcttgatcacagtgacatcacatactgggtacctagagaaaccgttagttacatactcgattgatgagcaaagaacacaaaatattattgcgatacatatagtagccaagtagtttcttcaattgtctctgtctagagtttttgggatgtacagatacacagacctcatgattaacactagcaagaagatatcccaataatatcgcaatatcatcaaaaaaaaactgtaaaaaaatctcctatatctaaggtaccaccggttaatttcatgatttcataaatttaaccatgtgtgttctatttaaatttatctttgtcatatcaaaattgattttaatatgataattagaatgtgtggttttacgtttgataccaggcttcggctatatagattcttcacaaaaataattgctatggaatacataggttgagtggattgccaacacctaaaagaactgcaaacgcgttaccatcatagacaatttgcagccgtttttagtgcattcattcacttagacatttcagcctattttttctcgaggaaaacctccaaaaaggacagggagctcatgcaatttcaccgttagaagaagagagtttatctagtttatcaggaaaaccgagtcaaaaatttactacagcacggttatttaaggaaaaccaatgaaaaccctaatattatcaaagtgagctaaccacgcagacctagatccactaacaaagtccaccaatccaataagaaaaatctcctaagacaaagcgttcaagaaggacacggaaacaaaagggtgacattggccgatccaagcaaatatgagattttcacccagagagatccattgaggctgaggataacatttgctacatagcaacgccttcaagaaggtgtacgacacctaagggcgtcgccgttgttagcgatggtaaggtgtgcaaggcttttgcccaccgcgtccacgatgaaagccacgcaatgccacctgcacacccaaagacttgcacaccaaaagccaccacttgtccaacacagccactgacgcacatatgctatatttttctagctaccaggtaccaagctgtcgaagatgtccgtccatcgccccggtcacattccactgccgcaccacaccatggagctgcacacgagaaagagggtgggagatccacatagagaagtggcccgagaaaagagcagccatagctccagcacagcttgccaagatgacatgcgccgccacctagcctgttctgcacgaagcttcatgccaaaccacggagttagcctgtcagaaccaccgaacgaccaccatctgaccagtctaatctgacaaaaatcatggatctagatctagatctggagaaaaacaaaagtggagacggagaaggatgaaagagagctaggaaaaaaatgataaagggagaggagaggtaaggcggagggggaaaggatgtgggagggaggagggcagaggtaggcgctggacaaggggagcctacagactcgccgttggtcacctcccatgtcgccccgagagagcggcatgggagcattgctggagaaaggtttttaaccctggtttgtaaaccccttagtcccagttatgcaaccgggactaaataaccgggattaaaaatccatatttagtcaagatggagccaagccaggtccggttggtagttttttttcttttttttattgtttttaactttgaatattgatttcactacatcctcaaatcatccccaaaacgtgaaatccccaaatcgatcatcacagaacaaaaatgatcatctcaaaatccccaaatcggtaatctccaaatacatcataaattctaaaaaaaaacatcgcaaatacatcatattcacatcacacacatatcaaatacatcacaaattttaaaagaaattcatcacaaatcaaatacatcacagattatacgtatcagatacatgcaatgaatcacaaattcttaaaaaaagtaagaataaaaacaatccggtgatgccgctgccgcctcccgcctcccctccggcagagaggacagcgccgcttgcacgccgcctaccgctgcccacccatccgcccgccacccgccttcttgcttcctgcagccgccttcctgccgccatcccctccgtctgcctctgcccgccacagccttcacggcgcgccgccgcgcgccactgcccgccaccgccatccccttcgcctgccgtcgcgcgccgctgcccgccgctgcccgccactaagaagaaaggaaggagagaaaatcgagaggaggagaggggaagggcgccggtatggaggaagagaggtgaagggataagaagagaggagaacgacgcggttgccgaggagatagcacgcggggaggcgtgcggctgcagttttttttcaattttggtcccagttgggataaacaaccgagattaaatatcattaaagatagcagtggggcccgacacggcctgaccacgttttgaaccgggactatcttagtcccggttggtgtcataaagtgtcgtgccgcttttgaaccggggttaaagatctctttagtcccggttcctattcgaaccgggactaatgtgatttttgccaacccagcaaagatggtttatctagtagtagagtcaaccctcatttcaatttaattagttggccctactataaattgggttgttccaaggccaacgtagtagcaatgttgagagtgatgacaaataattaggctcttccatgctatatatagatcgccctagctcctagctactcgccatcagcaaagcatgggcacaagaaacagccgtagccttcaatattccaataggagatggaggcatctggaattcacatcagagccgagaaattccgcctcgtgaattttccttcgaagagcctatagttatctttagcaatttattttggatagaaaaaggatacaccatggttcaggttctgtcttgctgtaaaaatttcgagccctgtgcacagggtcagcaagatcaagccggtgacggccaacaatacagcagtctaagcgatcggcaatacaacgtcactggcatgtgatactttgagaattgctcttgctgcaaggaatgcagcggcaacgttagcaggtgatttttttcctagagagggatgtatgttaatattgggagtacagcaaaatctaattagaactgcatgtatcatattgctaactactccctccggtttttttatatgacgctggttagtttaaactttaactagccagcatcatacaaacaaaaatggaggtagtgttagaataattaggctaggcccgatttatcctattaaaatctcaaaggcccataataagtgttaaggataataataccacctcaggatttaagcgaggagtatctcaacctaaatagggagttattagaggctccctgttgaccggttgaggtgggagtcggaaagccacacgcgcgcgcgccgggccgagggcgtggcgtggcttggctggctggctggcgtcacgtcgctattcttttgcaaccacgatcccacgttgcttctttcccgggtgttagttcttcctcctccgcgcctgtcctgttctcgcctcctcgcttctgatcacttgcgcgcacaagagatcggaaggagcagggcctccggaaccacaccttcgcctgatatctgcaccgggtaggcgggtgatcaggtttttggggagatcggaaggagcatggcctccggaacctcaccttcgcctgagatctgcacctgttctcgcctcctcgcttctgatcgcttgcgcgcacgagagatcggaaggagcagggcctccggaaccacaccttcgcctgatatctgcaccgggtaggcgggtgatcaggtttttggggagatcgaaaggagcatggcctccggaaccacaccttcgcctgagatctgcaccgggtaggcgggtgatcaggtttttggggagtgcttcccgcacgactgctcgtccaccatgtctgcgcctggagccggagctgccgccgccgccgctgctgctggagctggagatggcgtgcctggagctggagccggagccgttgcgaacgtcaacaccaacagaggcaattctgcctcacaatccagcggagggccattctcggggtatatccttctcctgctgttaactcattcgtttatagcgctgttagtcctgttagtcgcaagtcaattgcagcttttggggagtgcttcccgtacgattgctcgtccaccatgtatgcgcctggagccggagctgccgccggtgccactgctgctggagctagagatggcgcgcctggagctggagccggagctgttgcgaacgtcaacaccaacggaggcaattctgcctcacaatccaacggagggccattctcggggtatatccttttcctgctgttaactcattcgttcatagcgctgttagtcctgttagtcacaagtcaattgcgttcttgctatgttcatgttcatgatgcttatgatacctttagcatgctactggttatgctacatgttgtcactagatcacccaacactgtttatgccatgattattgtcttaacattttagattaaaatataccgatatatgaccatatttccaacaatccaaaaacctaataggtcattttcggtagttggctttgctgctgcactgaaaccacatgcttttgatggttctaactataagagatggaaagcacgtgcactattgtggttgacagcgatgcaatgcttctatgtttcacggggcaaacaaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaaattcggagtttccgacgccggcagtgagctgtatgtcatggagcagttctatgactacaagattgtcgatgaccgttctgtagtagaacaagctcatgagattcagatgctggctaaggaacttgagaacaacaactgtgagttgccagacaagtttgtggcgggtggcattattgccaaattgccaccttcttggtcggacttggccacttctctaaagcacaagagacaagagttcagtgtttctgatctcattggctctttgggtgttgaggagaaggcgaggacaaaggacgtccggggcaaaaaggttgagggaggttctagtgccaatatggtacagaagaagaaccctcatgcatcccacaacaacaagaaagtcaagcctgatgtcaaacccaaggctgcaaccaactttaagaacaaaggcaagggaaaggcaaagggagactgctttgtgtgtggcaagtctgggcattgggccaaggactgtcctgagcgcaaagacaggaagtctgccaacatggtcattagcgagggcggaggaacatcggggtacggtaaaatattacctacagttctctctgtttttcactcacctgattggtgggtggatactggtgctaatattcatgtatgtgctgacatttctctattttcttcttatcaggtcgggagaggttcctccttgttgatgggaaacgggtcgcttgcggctgttcatggtgttggtacggtcgatctgaagtttacttcggaaaagaccgtgcagctgaagaacgtgcagcatgtcccttcaataaagaagaatcttgttagcggctctctattgtgtagagaaggttttagacttgtgtttgaatccaataaatgtgtcgtatctaaatatgggacttttgttggaaaaggttatgacagcggaggcttgttccgcttttctttgaatgacatgtgtaataatcataatgttgtgaaccatattagcgaaaatgatgagtctgatgtgtggcattcgcgactctgtcatgtgaatttcggttgtatgacgtgcttagctaacatgagtttaattccaaaattcactttggtcaaaggttctaagtgccatacttgtgttcaatcgaaacaacctcgcaagcctcacaaggcatctgaggcgaggaatttggcacctctagaacttgttcattccgatttgtgcgaaatgaacggcgtgttgactaaaggggggaaagaaatatttcatgacactgatagatgattgcactaggttttgctatgtgtatctattgaaaacaaaggatgaagcattgcatttctttaagacctataaagctgaggtagaaaaccaacttgaaaggaaaatcaaacggttgaggtctgatagaggtggggagtatttttccaatgaatttgcatccttttgcgaagagtttggaattattcatgagaggacgcctccctattcaccccaatcaaatggggtggccgaaagaaagaaccgtactctaactgagatggtgaatgccatgttagacactgcagggctttctaaggaatggtggggtgaggcagttttgactgcgtgtcatgtcctgaataaaattccaatgaagcataaggaagtaacaccattcgaggaatgggaaaggaagaaattaaatctctcatacctacgaacatggggctgtttggccaaggtaaatgtacctatagccaaaaagcggaaacttggaccaaatactgttgattgtgtgttccttggttatgctattcacagtgtgggttataaattcttaatagtaaactctagagtacccgacatgcatgttggtacaattattgagtccagagatgctacattctttgagaatgaatttcccatgaaacatacacctagcacctctagtcaagaaactatcatgccccatgagcactttgcaccgatagaacacaatgatcaaacgcctgaggaaaatcctgaggaggacaacattgtagatactcgtaagagtaagagacaaagggttgcaaaatggagatgact

SEQ ID NO: 58796 - DNA, 6082 bp, Oryza sativa
caatggcaaagccgctgacggtttggcaggacttttagaaagtaaaaaataacccaaacgataattatattcgattttcaaaatctcaataacaataaagagaaaagacagtggacgagccgtagaggagtataatagcaacgtttgacgggacttctaaaaattataaaaagaaacccaacaaggcaataaactctaaaaactataagatccattttttaaagtttccaagaagaataaatagaaatagtgttagatcaagcaagcaaataaaggagatgtaagggatagcaagtgtgacttttaaaaactatataattagaaacacgggaatgataatatttggtctttcaaagtcttaatacaatgagatagctacttaataaattttaagtaaaatcatactaaaaaatatatgattttgtttaagtgctagccgcataattgcgcgggccaccagcaattgtatatagagtagggagtttacatggcgctatctttcacgtttatgtttgtggagccattgaactgaaagtggtcgaggaagcgtaattgtgtcgtagtcatctctgctctttttcttcctcctaagagcaagtttaatagtatagcccactactagctctaattcatctatagtcaatctaatagctaatttatacaatagttgtttactatactattaatatatggtccaacatgtcatacacacattgcgtcttggagtccgcgctgcatctagctacagatctgtagcccactgctcttctctctcatcttttatctcattaaaatatgtttacagctagctaatatctgctctaaggtctttcacagtactcctacctgcagcgttatctcgtttgccagctagaccaaattctgacgtggatgaaaaaaggtagtgggaccatatctttacaaaggtttacatctcctagcaaggatctggtttcctcatgccaaaaaataatggacatgctatatttatggcgacacaaaattagcttgatcacagtcggttaatctgacccttcgatatcatgtagattcgtgttgcactttaatgcttgacttaacgaacgtttgatttgctaagtccgtagttatttgatctctctgtactacgaacatgttgctcctgttatatattagtttcccattaaatttgcactagcatctctcttatttatatttacttatatatgtaattttagtgtattaattagaacttacatggtctaaaattacatatgtaattttatgacctacatatgtaattttagaatttacattgtaaatacactaaaattacatatgtaattttatgacctacatatataattttagaatttacattgtaaatacactaaaattacatatgtaatttagacacttacatttaagtgcataccgactattttttttacacttactgtgagtggtcccctactccataaaacttccaaattcatctactctgtccgtctgtcgtcgccgaggttctgcgcgggcttggagctcgccgaccacgctgcctagtccgacgaggaaggggagtagccggagcacaggaagaaacggtgggggctggtcgggggcgcggcgacgccaaggaaggagtgggtggtgagggagagccaccaacggaagagaaaggcacgacgaccggtggcaaggagagccggggtcgccgccgtgccatctcctcgtcgccacgcttcttttccgtctccgcgctccgtctccttgttgccggctaagagaggaggggcccggcgccgctccagatccacgtcgccaccgccgtcctcctcgctccgtctcctcgtcgctgccgagagaggaggggcctgatgctgctccagatccgtgccgccgccgccgtcctcctcgctccgcctcctcgtcgccggccgagagaggaagggcccggcgccactccaggcccccgctgtcctcgctccgtctcctcatcgccggcgcgacgacggcaaccaccaccactgcgcgcaaggcgctgtcgagcaccccaccgttctactatgcgcatggcgtcatgtagactggagtccgccgtgtggaggtggtcgccggcccggcgccaagaaaggggaaagtgggagagagaatgggaaagtaacagagagaatgggttgggatggttggtttggggatcccgtgtagtaactgtgagaggtatggattcgttgtacatttatcttaaggtaattcaaataaaggacttgcactgctactgcctaaagcacagtgccttagagtttttttttagggaaacagtgccttagagttactcacacagtgcgacgaattctctcgacgttggcaagcagcgcgagcttggatatgttgacgtctgcagttcatcactcattcgttaatgcatgtttcccatatgaactttaattagcatgaatcatttcaacagaaaaatagagtagagtaatatgatcacatccgtttctttttttcggcttctggattttcgaaaggagcaatctcaatgaaactatggatgttgcattaaattcttcatcttgaaccttcatacgtgactatgtctagccgcaaattcatacagtaaacattaaagcaaatccgtctccaacttgactgccatcatgttgtagaggcgtgcattggttagcccctcttattcactactggcctaactccaattttactagcattctttaatcttgtcgatgaccatctgatctaactctccagctctatttatcaatgtcgatttcttactgatgaaattggtttatagcctctcgcttaatgttttctttacacatacgatgctttagattgactgcataatcttcttcattaaccttgacactagccaccaataaactctctcgatactagagttgttaagtacacatggctcaccttttttcagttacaattcatcactttacaagttgcataacataaaacaaaatttccatttgttggcaacagccaacatgacacttcaaactttcctttcaagctggagagcaaatctaacctaacctgaaatttgaatcgtagtagcccatccaatcagtttgcttctcaaatcaaagagaacaagaggaaaggcaaacagaagggaaagcagcccaggccaagaaaagggtagagaagcaaccccaggccggcaggcaaacacgcgccacacgttgccgctacaccttccacctcagcaccctcgatggcctcgtcgtctgctcgtggggtcctcgtcatcgctacccctgggctcgtggccagcggcaattggctcgcactgctgcgcaccaaaaaaaaagaaaaaaggaaagaaaaaacaagagatcaaatcgtggaactcaacgggagtctcctcgcgaggtcgagtggactccaccaccttctcctcctccactccaagcccacgaattcggatcagcgccgccgccgccgccgccgccgccgcgggaggagggctcgccgattccactacttcactccagtaggtggccaacgcgcggggtgggagcagcagcgacgacctccaatggcggcggcggccgtctcctccctcctcgccccttcgggatcctgctactcccccggatgccacagctgctggggtcccgggcccggaggcgggcggcgcctaccttccccgcgccggcgcccgattaccgccgcggctcgccctgtgagctcccccctctctcgtacacacactctctcacacacactcgcccactcactctcgaatcgcgtggatgttcgttgattgggaggtcgcgcagcctagatgagaaccggcacttgcgaaatagctactttagttggtgtattagagagagatatatatcctaattgttgatctaattgctttgtataattgtatttgcgccaaatgacttcaaactcgctctcgaatgcgcagtagaaaactagaaatcatggcctaaggctaagagcgcattaagctccaatgcacgtcagaaaactggaaatcatatggcctaaggttaagagcatattcggcaggtgcataatagtttttttttttcctaatctgaatgttgtacacttttttaacctgggcagacttgggcagtgccgaggaggagcaggttggagtgggggcgtgtggaggctcagaattcgggcgctcgcaccagctgccgagcagcactgcaatggctatcatccacggtgagccatcaggagtattattttgtttaccctgtacactcgtcctggaaattctaggtctgccacgtcgcaattcgatcgagtcaaaccagctgaatgcctgcagatttcagtttctgatgcaatgtattgtctcacctaggcaaggtcccatgtgaatgttggttatgggtcgccgctggtgttcccaggtttgaccaaaccggggtcaagcaggtgtctatgcgttgttggaatggtcggcaatgcagggaatcaagttggtgacgatagtgatgatggaatcaaggttaccaatgagaagcttcgtgctgttatccgcaagagcaaagaggtgttggagatccatcggaatctacttgagaaggtagctgttctataagttgttgctggaacaaatgtgtttctcaatcttaaaataagttgtctgtttaaagttatgatttagcaggttgtcacaagcccacaaaaatgatgaaactaaaaaggttgtagcattatttgtgtgacctttcatttatgtagacaatttttggttgcaggtacataaattgaaaatacaagattactatgaacttcccaaagtatgatatagttttagttgttggatcacctataaagctctcttatacaaacaagcggtagacattcatgttagtcagattcgttctatccacatacatgctgttagagcatttccttccactgttgaagtaataaacattgtagtctccattgttgaaagatataccttttagtcttggattttacattctataccatcacgagacagtttaagttctagcttctgaggaacaaggcggtgtaaaggtaatggaggctctgttaacatctaccagtgaggtcctttgcaccatgtttgatggaagcaattaggtattctactgaagggctgatgcactgagtttactgaaaatgtgtcctttttcatgttcttgctggaatgtgaaatgttactaaatgtagcatgctaatttcttaaatggttattatatagtggtgatgagaaaggcaccctgcgaacgaccttgaattacaacctttttttgggccattttgcagttacatttatgcatgttgctggctgttcacattaaaacattactatatgaaacagttctggtcctcctcttttattgtttactgaaaatggtggttttgagttatgatatgtggccaacttattcagatatcggcatcagaaaggaagaagatcacttcaattatagaggacagttccatttataatgagcaagatccatttggtcaaagagatagttctttttatcatcttgatgaagttccagacgatgatgaatttagctatgacctacagatgtaccttgatagacgtccagatcaatctgaagttgttgcaactcaggattatgaggcacaactaagtcaaataagtgaaatgggacagtcagttgctgagggcactagtgatgatccatctgcttcagctgctgtagatcttatcaatatcatattggtagcggcggagtgtgctccttggtccaaaacaggcaagatcataatagccacataccttctaattttttcagtttccatgaaaggacattgcgggtttaacctagtacctgtaagttggcggactggagggtgtgtgggctaacacccaaaattccaaatacaacattacatggttacatttcctgtgtgagctgatttaatttaaggacgtgttgtttgtgttcctatattaaccgttcttgttccgtcagcccgttatgtttctcgtgacaaatgttgatgtagtctgtcttcatgccttttttcatttcttgatagtttccatccagttactcacaattggcaactttat

SEQ ID NO: 58797 - DNA, 676 bp, Oryza sativa
aacaaacatgaggccagcaaggctctactagagttcaagcatcaaaccaagcacaacaaaacaaggtataaaactatataacagtagcacagaaaaaaaaaatctatggacaaggcctacccagtacccacctcaccctgccctgccatccccccttgtgatgtgtgaatgtctctatcttacttgtgatagccagtatcctcacctcacccacagcccaccaatcacagcactcctttgtattctctctcctacatgcactcccctctacaaaaccacaaccagcatttttttcttttttcacaatccccttgacagcacagaggcaacagcaaaacacactctcatcagtgtcaggtctccacaccacacccaagtacaggtacacacaagacaatcctcccactgaactgaatcccatccactcctttatcatcatcaccatttccctccttcccttttcctcccctcatttccatttccagttgcagcaagagctgcctcctagctctcttcctgccatccatggcaaatgcttccctccaatcctttcttcttcaccaccaccattctttccttagcaatggtatccatgagggctccttcccttctataattctcaagctcacaacaaacagcaacagcagcatttcattcaagctcttctccaacacca

SEQ ID NO: 58798 - DNA, 7383 bp, Oryza sativa
cccatttttgatgagcagtcctattacatacatacatgctcttttgatttgttgctatgcatatttagctactttagggcatgtttagttcccaaacaaaatttttcgcgttgtcacattaaatatttggacacatgcatggagtattaaatatagacaaaaaaaaaaccagttacacaatttgccagaaaattgcgagacgaatcttttaagcctaagtgtgccatgatttgacaatatggtgctacagtaaatatttgataataacggattaattaggcataataattaaattcgtctcacggtttcctggcggaatctgcattttgtttttttattagactatgtttaataatttaaatatgtatccgtatatctgatgtgatgtgcaggggaaaactttttgccaactaaacatgcccttagactgagttcggccaactttgtctgacacggaaaacaaagcaaatgattagaaccagattaattaagtattagcttaaaaaacttgaaaatggattaataaaagcaactttcctatagaaaacttttgcaaaaattcacaccgtttaataatttgaaaagtgtgtgcgtgaaaaatgatggaggcgagttgagaaaaaaagggaagaacacaaccttaacataagaataaagtttcttttttctttcaaaatgcttttcgtgtgctctgtcccattttaaacgctgttgtatacgaaaatgcatagggagtacacattattagcacccgtacattctatacacctggaagatgcgtcctcgcagaaagaaaaaaaaaagttacttgtggtaatacacacgtcgtccctgacgattatttaaggaagaatggttctgttcttttcagttaattcaacagattatattattgccatcatatcatgaagtatttgttccacacgcaaaagaaatacgttttgttgaaaaatatttttgtactacattgctcgatcccttaacaaagctatttgtttttaaactgagatcattattatatttcaaatgatccggcttttggtagaaagccaagataacgaaatactacatgttaagtttatttatcaaaatatttaatttatatctacaattgtgtcgataatttgtttcaaattggacaaagtttatgactcgttccattttggtgatcgatggcgtgtcatatatgcagggtacaagaaggagcacatcaaggtgcagctggtccgcagccggcggcggctggtcgtgagcggcgagtgccccgtcgccggcgagaccaaccggtggagccgcttccggctgcagttcccggtgcccgacggctgcgacctcaaggccatccaggcgaggctccacgacggcgtcatccgcgtcaccctgcccggcgtcaagccgcagcagcagccgccgcccgccaagacggccgccgccgccgcggtagtaggaggggatcagcggggcggcggcgaacgatgccaattcctccgggagcggggaaagctcgcgaccaccctgctcggcgtggtgctcgtcttgtttagcttcgtcatctacatcaggtacagcgtgaagccatgaaccggggggacacacggtatttatttctgagatgacgagcactgatcgatcgcgatgatgcgatgggtttcgctgtaagaattaatgaaatccatctgaatggaaaaatgaaaatggaaatgtaaacaaagccttggctttttctgttcatatatatgatcatccatgtcgcatgaaagagatgtccccatgcaaatccttgtgcagtactatcatctgactttaagtggctaacatgtgggccttatacccatcggattcacgtgtcacaaaaagtcctccaactcctagacactaactttaggtggtgtttggttggagagactaaagtggggctaaactttagtccctctcacaaaaatagggacttatatttttgtgagagggactaaatttagtccctagttcccaaacacccccttaagccttgagataattttatagttattaagaaagtatcttaaggtatctaaattttacactaaaattttttataggtatttagtatttaaacgtatcaaattttacattagaaaatatgatatctctgtatatcttattaagaatgataaaattacccttaatctcaggccatgttttgaaacggatgattagctttagagcggcgaaggcacacgtaccgtcgcacgttagaccaagggaattgcgcgcgaaccattcgcgatgacgaaagctcggatttcatcttccgtcgcgatggcgctcccgccttttctcctcccctctcccacgagcggagaggagcggggtatcattgtggccgacggcgccgccgcgtccgcggcggcggtggcgccgcgcgtcgtcatcagccgcttggagatcctgcggaggtagcctccgaccgcgccgcccttctccgcctccggcgagcgcgacatgccgctgccgtcgtgcgcgcggcgcggcggcgacgccgtgaggccgagccggagccggtcgcggagcgaggagggaggtgaggacgtgggggaggagtatgaggctgacgagacggcgggcgcgtccgttgcaatggcgttcctggcgggcgccggtcggcgcccgctcttcctcggatggtgctccgccgtcgtcggctcgtcgttggccaccactgcctcgccgtttgtcgccgccgctgtctgccgacgcgtgcgggcgccgaagcacggcggcgaggcggagcggctgcgctgctgccgagacgacgacgtcccgagctggagccggtctccgatcggcggcggctcggccgccctgccgccctcgccatcgtccgccgccgcgggcgtcgtcatcgtcgtcgtcgcgcacaccgcgcatgggaacagccacgccgcgacgagatggaacagctgcatcgcgcgctcgccgccggctacagcacacaaaaccaactcctcgtcgtcgccgccgccgtcgccggcgtgatctgtgagcggtgtcgctgccaccgtgtgtatgcattgcatggggtggccgcgtcttatatcgtgcataggagaagcacgtagcgcgattgcaccggggttctcggcggcgcacggtgatattgccggaagaaacggcggcggcgtggggtatgcgagaatggaaagctctcccgccgatttctttgtaagcttccttctgcttgactgcttccatgtttaactagaaccgattgaattgagattaattgaacatatgccaaatgaaaaacagaattgctaaccatctgttgacagaaaatctatctctaaatattgcaaattttggtccactagatgtgcttcctgattcgtgatccagctgctctccaactccggcaaactcctctacttccccggcggagggccaacgaattagggtcccggggtggggaggggtgggagggaagggggaagtgttagtgatatgccctagaggcaatcatagagatgattgtatcacatactatgtttacatatttatctgacattgttcctcgaaatagataactcattatttgttaatgaatatgtgattcttttatgagactctttatgttgtttgttactatttctaaaggatccctgatcaaatatcatatgtggaacaaatatgtttaaatgatcagcacatgtattaattgatgatcatgtctcatggatcatagtatagagataccaaattaataatgtggacacatgttggtgaacatgttgttggatagacccaacatgaaacactgcaagagccatatgtgttgtgtcatcagtgatctcatttagtgttggtgttgaatccttagacctgagattatcatggtttccaacatgtgcaatagtttacttagggactgctaaacactactccgtaattgggtagttataaaaatagttttcgggtatgctatgaaacatgtagtggtatatgaataatcaagataggatttgcccctcctatggagagatatctttgggcccctcgatgttatagattatggaagtgcatggccatgccaaaggtgattgaggagtcaatcacaagttatataatctattaacaggttcgagtgaatgattgagctattagaggatggcacatatctagccttgagcttaatcgatatcgtgaggcaaaggggttcatacaagtatacactagaggttcagccaatatgatcttgatgtatgcccggtgggtcaatacgttctgctaggggccgctgttgacgcgtggaccgaaaaggagttttcgggttacagccgagtgtacatgaacatacagggtcgcacgcttaatggaccagaataagggattggatagggatcgaatataagcttaattcggatagggatccgaataggagtcctacgggccttggaggcccgagtaatggatcctatatattcgtgaggggtgtgaccggcggaggcattgcatcacgtgagaaaccctagccgtcacttccctccccgagcaaaaccctagccgcgcgcgggtgctagcacatctgcgcgtggcgttccgtccctgtacgtgtggataccggtagaggcgccgctggtttgccgtgctgatcggtgtgggagtacggcgaggagaacgcacgagtaggagaaggtcgagccgatgcgatcgactacttcctctacatggacgcgcgctactacgcgagagctccttcgacttctccgcgttttcttccactgcgcagcgcgtcgagtggtaacgatctatgatctaatacttgcatggttcctggtttacgcgatggaaaattttgatttatgctatcgtagcctacccgtatcccaacaggaagaaggggaagttcgccgagcttagaggaatggtcgtgggaggcggcggccctgcggtgagcggcggaacgggcgggcggcgaagcgccggcggcggcgccggagccatagggacggaggagggcggtgggccggcgttggtggaggggcatagcgagcttgtggtggccgatggtggcggatctagcaacgaggaagacggcgggccaggagcatctcgccttcgatggctcgaggagagaggtgaggggggaggaggctagtcggggtgtggaggtgggggctcaccggcgccgttgacgccttctgacaagccggcgaggccaggcagtggcggaggcggaggcgggcagaatgctctcgcactgaggagcggcggcgtgagggggaattgggagaggaaaggttttttagggtttggttgcctgcacgaatcttaaagcaattgggtggtccaaaatttgcaagatttctaagggggttttctgtcaagtgatctatagacggtcccaaaaaaaaggcgctaattgatcggcatgcttccatattgtatatatagaactggttcaacaaaaatggtagtggatccaaggcgtgtgctttgaaccggagtcttcatcaaagctccaaaaatgttgaatccgatgacccaatacggccttgttctgctaatcccaagagaaaggattggaggctaatctgaagagaaaggattggaggagattgagggctttgttcggttaagcccaaaaggaaggattggaggagaaaaagattgaagaggattaagagaaagggattggagggggttaattggggttaatttcatatcataatatgtgcggaataagtcccttcaaatccccatcaattctcttatgggagggactaaccgaacaatggcctataacatctgtcaggacgggcacaacttagagatatgaactgagccagcccattctaattttcttgtgagatcaccctatcatggtggaaatttgtcaactcccatgggcttttgacttcaggccctggggtatggcctacggtgtctatggtctagatccgctccatattccgtcttcattgagccaaatgatcagatccaatgcgaaggagatctaatgcgatgatgaacctattggaatgtttccaccaaataattaaggtccttctagaactagtaaattaaaggggaaaaaacaggacttcgatatgaatgcatatgcaaaaccgatgattatgaaataaaatacaaactcatgaatggcaatttgaataaacagtaagagcttgttcactttgctaccattttcaaccttatcaagttttggcattgccaaattttggtaaggttgccaaaattttgataatgttgctaaattttagcaagatttcatatgtacttactaaaatttgggaacaactaaatgtagccaatttttttggtaactttacttaaaaaaaagtaaggttgaaaatggtagcaaagtgaacaagccataagaaaagcatagtaattggataaggcagatagacatttccaagaggttaaacctcgtgctaactttccttcggaaatctccatgcattgaggcagaaatttccaataggattcaatggtgtccaatcttttgtttcaaggaccgttttgggcaaaacaatcatatagaattcaaatccgggaggggagctaaaactggtagtacccttttcagtttcccattgccctgcttagtttctttcaacatttcagtctgtagatgccctgaaaaggaggacatgcatcagcttcagcttcatgatcaagcaaaaaagatttgcaataataaataactgtaaaagaaaaggttgtaaaatggagttgcacaaaagcaaggaaatccatctactagctaggagttggccccattgatgaatacatgctggtcggcaaggtgaggtatcctcccctttccttcatcaccattaccagacttggcatgccttccatctcacgtcccaatattttactgctccatggattagccatttagcctatataacccagctgctgtgcacggcaaatttctcatccaagcagcaaccgagcaaggaagcaaagcacacagttcagcacaagtaaaatagcacaagcaaaatggatcaggcagcagcagcagcagcatctggctctcgctcccgtgtcctgtctgaaatcgacccccacagcgaatggattcacggtgacgagttcgacacgctcgtcctcgacgttacaggtatctcctcaattctgcgtctcaaattcaggttttgttcttagctaggtgttctacggaacattccccctgtagggagattcagttttcaaggcgatatgctagaaaccgaccgaaaccgaaaattcagactttctggactaagtcgaaaatacaaaatgttggatttttggtaagttagagaaaattaaactggattttaattgtttgataagatttatctggattacatcggtttttgttggtttatc

SEQ ID NO: 58799 - DNA, 77143 bp, Oryza sativa
aagtaacttagtgaaatcttaaattacaatttagatatattacaaaagtaatttgtgatcttcatcaaaatataatcatgtgagatcttgttgtaaagatttaattgttacgaacacaacggtgtaatcggattgtaaatcagatgagtaatttaagagaaaattttatttgaagcatagatgatagaaatatttgttctatttgcttgatcaattattactatagtaaagtatgattcttcaagacatatctggacaacggctgattggatgataaggtcgctcattatgactaaatcgagagcgctctcgatttagattttacggatttttaaggtagagagttcatcgggatgttaagggagtattcttcttcggagattacaccattccatccctcaaacccttgaaaattggttcattttatcctgatccatcacatctctttagccaaacacatattaaaaaacaaatatgatacgcaagcattgtttccattttctttagttgtgcttctccattatcaattgccaaaatgagattctaaacccaacattatttatagatgtgcagtggctaagcttggctgcaggatcagatcgaaggggccaatagcccaataccaaatgctagcacgaagggaacacagtggttggaggaatgtcaaacataacttatcattgtaaaccagctagcattcttctatagtaccgtactattcattctgcgtaatctaatcatcgagataagggagggttaggctggcaccattttggtgagttacaatacattaaacctctgatcagagcttgacaacgttttccatccatcaaagatatcaaatttttcgtgcactcggatcagagaacgatcgaccgacaatataatcggccggtgaatcgatccggcccaagcagacagcaccactgtctgaactaactaaatgtctgcaatattgtagtacgtagtacttgcagagccggtgttgaccaactgatcaaactgttcgtgatatatcgtcgtgtacgtgcagatcgatcggtggtacagatgtgggcaattataattgagatcgaccacgctgatttccaacgattggtcgtgcgtctctactacgtacgtacgcgcaggtggttgacacatggatattaattaactatatgcacagattgctactaactgatataggagtacatagtaccagtatctcttaaatttctctccctctgtactctatatttcctgcttgttgtattggaactactgattcgtgcgcatgtgcggtgaacatataactcgcacacgccacaagtacataaacaatttttccaagatgactaaaacagattttcgcgtgcggacctgtgcctaggggtctatgaaaataaaaataataataaaaaagaataacaaaaatttcaaaaatccctcgaaaccataggtccgccgccacccggtcgccaccgtcaatcaaaaccctagcccactgcctccacctaggccatcgtcgttgaggtcatcatcatcgctttcgaggacttcgtcgttgcgggggagggcggccgccaccagaaccgtgcaggggagggccgttgccgccggatccgcatggggggaaggtggatgccgccggatacgtgcggtggatggccacctctgccctccctcgccgcccaagccctccaccaccgttgggagggaggagaggggagatgagtgggggagaagaagaggaaggccgggacacccgccatcgcccgtcaccgctggagcccgctgtcgggagggaagacggggatagccgtcgccgccatcacgtgcctcctccatcctccctcactgccgagccatccatcaccttcaggagggaggagaggggagatgaggagtgggagagaagaggaggaaggccaggacgcccgtcgtcaccgtcatcctcgcatcgccgtcacccttgcttgacgtcgcagccgctatcggagcctaccgtcgggagggaggagaggggaaagcaggtgtgcataggaggagtggggagaggaggtggggagatgtggagtagggagaggaggagcgggtggtgggagagagagagagagagacgggagaggagtaggtggtgggagagagggaggtggggagaattaaaaaataatggtaagaggagggagtatttttgcatgcgggtgacttatgaggcccgcatatgaaaatacccttattttcacaatgcagtccttctcaagaggtccgtttgcgtaaattgatttttgcatacggtcctcttaagcagtcgtatgaaaaatgcgggtagatttttgtagatacggacacttatggctcatctaaaatctattggggtgctcatctggaaaaatcatttgtgtagtagtgcgcggcgcacacaattgtccccattgggcttcatgccatgagaattcgattcatacatcaaagataagtcgtccgaatttttatgtaagaatcacaaactttcaatttaacaatatgaaaatttcatcttaaatcacaaaaactttcaaatcaagtctgaaaactttcatcctaagttaagcaaacctttctcctcaagtctaaaactcttatatcaagtctaacactttcataacaaaaatagaaaataatttcaattaaatatctaaatctttcatcctaaaatcacacaaactttcaatgcaaagtcttaaacattcttctaaaatccacaaaactttcggtttagacatagagtatttcatctaaatactcaaatccatcttcgtcttcaacctcagtttccacaacatcctggttgccaccgccagcatggctacttcgccgtcttcccaacctcaaccaccgttgtcgttgctgccatattgccaccttcccaacctcagctgccaccacagttgcgacatccccaaggactagggttgagaagctagggtgtcccactacatggtggaatgagcttagggttggcaatggggcgggacggggctaggtttggacaagaacgaccctacccccgcttcgttccaggcctagttattaaaaccggactggaccgatggtcggaccggaaaaaaccggaaccagagccacgaccggtccggtccaggtaaaagaccgacatgcaatcgaaccagcaatgaaccggttagaccacccggttttggagaaaaactgccattaaactggggaataaaaccgcttccaaccgggcttggcggctgctgtacgcgcgcatgggtgctgttggggggaaaacgagcgaaaatgtgcatgggcctagttattaagaccggaccggaccggaaataaccggaaccagagcctcgaccggtccggtccaggtaaaagaccaacatgcaatcgaagcggcgatgaaccggttagaccgcccggttttggagaaaaaccgccattaaaccagggaataaaaccgcttcaaaccgggcttggcggctgctgttggggggaaaatgagcgaaaatgtgcatgggtgggattcgaacccaggaccacatgggaggaagtaaacaccccaaccaccaaactatcatgttacttgtgtatagatagaatgcttaatatatttaagagttattgaaccggattaagccaacggttcaaccatttgaacctgtgaaccattgaaccaagagcctcaccggttcaattaccggtccagtcttaataactatggttccaggtaaaccctgttgtagccccggattgaagaatggagcgaaatttgtccccggcccggcccctctggggccctcactcatcctgggtcccacacactcagtgctagcggtagttgccggtggcagccagagggagaggagaatgcatggggcacctacaatcggaggaagagggagtagaacgacgcaaggagtagtggccggccggcgagatgggggagacgacatggagcagcatggagccgcgcacctgagcgcctgtgactgagagcggtgatgtgaatgcagcgtggagcctcgatgggcactagcagggtgtggtgaagctgatgagcgacgcggcgtgtgtccctcgttgcagcctcgcatgatttttttttcatatgagcgtcacactaatgcactatggtgagccgctgctgttgggaacgatacgttcgttgtggatttgttgagatgggttagggtttactttgtgttttaattttatcttctctaatgggttgcacaagatatacttgctaggctttttatggctactacgtatgggttgtttccgatgggctttagactgctagtggacaacattatttctagggttaatttgatccatgccattgcaaagttgtcatattgcaaaaataccattactattcgtgaaatcttctacatgccactgaaattttgtaaaattcgaaccgttcgattgtcgtcaacatttttgtcaacatctccgtcttagcgcaaaaaaaaatatccaaattgtcctttcttttcacatcctcattctctctcctttgttcttctccaactccggcgtgaatagcacgaagtggccggcagctacggcaggttctgaatgctatgaggggagtagtttaattcgggagcgttttctttcttaattcgcagctaatcttgcaagtggtcgcctggccttgtagagtgcagttgataagatggacgaaagaaataaaggcatggcctatgagctcagtttgccggctgagctagtcaaagcgattctttgttgttttcttttgcaccactaccactaccaacctgctactaatagagaacatcatcgcacgttagatctgactaaatagaggccaaggacatctcgccgttcgtcatcgctccggccactcccaccgccacaccagcacctaccctagctcccgcactacttctaaaggccctgccaatatgataggcatgggtgctgatgggcaggagtggtctggctcctctgtgaggacgaccctaagcctctgtcgaggcctagctcctcccaacttttctgccgatgccattggtggccatcacgactccacgaactggtagcaacgggaaggatagcaccgccgtctccttgcttctctacctatgccatcggtggacaccactagcaggtggggaaagaagagacttggacggggtgctcatagaaatcttgatggcaatggaacatttcaaattttataaaattttagtggcacatagaagatttcatgaatcataatggtattttttcaatagggcaaattcgaagtggcatggatcaaattaacccttgtttctatacttccgggcccctatgtatgaccagcgggtgaagaagctgactcggccctagccacgcacgaagtcggggccccgcccctactcacccgtgggtgaaaattctcccccactcttggtcccataggggcaggtcctcgccggatccccggccccaacagggcaaatgccacccctagatgagctaagggcggatgaaatagaaaggatgagggaaaatgccacccctagatgagctaagggcggataaaatagaaaggatgagggagaatgagagggatggagaccatggctgggcaccgactccaggcactagcagcgcaacaggaacgatgaccgcaacaaggtgtgaaggcgacgaggagtcgaatgagaggaagttgggaaagagcgagaactcgagaagacaacaatggttcggtcatcggtctccagggttgggccggtgtggccagaagtgtgtgcccatggtgcatatgcgtgaataagcattctagtgttgtgtttaccctcaaatttgtaccccgataaactctagtgtgcaccttctctttcttataatgatagctagcaaggacttgctaatggctttaccacactagggttatagggatggaacgggagggtggtagggttggtagagacgatgggtttagagaggtattgctaaggcctaagtagcagcaaggaaaggaaatgatggtaccatatccaagtcatatgctaaagaaagacaataggacaataccaagtgacgagagtaacttatgacaggcagcaatggcatatctagtgccaaaaccattggagatggaaaaggagataaaggaaaattaatacgataaaatcggcaatgatacgtagaaagaggaggaggagggggagggaagcgatagtcaggaggacaggagagggtaatgatgacaaaccgatgagaagcattggcaacaagaatggcttgaaaattccctatttactgtgtaacttttcccctcgcacttgtgtcacccccatgtgggccctagccgcctctagtgcccccaactcatccacctctggcctcgccaccaccagagcaagccgttagtaagttgcgtcgtgagctatgaaggaagtaggggggaaaaccctagaggcgtgggctagaatgtggtgcaatgcttggggggtatagatgaagctagtgcgacgtggcagatagggtggcacagatagaggttgtgcactggtggaggttgtggcaatgaggatctagccaatgcaactggtttgggacaccgggagagcgaacttggtgatggtcagatccactgtgtggcagtgcatggccaaggtgccatgatatgacgagagggtggcgatgatgcgggctagaggtatcgtaactgatgatggcacacagggaggtggcgatgactacgtgtagttggaccctcccagcatggtggtgcgactcaccccttcttgtcttggtgagattggctggcaagccattgtagcacgggagccaagaggcgcaagccttgacctaggaggtgggcgggcgggcgatggcatgggacaacacaataagaggcaacaacatcatggggtgatgatgaagcgattagtttgcctaaggcggcaacaacgtgggaagtgagtttggcgtagggtggcttgcaaatgtcaagccctacctaatggtcagttggcagcgtggcgttggcacgatggttccacgctaaaggtgctttgacatgagagggtagaaggtttatggcaaaagtctagcctattcgaggctaacaatggcgacacttatggacgttgtaactttggtgagggcatcacacctctggatacatatgaggggggggatcaggaagcacttggagatgctagaagatggaggccaaattcatatcaagttagagtcaacccgaaatccaggaccagcccacactaaatcattgcccagagctcatccgaactctttttttgacattttacatatgtattgaaagctaacgggactaccttcctaaagggtctggtctcacggcaaaaacatcttctaagtcaatgggaaatgttgaacaagagagcctccaaaatctatccgggtgttgcgccattgtctttaaacccattgggccatgtattgtgttggagtccatttgggacgcatccaggggtcatcggtcgatcctagaacatatttattcagtagccatcgtcgaactagggttgggttttgcttcgattattctgccatttgtgacattcatcttatatccgcaatatattcagatcgtatcttctactctcttgcttgtgttcccgatttgcttataggagataaccttatcggcgaggttaaccgtgtttcaactcaggtgatagccaatggaggagtggtgcagtaattgtgaggggttcgatctatatggtcggagccttgggatcatcaatgttgaggctccacaatcgacttatccaataccaataggaagatcgcgacctacttcttcatcaaaccctactaggacattgttgtgtaatctctctttctatttctggtggatctcttcaagtgaaaaccacgtcttagtttcaagacgaacgatggtggctttcttggtgttgtaacattcctgaatgcgtcatttcaaaagatccattccctttcaaacctctcaatgctggtgtctcttttggtgtcggtgagccactacaagatgaccatgttgatgggctggttagggggggagtggtttcatcttctcatgcaccctcttcctctccagcctaaagacgtggacggagttgggtgtttcaggtatcgggtttgtttttgctccttagcaacgtgtagtatctaatagtagaacattgtttccaactagagacaacctaaacgcaggctggtcgttggttgctggagaaatcggtgtgcatgcgcgctggaataaaggcggttggccaattggcaattagccagacctatacgtgcacaaatgttaatcaattctagtaccactaccagctagtatatgacataccaccatgcactatatattttcagagattcagataacaggcgcacgcggggtgtatgtatgtatttataattggcccctcttgccattgcaaaatgtatgcatatatatataattacgataatcaattaatatccatatcatgaccgtaaacaatgaaacttgggtcttgataagctgatgatctttaattaacattatcgacacaattagatgattgttagcacatcctaacttctgtaggtattgtgatcgacgacctaacaactcttcttcacgccctgcacgtcttagacacagcagtgttaaggagaagttgagttaattaatttattagtcagtgttttagcataatttaaatgtttctagcataactaattgtctaatttgcgcgcgcacttgcatataagtgtgcgcctaccggcgctaaaaagccagagatcactccagccactaccttcttctgctagcttcttctcaattccttcaattcttactttagctatagctagctagctgggacaatggccgggaggaggctaccggcgttctgccgcggcggccggacggtggcggtggccgcggcgacgacgacgacgagggtgaggaagcgcgtgcagcgggtggcggccgcctaccacgctgcctccaagctgccgccgccaccggcggtggcgacgaaggcgagcttgggcggcggttgcgctgacgcgccatgcgcgggagggtggtgccactcgtacggcgacggcgccgccgccgccgccgtcgctggcgccggcggcggtggcggtggcggcaagaaggacggtggcgggaggcgggtgatggtggtggcggacgggcgcgcggaggcggccggcgcgctgcagtgggcgctgtcgcaggccgtcaggcgcaacgacgcagtcctcctgctcgccgtcgtcaggccggcggcgaacgcgtcgtcagacggcggcggcggcggcggcgagtcgtcctgcgtgaacatatcgaggacgaggtgctaccagcagctggacgccatgaggagcatgtgtgaatcagccagaccagaggtaattaattaacaaacacatcaacttcttagttaacttgtgtaatttaaatctccttgggttcattcgtgctatgcttaaatgatttgactgttcaattagaccccctttttaaaatgccagaatacattttctacagtaagttgtcctctaaaaatatgttacagcaaagtttgagaggttgagtatactcctatttgacaagaaacagtgatcccaacatgtaattagaagtcaaagatgcaattaaatcgtctctccagttcagccacgtgttgattggacggcttacgttgcggccataagtagttcagtcgattatctactaaccattagcattacaataaaagttttttaaaaaaaataaaaagaaaacaaagctttatagccttataggcagtgatccacttagcacatttcgcggaatggaggcgtcaaaagctattctagctaagcatgcagcctccggatccggatatttgcttcatcgtcctccatccctttcaaagcaaagaatattctaaacttaatttttttcagagtttcaattcaataaaataatattcagaatttcaaaaggacttatatatttttcataatttttgtacacttcaaattttactagaaatataagaaattctactagtatttgctaattaagtggcgttgtgcatgtgtgtaggtgaaggtgaaggtgtgcgtgatggaggcggccggccgggagcgcgcgccggcggtggtggaggcggcgaggcgccacggcgcgtcgctgctcgtgctgggccagcggcggcggcggcgggcggcggtcgcgcggtggctgcagctggcgctctggccggcggtggcggcggcggcggcgaagagcaagtactggcggcggaggggcgcgcggaggtcgacgacgacggtggagtactgcatcgagcacgcgccgtgcgtggcgctgggcgtgcggcggcggagctccggcggctacctcgtctccagcaagcgccacaaggacttctggctcctcgcttaattaattaatttaatttaattaattactagtgctttgtactagctaattgctgcgtagactggtcaatttgattcacatgatgctggataaggaagatgttatttacgggtggtttcatatcctctatagtaatgggaccctgatatgcgaggtactagaaggtggaactcacatatcagtaactgtaatggcagtaatattatggtagaggatcctcgccttcacggtggggttaaagcgcactaaaagtcggggagtatgctgtaatgtataagtgattggcataccaaatatcagacggttaaactacaaaccaaaaatatgacacgataaaaccctgctcgttgttgcgagagttaactatgataacaacaagaaaaaaaaatgtgtaagatagtttaaacaatataaacttacataaacataagtttacataagttgatgtgatttaaattcaaatagtatgtatacataagttgatgtgatttaaattcaaatagtatgtagagtgatgatttaaatgtaaaagaaaaataatgtgtctttgtgatagaacacaagaaggaagataatttagaccatatgagggaagaaaaaaaaagataatttgaaccatggattaatcatctaaggactaaaaatattgatgtgatatgacttaacaagagaaaaaaaaatagcatgaactaagtgagaatgaactactcactccgtttcacaatgtaagtcattatagcatttcttacattcatattgacgttaatgaatatatatatatatatatgtgtagattcattaacgtcaatatgaatgtggaaaatgttagaatgatttacgttgtgaaacggaggaagtatataggtatataggatataaaaaaataatggagatatattgatatattatgtgaatttaacatgtttatatttaaatctctaaaatttaataaattattaaattatagataatatatcatgcttgcatgatacttaaatgtaataattactagaaaaaatatccgtgcgttcaactggtgaaggatattttaatcttattattattgttatactgtttaattaaagtgaaatttaatgtgggatgaattcgtttggatatatatatatatatatatatatatatattagaaaatcatgagttgcagttatgatcgtctcaaggtagcatgcgagttttttttaaagtgatttcttatacaactctttttgtattttcaaaagtgaacaaacttcaaaaccgattcaaatatggatatgtatttccaaaaccgaacggacttaaaatcgactcatacacagatgattaccaaagtatcggtaaaaacatctttaatttttataatagtaaagattagtggatgatgatgtgtcatctttataaatgtgactttatagtaagagatgattagtcatgtacctgttacgtagagtagcgtagttgaacgttctaaacatgaagttttacatatttgcatgggaaaaaatgataatcattattttcaaaatttacctggcaaagtttttggataataatcaaaagatattttttaatttttagaacttgattttaggattgatgggaaaggctcgaggctttgcaacctacctggtcttaggcttaatttcagcggtgtaggcatctcctggacttcgcacattgccggatttgctactaacttctatcaacatatgtaaaatttgatcaatcgctgtaagacgctaatagttgtatggaccttagatatgagtgatattgtgatctaagttaaaccatatagaatttgacacatgagagggttcaagcatatctcaccataacaagcggccggacagtgacacagaccaggcaaatgaatagaatagttcaaaatgataaatattatggggattaattgatacgattctattacaaccataccatacgatgccttaaaaactttcaactctattttatttttttaaatcaactcaattttgaattcttctaactcggattttgaagctttcagctcaaattttgaaactttcaactcaaaatttaaaacttttaacttagatttgaaaactttcaactcaaaatctaaaactttcaacttaagctatgaatactttcaactaataattttaaatttttaacttgattttcttatatattactccctccgtttcaggttataagacgttttaactttggttaaagtcaaactgtttcaaatttgaccaagtttatagacaaatatagtaatatttataatactaaattagtttcatcaaatcaatagttgcatatattttcataataaatttgtcttgggttgaaaatgttactatttttctctacaaacttagtcaaagttaaagtagtttgactttgaccaaagtcaaaacatcttataaccaaaaacggagggaatactttattacgaaaaatgattcaaaaccataattaatgttaaacgctattaacgctaagcgcgtaactaggcccgcgtgggcacgtgatgtgcgcaccaggtcgcctcctgctgcagacgcgctgtgtcagagggtgaattcctcaagtgggggatagtaaggcccccttgttagttcggctgggggcagcgggtgagaatcgaggactcggtggaaggtgtgatgtagagggggtcgggcccctcaagaacgatgagacaagagcggtctatacaggttcggaccgctgagaagcgtaacactctactcccaggggcgaagccaggatttatagctagggggtgtgggcagggtgaacaagtcataagtcaaggtaagtaataccgacgataaaacaatacacaatgtattctgccataaaaaagcttgaatttagctttttagttgtatcattagatgtttgacagtttgagacttgagacaccatgctcaataacgagacgcaatgggaggacagagagacgtgtgaagccgaagcaatgatgacgaggagttgatttgcatcgtctctccgtctctttcttattaattgattttctataccatgtttattaataatggactaattaacatgctaatgcgctagttagtacaataagcatggggtcggataggggggtgttggcccccttcggcaccccttgtagctgtgcccctgcctactcacgtgcttggttgatcgagtatggaatacaacccttgaatctctgagacactagtgtgagttagccaaagaatctttctctttctctccctccctcacgaggcctggacctccttttatatctcaaggggctgccacatgggcccaaaagtctacctagggatgagggaggacattctctacattaaatgcatgtcttgtcgcttaacttggaagccataagcacgggcgccatggcatggggcccatcaaatcgcaccggctgacacgggggacgcctgcgtcatttaccatttaatagatgaagacttctgggtcctcatgcgcgccgggaaacggaaaccccgcgttgaccaggtcagacgaactgactccggctaggatgagagactaaaaaacctttgatcatcatgacattacggggcatgttaggtggcacgccgcctgacatgtgaccagtgcgcaggcgcactatctcggtactattggtcactcgactggtcatagaccagtcaggcgcatagcacgtcgcattaagtgcggcatggcgcgcccgctcaggtcgccttaaatgcggttaggtaggcgttgggaccgcccacctaactccgtacacgtggtgtcctgcagagggggtcggggcccgacccctaggcatggagggggcggccactgctctaccccgggcccgacccccctcgagggagttgttgatgcgaaaaacacacactggcctggaagatctgcttaacttcagtgcaggtccaaaatcttacttttaggttcgtgagcatgccggttgatttgatcctgcaatcaacaagaaacaaagacaagaaaaaccatggttaaatctataaacgatagctgatcggccagccgccgatgacatatcatttattttcaagccgatgtcatatgtgaatcgatcagtagttgtaaacaagcaagatatgactaaatctgctcgatcggctgtagatattaacgatatacaatccttctatcgatgtatatttaaaccaagtgattgggatagatcagtcatcatgccgagacagtataaatcacttagatcaaaatatacattaacatgaggactataaatgtttatagcatagccgatcagatagatctagcatgtatcggctaatactccgataccactttatattaagatattaaaacatatataatatatcaaacaggagcctaatatactttattgcgaataagatcttaatataaagggcagatctagcatatcaattaagcatataagatatagaatagctaaatcaggtaagatcggctgaaaccccgatactatctctctcgacaatcataaaacaagccagatatcataataataaatattacttaatagatcgaactcaaccgatgcagcattaagcataaaaataagtacaagatctaggcaagatgatgaaaacctataagagatggtggatacaccatataaattggattagtaacgtaacataaccctatcgatcacttcccaacaataaggaacagccgataacaagttataaagcgcaaccaatctagattacagcgtgtatatgataactcgatggattacatgaacatgattaaagtgtcataaagatggaagcattaaccccgagaatgcaagccgccataacaaactttacctctagttgaagatcgaatcgatgcagctcaacccgaaagcaagaactcgtcgaaataaaacgaaagtaaaaagggtggtgatgcgccgagattgtattgaactgttgttttgattacatggtttcgggctctatttatacccgagatacaacatatatccttgccggacacgacacttatctctaacaaactttaagataccataagtctttgcggcatatttttgcccaaacatatctctatggaatttacatgaaatatcctaattaatagatataattgcctatctgagagctttatctccatcgtggcaatccctgtgaagcactttgatcgattccagaaacagccttgaaaccatcttcatcggaatcggctgtatcacctctatcggctgtgttggctgtcctctatccaatccatctcagccgatgcaaactccagtcgatgccttcgcagccgatgcatactctattcttcgaatcgatctctttgtcgaatccgccttaatcccaatgtcgaacctgattcacaatttaccaaatttggtagtcaacaggagtgccacgtgagtaccgggtttagcctcttccctctagccttgatatcctcaggcccatatcaccgacacgctgattaggagcccctagaaagtctcacaaaaccgcactattgattattttaagtttgatctatcacaattttaaattctaccatcacatcttaaatttataatcttttatccatcatataaatattacatgcatgaaattaaagctttttaaaagtttgatatacgactatgtaaaattggttaacgttgtggttttctgaaactttcggaccataatacctgaggttatttttcacgtgtcaaaattactatggtttttgtgcaacttgaatggggttttatgaaattttacttttaaaaattaaaaataagatccatggatcaattagaaaccaggaaatgatcaaatgataagtggcaatcccagctgcagcagtcaatgggctaaacgcttttgggcctccaaatccaaacgggcctaataggcccattagccgacagcccatcaacaacagcaaaattagggaggcagcggctggagcaaacctccactaaaaccctagcctccccgctgctcctctcctccccccgtcccccggcaatggcgaagacgaagcccatggcggctgccgccgccgccgccgcggcggacaagaagaaggggaagggcaagaagaagaagcaggggaagaacggcccggctgcggtcgcgatgaaggcccgcggcgccgcggcggcggcggcggcggcggcggcgtcggggagcaacaaccccttcgaggccatctggtcccgccgcaagttcgacgtgctgggcaagaagcgcaagggggaggagcgccgcatcggccgcgcccgctctgaggccatccacaaggtaaacagtcaatcaatcgatcaatcaatcagctagtggaaggggcgggatttgggatgggtgaatcgatcggctgatgattttggtttttggcgatgtgcagagggagaacactctgctcaaggagttcgagcagagcgccaagtcgtccgtgttccaggaccggcggatcggggagagggacgagacgctgcccgagttcgacaaagttatcctccgccagcagcgtgagcacatggtacgcgtctgcgctgtggattcatggttggagattttctttttgagagagaatgcatgttttgcgtagaacagtcaacacctgtagcatttctctggtcaggacagatgaataaacttgatggattgtagttactagtaaaaatgaagtaaccttagagctttttcaatgaggaaaaattaatttgttctccgcttacaattgttcctagtgatattcgccttgtaatgtaaccacattgttcttatctctggttagtaactttaggatgatatcgttataagtgttttcttgtattactatagtttgttgagttcccttttgtaattctatctaggcaaagctgaaacgagaaagcaaatacaatctatctgatgatgaggaagatgaggttgatgttcacctgcctcactctctctcgggaaaagatgattttgatgaagaagtgcctcttgatgattatagtgatgaagaaggtttgttccatactctgtcttagtgtcttagcttggcatataatcatcttattttcttcttggattcctgtgaatcttccttttctgacattcatatggaaattttggtttcttgaagctagcgttctgttttctgcctcaaatgatgaatgtattaaatatttgttgtgttgttcctgaaaagaaacagtgtgcttgtttggtttggagccaattttgccctaccaaattttgtagtatagaatttgagcttgtgtgggcaaaaaatggtagcaaaccgaacattcatttcatactattgaagttgtcaaaatttcagtagggcaaaaataggcttcaacccaaactagcccagtaactattgatggcctgcaaaatcctgtctgttgatcatttgtgcaattgaggacgtaaccctttttaggctcagttttagttgatactggcaggtagcgatttttcccccttacgtgtagaatgtaggtatgtgtatttttaatggttcattatctataaaaagtgagtcctttttcttgcatatactacatattataataaataaatggcttacctgtaataggctcataaacatgcactaattttagttttcttttcatcattttatttgttaacttcaccattggagaaattaagatgacattattacatgaaattgttttcttgcatcatagtagtctccaaaatgaagtagagtccctatccacatgaatcaacatttatgattagattttgttcagcgtgcttaatcctctgtaattttcaggtcacatgatcctctcgaagaaccgcatacctctccaaagtggtgatgttccttcagaaattggtcttcctgaaggaactaatgtaagttttgataggatggtattaggatccaaatttaatcagtccgtctcctgtgacctcaatttaattacacttgttggcaggttcacaagagcaagaaggaagttatgtcagagatcattttaaagagcaaattttacaaggtacagcatcttctgtgattagatgccatatgtgttactttggtacccgtccttttgttcttgtgtgatcatttaggaccttattttgttttaatattaagtagatcgatcgaactgtcattctgctgtttttctggtatatgttgaactatgaaactttacaaaaaaaataatctgaattcagtccaggggctaatatgatttaatccatcatactacttacagtttttttgcttagcccttgctttttgcgaaccattctcggagataggccagtgaaacctggctttaaccttctatccctgtattcgtcgcaagcaatgataaagtattcttgaatgtttccagtaatactctgttggtcttatagtattttgggaatatgcactatatcctgttactttttggacgtgctcattattagatctacattgctaaaatcaaacaagctgaaatacttgaggaaaccccattaaaacacaatcgtttttagcaagtgaggaggctcgcctatggaatttggttggggccaaggggctatctttgatatggaccctgcttatgtaggcgtgtgcgttatgatgttgtaagagccttgttgggcgctttggcttttgtttctttcagcatgtatctgtgtcatggatgcatcttttcctcctattaatgcaaagatacacagttctcatgcgtattcgagaaaaaaagatctaagttgctgtacatgactaacatacgctatacttgcagtatttttgtctcatgtttccggaatgttattagttgtgtgtgacatgaagaggatgaagctgtttcttaaaacacaaaatttcttccttgtgcaggcccaaaaggccaaggagagggaagaggatgaacatcttgtagacaagttggatagtgactttgcaatgttagcccagacacaggcgatgttgtccttgactcgatcagctagaatggatgcaaataaatataattcaagtacagtccagaaagattcatttggtttgactgccaaggagatttttaataaggtatgttcttagtgctacgcttcttgcttctacataagttgttaataatcacactgttattcattcaacacatgttctattagaagaatgggtttgcacccggtcacttggatgcaacagttggttaaaatggttttgcatgcatgtccatgagatggacaaatgattaaaatggtttatgttaatggttaatattgttagctgttaatatactttttaaatgtttcgttcaccttaaggacctggatatggtactatgacattatgaagtcatttttctttggataaattcattttgtacctatagattacaggcatttgtctttgctccgtttttgtgtcaacagactttcattgttggctgtggggaaattcacattgatgtattttttattgacgttatgatggtaaagtctgatcagtatttgttgccaggaaaaaccagatgcatatgataaattagtgaaagaaatggttatggatcaacgtgctcgtccatcagacaggacaaaaacaccagaagaaatagctcaggaggaaaaagaacgtcttgagaagttggaggtttgtttcatattatttcagggttgaatgcagttattgtattcttgtttatttaaaatgtcccagtgccacaaattctcctggtggatgcaattgtcttacctaaaacttcttacatcaactttgtcattggatgccatatattctttaacaatttatttatgcaaacactggtgcaccatttgttttgtgatttaatcaagcatctaattaaattttatacatgcaattctatcacatcatggttgtcttttcgtatgaaatactgatattgaatctctctgatgctggttggtcttctagaaagagcgtcagaaacgaatgcttggaactgctgagtcctctgatgaagatgatgatgatgacgaggagggtgaccgcagcacgaagctagacagctcaaaacctatatctggtgatgatcttggtgattccttttctactgatgagccagcaagaaaggaaaagggctgggtcgatgaaatttatgaaagagagggtaaaaagattggtgaagatgctgaagggtcagacaatgaagaatctgatgatgatggtgatgacgatgatgatgatgctgaggatggtgatgatgatgctgaggatgaagatgaagaagaggatttaagtgataatgactttggtaatatgtctgctagagactgggagcaaagtgacgatgatgaggttaccgtggaagaagatgaaatggaaggtctcaaacaaaaggaacagaagatcagtggcaaagtggtgaaaaaagatctacaaaattcaaagaaagagtctaatgcagaatcgcaagtcaaggatgacaatcttccttttgtgatagaagcaccaagtaacttgaaagatctatgctccttgctagatggttggtcagaaactgaaataattgagattattagtcgaattcgtacatgcaattcaataaggcttgcagctgaaaatagaaagaagatgcaagtatgtaacttttttttttactgagatcaatatcgtatttatagttctacaaatatttactgatttttttcttaaatatcttacaattcacacggcatttattaaatgtatcctcaagtattgtgatctcttttggcaggttttctatggtgttctcctgcagtactttgcagtattagctactcagagtccagtgagattcaaactaattgacacccttgttaagcctttaattgagatgagtggggagactccatattttgctgccatctgtgcgaggcagcgacttatccacacacgtactcgtctatgtgaagatataaaggtttcaggtctgtgagctgagaacttggacttggtaggaaattggttttattatcaataaactgtgtgatttactgtgattgcttttgaatatatcttataggaaagagctgctggccaagtttgaaaacattacttcttctgcggttatggtctcttatatttccctgctctgacttccgccatgtggtagcaactccaatgcttttgcttatgtgtgaatatttgatgcgatgccccatacaatctggtcgagatgtagccgttggttctttcttgtgttccatggtgcttgtggtatgttctgtaactctaaatcttgttccattaagttcttatatgaatgatgaagaactattagctgaatttcttactcgacatgaatttccttttttctcttcttccagttctgcataataataactctgattgcaggctactaaagagtctaagaaattctgccctgaagctgtcgtttttctgcaatctcttttggtaacatctctgggaggaaacctgggatctgacctacgaaaaaaggtattttttagtttcaggcattgaactttttttttctttttttgctcactgcttgatatcaagcgaccctttgtatagatcaatgatcaatttttggagctcaagacaatggaaccatggcttcatatccatgaaaaagtgcacgaggtgaatccagcgaatatcctggaagtcatatgcatggattctgatgctccttatttctcctctgataatttcaagtgaggatgtgttttctctggcattttgaatattattggtttacttaacacataatcttacactcgtacattttctaacagggctagtgtacttctatctgtggctgaatgtttaaggggatttgttattatacacgaagaactatgttcgttccccgaaattttcctgccaatctcttctttgatgcaagaaattatggataaatcagacttgcctggattgttacaatacattttacatgaagtcattgagttgattaaaaacagaagtgatgaagtccatgcatcaaggcagccactccaaatgcgaaagcagaagcctgaaccaatcaggcagttgaatccgaaatttgaagagaagtatgcattttttggtgttctattctgtgttaacagcatgttgtattcttcttgaagggttttctgttgttcattctttattgactccatttcttctctttctgcagttacattaaaggccttgattatgaccctgatcgggaaagggcacaaatgaagaaaatgaagaaacgccttaagagtgagaagaagggtgcaatgcgcgaactgcgtaaagataattatttcctgtctgctgtgaaagagaaggagaggataaaacaagagcaagagagagctgaaaagtatggaaaagccatggctttccttcaggagcaggaacatgcttttaaatctggacagctagggaagggcagaaaaaggaggcggtaacattttctccatatttagtgtgtgtaaatatattgattatattccccatgctgttcagttcaccatctttcttgggtactggagatttagacacagcgaatggcctttgcatgctccattttaactgcctgttgtaacttctagcttgtggacacaccgaaatacaaaagtagatggtcagaactcccttgttagcaatatggagacggagcgtcacttgcatgaaagctacttggaagaatgtttttgcaatctccccaacaaagcaccaacatggcaatggtttttttatttctcttgtatcgggaaatggattgctctactgtgttatactcctgcaatagcaattttgatgtatcacagccaagagtttttgatgtgttccctttcctttttgcactcgtcagatgtactggaatgtaaaccaatgaaatccttaatgtaacattacttccattttatagccattccttgccatgttgttcactgtttctgaaatatttgctcatattgcaagggaagcattgtgttcaccagcattacatctaactctattgctgttggtgatgatggtgttctgcatcagaagataaattaggctggtgctttagatctgcccaaatgctgacctgctttgaattgggaattgggatggcttccatgtggagagcaacatcaccatcagcacctgcctagatcttgatgcttacatctgcctaattgcttatcaatcagagaggccacttgtgttgtgaccatccactttgcccattattcagacagtcccactcaattcatggagaagcttaggcgcatgcgcctaatggagccgcatgcatgcatacacgcacttgcattttttctgtgtgcaaagcatgaacaaaagctgctttactgtttgctaatgtgatcatgtcctgcttctgaaggctctagttctgacctaagcctgcattatttgcttttttttatcagtgcttgctgctgcctttttcatgacttgctctctagattagatgtcaccaatcatagcagcaatatgtgcatccaatcaatcatcaccagagccaaaaaagcatcactaagtgatgggcaaagtcatagagatccctaaaggtaagagacattccaaactaactctcatgctgcctatttcttgattcccatttcagctgctcttttttttagccgctcagcggagacgtcagcgccatgtcatcaaccgaggaatcatgttgacgaataacagctaatgtgattgatgacagtgttgcaggttagtcaaggaagttgatttgcttttgatgcatcattatcagaatcaggctaatgtgatattgctttgatgcaatatgtctttgtcagcaaagcttcaggtaagaagataatagcatgcttttgtccactgacttgcatctgcttgccccaccacagaatttgaagccattgctgtcatgaagattccagcttcaggtgagaggtgagctacaataatttgaaagcaatggccaaaattgctgcttttaaaatgaattttctaaggagcaatatttttttgttaatctaacatatttcttataaaacaatatcttccacagttatatttacatgatttatctacatatgtacaatgtggacatggcgaattcgagtatatttacaaatgatgatgatctataaacaacccctacactactattccattcctgcgccactccactggtaagtcttgaacagaatgaaggccctctctgtaacttcctgaattcttgggcctcttcgtcagctaagaattttcagtgcggttttcgggatcggctcatgagatcagcgcatgaacatcccgaaactgtagagagatctcggtcgaaacaggttggcgaagaggaaccatgtgggtgactctttcttctgtggctctgatggctcaggctggcctttcacctgaatgttctggcctatggcttgcctgatggagtctattgtcttctgatcaaccgtccctcctgtggaatcgcgaacatagaatgtgttgacagccatccttcctctcgtgctcacctccgctcttgtgacagtcaggctgttctcgcggaagattcgggtgacctctgacaggaggccgaccttgtcatttgtgcagagctcaagcttcacaccctgaaaacaaccaacattcagaagatgttctcgagtgaacaccggtcctgatttctactttgttgagacagtaaaagttcattcagttgttacctcagacaccctccgttcaatagcagcttcaaggcactggatgactcgcaacctgtcagcttcagtgtgcattggagatccatttacatgcctcacatagaattcctacaaaagcgcccccaatgtcacatgttttctcaaactgaatctcatgaagaatggatatggcaaattaggacatgtttggttcagcatattcacctggtaagcttgattatccttggcatcaatatttgcatggaaaacaacataatgcaggtctgtcaaggtgcaaaccgtgtcgaagagaagcttcggccggtccttgcatcggatggtgaccaccgagtagtccttgtcattccaattgctcaccgtcacattgggcctctgggactgattcggaggatgccgatggagctgctcatggtcgccatcatccagcatcatctggtgcagcctcctctcggtgtgcgtgctgcaggtccccgtcgacaccgccatggccgcgccgcgcgagaggttgcctccccggagaaggtaggacagcctatccctgatcctctcgagcctgtcggcgtccgtgacggccgatccggtgccctcatcggtgactcgcatcacggcggcagccctggtgttatgggtccagatctcggcgctgacaacgttgcacttgaggcttgcaagaactgcactgacttcagagaggaggcctggccggtcagtccctgtcagctcaatgacattgtgatcactcgaagcagcgacatctactgatctccggcgagaaggtatgtatcttgaatctgcacccaaagactgtagattttcagaagaaaaatgcattagttgtcagtccaatttgggtgatcattcagtagtcatactgaagattgccaaggattcttgtataccttacaaatgtagtcttcaattcgcgcaatagtagccttatctttaagcttctgcccttctttgtcagttatattaaagactgaaaccaaatagggatttagttaaaaaataaaaaataaaaaatgaatatgtaggtgtaaactaattagtaaactatatgctttattattaccatccatgacccatccaccatctgaggttatgtacgccttacttatcacaagattcagatcaatcagaacttggattacttcaaggagaatcccatactcatttgcactgtctacctatgcaatttaccaccaaaaccgaatcagtatctattctcactaaagagatgaatcaagaatcttcatcaagtggattaggaatatcctgcagatgatagtagggccattattcacttaaaaaaaatagtagggccattaccctgacaatcgtggcgtcgttgcatgaatcattatcgatctcgatcctacagttaataaaggaaacaagcaggatgaagaatcgagaattaataacataacagtatgagatagtaatctcccaaaattgagacaagcaggagcagaggagcacgtgaatgcaccttggcgggttcatcttgcgtatgaagttgtcgtactcgtcgtcgctgtcccaggtagggccatacccttcatctgtccacatgcagccattaaatttcactacagcttctgatgaacagcaagaaacatgctgatttttcttctctctcatatttttttttcaaaaaaaaaaaggttaaaactagtatgatgaataatatatgaaaaaaaatcagattttttatttctgatatggcaatatctgaaagagggtgagccataaaaaaaggaaaattgataaacaaaatcaagaacagagcagaaagaatatccttccttcctaacaccgttactaaatgaaatcaagaggaaaggaaggacaaaggtaccataaaaaaaaagaaccaaactttacattccaaggacatgaacaagaaagcccaacacaacagggagagagaaagcagagatggatggatacccatggacatggcagagcaggagaccaagaacttgaagcctctctctctcctggatgaacgaatgcttctcctgctcctctctctatctttctctctctactcttcttcttcctcctcctcctgtgctcttatgtgtgcggcagtaaaaagcgtgggatgtggtggatggcggcgatcctagagagaaggcaggagatgagagagagagagagagagagtaggtggtggagaagagaagaatggcctcttctctcctcttctctctctccttgttcccccaaaatcttggctgggattggcctacgggttgtttttcatgcctgcgcattttgcacctacgcccctgggttattccggatttgcgtgtggacggctgtccagctcaccaaaccacggacagaatctggagaattgtttggttctgaggctgtccgtcttttgcctgcttcgttcacactgggggatactagtaccaaaaacagtgtgcttggagcgcctattttttttctctagttttttttatattttttgatccttttaaataaaattttaaatgtaatctttcatgcattttatttatgtaaacttttttttctggtcaagacaacttgatagctatggtcgggaaattctacaacgacattggttcttggcgtgcagtatcgtggctgaaaggtctaatttctttagcaattggattgaattgtttcttgtgaactttttctttaaaaataataattctgattctttttagttcaaaatggcagagcgcaatgaattttttttcctataattaaaaagaataaatatgtaattattgctagtgggtaataatatggcatggttgtatattgagctttaaaagttggtgggcataattttatactaagatatgatatgttgagctaaaaattgcattggtgaacagatggaaggttgagggggaaataggaaatgaatgtgcccatgcagctgtgcacggcgaacatggcaaatcggcaacatttttttttaggcatggcaccatttacttccttttatgcatgtgctacccttttcatactttacacgttttgatttttttttcttagtcaaacttttaaaatttgattaagattatagaaaaattgagcaaaacctatcacaggattaatgttattaaatctaacatttaatatttaatagtatatttgttttgagtttgtaatgttgcaatatttttttaataaatttggtcaaacttaaaactaatttgaaaaaaggcaaataatcatataatatgaaaaggatggaatgttttttccctttttttgcacccagatgtgtcgtacgaaaaggaaattgcctcgtctctcactggagtacatcggccaaggagcaatgagcgagaaagcttacctaagtgggccaccatgtcaatgctctttcaaataatttggatatgttttcaaatatataaatcaatgtttagcctgatccaatggtcaatttcgctagttccaatcctgctaatttaagccagttttcttcttattatttcagcatatcctccgcaagcaaatgagtataatattctatcgaaaacgacttacattaacaaattaaataaaataatgtcattaccctagctaaccaaaacaagtgggaggacagaatatttgatgacatacgtatgtttttttcctagtaaatggcatgtgtcgttgactatatcaatgcacttgtttttcgtgtacaatagtttcaggcacaaatattattcttttagggggaaaaaataaactagaggactacagtgagcattttcttaccatttgtgacagattaagaaattttctcgagtcaattaatatatgacacacatgcacaatatccactcccttcgtcccataaaatagcaatctagatctggatgtgacatttcatagtttaacgaaccaggacatgcatctgttcatattcgttatcttataaaaatgtcttgtctggtcttaggttattatattatgggacggagggagtaattatgatcggtgggggagtacactgcaagcaatcttttttaagatgtcatgatgaattgcagttaattcctttatcatcttttgagtaacacctgagtcagaatgcagtcagccatctctctcacgttcaacaccaaaattaaggaagattcaagtgagctcagctaattgccgaacaagacaagtatctgtatcaaaagagaacgaaatgattcagatactttcactagctagtcttaattactagtacatgacaaattaaagttgatgacacatcgaccgacaaattactctaaaagaaagaaagaaagcttgcaaaaaaaaaacatatgaccagctagcccattggagtaatcagtcttatcattagcagcaaaaggttgcatctcaatccctctctttccttttggtacttgccaaggaatattcaggttgacttttcgacaatttgtttagcaacaatgaaacagtagggtagtaattaaggtcgctcgataacaataacatcgttgtctagtgttaattaagctgtttgggatggagccatggagggagtatatcatctttgctataatagttcttcaatttcctttaacttactattatacctaggacgtacatgtgccactcgtattaaaacatttatattttcatcactaatagtcaaacccctgttgaccgacggaaacgacatcttaatttgagaaacaaaaacgtcacttaggtagcacatatgaaaacgtcatactcattacttatagtataaaaatcaataatttcaggatattagcatgcttttcacaatgcaggtgcatgatcttatattcttatctgtcattaccaaacccacgaatatctagatgtgcacatccaccgaaagcatttctttgtaactaagcttaagcagtaattaactaaacaagtggaggaacaactaactaattaaggatcgatacaagcaaaattcgactgtataaagttgagagttttggactggcagcacgtagcatcgaagtttcctgctcaacttccacttgtgataaactggtgattacgtgtaccttgccatggtcaagtcataaagttcctttgatggagaccatatcactactacaaaatttgtcattagtgtcgctctatcagtgcccgtggataaaatccggcactgatagaggtatctcgcccatccacacagtcaatacccagtataaataagatccaacaccgatgactactcatcagtgctgatgagtggattattcatcagtattgtgaaccggtaccgatgagtagttatcagtacccgtttttttattataaatgttgtgctaggggataacccggcacatataagaagtcccgactatcaccgatgaatcttttctgtagcagtgtgaaatatttattagggagatggtccattaaaacgagcaaaactttttgtcgtgtgtatatgtgcccgcgcgcaccagtgccaccaagcaaacaacatagttgtatttcttagtagaaaatatgtatcccttttagtagatgtcgttttaaatgcatacatgtagtcaaagcatagttacttttatactattactagatacagcaaggtcatagaaactattttctaactaaaatatggaatcatttaaaacgatatctactaaaatggatacatattttcatctaataatttccatcttttatactattattactagttacagcaaggcctgaaaactaacggagccatcgttttgtttattcgtggaataagtgaaacggcatatttgcaaacgaaaagtaatatgtgaataaaacttttatatacgtgttcttaacgacctaaaattaaaggctaaaaaataaacttcgataaagaaacctcaaaattacctccaaatttaaggtttaaaattaaattttgactgataagtcataagtataaatataagcgaaaagataagaccctaatatttttattctattattgacatggtggttttaagaatgcatagatgaagaatcttttctgtcgttaccgagcccactaattaatctatatattcatattatccacatttaggaatttctagttgcttgtcctaaaaaacctactcctgacttcctataaggtgaagttcaaaacagaaagagaagactaaaatacctttaattaatattatagaatggagtagtattagtggatggatagataaataatgatttgttttaagataaagttgaagtttactttatttcggaatggaaggagtaaatcctaagctagtaggagtaaatacaattggaggaaaaagggtacaagcaaaattcgactttaacaagtacatttttggtgcagcacgatcgaagtttcgtgccaacttccacatctgatcaactcttttgtcgtgtactatgtgctactgagcaaacaatatatatatttttcatatttaaaaatgcaccttttttagtttatatggttttagaacacatatatatgatcaaaccgtaaaaacttttactgttgataatgacacatggaaaagattaattcagtggatcatggaaatttatatatattcatgtcattgcatattcattaaacaataactcttcctatcatctaattctaaaaaagtgacagatgacggccatatccaaaaacgaacaatatactactttcgatttttaatacatagtatccttgacctttatacatatatatttgactaccattttatctaaaatattttacataattatttttacttgatttatcaccaattttaaggcgatgacttatatttttacatatttgcacaatttcttttaataatataaataattaaatatgagttaaaaggttaatggtggtcatttattaaaactagaaagagtacaaagatgaactactccctccgtcccataatataagggattttgagtttttcttacactatttgaccactcatcttattcaaaatattttaaaattattattttttgacttgttttattatccaaagtactttaagcacaacttttcgttttttatatttgcacaattttttttttgaataaaacgagtggtctaacagtgcaagtaaaaactcaaaatctcttatattatgagacggagggggtaatagagaatggagactggacatcatgtcaccgacttatatatattcccccctacactcttgttcatacaaacttttttgatgagttctttaattttctaaatgattatctgccaaatattaacattcttgtcacatggcatggcacccgggagttctcagctaaccgtcactgatgtggttaacaacggtagtgcattgctggttaatttgacaaatacctccttcaggatatggccacgatcgaatagttaaccacaagtaaatactccctctgtttcacaatgtaaatcattctagcatttcccatattcatattggtgttaattaatttagattcattaacaccaatatgaatgtgggaaatgctagaatgacttacagattcattaacaccaatataaatgtgggaaatgctgaaatgacttacattgtaaaacggaggaagtatatgttaaggcagtctgcatgcctaccctagtataccttaccgtcaactctgagacacgatcgaacttaggtcgtgtttagttccaaaataattcttcaaactttcaatttttccatcacattaaaactttcctacacacataaatttttaacttttccgccacatcgttccaatttcaaccaaactttcaattttggtatgatctaacacccccttgtgaactctgagacatgattggacatggaaatggtgttccaaaacgtatttcatcggcaggccggtcaaccaatccgcgcatcaaagaaaaattaaccggtcggttcatgtcctttcccttgtcatcgtgtgaagaatagatagtgatgtatcccttgttgtttcgcttcatgtgtgtttatccgaattgcttattagcaaataaaaaaccatttatgagtaaacttttatatacgtgacattagcaattaaaaacaaatattgtaaaataaagtacgatgaagaaaaaaaatcaaattcaaaattaaattctaaaatttagagtttagctcataagtataagcataatccaaacaatcataatccaaacaatgagacacagtgaacgctatgtccagtcaaatccatatacgctgaagttaatgtgtcgaaaacggtgatgaaaattcttggcggaccgagcatcgtttttataaaaatgatattatttttagtcatttctgatcctagcttatatataaaatttgagttctctaatttgtttcggctatgtattgcaatgaccacttaataattaaattggtaaatatgaaaaattctcaatcgactaattttctaaacaatattgttttcaaccatttttatctagttatcatggatgaccactcctttcacccccgttgataagctctcatgtgccctgaaatgacacatgcattcatgatcaccaatatcgccatgactaattcttcattaatatctattaccatggctaactatatatataccatgcatgttgtggctgtggacaacttttaattttataactttgagtgaaccatgacaggaaagcacatacccattgcatatgcacactctcttgatttggaagaatatgtgtctgtgtttgtttctagtttctttgcataattatcccgtcaggcaccattctgtgtgctaaagctgacacatgttgcagaggaaaaagagaaagctacttgggccatatgtgcaagtggatcgatccaagctaagttaaattagctgatatatatagaccaagccactgatctagtttgcatgcatgcactcgccctggcatatcttaatccgtaattatctgctccctccgtttcacaatataggtcattctagcattttatatatttatattgatattaatgaatctagatagatatatatgtctagattcattaacaccaatataaatatgaaaaatgatagaatgacttacattttgaaacgaatgaagtacataacatgtagtagaacatgtagtagagtatgtatatagatagggtcaattggtcatgcactcttgcaacaaaatagatcatgagcagatcgagcacgcagtttgtgttgggagactaaatgtaagagatgaccatgagcacatagctgcatctgcaatgcacaagttggctttggtctatctgcatgattgagcgacagcgggaacaattattgacggtggccttggccgaatcgctgaagggataatgttgttgaccgacgacgatccttcttgtgcggattggtggtgtgggtttggacagggaatcgcgggcgaaagccttgccgagccatttggccggctgacaacggcggcgtcatttggcggtcccctccttggaggcgttgttttagcatacccctttcctttccctaccatattctccgagtgaaaaccttgcttcggttccgaacgagcggtggcggcgatccacgtcgcatcctccttgggggcaccgctttggagaaacctcttcgtgcaacgatattgtcattggtttatgcattggcttcgaactacagtcctagacctggacaaggccttctagcttcacattttgttttacttttctcaatttgggtcctctcttctcttgtttagtgtgttcaacttgtcttgaactacactctcttctcgagtggatctttgtaataattggctgtagttctttttgagcaaagaccaggatattatattccattatctaaaaaaaatcaacacgattgagatctgcagctgttaagtctgcttcttcttcttcttctttttttaaataaaagctcttccctgtcaaaagtatttcatgtttatgataagattaaaacgtgcttttaaaattcagataattaactttacattccaataaatttatgatattattgtggggtgacagtacttttcgaggcacatttacttacattatttcttttatttttaaactgactatttgagaaattattggtggttagaattttaagagtttcaccgggtcttatcctgatttttaacgggaggaagtaccctaccgagatgtttttcctttttcctatcaacatcgatctatgctagctctttaattgtgggagtacaccaaagaaaacaacaataagaaaagaaatccacatgcaagaggttaatttaatttctcacttttaaggaaagtgttataaaacaatactccctccatctatttttgataggcatattttcaaatctgaaaaatttatttttgataggcatatttcaatccaacaacttatcatcttaatgactttctcggatttaatgcgtgactctccattcttccacacaagattggctacatgagcatcgagaaatgtaaatattaatgaatcgcttgtttacgagaaataactagtagcatatttaaatgtataataagtaaaattacttatctttgtctgtgtgctaagataaaatataactatcatggagggagtaacgtatttgggcctgctagactttagttgaatagtcgcaggctcaaatgactatatattctgatgctgggccatcttgaattctggtgaacacaggtcaatttgtaagactaatgaattcccctttttaataggagcttaattaattctgattatagagtacttcctccattccaaattgatctacatatttcataggtacaccaaaccaagaaaagctaataactctctcatactatatttactctagcaacaaactcaacgcatgcaccatccccactatttcctagccaatagaaaattaagatattgcatgtgggttataaatacatgtgtgcatagatgcatgcataaatgtccatttactccaatgcacaaataacgaatagacctaataaatgaacacaaatatatagattatttaggaataacctaaaaaaactatatgtagatcaatttagaattgaggaagtagtaagctttataaggaaaaatttttagagatatacgtattttctgtagaatttacaagaaaataccgaacgagtaaagatttgcaaaaatataccgccgtcgcggtttcgttgagcgagaccgtggtctcgcacaattgaggcgtgagaacgagaacagtatcgctcgttcggtcagcgaggacggagcgcacttggtggcctaggcggtgctacaatatcgctttgccgattagcgagtgcgcatggtgtcgcactctaaggcccttcacagtgcaaggacgtggcaacggaacctttttgccacctaggattttcgtcgatgtggcgcttgcacccgggaccaaacagagaaactcgggaccaaacagagcgacgcgaaacttagtcgagggcaacgctgaaatcgcgagacacgcgcgctgtgggcagcgtgccttcgccaccccgtgccctctccctcgcgctgtggcgccggctcccaagaaacaaaaatggcggcggcggcaggatggagtgggggagttagagcggaggggcggcggacagagagggaggggaaaggctcgccggtgcgccgcccgtggaaggttttccctaaaatcgcggaacaaatcaacaaaatggcggtaacaaatcgcaacaaaattgcaacaaaatcgacgccgccgctgcacggcccggaggacgccgccggtggatggggaggagggagaaacggcgcggcgccatcgtcggtgaggagggtggggcaacgccagcgccggcgaggagacgtcgatgctgccagctccctccgtcgacaccgccggcttgaagtcgacgagcaggtgagcccggagcgcggcccctccccccacctcctcatcctcctcctcccaccccgtggaacagagagagggaggagggaggagctccgcggctcgccgccgtcctgctttcccgcacgccgcgggagaaagagagggaggagggagggggtctgccgctcgcctcggggacctccgccgccgaggtccagatctgagccatcgcctcgaggacctccaccgccgaagccatgaccgctccgaggacgacgaccacgagcacgaggacgccgtcgccgctccactccggatccgcgccgccgccactgtcctcccgcgccagcgctccggatccgcgcgcgcagacgaggagctgggccgtggcggggagggacagagagcgacgacgggatggcgcggccggagtcaacgtcggtggcgccgtcctgcttgctggccgcggcagacgaggagctggatccgtgtcgccgccggggacagagggagagagccggcgtcggtggatttggtgggagtgatttggggattttgggggaggaattaaatttgaaaatatactatttattcaatttttttaaaatatttgggatgcaaaatcttttgtataaatatactatcggtctcgcacaatcattacgcgaaaataacgtggaaatgacgtcgcgaccggtatcgtgcagggaaagtgcgagaccgcacggtctcgcgcaagcaaacagcgataccactcaagcaatcaacgctatcgctcaagcaaagatcgataccgtgcctccccgatttaattagcggttaattatcctaattagtgattaattaattatttatttattaatcactaattaagataattaatcacaaattatcattagttaattgttaattaagtacttaatcactaatcaaatggatcccattggacagtgtcgctgatggcttctgcgagactgttcggtcttgctcttccattacgcgagaccgtgcggtctcgcgccgttacccgtgcggtctcgcgctttcgccgcgcggtactgtccgcgacgtcatccccacgtcattttcgcgcaatggaagtgcgacatcgatggtatatttctgcacaagtttttgcatcccgaatattcctgagaaaaaattgaatgaacagtatattttcaaatttaattctttaggggagggggaggggggaaggatatccgtgggtcccactcggtgggtcccactcagtgcttgcactatgaagaaattggctctgaagctcttcatcctacgtgtcactgtgtggtacctcatagccggtgcttccactgtgaatggcctaaaagtgcgagagcgagccggtgggcccagtaactgtgactgcgacccatgcggtctcatgctacaggaacacaagagcggtgggcccctgactgcgacggcgcggtctcgcgctagaggaacgcgagagcggtcaggtgagccccactgcgtgcctaatggtgttaatgttaagttaattacgtagaaaacttcgtataaaaataaattaatcacgcgtgagcaattagaaattaaggggtgtgcagcttatttcatgacaatcttcgtacatcgcttaattgaaaaactttttcggatgcagtggtttactattgacgtgttccatttttgctactgtgattgcatgtgtgcttattgataatgcgtgtgagtgaatgcttgacgggagggtgtcagtgtcacatcagcttcggtctcgcaaaaccaacgtgtgagaccgcgcctcccctccgactctccgagcaatctcgcgctcccaccgtgcgataccacggctgccggatctcccaactaaaaaaaatcctgtgggacctactccacacctgttatcgcactctgaaagagcgatatcgattgtgctctcgcgattcgggcgtgcaacaccgcgggcccacgctctcgcgcgtctaaacccgatagcgatcccgttctcgcgctactaataagcgagaccgatggcgctactccatcccaaatcggtacgacgtggcgctctcactctatgaaaacacgataccgcgtcgatatcgcatagccaacaagcgacaccgccagctcaaatctcctcgcccattcgacgcgcgagaccatcatgctctcgcgcattggtaatgcgatacagtggcgatatcgcactttcccgttgcgaacctcggtatcacgctttctaatgacgatttcgatggtatatttatgcaaatcaatctacatccagtatatttatgaaagaaagatcgataaacaatattttattaatttttttcctttatgagagcatgtataataatctttagaataaatttcacaaagagtaaattgcgtcttataagaaggtttcacctagatccataaacttacaaaacccttatcgagatccctaaacttagtttattgtattatcccaatccaaagccttgtttgagtatggtcttgcctatgtggcatgccacatggacgataccaaggcaaaattttcatttttcctcctttgcctccaccgtgcatgtcgtgttgcctgtcggcttcacccacggcccaacggcgagcggattcggtggttgcggtggcgtttgtttcacatgagtggatccagaggaagctaggcgagacgcctgcctggaccaagcctatgaccctgtcacggggctcggtcccgaccgaggtgctcctctctcatattgtcccctgcgggtctgtagccacaatccctcaaacagggtgccggtgatgcaaggagacagcagatccaacgccgctatccatcgggcaggtcggatctgacgcaaccgacacaaggggacgggatccagcggcaccagggctacgagcactccgacacgacgctccacacagctccatgccattttccccatctacaccatccacaccaccacttaaatcggattggaagggaggaatcccaaccgagcagaagcagtggcagcagcagcgctcacgaagtcacgataggtcgcggatgagggagtagcaacagcattgtgccacttgctggtgcaggcatctaccgacacccatcttctttggctgcgagctcctccgctggctagggcccccactccagctcaaatccaacctgaccaagcttcaaccaatatgaggccgttacccccccccccctccctcccagcttccgtttgcttgccgggctgaccccgccatcggcacctctgcctctgatggccgacatcgtctctctcgctgcctccccccacccccccccccccttctctgtctgcagtcagtcccaccactgtcaaccgccgatgcatttagtggtggagtatgaagagaagaagaaagggagaaaattggggggggggatttttttccatgtgatcatccacgtggcatgccactttgacaagatcaaagtcaaatgaggcttttaactgcgatgataaaataaactaagcctaaagatctcaatgagcggtttgcaagtttgtggagctaggtgaaaccttcttacaagtttaaggaccgttggtgtaatttacttttgcacaaaactatagttactttggttagttatcacaaaactatagatttatcatgatgtgttacaaaactacggatttaacatggtgtattacaaaactatggatttaatactaaatttatcacaaaactacaaatttaaagtggaatatcgcaaaactacaaatttagtaataaagttatcataaaactacaggtttaataccaatttaatcacaaaacttggacatttacaactcaaacatagtattagtgttaaggatttaaaccccaaaatttgtagtttcgtgatagttttattattaaatctgtagttttgcgatacttacccttaaacatgtaattttatgataatgttattattaaatatgtagttttgtaatatattatctaaaatatatagttttgtgataatttaatatttattagcggaattgatataaataatttggtgatgtggaaaagagagtgggaagaaaggaaaacactgtcgctatacataatattggcttagagtcgactattaacatttactagagaaaattaaaattttgctgcatgaggtagagaaaagaaaaaaaataaaaaatatatttatgtattagtagttaagataccttattgttttttacgtaaagatatcttattgttacggaaatgctatctgatgagatcccgtcccaaccatgatggacgggatagggcagcaaccaaccaatccaccgattctatctccttctaccttatacattctaccaaactaccttatctctctcaaagcatgactgctgcacgagctccggcgtagcatggggtgtggatggtaggggacgcagtctcaagcgatgagctcccggcgtggcatggttgtggacgacggaggatgcaacctccgacgatgagctccggcgcatggctatggacggcggaggatgcagcctccagtgacgagctccggcgtggccgccggcgacgagctcccggcgtggcgtggctatggatggcagaggacgcagcctctggcaacgagcttcgacgcgacgcgatgcatggacaacggaggacgtggccgctagcgacgagcccggcgtggcgcatggcggcggaggacgctaccaccagcaacaagcctggtgtgggcgtggtggcgaaggacgtggccccggcgacgacctccgacgtggggcgtggacaacagaggacgcaaccaccggcgacgacctttgatgtgaggcgtggatgacggaggatgcagccaccggcaacgacctccgacatggggcgtggagggtggggctgccggcgacaccgcctcgatgctcagctcctgatacctagtaggaatcacctgatatccggtaggtatcatctgatatctcgtaagtatcacccgatacgtggtagaaatcgtctaatacctgataggtatcacatgatatctcacgagtatcacctgatacgtggtagaagtcatctgatacctgataggtatcacatgatacctcacgagtatcacctgatacgtggtaggaatcgtctgatgcatgataggtattacttgataccggttaggtttcagaggtatcatgttctgaaaccctctaaaacctaaccggtatcatcccgtttaaaaacgggattccgttgcatagtggccctctattgttaagagaacagtctctatagactctatcagactccactccactccagtatgtaccttcagcttcaggtgggtgcggccatgacactgtcagaaacgagatcgaggcccccctcacagtcgcggccaccgccgataccacgcgctagctcgccgcgccgccgcctgcttccgactcgcgtccgccatcgccaacctagaagctagctagaggcttacgaggtgttctcgtgatcgagggccgttcgatcgcactggattgggagggagggggacggcgtcctgcagtttttcgacagaatgcgtggcaaggtatgtgcttcttggacttgtagacttgtagtgcgtgaactaatctttgttttactggcttaaagctatggtgattttagagacaatatcttctcttcttttttttgagatggttataactgatgtgatccccaacagtggctagcagatcgacctaagctttcaatgcctgcattccctatttggctgttcattttcatgttctctttctttcttgcagaatttacaggatcttgattgtgtgattcatatgcatttttttctcttttcccacgaaagaagtatcataaacggtgttgacagttggtactagttaacatagttttagatatgtagctcacacatagttcggatttgatattccccgctacataaacagctggtcaaatgttttccaacttacatatgttgccgtaacatactaaacataatcttatactagccttgtctgaactctgaagataagtatgaatacgataaaaacacatatcagttattatcaccaaaaaagctactaaacatgctgacttcttaggaacaggtatgtccataagtacataacgatgaacatgtgtctgaaaaacatgtatagcaactagtttggcaatgcactgttagttgcacacaaacaatgaaatctgagactgagagccctataagtatgcaaatggcagattgcattgtgtgtcaaacctttctttgtagtcaagtagcaaatcccgcattcttaatcactgtcacctgaatcatttggttgccatgtggatgatgcatagagtatccttcctttccatcccaacactaaccattgatcttcctcgtcgacaagaaaatctttgtgataaccctttcttaccatatcttgtgtttctctgacgatggctggattcaatggaagctgcaccagtcctgccttaaggtttcttaccttccacttcttgtaactctctggcctctcaatcctctctggtccttcacatgcaatgacatttagcataatatattgatagatatctctctctattatcattcttgtctcattatctcgtggaatatttttatcaagcatatcaaataatgaattgtagtggtacatgacctctttgaaacgtgttaaaaagaaggggacaccataagatccattcaacactccttggacaaaaactttgggcttcatcattctaattgtattgagcaccctactccttgcactgttaattgatattgtctcatcaccaagatcctttattctgtaaatgcaattgactatgagaacttcatctttctcaatattaaaatcttcaggagagagggcttcccatttatttgatgatatatgctgatattcaaagggtatgttaaatgttttagcataatcagctaatcgcagcccaatattattacttctagcatatggtcggaagcctgactcaggtaattctataccagtaatccgaagcttaggtggtccatcttctatttttgcaagttcttcaaatagtgatggccattggaaaccaaagcaaatgccaaaatctataatgtggacctgtggttttccctttgagacatcaacgatagttctgttaagaaagggcatgtagagagacacacatggaatacctttagaatatcctttacattcctccttttggtgatgaacttgtggtatatctgacttccagttcccgttaatcgtacatcaaggcaatacgctaggcaaagtgctagcctttgggaatcatccccggtaggtgaagcatggtgtcttattatcttcagtatgtcactagctaggctatggttgctcacagatactgcttgtgcacaattgataaggagggttcttagatccacaacatctctcttttgtatccttttgcctgttgtctttcgccgagctgatgtttttccttgtccaatttgtgaagacttgcttgaattgtttgtcatggctctgctcaaactaacaccttcatctagaggcttatgatcagaacatagtagaacgttgtcaaacatctcatcccgaatcggttcatcatagtaaatagcatactgcttgttgctccttccttctaacaaatcaagatcttcaatacacggataactttttctatcatgaacctcaaacaatggatgcttcctcatgtaatgcgcatcaatttgaagtgaacaattgtcctggctaggcttttcggaaatggaaaggccatccacttttagaccaacaaccattctatttgagtgatgagtgaactgttctgtctctctagtaatggaagacaaactccatggaaactgaaacccttgaaagttgccattggaattcatacttgagctaatgtttgtcattctagtgacagaccaggtattgcatgcgtgaccattagacttgtcagtgttggcactgaggttctgcaggtgatcacatacacaaagtggttgttgctgagggaatgccggatacttttctccaagaagttcatagaagggctcctccatagcttgaagagcagtatcttcattgcctctgtcatcaatgtcctcctgcatcagtatcttatctatgtagctgagagttatatctgaatttatgctgcttttctcaggatagtctcctccactagtttggcaccaatctgttgtcccatttcctttctccacgtataattgggggttgtagattttgctacagaaggatgtgcttggtgcaatataggaatccttttcagagacaattggtagcggtgcattagttcatggggcttggtgggtataaaaataattctgaaatcgttagacttgcttactagattgatggattcctcattagaataggcatcacttcctggtccgtttgtgatgacatgaaaatcatcaaatcttttattgtcatcggagcccatatttgatcttatgacgatcctaggaagtcctggctcctgagtagtttgcacaagaaacaagcagaagagtcttagagaacaaaaaaccataaatcactataaccttggtttttataaattaacacatgattaaaagaattcatttcattcatgattcatctaagaaggctaaagtaaattcaaccatggcgcaggaaggttagttgacatgccaaggttcttaatcattaagttacaattaacatcgttggatattttcacattattttattggtaaaattatactcaaattgaacaaagttacatatggttaactaattagtgtaattcacgataaaaaaatatcattttaagttttaaccttctcaagaaaagaattgcttacccaccagtttaatgttaattcaaaatttcatcttagactgtagaaaggttgtaaaaagttattcttaaagagaatgatgatggggagtgcaactttcgtcacattagcatcaatcaacattttatacccaacctttgagatctgagttatctgtaaatagcatttctaacataacaataccaaaaagtaaggcttaattggtgcagggctcagactatttatgtattctttgatgcacttaactggaatgcttaaggttaaaataccgaaatcatcagaatacttttaatttaagagacctttcatgtttccagtatgatcagatcatactttttttttttgggggggggggggggggggctagtgaacaatagggaaatggatgtttcattttttccttgaaccattataagtacaactttaaaaataaaacatctggtaatttccatatgtgaaccttttagccctgctatttgtgctggaaagctaactgtgtacaagttgttcgtggatgctacaacagccgaactcagatatcatgtcattttgcatagatgcttccaacagatatcatgtcatttaccctcgagcatgctgtataacacacacaggaaaataaaagaccgacagaacataacagaggtttaatttaccgtttacctgttgcagggatcacacagaactcagggagacgatgcaaattctgcgaggcggacatccagctgtggatactctcaaaacgaacggcaaactgagggctggcacaaaggtgaagaaaaatctgcaagcaactacatgattacagagatctgttaagctgcccttaataagtaactccagctagtttgccacaggacaaaagacacatattgctggcagctagctgcttcaggatgtggtgctggtggatttgccaaggcagggggcgtggatatcagtggtggaattcgtcatatccttgcttcttgcgtaattaaggtcgtcaatacaggtcgtagagagaaggttgtttggtctctgggagatagtagtatctgagtattgcagttgccgtctttggtgaggattattaggattagccgtgagtccggaggttttgttgtaggtgacaaacctggagcctaggattttcagttggatgagaacattctatatcttacgtgggttctcatttgcatggattttttttattgtttgctaactttttaaattttaattttacaaaaaactcttctgaaacctatttttagttctaattctaaatctttttgccaggctagtcttggtggcatggcaaaataacgttgccacgcacacccacggcggacatgtcagtgttgttttaccatgccaacctagatggcgtggtaaaacctttgccacgcggtggtgtggccatataatggttccatgtcaagggattagtgtggcaataatgttttgctcgacattagtgtagtcagatggtttagaattgaaaataaaatttgagagtatatttacaaaaatttaagtagaaaaggttaaaaaaaataaaaatatcttcgcgaaatgatgtacaacaaatatatttgttgtttcaagtaaaatgtacggtctaggacaaattgcggagtggctgcgatttagtactacagtatgagaataactgtagatacacaacttggcttgtgttgcaaaacaaattacaaagcaaaatgttaggattttttttacaatctatttactggacatgttttgtttggagcacactgctgtttagcatctgaattgtccattcacaccggttagtgaatctcctttgcatctgtttatgtaataataattaactaatttacttgggtattattatttccatttgccttactcctctttttgttatgttattggagggttcatatcctctgtctttgaggccaaaggcaaagtttgccgttgctgccatccatcccatccatatcttattcaacggctctgcatgtttttttccaatttcaaggttaactaacagccaattaattaataaaatcagttgtactggaccaatttaaagatggatcgttagtattgccacacgtacttaagaaatcctcacaaaacttcctgataccatttgatttaactatttgtagaaatttatatttactcacaccaggtcgaatcagtgtttatagaagttagtaagagcgctttttcctatagccttttctaaggattagctgtgcagcatatttgaaaacgaaaaataatttatgaataaaaattttatattcgtgttcttagctatgtaaaagcaaaggcaaaataaacttcgatgaaaaaacccccaaaatcaactctaaattttaggttgaaaattcaaattttagctgataagcataagcgaaaagatgagaccgtacttttcttttaaaacaacaaaaatatggtattgtacagtggaatttttattgtttcttgaatgaatcgataccaatggttccaaaaagcgaagattgtgtcgctattttttcctgctttgcctctggagattgttttctttatatttctggagagtaaattctatcaaataaatagctggtagtaagtcacggaagggcctaacggttgatcgagggatggatggcgtggatggcagcaacggcaaactctttggcttcaaaggcagaggacgtgaacccattattggatcatctgccaacctattcggtgacgctggcttgcaaatctaccaaatgatcaaagatggcgcccaatgttcgttcatatactcttacacgtgctgaattccaaatcggtcagcattgtagctgcactcgcctccccatatctcttgtggagttttaagatacctcttttgtattgtattgtacttgtattggtaggtcttacttatattgttgttgtaactgtaggttgcaatcatctttttttttcttataataatcaaccatgttttggaaaaaaatatatttatggtacactaaaaattattattattattgtaaactctatatggccaatcttaatacaatatcgtagtttagtccatcgggaaaaaatttgtagtttacgtatagaaggtgttttttaatatatatgacaccgttaactcttaaacagacgttgatcatttattttatttaaaaaattattttgttatgatttattttgttattaaaattttaaataagcatttttttaaataagatgaattataaacgtacgtgtaaaagttaatggtagcgtatgaaaacagatggagtataaatagtttggcttgaggtgaactggtgagatgggcctaaagttggttctagagaaagatggccttggatttggatgtggtgctaggcagggatgaaaacggtcacggaaattcccgatcgaccgaatgccgttttcgtataggggtaccgttttcaactgtaccgtttttggctatttttaatttttttttctaatttcttttttcattgtagtataatgccagcagtaagtagtttaaatgataaatatgttcaattaccggctgatcgagcattgtttttgaagagatgctaccgattcctggggccaggttggagtcgcggagagaaaagctggcccgttgttcaaggagggaccccaccacggcaccacctccatacgtcaccgggaggacccaactgctcgactcgatcagcagcagcctccctcactagagtatcagcgggcagcggctcggcacgtccctatccaacggcgtgatctgattctggtgggatcttttgccctgattcccaccaccaatcacgccccccgccggcgtcgtcaccgcccacaaacccatcaccggccggcgagggccctagccatttcgctagtggcggcagttggcgatcgacgtacgtttacctcctgacgccattgcccatccatcatcatccaccctattttatatcttttgctttgtttttgaccgcgggaggggggagggagacgccgcgtcgtccctctctctctctctcttcgtttccgcgcgcgcgcgcgagatccagggtatatatatgtactagtagttgtcgctgttgcttcgcgcactcctcccatctatcaagtgcgggcacgactggcgatagatagatccatggggtgggcggtcgcgctgcacggcggcgccggggacatcccgcgctcgctgccgcccgaccgcagggagccccgcctcgccacgctccgccgctgcctcgacctcgccaccgccgcgctccgttccggccgcgctgccctcgacgtcgtcgagctcgtcgtgcgtactgtttgcctctgcttgcccccaccttattaatttctccatcatacatacacgtatggagaactgatcgatcgatcgatcgatcgatctatgcgtgtgcaggtgagggagctggagaactgcccgcactacaacgccggcgtgggctccgtgctcaccgccgacggcaccgtcgagatggaggccgccgtcatggacggcaacaccttgcgctgcggcgccgtctccggactctccaccgtcgtcaacgccgtctccctcgccaggctcgtcatggagaagacgccgcacatctacctcgccttcgatggcgccgaggccttcgccagggagcaggtcaataaaatcaccattgctcccaccaccatcccctcgcctttctgcagactgcacacgaatattacagttacagtatcactccatgaagattcagataatttctgattatctttagctcatcgctaatttctcgctctgattatcttctcgtaaaataaagttctttctctgaattttattttaatactatcggtaaatcagcaataaaattcaggtcaactccactgttttgttccttgctctgatgatctgttcggaaatggtagaaagaagaccctcttctccaagattgcgtcacatttcttagaccgaatcgaatacaattggcgtgattactacgtatgattgattttattagtagagacaactggcactacatgagttcaggtgtgtgttgcatgaatggaaatagttgagtatcacacgtattgtgtgcaccacttagcttaggagaacttctataagggtgcgtttggttgcaaggatggaataggatgggatgggacgaacccacttttgaggttgtttggttgagcggtgagtgggatgggttggtccctggagaggaatattcctctcagatccgggaccaaccgatccggcaaattctggcggacgaactcgtcccagttgggatgagcgaacggcgtgacccgctcgagctcgaggccagcctgcgcgctcgccctactcgccctcaggagcagcggtagacaccggtgggctcgacgacagcgaccgtggccgcggcgggctcagcgacgtcgacggcgaccgcagcgggctcagcgatggcagccgcggtgggctcggcgacggcgaccacggccgtgggagggctcggctcggtgaccgcgggggactggacgacggtgaccggtgggggctcagcgacggcgaccgcggggggctcagcaacggcgacggaggatctagtagtgggaagggcggtggaggcggatccgcgtcctctgcctgctcgccgccggcctgctcctccaaccgcacccctgctcgcccgtccgtgctcctcctctgttcgtccgcctgctcgcaatattgcgccgctcctcctcctcgccgccggcctgctcctccaaccgcacccctgctcgcccgtccgtgctcctcctctgttcgtccgcctgctcgcaatattgcgccgctcctcctcctcgccgccagccatcgtcgcacctccgctcgctctcctctttctcgctgacggtgatagcaaatggcgcccatcccatctctagctcatcccttcaaccaaacaaaaaattgggattgtcctatcctacaaaccaaacacgtaaatggaatcatcccaaccccaaaatcaggaatggtttcatcccatcctacctagtcccaaaaccaaacacacgctaagttttgttttcccttagttttgagacctactccctccgtttcacaatgtaagtcattctagcatttcccacattcatattgatgttaatgaatctagacatatatatttatctagattcattaatatcaatatgaatgtatatatgtctagattcattaatatcaatatgaatgtggaaaatgttagaataacttacattgtgaaacggaggaagtactttttaagacctggaattaagtatatccatttggacgctggatttctatccataatcttaaaaagaatgaaatttactatgcattactttctttattaaaaaaagaataagaatttactatgcttagatgccttacttgattatatggtgataactagtcacttgtcagggagtggagactaaagatccaagccactttattacggaggcaaacaaagagaggctcagacaagcaaaagaagccaacagggtgcaggtactgtcacagttttgtctgtctgttttctaagttttggtgtttagtacatttcctaactacggagtaggtgattggattagatatcatattcccccaatcttgttcaaagttcgaaatatatctgatgcacatggccctgacaaatctatggttcatacatatgtatatttaggaagataattaagcatctgccgttcatactgtcgcagttttgtctggctcgttgctaagttttggttttagcacatttcctagctactacaaggtgattggattagatatcacattcctacacccccacccccacccacaaacctgttcagatttctaagcgatgcacatggccctgacaagtctgtggttcatacatgtgtatatgtagcacgataagcatacattttgcagttattcctctgttaccattttgttgccatgtctttgtctgaatttatattgccaagtgcatcagaaatgactaaataaatttgagaaaaaattgaaatgaaatcggattttgttgtgcaccatgcatttttttcccccatacactcagtacgggatatgcacgattatgtccaaattaatcactctaagaatgcacataggagcttcacccatttcgttaagctattgttcaagatgagtcaaataagaaacatactagtagtagtgtacctgattcagaaaaacaataatttttataagattagagctgtttcgataaaatcatcacaaaacaacatgttaacggtcaaaatctgatttcatttcaaattgagaaaatttgaaatgaaatcggattttcagagggagcaggacttttagtataacctccttgcttgttgccaggtggattacacccaaccaattcccaaggacgacaacagccgggtcggcacggtgggctgcgtggccatcgactccgccggcaacctcgcgacggcgacgtccaccggcgggctggtgaacaagatggccggcaggatcggcgacacgccggtgatcggcgccgggacgtacgccaacgcgctgtgcgccgtgtcggccacgggcgtgggcgaggccatcatccggcacacggtggcgcgcgacgtcgcggccctgctggagcacgccccgccggccggcctctccctgggggacgccgccgcgcgcgtcgtggccggcgtgccgccgggcaaggtcgggctggtggccgtgtcggccgccggcgaggtggccatggcgtacaacaccaccggcatgttcagggcgtgcgccacggagggcggccgccacgaggtggccatctggcctgacgacgctgatggtgctaattgatcttcgttcagcaatcttcattggacgatttgaagcaaagaagctatatttccattgtgtgctgctagtagtaatttgtatgatgtttcggtttgatttggttttaggacattatatacaatggcttttggcttggtgtgtcagacaatcagctcaatttatatccaaattcaattaagttaacaatgagatcattttttgtttccattacctcctcccagtaaaccaccgcatcaaatttggaaaaaaaatatatggaaaaatacatctaaagacgagcacccagcagtctggcacaatgatatgatgagccagtaaatttggaaatcaactttcaccccacgtcgaaaccttgaaatttcatagttttcgaccgttttccgtcagaaacgtgatccctgactatgggaatcagatcagagctagcgatgctccacggagaaaaggagatgatgcttcagctcgagcagttcacgagcctcagctttttttttttacagccctaaacaagtcttacatgacgtggagcttcacctttgtcgggagctttctacggagaaaatccctagaaactacagcaaaacactcggagaacttgctgccaattctggcgccataataatcttcatatagtacctgagttgtgtctacggtcaatgcctccagtgtaggggcgttttccactatgtgcagaagaaactcaatctggcatctcgcccctttgtaccctgtaatgtgcacattcttcagacaactgtattcgcagcgcgtaagctgcggcataccaggcccctggtctgcaaaccatatcttatcattgccaccaaactgcaggttcaaacaaaaacaatatgatcacaacagtgtacatatgacttccactaaagatatcacgaaaaaaagtgtgacaggggggcctatattcagatttatgttttagtgccatagaacaaattttgctacatataaacaatgataggcaccgaggcccatggttaaaaaaaataatagcatcccacaaattcacattggaaattaaatccatgaataatgaataaagaaattttctgaaaatctacaaaggtccaaaggtaaattgaatgggacataaagaaataatggaatctataagagggcatatcttgggcccaggaatctatgagcagaggacagagaatagtacttacatgaacctctatatatatatatatatatatatatatatatatatatatatatatgccaataccagttcatctaacacctctctctcctgacccatagatctgttcatccaacggtttatattaaaagttggatcaactcatgcaattagcgattccacgtggtaaacagcggttagcgaaaaaaaaaagaaaagaacccaccgccgccgaaaaaaaaaagggaaaacctatcctcctgcgcggcgccgcccgccgctcgcctcctgcgcgcccgccggcgccgctccgctcgcgtggctgcgctcccgatttccctaccccgccgctgcctcggatcgcctgtggccgccgcctcccgccggagccgtcgtcgttgccgaggaagcgggccgcatcgccgccgccgcctcctacgcgcgtaacgcgcccgccccccaccgccccgcatccccccttcccctgctgacgggtgctgcaccgtgccggcgccggaacggcgaggttcacatccgtcctgctgcctcccctcccttctagccctccgcagccgccgtcatcaacgtcctccgcgggaaccgcacgtcgccgggtccgccgccaccactggaacgccgcccttcctccaagtgccccttccaaccccatcgccccttgctcagctgatcaccccgccgccgcagaaggttgtcaggacggccgccggcgaggcttcccgctcctccatcctgttcaggtcagcgggcaggccgtgctacacgttcttcgcttcgccgacgatggtggtcaagcaggtactcatccattgcttcccccttcctcttcttcaacaatcaccgcacggttctggaaccaacccaaatgcagggcagacttgattcctgctgctgttgtgatttgtgaataatgataatacatctgactatctgagaatagcgaagtgaccttggtagaactgttgttttccgtaccgatcatctccctgggatgaatcgcagcatagaaagcttgccaggcatcgtcatatcatctgtgctcatttgctttgcttcagtttactgcagcaaagttggttctacatattgtgacatcgatctcgttcttggctctgagaatggcacaccgctcatgagtcatgattggcatattcaggaacttaaattgtccataaggaagctttactaagaaataaagaaaatcgctccatgatctgatgattgttgaggcttgataggtctgctctctttctcacactgaaactaaaaaaaatcgcgttgttcctattttctgaatgtatgtgtccactatattatcgacaaagtagactatttgattacctggaacccaaatcacaaatactggtatgcaatctacatttggccataggttcagttcttgcagttactaatttactccgttgcaactgaaacactcacagatttttagttgattagcatttagtcgtaaacttagaggtataattgctcagctgctaagatctgttttatagatcagttaataattaatttcttttggattcagcagtagtgccagaccgattggcatgacatgtttgcctccattcagtaaaattcatctgaattcaaagtgttccaactgtggcgttttgcttctgaacagctccccaacttgcacttgatgcgatggttctgttttgctgctaaaagtcaggttcaattgaatatcttttaatttcagagctgcaagtacatcttcaattaaataacttttcttttccttttcattttctgctaaaaagctaggttcaattgaataccctctccaacctaattttctatttgctcggatgtatgtatctattaactcagaaatgaagatggcaggatagcctaggtttggagactatttttagttcacgacttcatatatcactcgcttagattttactaatcttaatttgttgatatgtgcaacctaattttctatttttttttcagatttttgttcctattaactctgaaatgaacatggcaggatgacttaggttcggagattttttttagttcagttcagggcttcatgtagcactagcttagattttactaatctctatcgatatgtccaacctaattttctaattgtttagattttgcacctattaactctgagatgaaactggtatgatggcttagatttggagatgtttttaattctggacttcatataccaatcacttagattttactaaatttggtttatattgttactaaaatatgttgatacagtgagtcctgaagactaagctgaagatcacaaatcatctactgccataggagtaaaataaactatattgctccatatttctctatatttgattatatcaatgtaggtttccaaaaggaaaacaatgggtactgtttctttagggaataaaaaagcagtgctttctgcagttcctatagaaatagctcaatatatcttattgcctctgtcaggcatttcaattcagctgagatacaatatgtagcatccacaacaggttgaaacgagctgattactgacggatgatcagtgtcaagtgagctatacaaaatataattttcaattccaacaaattgtgaaactttaccatttaaatttgcagacaaacaagttacatatgttatacatatacagctatggccaagttatatgtttggattaattattttttcccatgtaaatctaataatggcctggtatatatggatggttgacagcaggggagagcagcaaagctgctgcacctgaccactgcacatctttggctcttcctttctggccactctaggagatggattacaagcgaggcaagggctccagatcaatatcatccagaagaaagtagtactaatttaaaaaaaaacttgttattttatatattgcactacttataatttataatttacagatgcctaaatatataggatgttgatttattaatgtttttatcaccgaactactccacagctaaatgccagagaggatggatttctcagcaattgtctccacaattctgaagcagtgaccatacttataaaatagttcatgtattgataaattggatatatgtcaaaatgttcactgagttaaatgctaggagcaagttgaatatattaaagttttcaagggaatcacatggaactatctcttgacaaagcttaatgtcaagttcatgtcataatgcaagcacttattatttgagttccttgggatgaccatgccaacgggtagactaagatggcagttgtggttggtcacaataggttttactttttatttttagtctaaattcagtcttctaatggtttatcatttgcccatcattttctgatattgcgtccacaaaaactgacattcaggtagctttctatgccaaagcaatttctaaaattgatgtgctttttactatgttttttagttggatatattttagaagttggattttactgatatttcataaatatttgtaggtttgatttgaatttaattttagtttgactactgcaacaggttaaactgaataaattggataaaaggagtgccttagtcatccggaactgtaagtaagccaagttttcaaaattttcagctagatgcgttgtgtattgttggcgattctgaatgtctcttcgatttccactgcccattcaagatataatataatggatggattgaatcgctttgcttatactgtgtccaattgaaatgtggtttaatccttggccttaatatgaaagcttggcttggtactattgctatactatgaaatactactttataaaataagttgcttttagtattcgtcctcttatcgggctgcaattttcttttaaattgaagctggaggacaactctgttgatgacaatgccatattttctttttttgtaattttctctattatttggtttccatacattcacacatatttttcttgtgatccattccttccagaaaaacgagggatataataatatagcaccttccaaacagtataaataatctcatccatctttatttttcttcatattagctgaaatagggtgtactcaattcttagtgtaaaaccatgaatgtttaacgtgccttgcacgtgcacacttactattattcagaatatgtgtccaactttatattaaggattgggtttccgtttaagattatggagggagaagtagtttcccggtttagcctacggaaagccgattcagattttatgtggccggatgctgattttttggacaattgtaaataatgctgattttttttaggagggcagctagcgcagaccagcatagagagtttaattttggacaattgtaaataatgctgatttttcactggataattaaacacccgataaattaatagatattttcaaccgtgtcgcctgctgtccacgcgattcctcgctactttccctagccggatcctcctaggtcgtcgagggagtgccaccgcagctaaccagagcagcagtgccctcttcctccaatatcctccttggtatcgcgcccctgacgtcttgaaccaacacttagggcgacgtagagagtgacatttgtcatggttatggataccacatacctaatagtagttgactaagctcggcaggacccactatgtaccaagtcttatagagaatcatacatcgtatatagaaggagatccggataaggaaggatgaatagagttctatatggaaacgacaaggactacctggattgtatccatattggtcttcctagttctatttggacaaggggacatctattggtataaatacaagactccctaggggagagatgacacaacaacaacaacaacaacaaatcaagacatgacatacaacagatcaagctaacacacgccaagacaagcgcaacaatccccatactatgcaaaataccgtagttgcgatctcaaacgtcgactagtccctagccgtgaagttgcagtagtagtaggacacaaggatcaagtcgaggggaagggataagaggagagagggataagaggagagagggcgtgtggtgcttgatacctcgtagccagccatgatacccgatacctcgcaaccagccatgatacttgataccttgcagccaaccatgatacttgatacctcacaaccagccatgatacttgatacctcgcaggtaccaggtatcaggtttgctatctatgggtaagtcatgataccatgggtactaaccatggtacctaccaggtatcagacccgatacatagcacgacgtacctacacacgctccggcaatgatcatgatggctcacgatcatgtcgccgtcaatgaaagctctagatctagaagcttcgtaggttgcccctccatcaccatcggcaacgcgcctagaaaaaggaggtcgagaagtccacgctggtcagcttccttcccgatagcctccctcctagctggttgcccccttcctccatgggagctagatccagtgggtgccctcaaaagcatgagacggaggaggaggcaacaggaccttgtagtcaacgtgcactcagggtagatctagcagtgaggaagagggggaagggatccgttttcgggggcttgctttgttgccgccatgcctgtatagagaagctctctgcaacagggaggagggggaggggggaaaagagggtgaaataggagaggcggagaaggaagacgaagactcagagagtgaaggggaatggataagatcgaagcgttatccacttattatgtttccacgggatacggttgagtagtttttctgtttttttgacaggcagagagagctcaattttggacaattgtaaataaaacagtataaaaaccttggaacgtgagggattttgtcctggtaggactcatgagttctactcttacttttactttgactagcaaagtgcccgtgcattgcaatgggaaaactacactgaatgtgtgttgtcaatggtggcggccttataacggtatggcagtactctcatgtcctactcacatatgcctcgtttctgataaagtatttgtgagcacctcacgcttcttctcccctagcaatcacgagatggctaggagaagaggtttgattaacgtagtctttactggctaggagaggagggttgattaacatagtctttaccttctccttgaacgtctctcgccatgagagaagtcattctcctaggaaatttgtggcttttttcacttcgacattggatacatatatctttgggtcgattcggtcgccataatgtagtgagatcgtttgcaacatcatgagtgatgaggacatcctccactattacccgttggcaaagacgtcaaagtcgggcagcgaccgtgtgagtctctgaataatcccaccttacttagcttgggaggaggaagccaccttaaaagggagagccacccttcccctattggactagtcttttagggagattgggcctttccctgagtgggtgtgccaaagaactgttggggtccgggcaaccttaagtgaatgatgaggacattcttcactattacccgctggcaaagacgccaaagtcgggcggcgaccgtgtgagcctctgaataatcccacattgcttagcttgggaggaggaagccaccttaaaagggagagccaccacccttcccctattggactagtcttttagggagattgggcatttccctgagtgggtgtgccaaagaactgttggggtgttattgggcctcggccaaccctacctgggtcggattgttatcaatgagttgctatgaggttaaggttagttggggttttcctcggcaacggcaccagaaatgcttgttagtatttgttacgcacacagataaattcgtcagcgcatggataccgttgcaatacttccccttagaatattccaagggtatcggtatgtgtatatatctaataacaggattcaaccaagaataacaactaggcttaagatagagaggattcctatggattcaactggctaacctagattcctatggattcaactggctaacctaagttaaaggtaaaactctatcgaatggtagggatgattcctatggattcaactggctaacctaagttaaaggtaaaactctatcgaatggtctatcgaatggtagagaggattcctatggattcaactggctaacctaagttaaaagtaaaactctatcgaatggtaggcttaggatagagaggattcctatggatttaactggctaactagagaggattcctatggattcaactggctaacctaggcttaggatagagaggattcctatggatttaactggctaactagagaggattcctatggattcaactggctaactagagaggattcctatggatttaactggctaactagagaggattcctatggattcaactggctaacctaagttaaaggtaaaactctatcgaatggtaggcttggatagagaggatttctatggattcaactggctaacctaagttaaaggtaaaactctatcgaatgcttcagacaccggccctcccctggtctgccaagctaagtctgatcttgagctctatgatgtatcataacgtggagagatgcaacggacggacatggatgtcaccacctgccacctacctcacttttcgtggagcacacaacaaatgaaggtagcctctaacctagacatcacgtttacgttatcaattactactctagcctcggccaagaactaccttctttatccaaaatcttagtaagttagtactagagcactcagttagacactaagcgacgaacccgcaccgataagaatacttaagtaaactaattaaataacacaagatcagagagagtgccgacactccggcactcctccgaactccccggagagaactccaaactttggggcactcccttcagagcttccctcactctcttcccatttctaactctactagagagtagcctaaatatcaaagtgagttgtactacacttgagttgtgtgcgcttgagagtgagagcttctccttttacagtgttgtaatgacggcttggaagtcgattaagcccggaaccacgcataaccgccgtcggggagtcatcaggagcgtacacgtggaagcaaatgacaagagggtgcaaagttggttcagcagagctaggagttctgtcgaacttctggcctacctcttgggcactccttttggctgggaggctacctggtgggcccctagcatattgtactttggctgggctcaattctaagtggttttgattgacatatgggttcttcaatccgtgtaaatgcgtcctgattgtccggaggtatattttatcacatggtgggtggtttttgtccataattcacctgcatacaaatattcacaaagacttgcggaaatggttagtaatagccacttttggcgttccattttatattatttcatttgcttttatgcaggttttgacggttgaattcggtacttaaggatcgtcaattggcagtgatggctggggagagggatccgtgagggggctccacctgagacggagtggcggcctcaaggcgcagcaatggctcaccctcaagatggagtggcgaagacgaggtgactacaccgaccgtgcatccactcacccacgaagtctgtcaccgccgtgaagcacaccaccaccaaccccatcgctccctcgaccatcgccgcaatcccttctgctccccatctcccttgacggcctccccgctacccactttgaccgcctccctgtcccttatcatctccccaacctaccccctcccccccccccccccccggttttgctcacgcgattcaagcagagaaagagacagaacgggcgatgtcaatgtggcacttctcccgcttccttctccacgctgccaccacaaccgcagtgtctgcctccgcgtccgcttcgtcacggcggtgtcggtgttagggaagctctagcggtgccggtatgctttgctcccagcggctgtggagcctacgacggtgccgggaaggatggtgaggtagaggtgatagcgaaggaggcgaagcagctgatgcggctggcgaacatgcaaggcctagggacggcgaagtgaggaggccgctgccgatggtccactcccgctccttgcaaacggccgaagagaagagcaacgggaaaaaagagaaagaaagagaaaagtgagagagagggaggaggaagaagaggagagaggatgatatgtgggccccacatgtaaatgggtcccacaatttttctttgtgtgaatgacaaatgggtcccacatagtttttttaattctaatgcctcgttgctgccacgttgaacaaagaccaggtcaacatcgccatgtaagtgtcacgtcagcaaaatagtcttctaaaaccgccgagggagtaaaattgcagcgatttcaatagtttggggtcgagatatccggttttgtaatccagagaaacgaatcaaattcaatagtttagggagtcaaagtagacttattcttccccaatccatctcaggatctctaccgatccatggcgatgtccgccgccgccgcctccgcctctgcctcctccttccccaactgggtgatgctggagcgattcgtcttccgcagggacgacgacaccagggctacagtactgagggcatccggttccggatcccacgggacccccttcaccatcgccttccgcatcgccgaccctccggcgatctcccgcctgtacgtgcggtggccgcagggcccggacccggaggagatggtggcgtgccccctcgtcgccacccaccgcaacctcgtcctcgtctgcttctgctacatcgtcgagtccccctccggcccggcttgcccgcaggactacttcatcttcaccgcgtccggctccggcgacggcgacgtcgaccaccacccagttccctcgccgctactcaaggccctccccccatgtacctaccatgatgagggcgacggcaacgacctatccatgcggtatccgttggagttccggtccgtcggcatcctgtgccgaggcgaagagttcgccgtcgccgagctgcaggtcctcagaaccgccagtggcagagtcaaagccaggctgtgcgtgctccgctcggccatatcctcctccaaagacgaagatgaagcagaagatggagatcatggaggcggcggccggcggccgtgggatatcatggagctgccgatcgtgtacgacggcgacgaggagcgctgcgacatcttctactggaccaccgacgccgtgatcgccttccaagaccacctctgctgggtggactacgaccgaggcatgctcctctgcgacgtgctgcggacaagccctagagtcgccttcctccggtttcctctggacagctcgatcatccctaccggcagacgatctcgccgcaatttctcccaggtgtaccgcggcgtgtccgtcaccaccgccgccaccggcggcgccgccctcaagttcgccgacgtcagccggcacgacggcaagctcctgggctccctagaacaaggacgaggaggctacaccatcacctgccacactctgaggtcgacgttaggggcggccgccattgatgacgagtggagctggagcaaagacttcgcgatcgcgtccgacgagattcttcggtccttcgagggcgcccccgagctcgagcctcgtgaggttctcctgttccctaccgtgagcatggacacgccgagcgtcatgcacttcctcacctgcgactacgaccgcatgatcaggaagatgtcggtggtgaccattgacatagccagcaagatagtgttgtcggttgttccatatgttaacggggaggaggacctttccggtgaggatgccgacatggtcagggcgaagtcgggctatccccagtccttcctcccctcagagttttccaagtacttcaattcaatctaagggtgtgtttagttcacgtcaaaattgaaagtttgattgaaattggaatgatgtgacggaaaagttgaaagtttgtgtgtgtaggaaagttttgatgtgatggaaaagttataagtttgaagaaaaaattgggaactaaaccaggcctaaacatggtatacatacacctgcatcttaattaattacctgctgggtgtgcatctgcaatttaattaggctagagcctcagcttttgatgctaggtagggcgactgtggtctagaaatgctgttggttttgatggtaaaagcaattgtgtcctgttgaaatgattaagcaatttaggttgtttctacattattggtggtgtcagtgttaggactaggacgccactttgatgttccacaagagaattccagccttgtttggtgtctttgcattgtccactggaattaagcatgtagaattgaagtatgtcagttttattcttatagcatcagtgcgtgggctaattcagtgatagtggctcttacaagcatacacatagctatgtattatggtactgcagccaagctcaatccctgattcacatgctacccctttcttgctaatggatattcaatattcaaattggcttcaatctaaatggagaataaatcagaagccctatagacggcacaattcctagttaaaagtgatcactaccatgtcactaccagtacaagtatttggaaataccgaagtgatcatcggttcacatgttttaattatgtagctatttcaatctacgtatccgcataattgatacagcttcatactgcatcataatcataatatttgttccctgtagtgcttggtaagcaccaacgttatcaaaataactcaagatatgggtgaatcgattttgtagatttgcatagcgtatccaactcacgttttgtacaaatccattttatcattgataccataaccatctgtggtactgctctgatcgtttctaatttgtatgagaatcctcaatatatgcaggaagaggaagaaccagggatgagtgttctgaattagtggtttacaaagtgctaaatgtttactttcatgtatttatttcttgcgtcgctatgaacttgaatgtcacacttcagaactccttgtagtgcagtaccaactagaagcgcattttgtggatccatttacacctaatatgaaaaatggctaaatcatcgagtaaactgtgttgcaaaatatatttctccgtaggtaagcaggggacaaaggatcgtttggctgcttcaaacatcgctactgctcgctgttcagcagcatcagcacgctcttaggcaacagctgcgtgcttttttgcaaaaaagtcctatatgaaagttgttttaaaatatcatattattccattttttaagtttaaaataattatatacatgattctgtttctatttgagcaaatatttttcgaatgggggaggaatgtctacctcagattcagctagccactacacgaaagtgatctatcgatagagctgctggtttgtctccactttgttttgcaaatagggaggttgtgtgattagagcttgatctcacacttcttttattagagcaaaatcactacctaatttgttttgcaattttacctttggagattagtctggttggttttagaggattagccatggggattagtctccctaggtttagaggatcaaattgagggaatgatccatttgttcactgatttgtttatttttgggtaactgtcagtaaaaagattgtattattgttgtttgattccacacagcatgtagcacggcaagaatacatagttcctctgcttctccttagtacaagaatacaagcagctaatcaagggatgcccatgacacctgatctccctggctctctcgatcgatcctgatttttcatgcatatgtatgctagatcatacagataaagctagttctgtatgtttcgtttacttctgaagatggcttacttttgttcaatttttaacacaataataaataatcttcagttttggttgtttagcataatagcatttcacttgaattcacttcaattcagttttgttcaatggagattaatagcatttaattttgtaaatttacatggatatatttgtctctcctacaaacactacttaactagttttgtctttgtatctttatatgattatattttcttttatgatttgccttcttgcaatctgcaattgtttgcacagcttgcatctcatggtttgcagaatatatagcccacatttcagcttctctaaattttataggtcctgacatcttctctgaatttttatcttatagttttccatttttattaatcataatatagaaacaaagttgtgaagaatggtcgtcagttctaatttatggctttgtaggtagttggtgaagagtaactagttttgtcagttttgttagcaatgaagatactaataagacagttttgtttgataccaattgtacttagttttgtgtaaatggacagtacctcctactgattaacctactaattatacttagtttttgtgtagtttgttagcaagcctactaaccttgttttattagaatgcattgtttgtgattttctcctttcactattctctttgttttggtcaccaaatttaattgatatagttatgtaacatttttgtgttttttttttcaaaaaagttgcaacaaaaaggttgtgtgtcccattcgtagttttggtattttgcccaatggttgctttgttggttagctcgacggttgattgctggattagctgtcttcgctggagcatgttcccaaccggaacagtgcgtaagaaaaacgaacgatccattagcacgtgattaagctatttttttttaaaaaaaaggatcaatacgattttttaaagcaacttttgtatagaaaccttttataaaaaacacaccgtttagcagtttgaaaagcgtgcgcgcgaaaaacgagggagatgagttgggaaacttagggtaagaacacagagtactaaaagcacactcttgttcgttttgtgtgtaatattcatgagctgcattattttatcgttttgttttttttttgttttgttttgtaagctaaaagtacttagttttgtcaccacactgttagctcatatctatatctatactactacttaaaaaaaccgtagtggtgacggtgatttcaaccctgtcagacacgcgtaatactaatcgtacgatcgtgagatcccacgcgctcccctcctacgcatctgccccatcactgcatcgtgctcctcctcctcctacatcacccccatcaccaaccgccgacgtgctcgtctccgtcgctccccctgccccattccccacgccgtccagtcccctgccgccaccgcctccgtcaaaccgctgctggtgcagggaggactccggttcccgatccaaccgacgacgcgctcgtctccttctgctggcgtggggagggcattcaccatcgccgtcgccagcgctgggaggtgcccgcgtcgtcacccgttccccacgccgtccagtcccctgctgccaccgtctccgtcgccaacgctgggaggtgcccgcgtcgttgcccgttcccccatgccgtccagtcccccgctgccaccacctccgtcgaaccatcgctagcgtagggagggctccgcgcggcggactccgaaaacgccgctgccttctccctccctcgcgaaggtcttgttgtccccactgattcgccgctgcgatgcagtccactcccccggtcatgatctccatcatcgtcgcgatgcaagtctccctctaaagttacatatccactcctgcgccacccctccacctcctctctctctaccaacccctaatcagtcaccctgctgcaaaaaaacatttagctgctattcagtttcagaactcacctctttattaatacatttagttgtttttttttatcaaactacaaagttattccatggcatgatgcatctcaaggcttccataatttacttaccatgtgttttgacaagcaatggaggtttttcgtctggcaaaccttgaagataggtagaaatatgcataagctttctagcggatgttggaaactcaacaaattttggtgcgttgaagaaagaaccattctgtacaacatccgttgagaatgaccaattgaataaattatcctgtattaaccgaaaaaactaaagtaccatagtcatattctagtattatccacaatggtagtaaggtggtgtttgggaaagagtgaaggagtgattcccaaaacaccactaaaaggcggactgacttatccttaaaaaaactaaactgttgccttatcccttcctcctgttcccctctgcctgccttcacggagaacacgccgccgcacgcccgcaaagttgtcgctccgccgccgggtcctgcggccacttcctccctctccctgtgcatgcgctctcttccccacctgtactttactttagctgctcctctgcccagttgcccacgacctgacgacccggacatggcgcaggctgaggcggggacgacgacatcgccggcgggttgacgcagaaaggagcgaccacccgagggctccgctggattttcaggtagctgagctgagctgaactgaaccccaatgccccgcgtttgcgccgcccctcgggcgccgccgccgccgtgcccgtgccatgtcggagtagggccgcttcggccgaggtggcgcgcctcccggcacggccctctccgggcggctggccaggagcagctcctcaccgccctgcgcgagcagccggaccccgacgcggcgctccggatgctcaacgcggcgctggcgcgggacgacttcgcgcccggccccgaggtctacgaggagatcatccgcaagctcggcgcggtcggggccctcgacctcatgaaggtgctcgtcgcggagatgcggcgggaggggcaccaggtgaaattgggcgtagtccactccttcttggacagctacgaggggcagcagctgttcgacgatgccgtcgacctgattctgaatcaactccaaccattgtttggcattcaggcagacaccgtggtgtacaatcaccttctcaatgttcttgtggaggggagcaaaatgaaactccttgaatcagtgtactcggagatgggtgctaggggaatcaagcctgatgttgtcacattcaacacactgatgaaggcgttgtgccgagcacatcaggtcaggactgcagttctcatgctcgaggaaatgtctagcagaggcgtggcgcctgacgagacgacgtttaccaccctgatgcaaggatttgtcgaggaggggagcatcgaggctgcactgagggtcaaagccaggatgttggaaatggggtgctcggcgacgaaggtgacggttaatgttttgattaatgggtactgcaagctagggagggtggaggatgctcttgggtatatacagcaggagattgccgatgggtttgagcctgaccagatcacatataacacttttgttaatggtctctgccaaaatgatcatgtcggccatgccctcaaagtcatggatgtgatggttcaggagggccatgatcctgatgttttcacctacaatatcgttgtgaattgcctttgtaaaaatggacagcttgaagaggcaaaaggaattctgaatcagatggtggatcggggttgtttgcctgacattaccacattcaacactctcattgctgccttatgcacggggaatcgacttgaggaagccttggaccttgcacgtcaggttacagtgaagggagtctctccagatgtttatactttcaatattctgattaacgcgctctgcaaagtaggcgatcctcatcttgcacttcgattgtttgaagagatgaagaacagtggatgcaccccggatgaagtaacatacaatactttgattgacaatctttgctcacttgggaagcttggtaaagcattggatttgttaaaagatatggagtccactggttgtcctcgaagtacaattacatataacactataattgacgggttatgcaagaaaatgagaatagaagaagcagaagaagtttttgatcaaatggatctgcaaggcatttcgaggaatgcaatcacattcaatactctcatcgatggtttgtgcaaggacaaaaagattgatgatgcttttgagcttattaatcaaatgataagtgaagggttgcaacctaacaatatcacttacaattctattctaactcattattgcaagcaaggtgacataaaaaaggctgcggatattttagaaactatgactgcaaatggatttgaagtggatgttgttacgtacggtactctgattaacggtctatgcaaggctggtaggacacaggttgctttgaaggtactcagaggtatgcggataaaagggatgaggcctactccaaaagcttacaatcctgtgctccagtctctcttcagacggaataatatcagagatgccctgagtcttttcagggagatggcagaggttggtgagcctcctgatgctttgacatataagattgtttttcgtgggctctgtcgtggtggagggcctattaaagaagcttttgatttcatgttggagatggttgataaggggttcataccagagttctcatccttccgtatgctagctgaaggtctattaaacctgggtatggatgattacttcattagagccattgaaataatcatggaaaaggtcgacctcagagagtctgatgtttctgcaataaggggatatctcaagatccgcaaattttatgatgcattagcaacctttggccgtttcctggagatcaacaaccctcaatggagttaccgatgaagcagaatacataactgggacaaattacttgaatagtattagggaaatctcaaagagtggatggaatttttgctggttgcttaggggaatgaaagtcttaaattgattataataggtgattgtgttcattcctcggtagggatgaagtcagagcatgaagaagctcatcttggtgcagaaacttagcttattggaacagaatctaggtgctaggtgctgtctgctgccagattagtacctagcgccttaacgaacagtggctgcagatcccatccgcttattttgatcaaatctgattcattttctattccctaataaaagcctgattcatcttcattgcatatggtcgaacctaaggctatcatgtacagttagatcccaacccttcgttctatgagatgttgtcccatagaagaaatatcttctgagtatatcctagtactctaaaatgttcactaatatgttcaacttaattagttttgtaacctcctaaaatagttctattagttttgtaaccttctaaaatatgaattagttttgatctggctgatcttcctttggttaggtactacaaattcttaattcagacacatatttggttttctgaaaatttcatctatatttggtcaggctggcatttgaagttcttattttagtcatatactttagttttttacaattttcatttgttaaagatgataatttatttgttagcacagagcatgtttagaaatctgaaatattaaaacatgcatgttctcatgaaaataaatgttagttttgtttaaattccaatccacatattttttaatcaatgtcagaaattaccatgcttcacttattgacctagtatatgtatagtatttgatggatcatgttgatttggatttgctctactaacttgttcctattccaacaaagatttatatgcatcttgtgttctaaaaatgctacatgtgtcaagttgaaggaaaattctagctatgtggtgtcctaattttggtagatggtacctagtaatagataacaattctgttttatagtgatgagtaaatttgactaaatcgagtctagaaagtgatataattttctggagaagtctttcttggtgatttgggaaagggccattacctatactgatatgaaatctggaactagaaagatctgaacatcaatgttctaaagttttttgtctgaatttcttgtgcagaatatgaaggaaggtggatctggaataggtatttacatgtcctgttcagattcctgcaatctgataaactactgcaatccaataaactcttgatctattgttttctggatttttttttgggtgtagagtattaggaaggtatttgctttgttacaggggttggttggatgttcagaaaaccaaaatctgaatacactaacacattagccagtgttttattttagtttatgttattctgaccacaacaccagcagcttcaattggtagtagaacacactctgatgcaattggtaggtgtacaacagataatttgccgtgaatgctacttaattcaaccattttttttccatacagtgctatacaatggcacacaaacatccttcagttggactcaaatttgtttcagctttgctattttacagtcacctgcagttttttctaatccatcagtcgattttgttggcagtagattctgcttcaagatctgtgcacgcagtggaggcacatttggttacaggctgcttcaccagacccgttaacccatgggccatggatgctcccctagtagcatatgttgttttttccaccaactgcctcttgtaaatcaagatgctcccctctccacatttgctgcagacttcctccccgtggatctgagacgaactccggcgaccggcggcgtctacgagccagcgttcaccaatttctcaggtatatgagtcgtcatctatgtgcatctgctactttttttttttggctgattggacgggttgagaaggaggtgtttggggggaagagagcagaataatcccattgcgaaacaagcgaggaaggcttgtcgatggtggcggcggtggccttgattatcgaagatgcatgcgtgagggaaactgtgtgccagggaggcaagcttggtggcacacatcgagtggtatatcttcaggttactgctagatcgaagatcctttggtgcttgatgtgtgctgttggtttggtagttttggtggtactgtggcaagtgaagacacgaaagaggagctagtagaggcttagagtctggagtcgtaatcgatgtgcaagagcatcaatgccatcagttcctctgggcagcacggctctgcacttttcatctgagaaacatatatattttgttgattctgattttgacgaattatccaaacatgcagtttttttgggttccgcgtgcaaagacgattttgatctcctggcagatttaagggtggtattttgtttttgttttgcatgtagatgatgcattttgtaaatcattttaggttgccccttttttttttgtttttgcgagttcttactgaatttggataagttctggttgattggatcgacattctgtacatttgcaaggggattctatgggtttttgcttattgctaatcaaattattttgtgagttttggtttattggatggtgagaaagcaagattacatggattttgcttcattgctgattttgtcgaaatttatcaggcatgcggtttttggtttcttgaatacgaactacacggacagtactcctatattcttggtgattttgaagtgtatttgttattttggggaggtggaatggttaatattttgttcaaggggacacttctacagatgtatacattacttttgtcattttcagcataacaaagagatttggtagattcagaattcagatggcaactacacgtcgaatgatgtatgcgaagacatggggaattctgatgctgattccactgaagaaagctaaacataattttaatttatttaccaactcatttttctgtcaacacatttgctagatagttgctacccgataaacgacatcttgaaatctgagttatacttcagtctattttttttccatactctgccttagttattcaaacaaaaaaaaaactctgttttggtgttagttctgtcttgcgagagactgctgcaggtggaagtcgtcttgattttagaagtcagggactaataatgaacccttacatgcaaattgcactccccaatcatcgaagttaccattttcaatcatgtgcaacttcaactacaaatttgtgcaattttggatataaatttgtgcaactattgattttattctataatttttttagttactagtctggctttacatcacttggacaattatatcatgttcatgttttctgtggtttttttttaaaaaaaagatgtatagttctgttagtaattacttggttactccggcactttagtgccattttttttttacttagcacataaattgattagttagaactatgtgcggtttagctaaagctattaggatgcttagccctacttagaaagatcggtgcattaatgggataacttatgttgcactatcacttattgctgttcatttaatggtagctcacgattgtcaatcgtgatagttcaaataatgaatttgccaactaaaatctgataatggtaggttgtgagcatatggttttgatggtcgtgctcatgacaattaaggattagttcacgagctactgttgtgaagtattaatcgtactaaccacaagccaacgttggcaatggctaaatgcgttgtatagcatagttcatggtggagtgtcagactaagaagtggcagagataagcccactggggtcgctggggagtccataccctggtctaaagggggtgactatgactcgggaatggtgcactactttgaattgtgttatgcgagatatcttgtcacagctcctttccgagataccatggtggtattaagacatatggcaacatgttgtggggctgtgtcttgtgggtaaatttgtacacttcttcccagagtaaaactattcgaatagccatgcccgtggttatgggcgagcttagcaatgtctttcgtgtttagtctcaattactcaacaaataataataagtgataattattttaaatccttgtttggaatggttaattcctggtttggagatagggtctgttcaaccgggcatggttgttcagatatggttggacctatgcaacgggtatgttgtatagcggtggattaaaattgtttaattaagtactttattattttataaattttaaaaaagtttattaaatgtcgtttatgcaaatgagcatgtattatgccatcctttgtactcttgtgcactttcatatttgttgtgtggcttgctgattatttcatgtactcaccttgcaataatcatcatcagagaaggagtacttcagcgaaggtgatgctctggaggattaggccttgtcgtagt

SEQ ID NO: 58800 - DNA, 1040 bp, Oryza sativa
tacatgtaatcatgcaaaatcattattaaaatattatttacttcaaaaactcaagacaatcaaaatggagctagctacttcgactagtcagttaaacttcagttattctggcaggattagccattttaaggacaataaaaaaaactacaattttctactgtgacacataatttgaagatatatcatgaacaaaagaaaagagacaagtaaacttacatctcacatttgttcagaacagaaagcctgcttggaacacatgattgtccttttgctctgcacacagaactacaagattcgcccctcctgaaatcaacattgatatcatagagcaattgtgagggtgttccattcactcttcctatatagtatctcttaaattggaaaaggccttaccttcctatgctgatgttaatgccatccagccttggtccagaaccagaatcagctgatcctgcaaaataattttttataatcatttcccccctacgtaattaaagaaaattgcaattgtactagtagtgaataaatggtagcagcttttgtgctgcctgggcaagctcagctcagattaagctcgaaacttaaaacaacatgaatacaatgaatcttagttcatcgtaagtaattaacatactcagaggaccagggatgaggcactagattggggatagggagaggtgatcatggagaggtagaccaattcacctttcttgcttacatcataactaatagcccaccaccttatctctaatataacaagagatagagatcttaaaaagatcatatattcaaccggactcatcttatctcaataaaccttactaatgctatctaaactaatgagcatacatcgaactagattactgtctaattcgctggtgaatttcccagacctgcatcctgttatggcccaatggactgcaagtgttttaccagactattggcctgccataacatgcaagcgacatgttctgatatcttggttccttcattctgtgaagttaaaatactgttgtctcggttcttatttagtgttgtaa

SEQ ID NO: 58801 - DNA, 9220 bp, Oryza sativa
tgttgcagggttcagcaaggaccatctcaaggtccaggtggaggcgtcggggagcctcaggatcagcggcgagcgcgccgtcaacggcggcggccgccattggctccacttcctcaagcgcttcgacctccctcccggcgccgccgacgacgcgtcggcgatcaaggtccagctcgacaagggcgtcctctacgtccaggtgcccggccccggcgctcccgccgccgccggcggcagcgacggcgagcagcagcagcagcaggagggagagatcgccggcggccgccgccgcgcggcggcggcgaggcgcggcgggcacccggcgtggcagctcgccggggcgctgagccggcaccggcaggtcgtcctcaacgtcgtgatcgccgtcgtcttgctctggctcgtcacgttcgccaacaaactgaccaagaacgagtgatacaaaccgcgtcaccctatgtgcaaacacaatcgctgcataacatggtatataccaacaagatatggatactttccagtgtggacgaggataaataatggaataaaatccctgtaataagcataattgggaagctcaggatattgattaactgtgctgataatttctgcgctgaactttcactgcttgctagccagagtgatgtcggaaatcactgagatgttctgagatgttagacaggaactcacgggggtgtggactgatgatatggagtattgtacaggattcagcaactactgtaaatctgtaattcagtgtttcttccaacaagcaacgcgcaaacaatgtcgacgaagatggacactcccctgttgtactatctgatagctccaagcagatttgcaccaccgagcttagcaccagttaattgctgctcaaaagaacacatggattaaattttagaaaacaatcttgaactactagaacctatgatgccacattcccacgttagatccatatcaagtaaattgcatcttgcagttgcatgatctaaacctaggggaagaaggtacacagaattattgaggttgtgcacttttatcctactagatgcgactttcctgtgcattcatatgtgaaacagaaatagataactggctgccatgaagtggagtgataggaagtagacatacagtttcacgtaaatcaacttcccgcaggtaagctcgctgaagatttgcaccttgcaagtttgaaccagacaatttagctccctgaaaaagtgaaaaggatactaatttagatttgtctcgtctaaatggcaattgttggaagagacaataaaaacttttagtatatcttcagtttccatgatgcacaacatgagagatagtatgcctgaattggtacagaggttattggacattgtcaaatcttactgaaggaaccattctagattagtaacacaaaagattatcagcttatcctgggaataaatgcatcacaaattcgcaatgtacaatttttaccttcagattggctccttcaaggttagctcctgtcaaattggcacctgtaaggtctgccctctgaaaatccatgtaaattgaagtattgaacaattggtgttaaaactgatcatgagaatcaaacagcattcaacttattataatatgtgtattgtaggtacaaataagttcacatacggtttctctgcaaagtgacgtacggggaaaaaggtatgtgcctatatggtgctacacataaaaaatgattggcatggatccagcatgcaagatgatatattagaatattagatgctacagaactagagaacaaaagaaagactatatatcgtaaatgttaatgttttttggcttcaggttcatcatcataaaaaaaaacagtttcctatattataagaaattggcagcagtgtccttgcacataataattaatggaacagaatttcagttagcatatagcagaaatacgcagcaatatggagtactgaacacaattttttatttccaaacctgcagatgtgctgaacgaagatctgtttcaatgaagctacattttaccaagcatgcatctgcagaataggctgaagaatttattgcaactactcatttgtttatattttgcagagaaaaggaaaactatgcaggttcaagcagaataatctgtgatcaagtaaaatgtgaaaagaatagaaggtcaagtaccttgcaggtttgcactttgtaggttggctctgtccaaagtagactcttggagatttgctcctacaaactcacacctgcaatttcatattttgtaattactaacagaacctccaaagtccaaaacatgaactagctaaaggagaagagaaactgaagggaaaggcgactctgaaatcttcttactcacgcaaattagcataattgaacgaagatcgagaagcttgaacctcctgcaaagaatacataggtgtttcacaaccgaattccacacattaccaattttcagtatttctcagttgaagcaaaaacacaataggaaattcatcaattaacactgagttgaaatatataaataaatgagatgtaaaaatccaaataggcaattcatcaattaacacatatgcaataagcagaatgatatcacactacaagttctgtacccgaaatttagctttgtaaagattggcaagggaaaattttgtctcctcaatacacccgcaactgaaatcaacttccgataagtcctgcagaacatagggaaaacaaggcacatacaaacaagttcaccgcaagtttacaagaagcatttcagtaacaatggatggcaaactacacaagtgagctttcccaagagcttacaagcttggacaggtcaaggccagaaaggttgacgcctcggaaccggactttatcagcctggatgcacttgatcacgtccttgcgagtcagctcggcctctgaagatcttccaatcttatcatcccaatcctcaatcctttcacttatgcaatcgatcaatccctagaggatcaaatcagaccaaaccaaaaaatcaatgtcaggttctcacacagcattggggtcaaaatccccccacacacacaaccagggtggcaggaggcattgctcatatacaggaagccggtagtactccgcctcccgcagcagctgccggtactcggcgtcggcgagcgcggggacggcgccgtccctgagccagttgagcacgtgccggaacagctccccgtcgcggtccacgaacacggccccatcctcctgcagcgacgaggtcagccgaggagattaggagaatcaaaccacaaccggcagcgaggggcgagcggcgtacggtggtggggaggccgtgggcggcggcgccggagagcgcggcggcgaggagcgacccgggatcccgctgcgtgagcgtgtccgccgtcgtctcgtacctgctgccccctgcatcggcggcgggctcgcgtgagggggtgagaccaatttttggatcgaatcgagcagaaacggatatgctacgggtggtggaagaggcggcggaccgatgttgaggaggatcggcggctgcatggcggcgagcggcgcgggctccggatctcgccgcgcttcgctcttgcggtttctatggcgcgcgccggcgctgggcccgcgtcccgccgcggcggcggcggcgggggaagccgagaagtgaggcgggtcgaggaggagaggtcgcgccggccgagccgagggcagagcacggtacgcgcagcagttgcagccactgcagcctatgatttcttgggatttttttcgaatggtttgaactttgaactttgaaacgataaggtgttttaggctgtgtttagttcacatcaaaaatataaattttgttgaaattgaaacgatgcgacggaaaagttaaaagtttatgtgtgtaagaaaatttcgatgtgatgaaaaagttgaaaatttgaagaaatattttggaactaaacacggcctcaattgtcttttcgttttgaaataattgttcatatcctctccaatataagttttagaaattcatttcaacgtaaaatagatatgtaataaactcggatctttagagattgtgagtgtgtgtttggcattaacaaattacgaagaaaacttcattgttttctatgtacgcgcttttctgaattgttaacggtatgtttttttaaaatatactctatagaaatgtttcaaaaatcatattaaccaacttttcaagtttaaaataattaatatttaattaatcatatgataatggttcacctcgttttaggtattcctcagtcttcttcgttccttccctctcaaacacaatcttgggtctatcgtactattgagagaaaaaaaatttggcttgtgaattcgacgtaataatcaatataactttatattattttgtattataggtctattatattataactaattgtgttttttataatgtcaatgcatatgcaagtcatatcctatattagcaaccatgattagggccactctatagcccaatgtctctttcgtttatctctgatgctcaaagatttaattcaaagggatttttgtctccgtacttaagtttctaatatttaataaagaagaatattgcttaaaaaaatttaggatcgatcaatgcttgaaacatatctataactctgaagaagatgtgcaaacgtagaaaaggaaaagagacgtcacgaaggtttatccaatccaatattaaagccttcgacaaacgaggtgtgactatacgtgactataggagaatgtaaagtattagccatacacccgtaccgtaattatgatataaaatagagtgatttatactttggatcacattcatatccaagttttagtttgaaccacccattatctcatatttttattccagattagatatttttacctttacaacgtttaggactatgtaactcttatgcttttattaaccacattaaacttctccttcgacaaagatgttagctgcacgtaaataaaggagattatcagcatgaaggtgtcgatatgttcgaggttattgatatgcgcatgaagagagtttgagtggtctaaaaaaagataaatatatagcgtagagtgaaaagatgaagtaaagagtggtgtagagtaaattttagataataaaagatagtacaaaatataattcactttataaaatataaatcttgttcttcaatctagtcaacatgtgaaagccaaagtgagatatatatgctgtacactacatcgaagatatacgtgagtgttattttgtggctagtccataagcaatagctattttaattttagtgtcatgttatatgatatctaaacttgaagctgaggttttgggagaatgctagctatcacgcgcctgatgggatcatgggataacaaaatattgggctcttttccaattgccggctcacacaagaggatggtagcccctcccaaccttcatcactatcaacaccgtttcgccgctgccagaaacccccaagtcatgtcaccactgctttagcgccaccgacgtggtttctccagcctgccaccggtgataacctcaagccctatcacccctgcttcgtcaccaccgatgccgtttctttggtctcatcctccgctagcagcaaagccgtattggagctctacagttcggtctactcctctctgttgccaccgaaggagaagaagaagccgtatctgactggtgtattttgtgattcttttttttatgtttcaaccaatgtattttgatgtttatttgtgttggatcaaaatgttgcagtgagaatttttatgatgttttaatttttgtcttcagttcttgtggatttgttgatgtttcagtaattgaagctttgatgttttgtgtatctagacaaagtgttttaatccataattcaaccgtgtttcatcacttaaatagtttgaaagctagtggtgaagcattcttctccaaatactgaaacaacgcctgattttgaagataaaatcagaagtccgatttgtagtttcctccatatttttatttcgaaaacactgaaattttagcatcacgaagttctcaccgagaccgacccgcgcgcttgtgcgtttgtggcactaaccaaaccagctcggtggtcggaatcggatcatgccgaagaatacccgactcaacccaaccccggtcggttcagttccgttccccttctccataaaacgcaacgaaacgaaacgaaaccccccaaatcccccaaacccccacgaagaagtagaagagagaaaaaagctctcatcaatcccacacccatggcctccacaaccgccgccgccgaggaccacaagggcaagcgccccctgccgccggaggaggcggacgaggcagcggctgcgccgccccccgccgccgcggaggaggagggcgagaagctggtgctggtgtcggacgacggcgtggaggtgctcgcgtcggtggcggcggcgcgggtgtcgaagacgctccgcggcatgatcgaggacgagtgcgccacgggcgccatccccatcgccggcgtccactccgacgtgctcgccctcctcgtcgagtactgcgagaggcacgcgccgcactacgacccggaggcctccgaccgcgaccgctacccgttcccgcccttccccgtcgagctcccccccaccgcctcctccatcaagcccgtcaccttcgtcgaccccgacgccgacccgcacggcctcaaggcgttcgacaagaagttcctcgacgtcgacaactccaccctcttcgagatcatcatggtataagcgcaaccacacccccgccaaaccttattctgtttttttctcccccaattggattgtgtggtctctcgattttaacaccgattgttgcaatttgggatgatttgggaggctgccaactacctgaacatcgaggagctgctcgacgacgcgtgcaccgcggtggcggacaagatgagggggaagaagccggaggagatccgcgacatcttcgagatcgagaacgactacacgccggagcaggaggcggaggtcaggagggagaacgcctgggccttcgaggactgaagggagaggaaggcttggcttgttctgactattagaagataggcctccacagattgagttctgaattactgaaaaaacttccatactggtagaatcaaattaggcatcgaatactgcaaaattttgctgtgagttgtggtggatgttcttctgatctggttcagatcagcacaaaacagttagatagagtaaatcggtatgcttattttatatcttgctcagcttcagtaattagtttatttttgcttggatggttctgcagctgtgagatgttctttacctgcctctctgctaggaattgtgaatctgttatgctcaattgctttgtcagggtatgatacgctggctaaatgcgtttgtgctatttctcgccgggcataaaaaaaatttcaccgggcgtgtttgtgttagtcgctgttgctgttcttggtgagttgagattgtcacctccagttttatgcctgctagataggctgcaggattgatgattaggtgtacatggaagattatggcagaaattaagttagcatcctgcaagttttagtgtgaagatgagtatttttagatttgttcatatcagtactaattgccttttttagccattcatctctgagaaatcttcgcttgctagtatcttgcttagtctggcagtgttatttctgtttgaatgcttgataccttctgcattctgttctcagctgtgaagtgtgcatttctgtgatgtttagtttgcttgatcagtatgttggtaccccggacacagattgatgattaggcgaatagagaagattatggcaggaagttaaccattctgcaagttttagtgttgaagatgtgtacatgtatttagattggtttatatccgtactaattgatttgtggattgcacatttgtgatcaagttagttttttgccgtttcgcaagttcatatctgagaaattttggattcctactaatcttgctaatttagtctggcaatgctttattttctgttggcatgcttgatgcctttgcattctgctctttgctgtgaattgcattttgtgatgtttagtttgattgatcagtgtgtttggtaccatgaaaacaactggtgtttgtttagtgcccaatcttgcttatagtgccttatctagttatctagccataccatcttgtgggcatgtatacatagaaattatacaatatgaatgttgcctgtacaaggctgtgaatgacattaggaaaactttgcgaattgatgcattcagagttcaggtggttcatacctggaaattatgaatacttgagaagtcacatgtcccatgagtgctataaaaggattgctttactcaaaatagtgcggatatagccatattacctgggcatttatgttctaagattttctggagtttgagtatatatatacttttgatatatattgtttttcaaaatgttggagtagcatgtttagttgacgccagttgcaacgcactgacactaccacctcagtcaagaataaaattcaagactattaaggaatggcaactttagctcaaatttctgagagctacagattacaattaacttgggcacttttggacaaaaaagttaaaggtgttatcaaatttactcaaattcgagttcccttttgctatctaaagcaagcgacgatcgatatgttggtggtagaaaaaaaaatccctcaaaaagcaaaagaaaaatgaaatctcactcaggtgtaaattgaaggagggcatttgtcacgtacgcttattatatctgcaacagatttcagagcaaaaaaccaaaacaccggcatgaaggggaagaacgggcaagtttgatcaccggcgtcacatgagccacgacgacctcagcaccagcgccggcgtccgcttgtcgccgtccatggcgatgacgaggcccggctgcaccctgccgcccttgccgaggtcgaagctgaggaacccttccacgtgcggccggtgcgcgttcctctccgccgtgccgccgatccgcaccccccacccgagctcgtgctccgggcagtcggacacgcagactccccaccgcgccaccggcccgcgccgcctcgccggagtcgccgccgccgccgtctccatctcgacccagccttctgctctcaaggtgtcgtacatgtcgcagtccaccatgacggccaccgtgtgcgacgac

SEQ ID NO: 58802 - DNA, 663 bp, Oryza sativa
agcaatattgaaaatgcattttgttgggaggagatacaagaaagaagtccatttgttcacacgtctcaccggatcatcgaaccaaaccggcccaataaccccaaaatcctaccataaaccctagaatcccctccaccccaaggcccagccgccgcctcctcccttcctctcttctttcctcgccgacgacgcgattccccaccggcgtacggcggcggcggcggcgagggatttcgccggccagctagccccatcctcaacaaaatcgaggggtcggttgctctcccggtggaagagccccatggccttcgccaccgccccgcagcctgtgtcctctccattcgccgcagccggcgccgcgtcgaacaacccccacaagcgcaagaagccggcggcgagggggaaggggaagggcaagggaaagggccgtctcgccaagacgcccaggcgctccgatgaccccggcgaccttccccgccgccgcagcaagcccagcgacaggttcctcaagctgctccgcaagcgcgcccgcgactacaactccgacgacttcgacgaccaggagcgcctctcggatgaggacgaggaggaggagggggcttccgcttcggtgacgacgaagcccgcggcgcggtgaccaggttcgagcaggggtgccgcgcg

SEQ ID NO: 58803 - DNA, 624 bp, Oryza sativa
ttgttgtaattgcaattgtaaagtctacgtaaaaaacataccggattattcttccgttgccttgtatctgtcattgctggattggagtgtttcgatttgtccatcgtgtgtaatattcagatatataactaatatatttaaatttcacatgaaacaatcaagctgaatggaaaccaaatacctacagcaagaaacatctatggaacgcgatgcacaagcgccggcggtggccggacctcgcgatctgcttttctttttctttccctgcgctctcctttttgatggagagcgactctgctcttcgatggagagggatcgagcgacgcttgaccataggacgcacaaatgagaaaaaaattaagtgtcagatttacccctattcggttttagcactttactaatttaccctttaaaataaacggtcgagattaattctacttggagtagaatactgcaagtagagggcaccggagcgtctctccggaataaaacgctggcaggcgagggtcaatggattcacagccggtacccatggacacagatacatcaagcttatacctttttctacgatcgttcacctcgagaacttggttcttgaggttttcaatctcttgagaaatagta

SEQ ID NO: 58804 - DNA, 666 bp, Oryza sativa
aaactctatccccaaacaaaaagagccccttacatagaggggtttcacacagattgaactagattatgatgtgtccacaataccatcggcacgatcatggttgttaaggcgtcgctgtagcagtaaggcggttgcggaggtcaaggcgtccactccgccttatgtttcctccaccttagaggcaaaacgagtagagaaagggaaagaacaggaaaaaccagtagagaaaggaaaggaagaagaggtaagctcatcatggaacctagttggcttgtagagaaagagaaagaagaagcggccagagacattgatggcggctggtgcctcttctcgtcatggcggctggtgcctggtggtgtacgatgtctcttagggcataaaacacgtgggtatgaagactaatgttggtctttggtgggctggttgcctggcttagtgggccttttaccaatttcctttttttttcttcctaatttctctaccatatcctccactaatcacgcctcaatcatctcataaggcgtcgcaatgttacgcctcagcgctatggcgctaaggcagtggtgggtcgccttaaaccgccttaacaacactgggcacgattcaagtgcacaacaaaatttggggtgactttgctagacgatttcaaatctcatgttaaatcgc

SEQ ID NO: 58805 - DNA, 5343 bp, Oryza sativa
cgccgaggtcgctgaaccgggacgccggcgagcggacctgccacagccccgacaagctgagcttgatgtcgtcggccgtctcgtagctcaccttgccgaacgtcgtcaaccggttgggcacctcgtgatcgccattgccgccgccgccgccgccgccatgttcgcctggagaaccaaagatcagctcagctatggaggccctgaatcttgatcccttgatgctcacgccggcgccgcagtcatgacgctccgaatacgacggcggcccgccggacaacgctctgctctggatactctgcggcgaacagtttcatcgtcagacaaaagctcgccgccgcaaccgccaatactccagcgagctcagtggcaagttacctggatcaggctcgaaccgtgcaagaagttgttgcactgggcgccaaacgggacgagggtcatcgacagcaggtcgctgacgtgggcgcagtactgcagccgggtgagctccagtggcctcccgccggccgccgccgccgccgccgccccgagcccggtggcgagctccgcggcgacggtgtccttgccgccacgggtgctcgactcgaacacgaacctggagccgagccccgtcgtgttcctggccttggcgagcctgtccctcgcctgctcgagctcgtcgccgtcgacgaggagcagcgcgccggccgcgtcgagtgcgaccttcacccggacggggagctccgggaggtggaaccccttggcgctgctcgtgtacagcgcgacgaggcggtcgatctgctcgtgcccgtccatgtgcttgatcatgtcggcgaacttctcccgctgcagccgcttcatgatctcagcctgcaaacgcgagtgtctcagtgaagaaggtaatcgccatggttgctgatcgagtgtgttcgagctcacgatcgaggcgtacgcaccgggcggttgtggtggtggggatgctgctgctgcggcggcggccgaggcggaggcggatgccggtgagtcaattggccggagttgccgcggaaggcgaagcggaggagcgcctcgccggacctgagcaggctgcggaagttgtcggcgacggtggggatcggcttcggcgtaggcagcggcggcggcggcgacagaggcgcgggctcttgcggcggcggcggtggcagcagcagaggcgtggggttggaggaggaggcggccatggcgaggcggctgctcggaggcgacaggtggcgcggggtcaggtggatttcttctttgcttcgaaggggatttgagaggagtggagtactggagtgtcgctaggcgcttcgattcccgcctttttctttccttcacggctcccttgttcggttattcttgtgtgcctttgcctcttttggcttttgcttttgctttattacctttcatttttcgatgtttcgatgtattcggccttgtctaatctccatttttagtctcgacgtgctatttacgctatattaatttgtcttgacttgtatgtgtgtgtgagagagaaatgtagagggggtcgggggcgtggcatgtggatttcgattgaatttaaaggaaaaagtacgaattatcctctaaactatcgcggtcgaccgaattatccccctaaaccacaaaacctaatattttttatccccaactatgcaaaacggacaactaaccccccgcttcaatccacgttggttttggtcctacatggcaatacaatcagcaattcttttaattaaaaaatcggtggaccccacctgtcagctcccctcctatctctatcccaatctctctctcttctcactctcctcactagcacaggccacggcggcaccgaggatggcggcggacggcggaggcggaggcggaggtcacgcggcggccagcagcagaggcgaaggcagagctccccgggcagcggcgcgcggggacggccggcggtcggcgcgcacggcctgtgaggaggaacgcggtcgcgatggtgagtagcgcgaggaccgcggcagcgccggcggaggcgacctgagcggcgagcggcggaggtgaaggcggagctccccgggcagcgggtggcggaggcggaggcagagctccccgggtggcgggtggcggagacgaaggcggagcggtgcggccgacggcggaggcggagcttcccgggcggcgggcggcagaattggagctccttcggccgtgccccgcgcatcaccctcctactcctcgtcgttgtccatgcccggaccacgctgcggcgctccaggcctagcggcgccgcgcacgcacgaggggccactcggcggcggcgacagcgaccaacaacgccatggaagagggcgtcgacggcggcgacgcgggagcaagcgtgtgtggtcggtggcggcgaggtgacgacagtccggcaccgcatggagagggagaaggccgcgccggcgagcttgttcgcgcgggaccggcagccatcactactctcccttccatcctccctgagaccggtggccatcgcgcgtctcgtccccaacttccgctgcttttctccatccttcctgacctcggtggcctctggtggccgatgtcggcgagagacagagagagaggggacatggagaggctgagagaggatgagagagatctgacagtgggccccactaattttttttaaagaattgctgactaaactgccacgtaggactaaaaccaccgcagattaagctgggggggattatttgtccggtttcaatagttcgggtgtagaatgtctggtttttgagtccgagggtgtatttcggtcgacctcgatagttcaggggggtaattcgtactttttccaatttaaaacgtctgagttgacgatgagatttatgcatgatttctctttctttttttttaatgatcagctcgagacggcacgatgatttattgaatagaatatgaagaagttacaaggctagtacccctataaagcaatagttaggaaggaaaaaaaacactaccatgcaccgccagcacctacacataatcaaggagaaagctagcatcagactggacgccactaagcgtgatcgatcgccgctaaaccaacaaggccgtgagtagtagtagtttggctgttgctcttggtctgaggcatatatatgagaaccaacttttgtgagcatattgtgcatgcttgagcttatgtgaagcctcttctctcctctctagagtgcattacttacgaattgagagtggtagaggcattgtgcttgtgcatgcgattgagctttggcgcttggtaagagttaagtgggtcttgacttgttactcttagtgtttgctgacatctagagggcttggtggcggttgtgacccagtgacctctacaaaggagtttgtagaggaggcccggtggttgactgtgaaggtttggagctcacctatccagagatcggagaagagataccactagtgatcgaggcttgggagactaattcaggactggctcccgccttgcctatcccttgacgaaggggttcggaggctcggtggtttaagtggtgaagttgggctcacctcaacagtggcgtaggaagccagtaagcttccgaattccaaacatcgggtgaaaaaatcttctgtctctggtctcttttatttaatgccaatttactttgaacaagaagatatatgaaattgatgtatacatattgccccgaaaaaaaagatagtatatatatatatatattcaaaacaaaagcagtatgttatgatactacttttatcatggcaaaatagccattttcgtccctaaactatcgcccgaggctcagtttggtccctgaactatcaaattgtccaatttcgtccttcaacaattgatttcgaactcaatctcgtccgttccccttgatagcacgccacgtggccagctagacatgcgaaatgtccgtcctgcccctcgctcaattctttacatgttggatggctgacggcgtcgtcctcgtcttctctgttggtgcggcttctgttcgtcgtcgtcgccgccggggaggaagacccactagccgccggtccccagttctctttgcctcatctgcttcatccattctatctcgtccatctcccccatctactcgctcctcgtttcctccccgatctggtcgctccattgtggaggcggcatccgttgtgcctgtatccccatggagcatgggtccagggaggggagagtgagaaggtcgatgccaagaatgggagtagcgccgaatcccggagcatcgagttctggcgctcatggagctgcgcgcgcggtggaggtgagtacagagctgttggcgctggggctagggttgatttgaattggggattgatttgttttttgataaaaattcgtcgatttggtgcagcttgaaacattgcttgaagaacattcagaggggatgctggtgaggacagggcttacatgtcggcatggattcttcccaattttgtgttgttgttggtctggtccagacactggaagaaggttcctggcatgctcccaagttgagcagccctgtgatttcaagtattggatcgatgaacaatttgaaggtagagcaaaaagggtgattcaggacctagtttccatgaggcacagcatgtcggagctgtacgaacattcatctagacaatgggatgatatgtatgctgatcgacagagagtaaaacaacaaattcatgaactaaaatgtactattaaagaacaaagagagtgcattgtaatcttaatttgttttagcattgtaattgcttgtggtatatggctcattgtgtaaccactatttgaggcaatgtggaatgaattgaaaaacaattttaacatgtcttatgctcttgtccagaaacaaatttaacatgtcttatgctcatggttttgacataacaaatgcaagcgttcatgacatcatgactaactgatacaaaagcattattgctttgggactatatttggcaagctacatcatcttgttcttgaaattcagcagcccatttttctgtgatgagctgctttgggcagatactgatccacgaccaagtgaagttgaatggatttttgcagaggcatgcccaccttttacattgattgttgcctttgcaaatgagctagcagtcccagcattggtttcaatgacaacagaagcactccctccagcagatgccttcgccgatgcttgagcacttgacttcgcagatgcttgagaactctctccaaaagataccagtcttctcttatggccagactgtaaacaacaaagccaatttaggcaaatatacaaattacttaggctatagcatggacatgtcataattattacctaacctgtataa

SEQ ID NO: 58806 - DNA, 5635 bp, Oryza sativa
gttggataccactctggagttgttgcaatggaaggcaaggaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaattggaaaggacgcacgaaacatacggtttggtttgagtacggatggcatgaatccttttggagagatgagcaacggccatagcacttggcccgttacgatgtgtatctacaacctcccctcctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaatgattggcctgcacttagcaacctatccggatagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataaacacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgcttgtccagaggcaagcatcgccaagggttatggaacagaggaggtcatcgaattttgcgtagaatttctcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcatgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgaggattacaatttttattaattttaaatcatgcagtatgtacattaatatcttaattagagtttttaccaatataataatatcattcatatatatgctaagaatatatatatattggaatttttattaattataagtcatatatttgcttttacggtttatccacttaatttattacagacaaaaataatttttcgaagtaattgtcatcaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggagtaaagatccaggggtatatatattcccggtgcgccctcgtcttcttcaccaacacttaaacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgccgccagatctcccttcatgcatctcgatctctccgatctcgatctctctccgtcgcgccacccgccacgagacgccgcgccacgacgacgacgcgccacgccgccgccttcgacgccgcgcaacgccgccgccgcatgccaacgccacgccgccgccgccgtcgccacgccgccgccgccttcgccgccgcgcgcgcaatgccgccgccgccacgccacgccgccgccgccacgccacgccacgccaccgccgccacgccacgccgccgccgccacggccccacaacgccacgccgccgccgccgtcgccacgccgccgcgccaaccgccgccccgatgccgccacaccgccgttaacgaacgagaacgagaacgatcgaacgaacgagagcgagaacgaacacgtcaacgtacgttgccgcgacaacgtgaacgagaacgagaacgatcgaacgaacgagagcgagaacgagaacgatcgaacgaagacaagcgagaacgagggaacgaacgtgaatgagaacaagcgaacgaacgtgaatgagaacgagcgaacgaacgtgaacgagctagggaacgtgaaagagcgaacgaacgaggacgatcgttaacgtgaaatgcaatatatatatatacatatatatatgtatatatgtatatatatatatgtatatatgtatatatgtatatatgtatatatatatatgttacttcgtatttatcctaatacatttttttgtatcttgcagaaaagacgtgttgtcggagtcgtccgtcaagcctgaatggaacagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacagaattggtgcgacaagtagcaattgactattgtagtcttaattagacttagcatatacgcacgaaacacttagcatatacatgactattttagtcttagcatgtaatattatttgatttttaatataagattattttatttgtaattagacttagtatataattatttactagctagggttgtataatatacctcacctagacttagcttatatcacgatttgtaattagacttagcacgtaaggttgtgtagggttctaatgtacgacatttacacttagcatacatgacttagattgttaaaacataaatgtctcgtgacttagcaga

SEQ ID NO: 58807 - DNA, 1480 bp, Oryza sativa
ttagcattgggcaaagatggactactaatcttggtgttgaaccattaatctgatataaattgtgttcaaaaaatattttctgcatgtaaattctattgaagtagccagagtcatgctggatatgcttaatgcttttaatccttcaataagcacataatgggacctgaaatccttaacttcactaatatgtcatatattatctttattaatatgcatatcttgatatgtttttgtccacttttggaacaaaaagtcactagttcttcccattttcctttggaaaagcctagaaaccagagcaaccctgactaacctcagatctgttaaaattgcagaatatggtggacaagataaaatcttcagtggcacttcctttccataatttctgtggcggtgcaaaatctccggccactagcattccattggaagaatcagtgcgtcctgaaccagaaagcatccagtatagtgatccagcttgtcagacggaagatgttatacagttgggcactgaaacagatggtccccaacccccagaaaatcacaataaagatggacaaggccaccttgtacctgatgacatggagatgtctaggtcccctcctgagcattcttctgctggtgccaagcaacgcttccagtcactcatcgaaagtagaaaccaacaacagaaccacaagccacaccaagaaccagaatttaaccaccagctgaagccttttgattacgctgaagccagaaagaacataacatttggagagcgtaagccgagagaatcaaagacaatgcagtggccagggcaataaacaaggattctggagataaaggtagaacctcaaaccaattcggtgctggagagaacgaggggaatcgccagaatcctcgggggcgacaggcattcccgccttctggcaacagaagtgctacataccattagttgttaagatgtataaccagagacattgtgttcttgtaagaggtattatgttcatcttagaggggaagtgtattgtctctggttttcatcgttagatacttagatcatggcaatcttttgggggacaatgtagcggctttcttagtgatctatcttgagagaagtaggaaagcccttctggctggtggtgctgggttttaactgaacatgattcagaacattgaggatacttataccagatattgaatcatttcagtaaagcacgcatataaaatatgcttgcttagaatgtggaaatttaagatgatttcattagtaaatactgctatcataatttccctcaaaaaaaaaatactgcaatcataattctagatttctagtgtagttcgtataaatatgtgccttagagcaggtacgatagcgctattaagaaaggctccaaaacttattaatcagcctaatacaaaattagggaaagaaaatcgctaggagagaaacaagcgggcgcttgtattagcgccggcttgcacagcgccccacgccgta

SEQ ID NO: 58808 - DNA, 3074 bp, Oryza sativa
aatccatgatattatcatcttgaaatagggcaaatacatcctcatctgcatactgtgttccagattcttcattcccacccatatcaactgattcggtgtatatatctactgttgtagcagttcccagctcatgaatcatgtccaaacatgacttgtcatctacaagtaacctcataccactattcaattctgcaccaatggcaaccagtacatcctaacagattgaggaaaagttgtgtgatccaataggtggccttcaagttcagggatagagatcttgtccttctctatgtgggacactccacaatccccattgcaatacgacatctttgactcatcaagaacaaattccccattaaaatgaaattgaacttccagtacctcaaatttagacattgcttcgtggccctatagatcaactatatggtcaaatttaaacattctacaatgaaatcaaactcaagtgcaaaactagtgaagtgccactctcttacctttgcagcacgtcctctcctcttcctgtgtcttggttgcctatgagcagtccgtctgcccaaggacaagggcacgcctccaccaggagaaggggtgcgcctccaccccttcgaacacgccgtcgtcctgtactgatctccgccccagcccccaagccaaaaccctaacctacctatgtagctgccatgacgaacagagaagacgaggatgagagggaggcaacggggagcctgaaacgccgttagccatccaacatgtaaagaattgagcgaggggcaggacggacatttcgcatgtctagctggccacgtggcgtgctatcaaggggaacggacgagattgagttcgaaatcaattgttgaaggacgaaattagacaatttgatagttcagggaccaaactgagcctcgggcgatagtttagggacgaaaatggctattttgccttttatcatcgatggaaaaggagtatagttgtttgaaaaaaaaagtggaaaaagtagtatctatcccagaaaatagtgcatcgtcggcttcgtcgccatcagcacggtgtggcaccgatagcaggaagggagtagcaattagcagctggcaccgtcgcctgaaatcgaccaagggacgaagcacgctgactagtgcaacggatcggctactcggctgcgcttggatgaagaaacgccacgatcattcatctctgcttcgatctgatgcatggttggttctgctagcacgccgccatgtcgtgccgtcgccgatcgatttaaaaaacggccgcagcagccgggggagcgcgagtctgtaagcaatagaaatagattaatggaagaactaaacagaagcttcgatctccatgcataaacaagaagcaaagaacaggaaagtacggaaggacatggcagcatagaatgttacggtgcccatcttcctggcttgatgagttcgattactccgttgcacgcccggcggaaggcaccactatcgcggcgcgcggacggcgccggtacaccgaggcacagcctagagtcacagcagagcagccgtccggcgagggtgactagcgatcgacgggatgaaagagacaccgcgccgattggcagctgggaacgcggtagatcgaactaccgccgccgacgaacttgctatttattaatgaaacggatcagtattgttgtgccttccgattaggccggccgggataattcagaattaatagaatttcttttcaaaaagaaaaggatcaaacgggtttaatataaagacccggtaggagggtgggatggattgatcggtgcttacctttgatggacggtggattagagtgggagtacatacacctgggtgtatagaaacattttccaatatatatatatatatatatatattctacatccctcccctaaaataactattttacacctccccttctatgggtcaaacccacctccctcactctccctagggcccaaaacccccctcccacctcggtcaaagccccctcccgccggtcaaacccgagtcaaaccgcccattgactctctaccccgcccaccactttgctgttcacgtctcgcaggacttccgcagtaacataacggttattgtgcagtaacatgacaactttctcgcagtaacaacatcgaaaaatagtcatgatggatctagttctcgcagtaacaacatcaaaaaatagtcatgatggatctagttttgttaagtatttttttacgaacatcatggtgcagacggattagaaaaatactatataacctgagagatattgctctctaaagattgagatttacttttttttaagttcttgtctcactgtaacggcgtagtaacgcgacgatcaatatgcagtaacatgactactttctgcattaccaacgttataaaagcatttttgtctcgatcatcgtgtagtaatatgactattgtctcgttgtaacatcgttttaaagtattatagtgaaaacggttctaaaaaataatttgcgatgtgagagatattattttttaaagatttcaattctaaaaattcacttatactaagcttgctactacgtatctttgtatggataaagagaagtacttttagcacttgtgttaacttgtgaccatgcacatacacttttttagcacttgtattttatataagattgagatttaaaaatttagctatgcgcaagcagtggtactgtagtagtactgttactaccatatgttctctgttactgcaatttcatcatgatgttactgtaaaaagtgcagtaacgacctataaattttgcagtaacggcctataaatttcacaataacgtatcgtgttactgcagttctgcgataatgttattgtcgaatcataataataaggtatgatttcctacagtaacataacgggtttgtgtttataaaatttgaacagatatacaggtgaattggttaggagagtttgttatgaaccatgagatcatgggttctagtcttgaattcagcaatttatttttattttttctcaaaaaagaaaagaataggtggaaaaataagagaaaggagggagaagaaaaaaaaagaggg

SEQ ID NO: 58809 - DNA, 95547 bp, Oryza sativa
  unsure (1)..(95547): unsure at all n locations
ggttgtggtatttttattactgtgatgtgagtttagatcattttatttgtcagagaagaaacttgctgtgaggtggaaactcatattttacgcatatgtattcttggatcttcttctttaattgtatagcaattggtagagcataagcatgaacagtctgaacatttcaggcctgattgtttagttcttttttttttttgcattggatcaacgtggtgagcttcatcattagggagcggctccgttctactatgaatcatcctaatattaaattatcaatggctattatgcatctgttcaaagttactgaaatagagataaaatagtgaatacaaatgaatttgtacttgctgtttaattttcctccctcccactatagaatacaccagtgagataattgaaatcaaattattatgtgcatgtgtgacacaaaaagttattatctgcatgtgtttctcattcgattcctgcctccagattgactcacgctgtcaccgccgccaccacacaaagcgctgactcggccgtagccccgtcgccgattcactgccgccaggtcgtgtccatcatcatgccagatccagcagtggacanccnancgagnnncacncaacggtgtaatcggattgtaaatcggatgagtagtttaagagaaaattgtatttgaagtgtaggtggatagtgtttatcatagatggagtggtagctagtttagacaaatcagctaccatagctgtgtagccatgtccttaaaaatctgtggacccataggccacaccgtctcatctctcgtggcaaacagtggtaggaattatttcattcagaaaacaagaatatgcctacctatcttacctcatctccaaaccaaagtaccgaacacacgtttagattttgcagacccagagtttaaaaattatacgccgattgtaaacttgtggagtagatctcgtccaatgaatgtaacctggatagttcacgggtgatagattgggctgcccactctcacatatacattgctgaactatatgtccatatttttttaagactatatatatataattatatggccgtctgatccctacgtcctttatgtgagtgtacaatgtcacggaaactatatattctctctcatcgtacttcgcttcctcgttctaatctcgttttcattcatttgaaacggactacgttatggatatgattctctcttctcataatgatgcgatgtgaaaattttcaagcaattaatgttgactagcgaatctagctaattaattaacgacgttattggttggaagaggagatactgcagaagattagtttacaggcccacaatcacggaggtgatgagatgatctgattttaattaatttgatcttcgttagacaaatgcttggccttttgttctctttttccttggcgctagtcctgtctatcaagaggacttctatcaccccatatgaatgatgcataacccccaatcattcgttcagagaacaaaaatataacaaaaagaaaacgtaaaatctatttggaggcctctcgtttttaccttaaccagtgacgcctaaatatggagaagacgtggagtctactacatcgtactcgtactacatgcatgcatttttttaacgggatggctatttggcagtcacatgttttttcttggctctatcgttcgttttttaagccatcggatttctttgtgattcgtactggcttgtagttcattttgtagtatcggtgtgtgggcttatgagctttttatttgtgtctaggcttttgggcttttttttttgtgtgtggtaattatgtgggacccacatcagaaatttttttcgacagcctgtgtgggacccatgggcactgttcgaattttgaaatccgcgcttgtcttttttgtgccgacggagagagagtgagtcagatagagggagagagagagatatatttctctcgttctcgtcgtctcaggcgacgtggcagcgattccgtcgggcggagcggcggagtttccgtcgggaggagcggtggcgattccgtccggtgattgtgcagtcctgttgcgcagtttgcgggaggtgaaggtggcagatttattttccattttttattgatttcttcttctatttgttgctcttgtgttgattcatctcttcatttttctcttctcgtagtttttggtttgctggtggctacgacgcggctgtgaagttggagctgattttggtgagtttccccttcgtttttctgatattcccttgtgttttaggtcgtcgattcgtggggcttgtagatctgagtttgtttcgactcggaatctatgtatgtgtttgatatggtgaatccccttgattcatattcgtttatgactcggtgatctctgtgttcttagccctatatattgtcttcttgtgcactagatctgcgcttttgcttttgtgaactagttacgtgcttttttattttgttctagaactgtgttttttgcttttttctgaactagatgtgtgcaaataagggagtaatgtacatatgttcacctatctatatgcactgattgtttttttagtaatgcattcaggatgtttttattctagaaatctgcaaatgctatatgttaattcaatgacaaccttatatgagcagttaaatttgttattgatattatcaattgttttttgcatgactaagatatgctggtttgtactaagtttcaagttttatgtctttattagaatggtatttatggttgttaattttttttgtctctgatgcatgttccatgttcaggttcagtattcaaaatgagaaaagtactgttatgtttatggttgtgatttgtgttcttagccctagatattgtttatgtggactagatgtgtgattcatttcattttagatatatctttttatgattgcttttttacatttgtgaactagatctgtgcttttgcttttgtgaactagatgtgtgcaatgtacatttgttgacccttctgtatatccttgatttgcatgttctgtgcactgattgattttgtagtaatgctttgatgtcagtttctaaatctatgcaagaaaatgctatatgctatttaggtggatgtttatgcactgattcaggatgtttttttttctagaaatccacaaatgctatatgccatttgcattttagtttggtatttttaatctttcaatgacaaccttacatgaggaaataacacaagttattgaagatttctgtactagaatgttttttatagtagtcaatttttgtctcttcattttgcatgctcaggtttagtattcagaaggagaagagtattgttaatacatttgttcagaaggagaagagtatagtattcctagtcatcactatactctgatatatgacatgagtttgtgctacacatttgacactactctatgaaaataattatttctactatatgaaagtaatattattttcatatgacatggtgcatttaacttgtatgttttattctgttttgttatatattttagtccataatacttatgttttgagatcttttttctctccttgcagtcatgggtcatagaaaaagatcaaaagttgatatttctagtgaatctaacagtgacaatgattgtagtttgagttctgataatcatgatagtgatgttcatttatctaatcatgatgaaagttctgataatcatgtaagttcatttgtcatgttcatttatcatggaagtttattttttatttcaatattttttttgaatcttcttgtttttttattaaggaccaacattttgaggaaaatgatcctttgcttcatttaactaaagaagagcttatgaagaaattgaaaataaagcttggtaaaaggccatttacagatgaccataaaaagaaggtatgattaatgcatatttagatttttgtaatttacattatttttttaatatgatatttttttattttcagagacataaagttgaatcagactcaattatcgatgatgcattgttagagattcacaatgatctagttctccattctttgaaaatgaaattaagcatgcttggtgaacagtctaaaaataaggtaattttattaccttattacattggtgaataattttttctttagtttttttaatttcttttctttaaatttttttggcagagaaaaacctttgagaaagataaccaacaagggtgtgttctgactgattgcaaattattgttttatatgatcatgatctttaattttttatagtttttgatatgctatgggataagcttgacacttttatatttacttgctgaacatttagctgtgattgaatgcttgtgcaagcatgtgctgctccatgttagaatgtctgcatactttttttttcttgcaaaattaactgtaactttaaatattttttcatgtaatttttttcagtttcttcatatatgtaagttttgtactgttactgcagtcaagaaactgttaatattgatggagttcactgcaaattctcatcttttggttcttcattcaaacaaggtggagaattatcaaattttgtaatgtctgtgttctgtcgatatatgtttaaatcgattcatccttcaaaatccaaaagacactatttcttctcttcaattggggtaagtgtttgtaatttttaatttttttattaaatacaactcagttacttgcaaattgagtatgtattttttttatttcagaatgatcttatgaaacacccttcaaaaactaattttggaatggtccaaaagagtttttctggagcatcacttgctagaccaattgagatatgtgacatggtatgtacttatgtaatgtttaattgaattagtttgtattagatttctctgtttttacatttgtttttattgtatcatttttttcagctgtttttcccaatattgcatttgaggcattggtttctgtttgttgttgatttgaaagatgagagttttgttttcattgactccttatttgaagaagaagaagaagactatcaatacaatgctagatgcagactggtatgattttttttttgcaaattattatatgtatagaataatttatttttatgattgtttcattttgtcatatatcaaaattttcaattgtatggaggaaatttgtccctgaacatccaattaactttgctagtttcaagataatatacccacctcgtccaagacaaacaaatcggtaaattacaaatgttaactctttgaatgttattttaattctagtaatttttattatttatgacttatgttttttttatttctgtttttttagccttgattgtggtatttttactctgaaattcatggaaatttggcgtccaagagttctgctaaccaaccagttctctcaaaaagacattcctaacataaggattcaatatgtcaacaaattgtttttccatccatgcaacattgtgctgaactctgcaacaaagaaacttgttactgactattatgcaaaggtaagtagtcattttaactttttttaaaaaatatgtttttaaattttttttcttctgttacctttacatttagctttttttttctttttttttgtagggctgatttaattcaacaggaatactttgaaaaccaagattactttagctcaacagtttatagtagatttgtatagatacaatttctgcgccatattgtaactattatagtaagataacaacttgaaaggtcacatcacaaaaagtaccaaacttcatatattgtaactattctgaacgactattacaattgttcactacgcaggaatataacttctcatattcagtataactattttctgcttcactactttctaacttcaactttagccatctgtctttcttttcttagtccctttttgctccattaatacttgtgttgttgcttcttgttttttccctttatttgtcttctttgaaccatcagtttgttcttcctctgcattctgcaattgcaatcaaattcaaattaaatattttaaatcaaatgagaattcttaaaataaatacttttttaccttttgtgctgtgttttttgtctttctaattttctttcttggcaaatcaaattcaatgtgctttagtgggcatgttggaaaagtgtgatctgttcgttgacaataactgcaatgataaacttctttactctgtaattcctctctaaatgatttgtatctttgagatggtcttccctttgactttgctatgtctggatctatcaaaatttcttcattgttttcttctgtttcttcaatgacttctccatttgttgtatctattttgtctatctccatttgctgctttgttctttgctctgaattcattgatattgattctttttctaacttgtcaatctgatcaactgtaaattggaacgaatcaatactttttgatccttgtgaggctatttcagcacatttccttgacagaatattgaatctgaggattgagctctccgataaaggtataattctatcttcaaaatcatatttttctttgtaatccttttttctccaccgatcgataatatatttctttggaatcttcataatgttgaggtgaagcataattttcaatatgtgggagcaaagaaggccatctttctcaaattttgagcaaatacaagtgtattcctccttttcagagtcaacaattacaaggtacttccttcttcttactacttttattttctgattcaatgcaagaaaaacttcataagtcttcaatttctcgacctcaatcaattgtaatcttgttgtcctcttaagttcaacttggaactttttgaatatttttgaattgtacagcttgacagcttggtactcaatgtagtaatgagaccaaagtttgcttggcctttttgtccttgaattatgatcatctagctgctccaaattctgaatagtgtccattactctgacatattctatcaaaaagcttattatactgtattgtggaccaacatctttcttaaaccttgaatttgtaccttcacttagagctgtgctttttatgaatggacaaaaatttgttttgaagtatactggtatgaatctctttctaattgaccacatgtgcttcaaaaagtagatgtgctgaacctcataggaatcaaccatttcattccacaaatattcaaattcttcttcagtaactgaattgttcattatatcctcatactcatcatacaacccttcttttgacttgaacaaagttccagacagattgaatgctttccttactatatgaaagaagcaattcctatgtgttgaatttggaaaaatctgtcttattgctgacctcatagctccgtcctgatcagttataattgttttttatgctttttctgacattgctttcaaaaaagttatgaacaaccatttaaatgtttctgcagtctcatcatgcagaaaggcacacccaaaaacaattgtatttccatgtcatgaaatcccaacaaatggagcaaatggaagattgtatctatttgtgaaatatgttgtatcaaaactaacaacatctccatacttctcgtactagtcaattgaccttccatcagtccaaaacaaatttgtcaccttcttattctcatccaaatcaaattcataaaagaactttggatctttctccttcttctttctgaaaaattgaagaacttgcatcatatcattgctacttgtctctttatttatacaagttctcacattactaacatccttcttagtataaggcaaagatgtcagccctcctctcaaagttgacaaaatcacaatcatatgccttgtgggaatattgcattcctttagtgtccttatcatcattttctcttctgttgtcatatttttgtgtgacttcaagaatctaacttcatctcttggactcatcttatgattgtgatctaaattaacccttataattctccaaatcaaatttctcttagaaattaccagtgcacagttacaacttgtggctttaatctcattattgtttctctctgctactactgtctcttctgtttcttcttcttgtgattctgactttgcttttccatgtcgattgcatttgaatgttactctaatcacttctccattcctttttttgcttgtactgtggtaactgtgagcaatgacaacagaaaatccagccaacaaagcataaaagttaaagaaatcgtgtgcttctttaattgatttgaactgcatatcaactcttggaatgtacttcgcatcaattgctgcattatttccttttgtagcttcttcttgttcttgctccaaaaaattgtttatatcttcttctgtcaacatttctccatttgcatctaaatcattactttccactgtatcaacatttgttgttgcttgatttccaatttcagtactgttgtcagctgaattttgcacctgcttattcaaaaattcaatttcatatttcaaacaattattttttaaaaagtttttttctttaatttcacaacaattattatcaaatcaaattttatcttttagatttgaataacattcttcaaatgtaaaattttcagtaatgaaaagttcttagtaaatcttacattttgaccgtttgacagattgaacatatcaagattccaattttccaattcattatcttccagatcctcatcttcaacctttaaaaatagttagaacaaataatatcataagtaaactcaaacattaattgtatcacaaatacgatttatagaaacaaaaaaataaattaattcatacctgatttgtattagcataatccatatcaaaaggaatatcttatgttctacttgttgtcaatatcattgaattctacacaaaaagtaattcaaataataagacaattatttaaaatttaatacatatttactattttctttcttcttatgaaatatgtgagtacctgaaatgctcttggtgtagcaacaaagtttgattctgttgatatttcttgctgcatttgaaatttaaaatgttagttttacacattaataatattgtttatctgtcttcaacattacatttattacacttgtaaaatacctgaacttcagatattgaaggttgagatgatataatttgttccatgagacttgtatatgaaaaattttgagcctgcaaattgaaaacaaatttattttatgacatgtattgctgatttttgtttgatattataaattctgtcattccaaaacttactcctaaaagagaccattcatcatgtagagtacaattgttgtactcatcacttgaatttgttttttctctatttaatttcatcttgtcgttgatgcttatttcttcttgagatgcctgcaaataaacataactcaaaatataaacataactcattactcattactcattttagtctctgcatataaacataactcaaaatatgaaagtaatgatttgttttctctgaatttttcagatttgctgcagagtccaacaaaattaaataaaaggtaaatcaaattgctttacttgtttatatgaaatatatactgcttctaggagttacatgtatgttcaactctatttgcagtgttaattctatgtttttttttaatttttggactgtaatttgtttttatgttgattactagacatatatatgaatattaagaccattaagactgtgcaaatacacaatatcactctgtgatatttttttaactaaagtgttaatttttttcattagttacagtgaactaatattggaattacagtgtttcttaactgtaattttaattttatttcactgtaacttatttgaaaattataatatctacatagtaaatgagtgtctgcatatttatttgtaaatgaaattgtttatgtcatcatgaaatcactaattatctatttttgacagatattttgacaatatatgattcaaaccagctaaattttattttaactatgatgttttgtctaaatgtgatctttgcagattatatttgaaactaattatgtttcttacctgaaatcaatgtatttgcgttatgttctgtcaaaactaattgagtcatattctgaatgtttccatgctgaatgcttctttctgcatctttgttatctttgtttcctgcagaacataatttgtaatataattcaaatcagtacatcagtaattaaatttgacatatatagatatatccaaagaaagaaagatataactcaaagtggtaatagtacctgtatccaaagaaatacttcttcctgcttcatagaaattaaaaatataataagttatttcactgtgatatttggagaatatctagatgtaacaaatattcaaattaaaattcacctataatctctgtatccatagaaatgcttctccctgcttgtccattatatttgtttcctgcaaaaaacagaaggtttaaaacacaagaatataatttgcagtgaactaatactagaattacagtcatttttatatgtaattttattttgaagggagaagcattgatttgtgcttgtattttaaagttttaggccagtgatgaatctctatttagtattagtttcagcgaaaatatcttttttgccaactctgaaatttatctttatattaaatatcaattttttttattgtcctctgtgttgtttgtttacttgtctaagagcaccaataataaagaaaatcttctcatcatcataggcgaaatttttgccttcacttgtcaagcacctttttacctttgcttttcccaaaattagtccatcatccttgtacttcaaattaacatctgtaaagcaaaataatctagtgtactagcttctttttgtttttatatatgctaatttgaagtgcaagaattatatactagtttttgagaatggtgcatgtaaaaaggtgcttgacaatctatagctaactaattcttttgagcttgcaaaattgataaaaattttgcctatgtgaatattgaaaaaaattatagtctaatactaagaaatgtccattttttttgtactaattgaagtggacaatttctgaggccatatatatgatatttttttgtttttgtatacctttttttgtgtctaaagaaatgcttctccctgattgtccattatctttgtttcctgaaaaaaacagaaggtttaaaacacaagattataaattacagtgaactaatactagaattacatttatttttatatgtaattttattactatttaactataatttgtttcaatttgctgatttcagcaccaatttttaattgtgaaattaaatagtttttgaattgaattcagtaccattgtacagcttagtgtttttgttttttattagattcagctgaagtgtttcagcttagttttttgcttatttttctctctgcatttcttctatgcttggagtactaataacctgttatgtgcttgatgaatctgaaacaatttcaatttgaaaataaaactgccttagatttaaagttccctgtatttacatgcatattgaactaaaattacagtgttctttcgtatatgtttttattattctttcactgtaacttgtttgaaaattgttaaatgactgaaaataatgtaagcaaatcttaattttgcttctcaccaggcaagaaaataatttatacctgttcttgattcttgtctattcactttggtggtgtattccttgtgaattccttctgcatttgctggaacttgagtcatatctgcacaatcattgacgttacgttttagtcaatactagacatttcatttttgctttgaattacttttttttagatttgttgtatagtccttataatgttgtaatgaatagtaataaaatttgcttttagttgttgatttgatatgaaatatgtactgcttctagaagttacatgtttgttgaactaaatttacagtgttccttctatgtaattttataaatatttgactgtaactagtttgtatattgatttgtagacaaatatgtgaaaattaagaccattatgtgctcttttgaatatactgctatcatgcaaatacacaatttcactctatgataattggtgatttctaaaatatttgaaatgaaacaaaaataaaagtcaagtatgaggaatacatacctttggaagtgtcttttgattttacttgttcatttgtctccatttcctgtatgcttgaagaaccgatgacttgttctatgcttgatgaatctgaaaccatttcaatttgaaaataaaactgccttagatcatgcttttgttagaatttgtacagtgtttcctgcagttacatgcatattgaactaaaattacagtgttcttttgtatgtatttttattattctttcactgtaacttgtttgaaaattgttaaatgactgaaaataatgtaagcaaatcttaattttgcttctcatcaggcaagaaaataatttatacctgttcttgattcttttctgatcactttggtggtgtattccttgtgaaattcttctgcatttgctgaaacttgagtcatatctgcacaatcattgacagtacattcagattgactatatgagttcatattagaacagattcacactattcaccattctgaaaatttcagtgatttgcccagttctaaaatgacagttacagtgatttgcccaatttacttacagtggtcagatttactttcagattgactctatttagttcatattagaatagattcatttttttagatctaatcagtttctacatttctaacctcattaacttttctttacagatctgatcaaacaaattccaaaagaagaatcaaattctgaaaagaaccaagcaggtaatatttggagaatttttctgttcactcacctttgttcttcttggacttgtcttttgtgctctttctgctcttcgattcttttttttggagttctttggattgacctttagtaccagtttctttgatagatttgatattctttcctgacatttccttcttttctggatcttgatcttttcctaagcgtatctttctcttcttgatctcttctgaattcatcttgattttggattgatgttttgggggatctttctcttcctctagctccatctccctagtataatatggattgttgcggcgtgtgttgtgtgatctctttggaaagaggtggtcctagttgtgatctgtaatagttagctgtcatcacatgcccatcaacttggattgcaagctttctaaatatgtttgttttgtgggctctgtttgatcacgtgcctttgtctctgtttttctagggacctttttagactttattgtgggcttgtcaatttgtttttaagatagatgggcttttttggcctgtattggtctcaaaaaaataaatctagacttttataatatgttattgtagcagtttttgtgagttgttagatgtaaatcgtgtggtacagaaatctgactgaaataggacacaaaaaacatgcgtttgcagtatagaccgtccctttttttaatagacatgcatgtatttttcctcttcaaacaaagttttctctcaaattatttatccgatctacaatccaattacaccattgtgttcgttacaattaaatcttcgtaacaagatcttacattattatattatgatgaaaaaatatttatatttataaattacttttattatatatgtaagttacttttatcatgtgtataagttacttttagatttaactaaattacttcttagacatatacaagtaaattcaataaagtctaaaagtaatgcacatatatattataaaagtaacttaaaaacaaaacggaagtaactttgtcacgacattagaagtaaattcgttgtagggataaaaatatgacttcacgtccaatgaaaaaaggcattcattaaagttactttctttttattataagttacttccataatatatgtaaattacttttagtctttattaaatttacttttatatgtctaagaagtaatttggtgaaatctaaaagtaatttagatatatgataaaagtaatttataatttttcatcaaaatataatcatggaagatcttgttataaagaattagttgtgacgaacacaacggtgcaattggatcgtatcggatgagtagtttaagagaaaattacatttaaagtataagtggataatatctctcttaaatggagtggtagctggctaccactagcctagctgtctagtcacgtccgaaagaaaagtatgagctgccgaaattcccacgtgctttctaaaatgcacagcgacggcgtctagggggacacggcaaaatttcccatgttacggtcaggtcaaaattagctttcctttttttaggatcgtgtgtcgaattgttggttgatccaggctaatatctaaggccgagtgcatttctcttcagtggacgagttatctaagttggatatgtctctgagtttcacagctggtactgtacaagagtagagaaaagccccatacataaggtgatgatgcctctgagtttcacttcccaaagccctaattcttagcttcaagatgcccgagaactgcctctcctcacaccttaaaaaaaaaaaaggcccgagaacttcacctattatagaaagcgcctcgaaagaagaaaacactaaaattatgtagtaatattaatattagaaatcatgtgattatgtcttaggctaaggtacatatagagataatgaagttaggtcctacatatatccctctgtttttttaaatatttgacaccgttaactttttagcacatatttaacgctcatcttattaaaaacttttatgaaatatgtaaaactatatgtatacatataagtatatttaacaatgaatcaaataacttaattttttaaataagacaaacggtcaaacatatttaaaaaagtcaacggcatcaaatatttagaaatggaaagagtataacaaaactataacaaatctttaatgtacagtagtgtaagcatccacatcaatatgagtaggtaacccacgaatttagtgtgttaagggggaagctactgccatcaatatagtactaccttggtctaaaaagaaattgtatttttttactgttcgtatttatagccatagctgaagagagagagagagagtggtaatagtatatatatactcccttcgtcaaaaaagactcaattcctaagttttggtgtttaatgtttgaccgtccgtcttatatgaatttttttatgattagtattttcattattgttagatgataaaatatgaataatactttatgcataacttatctttttaaatttttttataattttttatataagtcaaacggttaaacgttagacacggaaacgcaggaatttagttctttttttactgagagagtactccgtataaagcaaaattccatgaaaccatcgaattaagttaaccggccgccatcaaaattaattgatgagggcccctttgttttcatgaggtcaggtgccgggcacgttgaagtctgactgccgaaattgagtttttgtcctcatcattaattagtactccatccgtttcacaatgtaaaccattctaacatttttaacattcatattaatgttaatgaatctagacatatatatctatatagattcgttaacatcaatatgaatatggaaaatattagaatgatttatattgtgaaacggaggaagtaatagatcctaactccacagatgataaattgatgttacgtgctgctaattgttgtctgaaagctacagttttaattaacaattcactttggttagtccaattctgatccacaactttcttgcacggtcctacacatcagtctagataattcataatctaggatcggattgaatggcatggcctgctgatttaattaaggggacaaccggccggcaatattacgatggtacgttgtcaaagaatagaaagggatcgtccctgcatgcactgcttcagaaaatgatgagctttgtcaagatccattcgtcgtaaacgttcttcaattcactgcctatgtatacgtgaggacttttactgtacgttttactgcgtgtatatacttgcagtatatagaagggtatgtttggtatttgttaaaaatttaaaatgggttgtttagtcatttgaaattgagatttattttcatcaagagtaattgtccataggaagtaattgtcctggatctcgtcatctgttcgtgctagcgcttcttttgaatgtatcgtgcatccccggcacccttgcctcccgtcccggcgcctccatcccgattcctttaggctaggaagccaaaagaagccgagcctttatgcgcctagcgtctcctgtgtccctggaccccggcgccttgcctctcccccgcatccaacctcccacagcttctgtgttccccaacccacgctgcctccccccgtctcacatatctagcctggcctcattgccctgcctgccctgacgccgctgagtgtctacacaagcttagacttctggtaagacacggacctatatttggtataactgtaatgattaattttcgcaatggttgttttgttctgcaatttaaggtgtgcttaactttcatgtcgatatgaaaatttgctgtcacattaagaaaaagaggtgggatttaatcttgttgattgactttgtatttagaagatctgcctacgaacactaggctgtctttgatgagagaagtaggatgaaaatctgtaactagaatcgcattaaacctaggtgtatagctagatgagtgagctatgtcaaattaatgtcacagagctgtaaattgtgctacttaaatttagtaaaaattaaggtattatccatatatgtcataaagctggttccattgaacgtttatatattgcaagttgtcataaatcatttgttttaacatttgccaatagttcgtcaagcctttattactttgtagtttgtaggatgtttttcacaaaataattttatcattattcttacatccatttttctatttgtgatgtgatctgtgtgtgacacaactcgtctttgtaactacttgatttatgtgaagacttgcaaattttaatatatttttgtaagtgatgtatgaaacgcaagatgttaattttattttaaaatatgctgatatggttcatctctctgtctatgattactatgtacgtattgacagtggcacacaatggctgagaacgaagttagcttggaggagatggaggagtataacatggttgctagtaagcattttagaagcgagtaagatggttacaagttttacaatgaatatgcaaggtgtaaaggttttagtattagaagagacaaagtgaagcaatttagtggtaccgagcttgtcttctagaggtgattttagcaagtatatttacaatagtttgttgtgaacatttgtgcgtgtaccgttttgtgcaatacactccattatcaggtagtcgatcataccttcatgctgctactatgaactcctatcaacacctgacccattcgaactctcttaaggttttagaattggtaaaaaaaagtaagacgtcctcttttctatcgtttcttctcttacatactccctccgtcccataaaaaatcaacttctggctataaatctagacacacgctacgtctagattcgtaaccagaagctggttttttatgggacggagggagtaagtagtattggtgcggaaaagctaattggcgaacgattgccctccggcctctgcgatcactttctttacgcattctcattccatattccttccgccactggttcggactgagcatgttttcggcgttggagagacgagccatgtcaggctacccatgcactttttttttcttttgttacttgacttttctattgcgtgcatgcaaggtggacccacaccatatatttttaagtttgcatgtagtttacaaatactacttaacctacatctttctatttttttccatttaggggcatatagaaagtttatatattctttttacatatttttttatttttaaaattcattcatacacttttttaaaaaatcaatatcaaaaagtttatatgtgcaaagttcatatataaaaatttaccatgtataaagttaccatgtgtataaactttccgtgcagaaagttgcaatgtataaagttagtatataaaatgtttatatagataaaattactatgtatgataaattagtagtatatgtattgggctatagtctaagcccacataaaacatgtacatagataagagaactctggatgagaaagaaaaaaaaaatacttgagctagtgggcctggaaaggtttttgcacgtgggctagagaacatggattcaggggttgttgcgtctgtcatgcgcacacgaaaacgccaaaaaatgaaatagcgagagaagccgacacgtgcagatgtaataggtcttgacatgtccgccgtactagacccacccatgttggtggggctcgggcccaatcccacctaggattatgttgtgttatgattgttactgattccaattataagtaagtcgactacaccatggacaaattatattctcccttctatttattttggtaccacacaaaaacaatgaatgccaacaaaagcatggcattttgatttgatttaaggtcactacattttagccaaattgattaggatcctctgactttggagaatgctccagatcagtataccgatctatccggcactgtaaccaactaattatcctactgtttttcctactcaatccatccatacatgtatatattgtttttcaaaatatattttctcctaaagtacttatccaatttacgatacaattgcaccatcatgctcgtgttaattaaatctttatgatagaatatcacatgattatattccgataaaagaaaaacatatgttttaaaccgttaaaagtgaatgtttcatacattacagctatatgtttccgtgtgtttttagcgtgttttaaagtttacgtaacaacgtctttcacactctctctctcttgtcttgtactatttgcacactctctctttccattttagatctttaaaatattttttcttctaaactacttatccaatatgtgatccaatcacaccattatatttgttgtagttaaatctttacaataagatatcacatgactatattctaatgaacgaaatacatatgttttataccgttaagacttattgtttcatacatgacagcagcatgtttcaatgtgtgttttcactataggcttggtttagttccaaactttttcttcgaacttccaacttttccatcacatcaaaactttcctacacacacaactttcaacttttccatcacatcgttccaatttcaactaaacttctaattttagcgtgaactaaacacacccgtactttaaaaaaagtcaatgtttcagttactaattttttttcaccatgtataacttaatgtttcacctaatggttaagtgaagtatttaaccacctgatttagagggaatcgaacgtccgatttggagttcactcctcagacttttagttgaatataaaggcataggtgaattaagtcgaacttaatttgggatattttccgatatccaattcacaaggaattaataaggccaaacatgctacagtactattgaacgatgattatttttgcatcatctacactgttgtcaccgtatttgcaccaaactcatttctgtgtacctttgaaaaaggtcagagaatctgattctcatctgtatcactacatattttcatattcacaacctttctcaaagctaaagcataatcgatttgatgctaatatgtcaatttatggatgcgattgtcgcctgtgcctactgcctagtgttcagtaaatttgcgctagaaacagaaaagaaagaaaaatagtgtccacgccagcattctaattgtattgtactcctgtttatttttatgttatatgtttagttaaaaaagaactaatcaacatcaaacatttcataattaacagagagagtatttcttttttcaaatatgttcactgtttagcaagcccacgcaaggagccagcaatgatagtaacatttgatatttcagagagacttctaaaccatgcacgcatctaacaagctatcgatatacatgcctctttgcgttaaggtcaattaaccctttacttgaatcatactacacaacatataattctgtctgcacagtgtacctgctagttcattgataaagtagcttatcttaagcaagtaagtatgttaattagtggcctgagagttctaaaacgtagtgtaactaacctccctaataacttgtctagagttaattaattagtggagactgtgggtggcagacaaataccaagggaggaatctgtgtggattatgggcatgctgacaaagacattcttctttggtcttaagtggggagcagcatatgtatgtatgtgtagctaagtgttcattaattgccatgattggaggatatagtccactaaatacagtaccaaatggggattaaattaggcaacccagcactccacaaggacagttttggtatagaagagtaattattataagtgggggcaagttgatcgatcaccaatatagtctcaagaaaatgaaaagtgtaacatggaagctgccccgtgcttccaacttctttgtttgtatcgggagacatggataatactatgaagattgttaagagttacattagttacatatcgattcttcttttaatagtggtgatctttcaaaaaaatatgattcttgttttaatgatagattaattgttgatgctagctttaccaaaagttgcaacatgacttcgtgcgtggtgaacaaaagatatagcaatgacagttgacaaataatgaatgggcatctcgaaagaacaaacccaatagaatcctcgcctacatagctgatattttccccgtggacaaaagaattgaggatgttataggctctgttctattcgttttttttccagatttttaccacagattatgttgctccacgcttataaaaatacgattttttttaaaaaaaaactagtaaccaaatattctaaattactactttgttccaggaaaaatcaaattctagggcattggacaaaacgtacatctagatacatctttaggatttgacagggtatttgtgatttttatatgttgcatctcttcacccgttttcctctatcctagtacaaaatatatatgcttggctcaattattatggtcgtacttatacatatcataggttgttttttatgaaattaaatatcactgttggacagcggcaaatcctcattttttccacgactgagtgagatcaagctagatatatatacattaaaccatgtatttcggttcctcacaaaccaaaatataagtatgtatttcagttgacaagtcagttggtccattttatacaatcgctgatgtggttaaccaagcatgacgggcgattagattgccattttggcatgtcattttctgaagcacgactgttatatccgtaggcccacttgccagtgactaggttggtcgaacatcctgatggttcaccctcaataaccagggctacgctaatcatagttggtggataggtcaaaagaacgatcgatctgaaaagcctgaaaggtgtggctactaatcagggaattaattgaacaatttcaatccaagaacttgtttaattagcaactaaaacaggggtatcacgaaagctgattaattgttgatgcttctcttctttacatacgggccccctgtttttaagaaagaagggactttgggaactttttccatgactcaatccccagcctcactatgcataaagttttttttggataccccacaaaaaaaggggttttttttgacaattcataaactagttggttattcacgtgaattaaaaaaatctaaagaaagctcgagagtacaaaatggtcgtcatattacatatgtataagtttaaggttattgtaatttcaattattgagccagattactataagttgaattataataagccaacacagaataaactataagctatttgtttctttagattattagatgtttgttagctgttagccacccaataatctaaaaaagcatagttagagtggattactatattatagtaatctagcttatagattgtaataagctactcctaataacccagattattataatcctaagctaaatcaaacatggccttaactgggtcaggatacttctttgttgaccttttttttctctactcctagcttgtagtattatattgtattcttgtgataaattttagaggtaagtgaactagtgctgacattatcttattaatgtgcctaaatttatgttgagtaaataactagcataaagatagtgcatcctccaatgttggtgccatgtgcacccaaatatatggctgtttcaatttaacccacacttccattatgcttagcagaaggttatcccataaatcattaatcatttatgtatccttaatcagttactattgtttgttattgcgtttttcatgactttttcagcaggtttagccgtgatgagcataaattgaccgtacaatgaaaaaccaaacccaacagaaaagagtcgattctcttggttttcggttggtccggttattccagcttggtttttgtgttgtggtagattttttttaaaaaaacagtaatatggcaataaagtaccgctgaggagtgaggactcatcccagtcaactgaccacgtcaccggttgccgtagcttcatttgaatcccggataaaacaggagagagagaaagatgaaggggtgaacgaaaaatgagggataatttgattcaagtttttttataaatgtattgaagaaggggtaagtggtgatatatttcactttttatttaaatataatagcatatgcatccaaataggctagtagaaataatttctttttaaaaatcgaggaagttgtaatggcatagatcccgttcgaatctgcttaaaaggatgattaaattttagattaaagtggcgcgtttttcaaactgctaaacggtgcgtttcgtgcgaaaattttctatatgaaagttgtccttaaatatcatattaatcctttttcaagtttgtaataattaaaacttaattaagcacacgttactaccatctcattttgcgtgaaacacttaatcttcatcttcagaagattcaaacaccacactaattaaccctaaaacgaaaagataatccagctatggcccatgaaacattaggcccaccagccgccggcccccaccaccaccaccactgccactctattcacttcacttccaccgcgcggcggcgaggcgagcctggctgcctgcgcgccgccgccaccgcccgacgccgcggcgtgtgttggcgagagcgagaaggccgccggcgagcagccacaggagttcctcctccccgcagaatgcggccgccggcaatggcgaatcgccgccgccacttgagtccgccggagaccccggggagccgtaaaactcgagacgaagaaaatttcaccgctttgttttttttccccttcttgtctcaccttactctattccaacccttcctttatcactaaagttctcaaccaaaaaaaaaaacttcctttattccttttttttcttctctcgcgctcgattcgcttttgtttgttgggtgcaacagcaacaaaataaaagaagaaaaaaaaaatcgatccgcaaatgcgtcggcgttgcgtgcgagctccgatctcctaaacctcctccaattccctcaacgaaatctctctctcgatccgactctgctctctatccggcctcgatcacccccaccaacatcctcctccgattccctcgccttctccttctcctcctccaacttctcgatgacttccactatactaagctagctagcccccgccgatccccgcggggttttagtttagctccgcgccacccaatcgccgcaggtgatctttcccggtcaagaactcgcggtaaatttttcccaaatctttgcttgtttttactcgagtcgagtcgcaatcgttagcagcagcactggtcggccatcgccgccgccgccgcctagtcgccttcgccgatgttttttttttctctttttaaattcggtttgcgactcgggctatctcgcagattcgggggcggatacggaggaaggaaatctgtggtggattcggatcgagctcttcgttttcttgctctttgtataaattgcgatcaggggcggcggaaacaagggttcttctctgtctctcttcattagcgccggcgacgaggtgaggtgaggtggtggtggaggcgatcgaaatggggtcggtgctgtgctgcttggccgacgacggccgccccgtctgctgcttccgcctcccatggccgatcttcaacgccgctcacaaccacaaccacaactcggtatgattctacctctgcttttttttttttttgcttcttgattgtttattttgttattacttttgcgaaattgcgcttctattttgtgttcagattgtaagcaacgatgaggcgctgattcacgattgagtttagtttttttttattagtttctggtgtcggtaatgtgtgctttgtgatcttgactcttgcacgcgttaggtgttgtgtcccggtgttattgaggtcacattgctgctgagatgagcttggcaaagtatgtaaaaaaaatgtgggtttgaatagagttcgcattgcattggtatgggaaaggaaagagtgattgcattgtggctttgaataaagaaagggttgattcgtgtgtttgcatgttaattttgttggatactttctctcagtttttgtgcattactattaactttaataatccagcaatcgataaattgtatggatatggagtactactagtatcaactcgctgctatttttagaaactggaattgcacaactgtcaactgggactgaataagtaagatgctgcatgttctcaaataaatattcctgcactagacttttcctgcaatttctacacatcattttgtcatctttgctcattattttagatcttctctctatgcctgatctttcaaccatgtgctatccatactcactctgttctaaatggtttctctacagggttccattgctcgtccaagagcggatacacgagttgcgcctgatcaaggaagaattagtctcactgctccatcacagcatgattcgatggatactttccgctgcccgccaaggcccttgccttgggatgatcctcgattcagccatcatacagagcatcacccactagtaggaggacatgacaaagcttcaacaacgttccacaaatctggtagccttggagaaagcaagaatgctgatagcatatctaattccaaagctgtcaaggatgatgggccttccacagctgtgaaggatgatggatcatcagtaaaacaccattcagatggtctgcacattggcaaagagcaagtacatgatcttttcgactttgaggacgactgtccaatatgcctagaaggttagtgaaaacagtaccactactcttttgttcatacatacactatcttatctttttctcagcagatagtgtttactatttaaatttctataatgcaaaatattaacagcaagagaaaggggggagcattcaaacattgttatgctgtagcagaagatacgtgttcatgttgtataattctagctaatgaacagtgttcatgttgtataattctagctaatgaacaatgctcaattgtggtggatcactacattgtgaccactctgctgccataatgtcagtgccatcataaaagaaagctaaatttccgtcaaaaaaaataaaagaaagctaaatcatgctcaggtctatttgcttgcatgattttggtgcttgtgtcgtaaagatctttttttttctcgcagagtatgattatgagaatccaaagatgacattacaatgcaaccacaatttccatctttgttgtatttatgagtggatggagagaagtcaagcttgcccagtctgctcaaaggtacttgcttctacttcacttttaacttcacctcagaagtgaagcgtttagcttgactccatcgacattaatgatacctttctcactacaggtaatgctgttccatgaggattcatgatcataatgctgcaacgtttctgtgatgttggagagtggagactcacggggactggatcacctagatttgtgtacatagcttgacgaaaatcaaagtcgctagattgtttgctgaaacttccagcggcgcaaagattttttattatttttttgtttctgtagagcatataattcttttctcatttttcagaaaaaattggtagcttgtgtcaatccacatatcacatttcgattggatgttacagatgcgcgtttgagtgattgcatttgcttctgatgctgaaatacgaaacttctgaaagccctagcatctgaacttgtgcttcctgtttgagatgacgagagattctttgcattcttcaggtcccatcgtaataagccaaacagcatatttgcaaacgaaaaatatttgtgaataaaacttttatatacgtattcttagcgatctaaaagcaaaggctgaaaaataaacttcaataaaaaaacgttaaaattagcttcaaatttaaggttgaaaatttaaattttgtctaacaagtataagcataaacgaaaagacgaggcccgttcttgccatgactgagttaagtccaatgaacatttctactattcctactttgtggacctatctaatattcctgcatttttcattacaaaactatatcacgcctgcttgctctctctcaaaagaaaaaggaggaataatcctgcttgctctctctcaaaagaaaaaggaggaataattgtattgttgcaaccacaacaaataggagtactaattttcgtcattgtaagctcgagtgttgttaatttagccaaaaaaaaaagggaatattttgagctttcatgcggaaaactggtcaggaactgttttaaaatgtctcaaataaagaataaattgcaaagaaaaatttcctgctatgttactaccacttttcacttcaaattttgtagattataccaaactggatttcaaaatgccttcaaacatttgtggtattcaaaaggttccaaaaaggcaaccaatgaaaaacttatccggatttggagctatagtctaaaatcctatataattatttctagaaagctcagcccaatagcaacatttttttattagccgcatgcctaaacctttggtccatgattggtgaaatcgtccatcaccacacatgtgatgcttccaagtccttaatatttcgttactttcttgttgtattgtactcgaacggatactcttggaactttataggactctgctgaactttgaattttactatttcatcaccggcaatctgtgagcaaaggcatagctgtcaattacgatggcagatttatgcaaatagagcatcgcaccatctattctttagttcttcagttgcacagaagaggggtgattttttatttttgagctaggaatgtaaatcggcacacaaatcattgcatcaccattcatataccgacaattttccgtaattaggtaagtgttcgcaagtccattagaattcggttcagatttcgtaaaattcaacctcttcagaccaggttaaatacaaaaaccactaggttcaaactgaattttaaattttcaaaatttaattagattctatcagcttatcaacagattccacgaaatctaatgcagaggattgtgaaccctgattagaactatttgaaaatgtacaacagcattcagtaagatagttaataatactttaataattttcagtaattaggttagtttgaaaatgtaagcatgtagtaatatagttaacaccaacattactactaataacacattgaagctcgcagtcagattgactagcagatttataaacacaatgaaatagataactcaggagactatcatttaggagatatacttaaaaactaatcataaccagctcacagagcattcgataactgaatcatttcttcatctcatcacaggcaaatagagaacagcaacattgcttctagaagatagttcactggtttcagaacacaagtaccaaaattttaaaagtgcaaacagatattatcaaagtctgcaagggttggattccacagtaacgtaacatcaaagcacataggcttaacgataacggcgaagagagacagtctggttgcgcttccaggtagccctgcgggacggcctggccttgtggtgagtgtgacccttgccgcgcagaccacggtacttcttgccagcagaggtgagaccacggagctcacggtgcttgtgcacaggcttgcagagccagttgatccttgggtcattgcggatagcactgtgagcaacatccacaaggatgatctcaaagtacttgtaggtggagtcctgcattaaaccaaagaaaaccaagtcattaatggaaggcagatacattgttgataatcatctttgaaagatctcagtaaagtgaaatgtacctcgttcacccagtaggagttgagcaccctgagtccgcccaacttgcgcccagctctctcctcagcaactgacctcttgttcctctggaacttgagctgggtgataccctggtgcttgggcttgccgtagacaatacccttgggcactggcctcttcctgccaccacgcctcacacggacacggtaaaccacataaccctgaggaaaggtaacgacaaatagttaagcacaatattttgattacaggacaaaatattcaaatgtgattatataaattggtaaataaatgggagcacccgtacaaaattttgctcagagtatcaatgacaaacaatgcaatttaagttcaactacggcagcaaactgcttttgcagtaagtaacgcaccaaacaacattacctatgccaattacaagaaaaggtctcaagggatgatactacaatggcaagcatctaccatccaatcgaatctaatggagaacacaagacaagtgatactgtccaagaaagcactaaaaacagattaactcaatgttctactaacagttaacaaatggcagtaacaggttccaacaaatcaacagcacagtcgttgaacctaaatcagcagaacgataacctagcagagtctagatctagacaaaaaagtaagcctccatttctacaggacagatcaatacttcaaacattaacaccatcatcaaccgcgggcacaagagaacatctggaggaggggaggtaacctgcttggccttgtagccgaggcggcgggccttgtcggggcgggtggggcgggtgaggcggacgatggccggctgctgcctgtactcccagcaccgcacgcgctgcacgaacctcatcacgtccgactgcttcctcctccatagctccgacacgtacttgtacgcacctgtgcacagcaaaacgacggaggacggatcaggagagagatggaggtggaggggtgggaaactggagacgagagtgatggagggaggcggcgtcggaggaggagctcacccatggcggcggcggcggcggcggcgagcggcgagaggcggcggcggggaggtggagcgggagaggagactagggttcgtgcggaggcgcgtggcgagaggctatatagaaggaggcgggggcgcggtggccgtcagatggggctagggtttttctcgtgcggttggatgttgcccggggaaggaatggatgggttactgatgatgggcttggcttgggccttattaagtgcagtggtgccgcacaagactcagcccaggagccagcctgctgctctttctcagcctgattaaaaaaatagagaatctattctatttattccactgagttggttcgagttcatgatttgccatcaacattatcactttctataatatactggtgaatttatcaattgttatacaatacgctattaggctgggacttgttttaaaaagtacccaaaatacccttatacacaaacaaggttaacaattgatttatcttattagaagtttcaaaaaaaaaaataaaaacttttatgtggcatccttacacaacatggatatttatatacaagtttcaattttttttatttttttagaaaaatatataacttatttgttatatgatacataaaatacttttttattgttgtttttaatataaatcatctttcatacactatataagataattttttgctattatttcttctataaaaaaattattttgcatacaccacataaaaatattttttctaaaaactaaatataccagaaaaaaattgaaacatgtatacaaaattgcatgttgtgtaaagaggacacataaaaattttcatattttttgaaacttctgatgagataaattaattgttaatcttgtatgtctcaaaggtattttgggtatttttgaaaataaggcccaacccaatgacatattgtagaacaattgataaagtcgctggtatattatagaaagagataatgtcgatggcaaatcgttgaactcgaacaaactcagtggtatagaatagattctctctaaaaaaataaatgatactagtagtttgttattattctttattatttattacggtcttggagatacaactttgaccccaaattatataagtgtataaaattacttcggaagttacatctaagaatatcatttttatgttttcaaactaattattttattaaaattcattgatacatattgatatgatcttatccaaagcatcatataatttccagtgaaaagactaaccacgaaattagtatgagtaatagaatgtgttggaacagcaataaaatgaaatagacaatcaatatattaataaattcagaacaccttgttgttcacataaaaattgcttgatcactccaacaattcatctcctaaatttaagccttttaatcgtatacatggtggatattgagctagcttagcttgggttgttattctaacgagataaaaggttgggtcgacttgatctgtttgctaactcaagctggcaacacattggcgttggctggacctcataaaaacggcaggctccatagcaccagagctagtcaacgaggacttttgtgatggtgccaaagctcgtcaatttttcattggagcatggagtcaaacgaggcgtcggagctcgtcaatatgactgctcagcaatcggtgaaggggatggcaactggaggaggagagttagaaacggatccaaggagctagcatttgggcgggcaacggtgaactaggggtcactagtgctagcactgccatggctaagcaaggacttaaccatttggcaacaggctaggattaatggtgttggcactgctacggacagccaagaagagcgaactggtgactagagaaggggatcatctggtgttggcgctgctatgaatgggtgggcgacaaatgaaagtgatgacgacaactagggtgcgaggcagagatgattgagtcatatatagaggtggatatcgagctagctcgattcagttcctataggaaccggtattgttcatccattcaagaaaaagggaggaaactttcctaccatgctaatttggtagaaaactgcgtgaaaaaaaatcgagtgcaacatctttttctgttcccattgcataggatcgaggcaaatgaagtcttgatgccactaatgcaaggattaagcatcatcaagcttttctactttttattatttagtactgttatttagagataagaagctaactctctaatcaactttgcatgtaccgttgcttcctatgtttttcctatggtttatctagtgcatttctaacctattcttatgtgttctttctattcatgtgtttttttactctacattccaaatgagctcttaatagttagccactaaatttgcatttctatgtttcggcaacatgtctttataaaaccacagctaaaacacagggggagaactcgggagaaaatcggtgttcaggacaaagtgctacgtttctcagaagagaaaaaaaaagggggcacagacgcacagtgcgttgctgctcctctggcgcttatagggcctttggggcttcttgggccatttggttggtcgttttggttgcccagcccaacatgatggtgttgtgcagcagcagtcaagttaggatagttttaagttgggcaagtcaaaaatggtccaactctttacatatcctcttgcagttacaactttctaccataaccaattcaacttatcaacaacaacaacaacaacacaaggtcagataccttggtcgaaattattacagaagagcaaagatgagaccttttacagaagcaagaaagatgagaccttttacttttacagcaagggcaaggtgcaactggagcagccgtaattttcacaggagccaaaaaaaaaaaagccggtgcgtgcatacacttaggacatgtattttcttcacagcgttctcaatttttcatggctatatacagctgttaaaaatgtagaatattatcatcatcagattacaatagattcaagtacctaccgtgtagcaaccatatatcagcaactcttattctttcctgcaaaccagcttttattctattttgcacatgctttaagtaacctataagtgtttcccacacgcacaatcattgagccccatcttttgcagcaacatcaaaagcccttgtgaatgcatttggaggctggccgccgctgagctgaaatttcccatttatctggaaagtaaagaaaaaaaaacacagtagtttgaattatcatggacaagtatccagtcactgaccaagtgataagataaaaagtgcaagagatgatagatatgatcatttaattagtcctcataccacaaagtgaggaacaccagaaattccagaggaatatttgttgagttcttccttgaccttttatccccaaaagaaatgttaggatatttgattcgattgcatctgtcacaaaaagatggtcactagaagtgaacatcggtggaaatgtacctcatcgactcctttgttagaatcttgaagaagttcttctgctccttctatgcccacctttcttgcagcatccagcagaacttgccttcaagcatttggaaattattcacaagattgaataatattgtataaaatcacttattgtcaacataaaaatatatatagggaagcaggatgggtagctaagttggcaggtggacatgtttgctgaagcaaatcaagaagataaagggtacttttcttgcccaaacatcaaaactcctacaaaaatttatcattgatagatagcatggaatcatttctgactgcaactttgcataaagaaaaggtgcctaaaaagggacatctaggaaaaaacttcagcagtatagtaaatgctgagaaactattcacaacccttacgcaccagaacaaagaaattggttggttattttcatttgccaatactgaagcagcacatgtaacaatggaaaatgcacaacgtgctatctgctttggtttaacattctaaataactcgcatccatagtagaatgtgataatctagataacgattccaatatgaaaaggtctgacatattccttttcggaatttcatcagtcattcttcattttagcaacataaaatgagtatgtttattacgagtttgtctcaaggagtaatatagcacagaaaagaaaaatgcacgcccttcaatgtaccactaccaacaggaaagatgtattatgcatcttgctgaaagcctcatacatagaaaaacgattaagtatggctgatttatgtgatttctcatgttgtcccatttctgacatgttctaaatcaataatagtttgtcacaaatatatatgaccgaatatgcagaattgacaaagaaaaataaagtgcaataagattataaatccattcctacaatcttgaatacatactcaccgatcaccaataaactttccatggcaaaagtaactttggaataattcttcaacaagagcactttgtttgtcataaccttggtgcccagcaagagttatgagcctatggctgtccattgtatttccactgtattaagtatttgtatcagcgaactagccaatgatgcatgctaaaaaaaaattcaagactatagcttacgtcaacccagacatgtcatattccatcccaagtcctctaaatatctgcaaaaagagcaaataaaaggctgaatatgatatatatgatgtgaacaaactctgcctttgcattgttcaaatgtattaacctctgtcatacgagcagttgcatgctcaaactgaatagggccaaacttcatccggtagtaatcagatttcttgatgccttccttaggtgcattcggatttaaaaagaatggatgccagcggacctaatcagcaaaaagacacgctagttttacgctgtatgaccatgaagttggacaacaataattttgaagaagtgaaacctcgaaatcaaacttgtccttgttttgctccatagctttctcgaggttctttttcccgacaaagcaccatgggcacaccgtatcagagctcacatcgatctgaatgagcttcttgccagcgtttgaagccatgtaaatcctgcatgtgtataattcacaaagaagctaatcagaaatcggatcaaggcgcctcatggatccggaaagcaaggactgaaaacaagtaaatattttgaatggttgctggtacaggccaagatcctaacacctgtcaagctagtgatccgaatttttcatcgaacacacaagctagtgatctgcagatggcctcaaaacacggtttatttgctatgcgatctgcaactagaaacagcaaagacatttgatcttcaactgtgtgggagaaaatcaccaaccagagtggctgtcagaaaattaaaagagttggggatgtggaagaccatctcaatgaagttctcatatacagttggcatatgtgggaggaacatgatatgaggacctttcaaaatgaggagcttgaggcccatgcggtgtcattcttattaacgagaacattgataagtggaagtgagcaatgtaacagtttggtgtaatttggtgacttaattattcgatgttatatcgtcctcccatagcctcgtaatggccctagcattttcttttggtttttggccatggctactagctgcttatccaagtgtttgtaacctaaattctattacatattaatctttaagagagaatcccttatatgccactagaatttgaccagttcccttatatgccactcaaaattggcttctcccttatatgtcactagtttaagtttttccacccttttatgccactcccaccactatagtgttagttgactgttagtcaaaggttagtttttttcgtaaatgaccaatatgccctctcaactaaaaaatgtgtaaacttcaaaaaatcataactaatttattttaaatcctttttgagtaaacaaaattttatcagaaccagtgaaaatgctctttatattaaaaatattattggaaaactgcatatttcatgcttacattgaaaatttatttgtgatggtaatggctaaaattgcatgtgatgcaaaaaaaaatcaattttcatatattgtatccagtagctatattagtactaaaatacatattattggttgtatactaattctcaaggacaaatgcgtctttttacaatgaagttaacggtcaactagcggtggactggcggcaatggcataaaagggatgagaaacttgaaccggtggcataaaaaggagaagccaatttgaagtggtatataagggagccggttaatttggagtggcatataagggattctctctaatctataacagggttccttcctttctttgaaaatagaaattggctgaaagtttcctctgcaaaaaaaaaaggctgtacaaactgtgattatgactccatggttttgttatcactaagctctacgccaaacaaacaaaaagcaaaattggttttagaaaacaaataaaaaggaaaaataaatttaaaataactgaaaattgacttaggtgcagaattggggattaacatggcttgtagaaaatgaaaatggtagttcatcttctcctatctttgctcacttgctctaatttttctcaccaatgtattaatctagccaaccggttggcaatatcaatgataaatcgatgatcatcagtctttggaagaaaatgtcttgtggcatggcatcagcataaatagcaagaaacagcgcctgttctctgctatgcctagtataaaggagaactatgaaacacagaaaggtagtaactatcaaagtatcaattgatcaatcaattaattaaagatcagtttcctattgaaatatagtaattggcaagttcccctgttggtttagtaaagaaaaaaaaacacacagtaaagatcagtttcttgcatccctagagagcaggaaacaactaacaactgtactggaagaaattagaaccgcctgttttcttgggatgaacagaagagcagacaagagtatatgcaagtatgcatcgatggtttcattcaaaggggagagggagaggataggattgagctggagggttgatccgaacctggtccagttgtggggaggggatgcggcttgcgcgaggagacgactccaagaagaggaggggagggagacctctgccacggaattttggttaactttgatttggggatttgatttgatttgattcatgtccacgtctcggtggcggtggccggggacggggaggtaggtgaagctgcccggtggtagaggaagaggggaggtgggcgttggtgagcttggtctatggagaccacacgcttgaatcacctcaccgatcggtgcgtcctggacgcggtccacaggacggcagtgtgggttggaataaatggcccaggcccaatttaactcaattaaaatctcaagagcccataagtaatgttagagacaacaatactgtcttgcaaatctaggtggaagaatctcaacttaaatagggtgatattagagattccttgttgaccggttgaggtgatggttgtactgccacacgcgcgcgcgcgccgattcggcctcggccgtgggcatggcgaggcgaggcggccgactgaagctgagcctgcttgctgctctttcgttatgtaacagacgagaataaagtcaccattaacaaatgagagattcattgtgatgtaaccttcacgacaaatgagatttattttgtggtaaccttcacaacaaatgagatttatttgtgtggtaatggagatctttctctatatataatgcaaggcaaaggctctcaaagaacatgtcttcctcctgctattgttccttggtgatactctccttctgttcctgcgatgtctctctatttccccagttctgttcatcccgcgcgcacgggtgatcgaaacgagcaggtgcctccgaaactccgtccgcttgagaacctgcacgggtaggcgggcgatcaagtttttgggtaacgcttcaagcgcaactgctccgcatcatcttcaccaatatgttgacaaccagcgacaacaacaacactggagacttggggagcctcccgtcaacaccaacggaggcaatactgcctcaaactccagtgaagggccattctcgaggtataatgtttcacaattactgtttgttcttcgtttcctacaactgtcagtcacaatattattgcgttctcttgtctatgttaatgcttattctatattaagcatgctcatgttgtacacatctagcactgtcactagatctactcaaattacaaatgtcatatttattgtcttaatattttggattaaaatatgctgcattatgaccaaatttcgattaaaatatgccgaattatgaccaaattttgattaaaatataccgaattatgaccaaatttccaacagtgtggatgtgcgccgctgcacatggcttgccgctgtgttcagttccccactcacaccaacggcacgccccgccccgccctcgacttccaggccgcctgtagccatctccagccctatcatttcgggtataagctatacggtatatttgcaaagaatagataacttgtaaataaaatttttataagcgaaaagatgagtccggattcttcgccgttcctgcaaagtccgcatcgacgccgctacccgctatctccgtggctttagcttttttctttttttttataagaaaatcatgttctctccatcggattttcgtttgctccgttttgggttctggcttcttcactgtacactccatacacaaagaagctgcgctgatatgtggacctgtgaactatgaagcttacatgtaaaccactcgaatcaaactcaaaatcaaaggacagtaaataagaggatttggttcctccatacagccatgttctttctccaatagaagttggataaagttttggatactcgtggcacgcttttcaaactgctaaacagtgtattttgtgcgaaaactttctatatgaaaattgttgtaaaatataatatcaatccattttttaagtttgtaataattaaaacttaattaatcacatgttattaccacttcgttttgtgtaaaacacttaatttttatcttcatcttcatcttgagattcaaacaccaccacaatattgacgacatatgtaacgagtttttttgggtggataaaaaggataaaaatgctaaactatatgggtatatgtgtagcttaattctcataggtagagtacgtagcaaggttgggcgccttcttttgaaataaaagaaataaaagtagcagtacacaatacgtgtatgatctacaccaagctaagatttggtgtaatggttgtcgtgaatagaataagaatgttgatcataacgctttattaacatcatagcttgtcttcagtcatttctttctgacttcgaaatttcctctatttatccatgtcaatgcatttgcacttagataaaaaaaaattctcttagtattgtaagaaagatccaatcttattgggcttcttcacagtgtccagctaagaaagtagttctaattacagtatacatgaccccaacgtaaaatagtttctccaaatgctactttggatagtgtacttacttttcttacaaaatgggagcctaaggctaatctaacctgcacgatggacctttacttttggacgacgatggtgccagagaatataactgttgtttgttttgcccttctacaataaaacatctgagcataggaacatttggaattgtcaccaactttggacagttgatcaatttcatttcttcaagcactggaattgtgaatacttctatcacctcatcttcttgccacttttccaagcttggcatatcacacaggataagactcttcaacctccagaagaatcgataatagctgacctcaatgttgtccatcgatacattgtcgcaaaaaagtgtgagactgtccattccttcaagatgtaggacctcaagtgatggaaaatactgcacaggaggaagcctcttacatcttgcgcaatctttgatggttagtttaaccagattagcaagagtttgacctggccaccaaattggaagtatgctaccagggtatcgccaaaccttgagtgtctgtacacacataggggttctaagagcctccatcacttcctcggcattgtatgcatttacctcgtcattcctaaacataccccaacacaacaacatattggacattcttgtttttagagataaatttgcggcctcggcttttgatttgtccctcacgttcttcagattatatatttcaagccgcccaccgagatccatgctcttgatctcttcaattccatacccatcaccattgcccactatgtaagttgtcagtgtttgaaggttctgcaattgtcccatatttgacggcatgttttctaatcggaagcagccatcgatataaatgtgccttaaattctccataaacctcatgttttctggaagttgctttaggtaaaaacaatcggagagcctcagagtttgcaggttatagatcatgaaaaagtcctctggaagcgacgttatccaacttcttgacagatcaaggtacctgagatgcttcatatcttggcaactaaatggaacactggcggacaagagaccatgcaggtctaacgctctcaaggagttggatttccaaaaatcaggattagacacacttattcgacatccttctccttgtgacaacagtgtgtggataccccatgcattgggtagaatcatatcaacatctaaccctgaaccaaccactgacaagtgatggagctctggcatcacttctgtaagttggtggccttgatgtaggattcggatctcttttccagcagctgacgttgctatgccatgaacaagagggtgcatcttatagattgttactccattgtaaggttgactgacatcttgaagaaatgatcttgactgtagcctatctaacatccaagcccccataccttcagtatcgtaccataccatatcattagccatccacagctggatcagcatatcaccatccacttcaaaagcttcaggaaataaagcacagaatgcaaagcacctcttggtgtctggttgcaagtgctcatagctcatctgaagtgcgaccgaggctacacctgccgtcgtggtcagcatatcgctttctgcaagagccaaccattcattggcagcttctatgacactagaccattcattagaggttcccttctttctcagcaaatccccgagtgttacagcagctagaggaattccatgacacttttgcacgagggattgaccaacctggatgagctcgggtttgtcatctaggccacataacattcgctgcctcattatggaccatatctcatcatcactcattggtcccagctcaatgatgccagatgcaggtgcttctaaggttcttgcaacacaaagttcacgggtcgtcacaatgaccgtgctccctgatgctccagatgccagtgaggttctgagttcttcccagccattggtgttctcatcacaaacatcatctaagacgagcaaaaaccttctttcatgtaaaatgttctggaggtaggattgcaactccttctcttccttgtgatccatttgtgtctccaatggctcacaggttgcaacctcaataatccgttttgtgattctcattgcatcaaattggcgagatacattcacccatatgcacaatgagaaatattccttcacattgacttcatcaaagattaattgaaccaaggcagtttttcccactccttcaatgccaactacacataggaccttgaggccttcatgcttgtatctgtccagacagaatagtttttgctttatctcttgcttctcatgcacccttcccacaatattattttgcattaccaatggcacgtggttgatgaagccattgatctctgcacctagtgcattaagttggccggtgatcattttaagcttcctcttcatgcttcgaggaagaactaatggaatatacatgttgcgcatcatcctgttcctgtgcccgtcaaccaaagccttgttgtgctgagcctcccatctcaactcctccagtagatgctcaactttgaaggtgagtaacctcaactcagccattgaaaatcttagtgtcatatctttgttgttctgtcctgccaacgatgaccgttagccaaattagacatcattgagtacaaaaaaaaaactctagcttgacatattatcgtagacttgtcacttgtcacaagttaggcatattttaatatcaaaagcacatcggtccatgaataaatattaaaaaaatggcaacaaactcataaaaccatgatatgttctttaggtatatttgaagatagagagcacgtcagttcaaagataaattagaagaaaaaaaaggtttttatagagaggcaactgcattatcccccttattttcaactcaaatgatgattttacccctgcttttctaactttgtgattttgccctcatttttttgaactgaagcttgtgcttgcccccattccgtgtcatcttaacggtgtcaaaggaacgtatgctcttgcagatttgcacatacttttcttaatatttttgtgattttgcccttggtttgacatcaagcattttgacatgaatttttgcccggttttcacttgaattttcacatattcgatttgaaaagatgagggcaaacacaatcttcaaatgaattttgcccctgtttttatatgattttggacattgttaagaggagacaacaaaatggggataaagctcaagcattagttaaaaaaacagagacggcaaaatcacaaagttagaaaaagtagtggtggaatcaccattggagtttaaagtagcagtaagatcgcaattgctactttttaatggtataccaaatttgtcatattgtttctatttatccgagtgttaatgttgctttctcatgggtggtaaagttcatttatatctatcttaattattaaggaaaatggtatctattactacactatattaaggaaagaaacatgttttttttattattttagtatcaaaataactctctgaaaataagaaaaataatattataaaaagcaatattttctagtgtgtatatttacttggagtatcagaaaactttatgagtattataaaaataaaaaatctagcatttacatagatagcatggatattaacatagaaaggataactatgtcttgttactactttccctctttcgtggatgtatttgtggaagaaggcgataggtttttatttaggaaaaatcgtaaaaaaaatatggctgggattttgtgaaagctctagctcgagagagtagatgagtcacttaaaagaactaggaaaaaaaaggcagcaaatagagataacaaaataaaaacatgtaatgcattaatatgaaaacccttgtgtaagaagccatgggcacacaagtaaaagattggttacgaggcgataaataaaacaggggattaatgtacctttttatttatttaacattttcagatgtatcatttcatagcttcagcatttcatattcctaattgtcatgtgaaaatgacattaatagatctttcatgaacatcttattatatcatcaatttttatgaatgacaagtaaaagaacttcatatacactagttaaaaaacgattttcctggacgaggagctatttagattacagacggaccgttttcacgtccgcccgcaaaaatcagcctcccattttcacgtgcggacccttaagaggtctgcacgcgaaaatcgattttcgcgtgcgggcctcttaaaggcctacctacaagtctatccttactccttttttctctcctcaacactttaaaatttcatccttatccacccatcatgatccttatcctctctcactctctcacctctctctcactcccacactgtctcctctctctcactctctcactcagtcgcggctcgaggatggacgtggccaacggcatcatgcagctcagcgacaggcgcggtcagcggcaccgcacgactcggcagcgggcgcggtcgtcggcaccgtgcggcttggcggcgggctcggcagcgtgcgctcggcggctggcgaccaggagcggacgaccgccacccgctcggatccggcggaggcggctacccctttcccggatctggtggcagcggccgtcccccgcctggatccggcgggcgggcgggcttggacggtggggaggcggcggatccggctaccgcgacggcgacgatggagaccgcgacggcaatgatgatgacgaccgcgaggagggtagtggcgtcaactttagggttagggttttgtttttttggatttttttcggttttttatttttgcgtgcgggtgacatagccaccccgtagatttttgcgtccagatgcgccacctgtacgcaacaatagcgatttttacagatacttcgttacagacggttgaaagatccgcacgcgaaaatcgctttcaaccgcacataaaaatcgttattttactattattataccagtggcttctatggttagaaaagaaatagctgaagttgtttattgtaaatcatggtgatgtcctaaatgacaagtagaaaacaacacaaaaagtaaggctataactcgtttcttttctagattttgtttctgaaacttgccttttgttctcaaatactagatttcttatagggtttcaagcgctgtttttcccaaatgggccgctttcaaggaagtaagcactaaggacaagtcaggaggcttttaattgaattgattaataagcatcttatgttgcgctgaagtctaaacagcatcttaaaaataagatgtagagtatccttagatgcatattgtaatttgtaagaactattaatccagagtagccgaataagttggccgattaattatagcatattaataacgtgacactgtttcgcatgatgactaaggtggtgtgtttgcaaactactccctccgtccagaatgtaacaacctattcccattctaagacaatatatctgggtattgtcctaggttgctatgtacgttctgggacgaaggtagcagtagacttcagcaatctgctgctgcgcccttttttttttgcatttcattctttttcattttccagggggaaaaatgatatattattctctcaatgcatgcatatactacgggcatgtttgttacagctctaagttctaaatataactccagaagttgagtctagagtagagttgtggagctgcctaaacccagctccacaactctagtacattttgtgagagagctccacccaattccactcccagttttggtggagttgaaactgtttggctgagctccagctccaggaggggtggagctggagctggagctgtgccaatcagacccgtaccctctgtttttttaacatatgatgcccttgacttttttgacaaacatgtaaccattcatcttattcaaaatttttatacaaatataaagaatttaagttgtgcttaaagaacatttgatgataaatcaaatcataataaaataaataataattacctaaattattaaataagataaatagtcaaatgtatataaaaagtcaacagtgtcacatattaaaacagagagagagtacctgcttattggcttttcaacagtaccagaggcaacctggttcatgaagtttacatctgtaaactcaaaccctcgacaccccccaccctaaaaaaaatccaccaacaccaaatatatgcctacagtatcacagaataactatttgattgagccgcacagaaacacatgaatcagatgagaaagataagctcaaaagaaaagtttccaagaggttagagctcttgctaaatttcctctaaaatatttgtaggattgtccattctatgataatttcaaaggatataatgggacttaatcctgtttcaaagggttttatagaaaattttttctataagattaaaatcctccaatatccctacgtttttcctccaaattaaaggagccctaattgttgattgagccataggaaaaacacagaaattgaataagagaaatagggttaaagaaaaaaattttcaagaggttggagctataaaattatccatttcatataaatctatataatcctttgttttaaaactcctcgtagaaaattcttttatagcactaaaattctctgaaatttctattttttcccaacaaatcaaagaaccaggaggggtgcatacataccagttcttccagcggattcagccgcttgtcggagcatctgcagactttcgcacagggtggagtactcgcgggcgatcgtgaggacacccatgaaacctctaagaaatttgtcagatgccttctgtaccaggctgttgaggatggccgtcagctgtccgcccccgtcgttgtcgtcgtcgtcgccgccgctggcggccttcgtccgctgcttttccgggcgaaagccgcctctaaagcaactcgccatggatatttcccgtacgtgctcgacctcgttctcgtgcttactaggatgaatggcaggatgtgggaagaggcaaacagatagtagtagtacatgtgtactactcctatgtatagtactcctagctcttacgttggtgtttggatcagagacttaactttagtctttatatttagacactaatttagagtattaaatatacattacttataaaactaattatataaatgaaagcgagataatttttttaagcctaattaatccataattaaagaatgtttactgtaacctcacataggctaatcatgtattaattaggctcaatagattcatctcgcgaattagtccaagattatggatgacttttattaatagtctacgtttaatatttataattagtatccaaacattcgatgtgataggtactaaaagttttactcccattcaatgtgatagggacttaaagttttactcctatctaaacaggtctaattccttctcccaaatatcggagcagaaggcgaagaagatgcgaatgcatgtaccagtacgaatgaaggcaaatccaaaagtcaaattttgctacttagtgtttacacatactagtacgaacagaagtaaggcccgcggtttagttccctcgcaacaaattttataccctatcatatcgaacagttgaacacctatataaagtattaaatgtaggctaaaaaaataattaattgcacatattaggactaatttgcgagacgaatcttttaagcctaattgctccatgatttgataatatggtgctacagtaaatatttgctaatgacggattaattagatttaataaattcgtatcgcgatttactaacggactctgtaattagtttttttattagtgcccgaacaccctcgtgtgatattctatatagtaatacctgatgtgacaccggaaatttacatcctggatctaatttcgctaaatccaaaagtcaaatttcgctagctctaaaagtcaaatttacaccctggatctaatttttaaacacccctaaatccaaaagtcaaatttcgctagctgttggtaatcatcaccgacggagaccgaccggctatcgagaagagatatgattgcagcatttatttttctttcctttcattccttccaagatacttactccgtcccacgatataagagattttatctaatctagttgtttcacgatataagaaattttactatactacttgtcacatctatcaactctaattcaaatttttatccattttaaccatcaactacccactcaccaataagcaaatatcatttaataggggcattttagtatttttttttgttatccttaaactaccaaaaatgaataatcccttatattatgggatggagggagcattgctatcttcttcctccatttaaaataagacaacctattgaaggatatgacatctagaaagggataaatgattgtccagattcgttacatctctcttgtaggttgcttattttttttatgtagagagtacttcattcatcttagaatataagaatttaaaaccgaattatactaatattatagatctggagaaatagtttgttctaaacaaaagataaacccgcatgtcgttatactacccacggtttatttttctaagacggatagagtatacattactgctagtcaacttttgcatgcgcaatctccaaaatccttcaaactgcagcgatgtgatgtacacaagtgccaacttaaaagctactacctccgtagtgggctagtgtgtgctattggtcaacacacggatcacctggtcaagtagccagtgcaatatttgaagagcaaatttcttcggagagttcctttgacagctaatatatggtttaggtggtgtttagattcggggacttaactttagtccctttatttagatactaatttagattattaaatatagactacttacaaaactaattacataaatgaaaactaattcgcgagataaattttttaagcctaattaatctataatcagagaatatttactgtagcatcacataggctaatcatggattaattaggctcaatagattcgtctcatgaattagtccaagattataaatgggttttttactaatagtctatatttaatatttataattagtgtccaaacatttgatgtgatagggacttaaaagttttagtcacatctaaacagggtcttagttccctaaattttttttctcaaaaacgttatatgaaatctttagacacatacatagagtattaaatatatgccgggtttagttcccaactttttctttaaacttctaacttttccatcacatcaaaactttcttacgcacataaactttcaacttttttcttcaaactttcaattttagtcaaactttcaattttggcgtggaactaaacacacccatagattaaaaaaactaattgcacagttatggaggaaatcgcgagatgaatcttttgagcctaattagtccatgattagccataaatgctacagtaaccctcatgtgctaatgacagattaattagattcaatagattcgtctcgcgatttccaggcgagttatgaaattagttttttcattcgtgtctaaaaacctccttcgacatctggtcaaacatccgatgtggtatccaaaagttttcttttcacgaactaaacagcccctaaacaattgttcaaagaacacaagaaattttacaacatatgattgagatttgagaaaccgtacgtaggaattcttgttccatcatgagctttgattgtaggattgcctccaaaattcctactcccccattctaaaatataagcattttgaggacattgataagtcaaatatttttaactttgaccatttatggaaaaaaatcaatcatatttaattgacgccagacttgaaagcgcggattacagaagcatcggtgatttcggggatcgtatttttgcactcattaaagcgccgaatatagtccctcaatgactcgcccggattctgcgtcaacgcgtgtaggttgtcctcgatcgcgtggcgcttgtatgtttcttggaagttagtgacgaactgttgccacagttctgcccacgaagaaattgagtagggcagaaggtgaaccagccatgaacgtgcagatcccttcaacgcagccggcaagtagttcgccaatgcgttgttgtctactccggcagcatagagtactgtggaatagacatgaagaaattcttcagggtcggtgcttccgtcgtatttctctattgctcccggtcgaaacttctcaggccatcgaacatctcgcagagtacgagtgaaagccctgcacccgctgccaggggcagtaggttgtcggcgatcatacgctcgtcgcggatgtctgtccgatgaagatgacgaagatgatgatgatgatgatgagtcacttggttccggggcgcggtttcgaggacgacgctcgagtatgtgagccttgctgtcgcccatcgttgttgtcccggcgtcgatcttcgtcgtcgtcattgtcacggcgtcgacctcgactggtatcgcccggcacccgctgctcgcgattagtatgttcgcggcggttgtggcgatcatcacggtctcggttctcgctcggatgtcctccttgtttgccgttcttgcgatgtcacgaagagacgcgatgtcgggaatggttttcattatcttgagtgagtcgcgcttctcggcggccatttagatggttgcggagatcactggtgccgcaaggtggaggggtagcttgacgcagtggcgtccgctaatcaggctgttccccattagcgtcgccggtcgacgtttgttctggtggcgccctcacggcggcctctgcgaatgcgttactaaggttagccactgattcccgtagtcgttctgcccattgatcgagatcagcgttcaggacgggatcgaaggggctttcgctcaatatcgcattgagggttctgatatgttgggccagcgtcggcgtaaccgattgatcctccattcctgtgttgccgcctctagatgtgctggttccatcgatagcgtacacgtcgcgtggtgtacttgttgatgatgaggccaggtcttcgagtagatgtaggacagatggctcgtggggatcgatatcgattaccccgacgaatcgatctaaagtagtcgccgcaccttgttccttgtccgtatctctaggagagatttgtgattgctggaccttaggggatgacaccttcatggcgctgagaaggaccttgcagcttgagaggtcgtgagtctttgccttatagataggacaatagacatcacgagttggagaaatacgttgaattccacgctctttgcaggcacagatttcagcttgtacgctgaggaaaaccgagcaagcttgcaaggtgtgcttgctagtcctgtggagtggacaccaagctttagtcgccccggaagttgtccttgtaggctcgtgcttcttgtgggtaggacaagatttggccgcattaggatccttctcgggcttggatattgtcgacgttccgttctccgcttctgcgggaagatctttcgacatggagtcgaccggggtcgtaatcatgctgttctcactaccgataattgctgcgccagtcgagatcggcattgtggtgttgaccgggaagacgatttcacctacttgagtccacatcagcatcgtcgaagttgaaactccttggtcgatgccggtgttgacgttgtcgtcgagaaggcttgaagtcatagtagtagaaccttgagcaccaagtctccctacttggcgcgccactatcgacagtggatacccgtagatcggatatagagggtattggggtccgttggtaccaggatctacgtagtacgacatcaagcaaaaaaagacaaggattatactggttcaggccccttagtaggtaatagccctaatccagtggatatgggattatatgatggaaaccacagattacactgggaatagcagaactcaatgataccgacaagaccgtagtcaagttggtccgactagatctcacggcgacttggctcctgcacgctccaactccctagactgtggtgggtgtgttggcagtaatattcgatgccttaggtcctgcccaaggggtcccttatataccgcgggtcagttgatctccaagtaggactcggagatatcgaacccctcacgatatggtatagacccagtctcgtctgagtagaactccttccatccgtagattccgtctctatcacgtgatagatttccttaacgtatacggaaactatccgtatacgcgcgggtataccgtatcggtattcaacgtacatccaagaatagagggtataccttatccataaccctgacagaaggtaatatgtaattgccatatctcttgtatgcagcatacaagcatatttctatctcgcatatctcctccacaagtatgtaatcaattgtttccatcatgattatcttatagagcttcgtactacaaaagttataatgtaggtactaaaatttaagggttaatttgatatgtgccattataaatatgcatatccagataaatgtcattacaattcgtctatttatagtcgtgccactcaaattttataaaattgtaactatgccatcgccatcacgttttttatcttcttcatcatttgcacgtgggacccacccgtcagattcatcttcttcctttcaccctcccttatcatattcctcaccatctctctgtacggcggatgggaggagcggacgagcagcgaggtggcggccgtcattatcgccggaatgttggaataaatggctaggcccaatttaattcaattaaaatctcaagggcccacaagaaatgttagagacaataataccaccttagagattaaaagtggagtatctcaacttaaaaaatgagttgagattccctgttgaccggttgaggtgggggtcagacagcaacacgcgccgagcgaggctgagggcgtggcgaggcgagcggccgctgctctcttaagttttgcaatggttgggaattgaatccacctacgattatttctgtaacggacgaatcaattccttgattgattacgttgttactacagtaacggaagcaaaagtgaccgggattgattcttagcgatcgggattgattctcttccccttcccctcctgctctcgatctggtcgatttggttaaccacaccttcgcctgagtacctgcacgggtagatgattgattgcgttgttactacagtaatggaagcagaagcgatcgggattgattctcttccccttcccctcctgctcttgatctggtcgatttggttaaccacaccttcgcctgagtacctgcacgggcagacgggtgatcaggtttttgaggagtgcttccgcacgactactcgtgtttcttcctctgtttgtcggtgtaaacatcgtcttctgcttcggttgttcagcgaccatgtcaacggacaatgccaacggcagtgcgcctggagacggcaccaacggaggcaattctgcctcaaacatcagcggagggccattctcagggtataacactgctttcatcgtgtttatgttctttttttcatatgctactgttaggagcaatggtttcattgtattctattgagatgaatatctatgcttatcctttactaagcatgatcccaggtttacgtttattgatcactagtttactccctacaaatatcatacttattgtcttaatattttggattaaaatatatcaaattgtgaccatatttccaacacggaaagtttgaatcctcacctagacccatcattatcgtcaggggagggaaccgagactcggagagcatagctacagccatggcgccgactcatcacgatgcttctctcgcgcctccaccgtccaccctgctgtcgccgcaccgttccccatgccaccgtcgccatagatttgcctccaggaggtcttgcagccgaatttgcggcttgtttggtatctcgagggaaggggattgggagtttacacgagggaattgatgatgagattaagatgggaatttgattttttatcccaatatcttgtttggtggaggtgatggaattgatagggagtttagttggagattaggtcattaataaaaacggatggctgagatttgcttaaataaattaaaggaggaattccctcccaattacctgcccctacccaggtattgaaaagtagggagttctttccttgattttccatccccatcccaccaaaattcccatgtctcccaaccaaataaaacacttaatagcctcgtccctctaaactcccaatccctccttaaaaactttctccaaccaaatgggccgttggtgtctgggactgacgacagcaaaagattaggacaccctctctggtaggcctctctcttctttcacgggctggcctatcccttatccgagctcttctgtagccgcaacgctcaacatgatgacacgagaaaaaggtttgggtgatgcagtgttactctgatccactcgtttggtcttgtgcagatttttcctttcactgtttcatttttttttcatggtaactgattggcggaggatcttcgagtgtttcgtcgaaacaagaattcggcaataataaaaaggtagtacacaatacctaaaagtggatgaatacggagacaaagaatttaaacaggttcaggtactttcaatgagaggtaataccctactcctgtttggagatttgaatccaccgagtgtagtattgatctgactatatgaatcctctgccctagaggacctcctatccgtcttatataggatggagggcaggattacaagatagaaaccttaaccaatacggtatcggtttcctaaatctactttataatattatcaaaccaggactttaggtcgttccgtaatatacaaggaaatgtaatacctaagtcataatttgtacatttttcatagatataagttatcccctataactagtcggataaccatgccgtgtgggtatggggtacccataatctccacagtaacccccgagaccttcatagtcgaaaagataattttctctcgaactagattactccaaagccgagtgcttcaatcatcttcgccatggtctcccgagtacttttaccaaatctgaagactgtggagggctgaaaaataattaaatgtaaacttaggtgcatcgactagatgcacctaataggtgtagcccccaactatgtggttagttgaataaactaaacatatagtcaaggagtaaataatctaaccaaccgagtggttttgataattgtagtcaaccaagtgacttaatattaatggtcaaggcaaagcatgatcatgaagctggggtgtcgaagagcaaggagaagggggcacgttgctataagtgtcatgagtttggacatataaggaggaattgcccgttactgaacaagaggaaaagtgcgattgcaagtttagcagctcatggtgatgattcagatagcagtagtcatgagattctcacagtgtctaacgagaagtctgaagaagcgtggatgttagactcagctagttcctatcatgtgacatcgaagcgggagtggttctcgtcatacaaatatggtgattttggtgttgtttactagggcaatgacacgagttatcgtgttgttggagtgggcgatgttaagttcaagatgtatgatggaaacgaggtgctactttcggatgtgagacatgtgccgggactaaggaaaagtttgatttcacttgggagcctacatgagacaggttggttgtattaggtggattctgataggaagaccacgaatatcatgaaggacagcaagactgttatgactggtgagaggacaagctcatgttttgtacaagttataagggagtgatattgcaggtggagtcatggaagatggatatactggtgttgatgttcacaatcctaaaggcggcgagcctagcataggctcgtcgggcggctcggcgtgagcgatagaagaaccaactcaagtcctagtacacggaggttcaagcaagtaacagattcaagttggcgtggcatattcgtcaaggtggagtttgttagagtttgtgtcgaatatgtgtacataattggttacagtttagaacttagagttgtaataggcattaggactagagtatgagttggactctatcctaggatctctcataaatagagggacatgcctgttgtaactgcatgatgacttagcatagcgagagggagtggctgccggcaacgtctggccgtgagtcgttgtaactctcatacgctgtatatgatggatcggggaggagcgcccgtaataagtgccccagagatgtatactacggctgaactccattaccaaatatcgtgtctcggtgtcgtcatcatgtttggatctcctatgatgttttcttccgcgtttagctaccgatgtagatttcgggactggttttataacaatacggtctacggatatccccgccgataatggtattccctccgtttcatattgtaagccattctagcattgtcctcattcatatagattcatgccaaaaagtcttacattgtgaaacggagaaagtagtttttatgggatgagaatggtgaattgagggagaaacttcctcctattcaatatacacaccttctgtcccataaaaaactcaatcctaaccggtacggatatgaacacgtgggtgcctagattcgtagttatgattgaaaattttctaagaccaagggaatacttggtaggaggtgataattgagagaaaattattcctttacgtcgcctaaacagatcaagtctcaaccattcgtactccctccgtactcgtaaaggaagtcattttggacagcgacacagtcttcaaaacacaactttgacttcttgtttctataaaaatatttattgaaaagtgatattgtcagggttatggataccacatacataatagtagttgactaaatctcggcaggatccaccacatactatgtcttatacggaaactggcctcgagggagttccggataaggaaagacaatcagagttctacatagaaacgacaaggactactcggattgtatccatattggtttccctagttctacttagacaaggggacacctatggatataaatacaagatcccctaggaggagaggggagggggaccatggaagacacccatgacaatcaacgtacgcccaccagaagacacaacatacaagcctacatacgccaagacacgccgccggatatcgacttcagggataggcatggctattcccctacggtgtctccggataatgtcatgagatacgaaagcgctatctctgatctcgccggacacggattcgaggaggaaggctaccctgttgtcgactaaaagtcagaccttcagaccgccatgtcgacaatagttagataggctaccccacatattgtactggtgtgattatggtgaataaaaagcaacatcggctccgaccaacaggatgtagggctattacctgactgctcagggacccgaacctgtataaaaatccctgtccccatctcttttacctcagtctcgcatatatcctaacactaacgatccccatattgtccaaataccgtagtcgagacatcaaacgtcgacagtggtgcgccaggtagggggattttggtgctctaggatttcgacgagatgggtttaagaagatggactctccgacaacaagctactcgacgactttagctatgaggagatctaacccaaccggagtacgtccccgaatgagatcggaaccatcaacatcaacaattttgatctgttgagatcatccaaccttcaaagatgacgccgccgctgcggagggcatctgtacggtatttccgaccattgacgatcttgaggatgatgccggaagggtacaagacgccgacacctctagagaccgaaaccgactactacactcatcgggtttaagtgcggttttggtcagactcggagtaacaggccggatatacttcctccgtctcaaaataaagccattttgaggttggcacgggtattaagaaagtaggtgagaatgattggaggaagtgtgtgattggttgaaaagagaaagtaggtgaagaagaatagttgtgattggttgagaggaggaggtaggtgaagaaatagcttcattttgggacaagacactgtgctagaaatagctacattttgggacggatggagtaccactgtccgacatcaccacgtactgatcgcttctgacatgtgcacatgcatatgcacagactcaatacgtgcccaggcatgcattggtttgccgtcatatacatgcaccgaagacaattcaacggctactaaggctagttaaggtaattagtagattaattaatttaatcaatctactaattccatagatatatccggcatatatctacacaagtacgcaatattttatatgtaatttatcgtatctatccagatcatgcagcattgtcagatcaataatttattatgtttacctagagcatgttttttatataatgtccgttgtgcgagtacttccgacgataggccaactacggtctaacgctgggggctcgctctattttcttctgtataaatcatgcttgtttacggtttacataatgcctgatatttaatctgctcgttatatcctgataatactagaagatccatgcaattttttgagtacatactcgatattatctgctatatatcttgccttctagaaaatatttttcaggaacaattgagcactcgagtaggttatggtcgagtacactccattatcgagaatattctcgacaaatgtggagttatcgcacccaacctaccaacaaagaccgacgacctatctcatagcaccggccatggctggactactcgagaaaaggttgttaatagataattcctcgtgaacgccgtcggcttgatcacccgacatgattgcgaacggacatctggatatgctataagttgggtacgtgattcatgctggccacatgaaatacacttgcaataaaccaactctagcacttccattggtgtgcgagagataattccgctcgctcactggttctcgcactagtacgcagcaatctctcacaccgcaacgtccattggtgttcgagagataattccgctcgctcactggttctcgcaccagtacgcaacaatctctcacaccgcaacttccattggtgttcgagagataattccgcttgctcactggttctcgcaccagtacgcagcaatctctcacaccgcaacttccattgatgttcgagagataattctgctcgctcactggttctcgcaccagtacgtagcaatctctcgcaccttaacttcagatggtcaaggtacgactacggcagcgtagcggtcctcgcaccatgacttcagatggttgaggaacagctacgactggtcttcgaccggcagcgtagccgtcctcgtaccacgactccaaatgatcgagagacgcctattcactggttctcaaccagttgatcatagtgatctctcgtacatttgcttcaagtggtcgagttacgactactgcctggtcctcgaccagcgatgtagcgtctctctggctacttcgactttcagtggtcgagttacgactactgcctggttctcgaccagcgatgtagcatctctccggctacttccactttaagtggtcgagttacggctactgcctggtcctcgaccagcgatgtagcgtctctccggctacttccactttaagtggtcgagttacgactactgcctggttctcgaccagcggtgtagcgtttctcccactatttccacttatagtggtcgagttacgactactgtctggtccttgaccaacggtgtagcgatttctccccctacctctacttcaacaaagttggtagcaggtacacaatatcgccaagttttttacccagagatcccttaccacgacgacacctagcgttgaaacctatcctactgtccctttacgccgtcctgacaaggcctccgaggaacctaagggatcttcggctggagacgcccagagctgataagaccttgtcggatcctgtagagacaaaagaccatgtaagatctggtcgtgtaagagttctcgccgtgcgtattaaccaagccgtgtaatcggaaattgacttttccaacttcacggctgggggctaggatcagtgcttattcaaccaaggcaggtcaagggtccaagagccttatcatccgagaacgattatctgacgacaaggctgggggctagggagagtgcatgactctacaaactgactgatcgaagtcgttaagagagaagacgctcatacacaaaacattgatcggtaaaattaattcatttttagttttccatacatattataacatgtcaccctttgagcattcgctcgggggctatttctatttgatattcttttctgagtattgatttcaggaaaattctattcgacattgatgaagactccatgtctctatggttctacaccaagatcgactaaggcgagttcgacaaatgtcgacaaagctccgtcgcagactctacgccttctcgatcgcttgagaacggttgctggatctcgacaaggaatacggaatgaagaaatggtgtacccgccgagataaaatttcttgacttcaatccaaattctcgattacagcaagacgagagacttagtcgtacgctctgtactttctcggtcgacatcagagattgacttagacaaaccctttcggtgcccgcacgaggctgataaaggaagtctaacgttatctctaaactcactgagaacggtcacgtgagctcgataacagttcctccgaagtctgcggttgagaatatgaactcgttcatttgcatcgaagtcgggggctactgtcaaggttatggataccacatacctaatagtagttgactaaatctcggcaggatccaccacataccatgtcttatacagaaactggcctcgagggagttccggataaggaaagacaaccagagttctacatggaaacgacaaggactactcggattgtattcatattgatttccctagttctacttgaacaaggggccacctatggatataaatacaagaccccctaggaggagaggggagggggaccatggaagacacccatgacaatcaacgtacgcccaccagaagccacaacatacaagctacatacgccaagacacgccgccggatatcgacttcagggataggcatagctattcccctacggtgtctccggatactgtcacgagatacgaaagcgctatctctgatctcgccggacacggattcaaggaggaaggctaccctgttgtcgactataagtcagaccttcagactaaaaaataagagagagcaagactaaaaattatagccccatattaatcacatcatcaattttctcgtccaaactttcactcctcttgccaaacaatccgtaaatagttcctaatcgaatggatttctcgataaggccgatggtcgcattttgaaagcttgctcagtttcgatcgcctccgtcgtcttcttcccttctccagatgccctgggcgtcgcaccgccatgagctgagcttgggacaccgccgcttgtcgacgaaccggagcttaccgaacgtgctcctcagctgccgccactcacagtccagacgctccaggaacctcacccgcaacgtctccacgacgtcccacgtcacgtcgtcgccgaacgcgcggagcctcccgccccggacgcacagcttcctcaggccgccgccgcgcgccgggtgcacgacctcctgcagctcctccgccggcacgcgccgcaggtcgagcttcgcgaggcgggggaggagggacagatccatcctcccgccgccgccggcgtgggctgcggcggcgccccaccgcacgctcagcgactccaatgccgcgaacccgtgcagccgcggcagctcgtcgtcgggcgccacgggaagctggcgccccgtgctgacgctcagcttccgtagcagcggcagtgccgcgaggtcggcgaggcggcacggggggatcttcttgccaccggcggcgctggcgaccacgaagccctttaggacctggagccggtggagcttgcagacgccgtggggcatttggtcgagcaggtagcactcggacgcgtcaaggtactcgagcttccccagcgacgccatggacgccggcagggtctcgaggttgtggcacgccctcaagtcgagcacgacgaggtcgcggaggtcgccgatggactccgggagcgactcgacgagcgagatgccccggaggctaaggtacctgaggttccggcacgccgccgccgccgcggcgcccaggacaccatccggccggaccatctcgacgtggtgctccggtgacgtctgccaccgcccgagctggagagtccccatcccccgctgctcgcccagccacgcctcgtccatctccaagtatcgctggctcaggttgtacaccgtgacatactcgccgccgccgccgccatggcggctactaccacgggtcctgcacagagtgacgcgccgtgtcgtgccggggaggcactcgtcggtgggttcgccgtctcggtcgaaggcgaagtagctgaagctccgcgcggccgcgacgaggaggtcccggaccgacgggtggaccctgcagtagtgcgccgtgtggcagtgtgggcggagcatcgccggctggaggaggccccgggagaggaggtcctggaagcacgccttcccggcggcggccgaccgcacgatgccctcgccgatccaccagtggatgagcagcctcctcttgatcgccttgccgctcgggaacacggcgaggcaaagggcgcactgcttcagctgcgggtccagggactccaagacgctcttcaggtggccggagccggaagggaacgcctcgtcgccgccgccgtcgtcgtcttcgccgccgcgggtgttggtcgtcatccgcatcaccttctcctgcagagctgctcgcaccagctgcacggctgatttgatctgctccatgaaggagcagagctcgatgtggtccagatcaagaacgtcatcctcatcttcgccgtcgccgtgaccatcgtcatcaccgtcgccgccgtacctgtgcaaggtccgaagatccatttgcatctcttcgaccatcgtgtcaatcttctgcagccggtgttggatagcagagaaaacatcgattggttcccggcgagctaacatggttgagtgtagacacgaaggggaaaatgaggcaacctgaattgtgctatgcacctaccacgacccctatcaccctatgatgtttatagtctttcaaaattttgcaaaggttggagtagtagatgtttattagtgttctgattttttttttaaaaaaacacacacaaaatttgggatgttgttgccgcggtgctaagaaaggtccatgggcgtgggggacgagcgagtccaggatggctccatagaggttaccagatagcaggttgagcccacgttcctcgtctatcctagcgagaatggggtcatcactgctgctgctgtgcctggaaaggatgggatcaccatcgccattatcgcgccgagggaggacgaagtaagtcgcagtcattgtgctgagggacgacgggtagcgtcggcaccggtgctattgagtgagtatgagaaaggtcgttgccgttacactgagaggcattcatggagaccacccttgtcactgtcagggaggaaggggagcattgccaccgtctccagacgaggaaggaagggggtcagggaaatgacactaccaatgggaaatggtacggtggaacaaatatccacgtcatttttgcattttcaatctgttgcctttgtcagggcgtctctaaaaattggaatttttaaagtaggcaaggggctgccgtgaaatactgatgacatgtgtgatgccttcactcttcaacctagacgaatcaagagacatgacgagaggcaaataaggaaatgaacatatcgttttgattgtctgaattaggagcttagcaactcactagtcaatactcaggatgatcagcctcacgctaatgcccaaacgtgtggtggcgaagctgcacttgggtgctagccagatgaaccgtcgagacgtcagtgcagggcatatgcatacagtcaatgaaccacatagtcacataggggtgttaccgtatcagatgggtatgatttgtgaaggcagcgccttagcactcatcaagctgggccgatgggttttgctctcttcgattttgggcccccaaaatttctaggggccctattccatcgctcagttggctcaccctcttcgacgaccatgatctttatagatattatgaaatcggtatttgggtatcatatttggatcgtggagtgtcggcttacaccgacaaggtatggtgtgcagatggatacctgatcttatctaatattgtgataccatataaatcctaaactacacacgttgagagatattttctctgtcctaaaatataagtattcttagaatagtgacaagttaaatatttttaactttgactattaattaaaaaataaaaaagatcaatcatataaaattgatgtaactagatttatcatcaaacaaactactatcatactccctccgtaaaaaaaactcaatctaagatgggataagacatattctagtacacagaatatgttacatcccatcgtaggttaggtttttttatagagggagtagtatgcaattattttcatttaaaatgttttattattatagatattgttggtcaaaataacatctcgaagatcgtgtcgaagtctaaaattggttatattttaggacggagagatcatgaacgactctcattttctcgtgtgtttcacgcctggctaaaaattaaaaaaaaatctactcctagcttggcacgtgacctatgcgtgatccgcaaccgctctcaacctccaagagctcgtgagtcgagaaatttccggcgtggtcggtgcccattttggtcagaatcgcacgagcaaagcaacaccccccaccccgcctgagaaatccccacgtcaacggcagcaaccctcccccctcgatctccgcctgtaatcttcgattcgtcgccggcaaccgccgcccgccgccccccgtcgatctccaaccgcagccttcgccgtcccgctaagttggagagcagcacaagtgctgctgggagccgcttgggggaagccggttcgggcgactgaacgccggggagcgccgccgccactcgctagctccggcctccgggggcaacgccgccgagccacgtcgccggtcaggtatatttcggtttttctgaatacggaaattccatcaacaccagtatccaagcttaagttaggcctcgcaaatatttcaatccagggatttgtgtgccgcatgataacctattagtattattaaaccatccttccattgctctaaaatttgagctctgtattggtcgatgattccacgaaagctcattggagcccccccaatgacccatgttaaatccacccctgattttagttcatatgctccgctttatcatttttagctaaagatgcatcatatggtagttcgttcgcactgtaatgttgcttcgcctgcttgtttgattgagtggctcttcctgtatgcatgtcctaaacaaacaggcaatggatatggatgatatgctcggtggcctgcgtgttgccggagtgccgaccaagagcgcaatttacttatgggggtataaccacagtgggcagacggcacggaagggcaaggagtgccacttaaggatccccaaaagcctccctccaaagctattcaaatggcaggatggcaagaacctcaggtggattgatgttgcctgcggtcgcgggcacactgctgcggtcgcttctgatggatcgctctacacctggggtaggtcctttatttttccttctgttctttaaatcagactcgaataatttgctaggtgaatggatgaaacttcaaatgaatttattaataccattattgtttatactgaactttgatagtttacttattatgtctcgtgtattttttcctcaatgttatgtcagcacaggcatttgcgtcagtgataaaaatactattatgtctgctcacactatttataagtcgtatcagtgttacaactttctgttttctgacataaccatgttgtatgtgtagtttagttaaaatagctatatagtttctaaaaggatcacagtactccccaagtgtacctaattcaatactaggatataaagtgcttagtttagtgagggttagtttgcaaagtcattttatcaattatagcgcttgagcgccagagctaagatgagttaattctgttgcacccataacagtggttttacttgttcctgaagaaaatcactcacatccaacttaaaaatatgtaggggcgaatgattttggccagttgggagacgggacagaggagagtgcaaaggaaccccaaaaggtgaaggcactggagactgaatttgtgaaatcagtgtcctgtggagcacattgtacagctgctgttgctgaacctcgagaaaacaatggcactatatcaagaagtaggctctgggtctggggacaaaatcaggtttgcccctcatatgattactgtccaatatgtgtgatcagcaatttatttaataaaatattcagcacttgcggtatccatgcagggctcagattaccctcgcctattctggggagcttttgcaccaaatacggtaaatttggattgcactgatctgttgttctttttgtgtgtttctagtagatatttatgagatctaaagtttttacctagtcagacattgcaggtcatcgatgctagtatttttcaaactcatcatatttaagtaatcacccatagtcttcatttcctatttatgtgttaatcttttatccctgtttgctgttgatacctgttatgccatggccacaatgcttagatagcagttcaaatagatgaactcttaattagttgtgtcatgtgtatgttgatgtaccttgggttaactgttacagaggttgtgtacatgcatgcatccaggagtccaaattccatagctgttactattcctagagttggttagtgccttaagataattaggaataagagataagattctaattaggaatatatatcatttgagttaatagaggcaagtgaagattataatatttctatatccttcttcatgttgttcctgactttctatatgtgacatccctgttgatgtagttccctgcaaccagctgctgggaagaacacgtccattgatctattgctactagcttataacagctaccttctcacattgaccacaaagtaaacacaataatgtatacccgcagtctgcattaagataaacctgtttagatttcaattggatttactctggcatattggcatcgtataccattgcctttatggtttgagtaaatatgatctaatccacaaggtaatgtatttgaggaaatagaatccaaatttcctcacgaaaattggttctataccatggaagatctatcttcaaatttaaccaccgaagttcactagtacactttaataccataaaaaattacaatctatttattgttgtttaccattccttcatattgcaaggatagaactgttaaaagctgacatttacccttaaatacaccctcacttaaccactttatctgtgcacgcatgagttttggaatcatctgtcttcattagctaaattggcagtgcacaaatgtattcaggtgtacaaaaccaatcatccaacagtaacaatcacaattatatgtgagattgcactggatggatgcacataggcatcgggtgcaacagagcagtcaaccatcacctgcgcttccagccagttcctcagccttcgctgcttgagccttgaggtatcccttccactatgattcccctcccagtacctcctaatccacatccctcccccatctcccttccctcccgctcattgcagccatggcaacctcaatctcgatccctctgcaatcatccagcaattccccatttccaaactttcaccctcttctccttcctctcctcccatcccttgttcctgcaggccaagtagggactgccccttagactaggtgcagcgctgtattgactggcagagagaggtggcattaaatgcaggagcagcgccatagtcagggcagcaaaggaggatttgatgctatggacagatcgaaacaggaggggaaaaggcggtattctcattattgaatttgataaaagaaaacaaaacaaacattagtcctaacagaataaggtgaaacgatatgaataaatctaaaaattaggaactttggatggcattaaaatgtaccggtgaactttgatggtaaaaatctaaaaccaggatctttcaatggtttagaaacaatttatcaaattccttaatgcctttgatgattctaaaccccatttgaagctgaagtgctcaacactgagagggttaaacataatggccatgtttcttttgcactagaatgcagccgttgctgccacagctgcagacacgtaatactgttcgggttggctgcactgcatctgaaataagtgcagctgaacagggccaaagtctttggagttacatttgcttattgaccaagaactatcctgtctgtgcccccaatatcctaataagctagtaaaaactcccggcatttgttaaataaaacaacaagcaaaagtggatgtgccttttttgtgcattctaggttctgcattctatgtgtgcatgcatctcatgtttctctgttattctaatgtgtacctgaaagtgtatttttggtcatttttcacttgtcttcgtttcagccacaaacttgttcattcattaatgaaaagtagatgcatatgcttgtttcttggctctacagtctgcatctacatgtatctcctagcattataagctgatctctaaagaaactgattggaagtagaaaatcaaaattgtgtcaggtgcacatctacagttggtttaagagaagtgaacaggttgctatgtgtgcttagaatgccatttatttcactatttgatatttttgtacttatgaattgcaattacttgttattttcttaacttgagatttgtgtcatgaattcattcttaaagatactggttggatgtacttaatatcttccatatgtacacaggtgatccatcaggtttcctgtggagctgttcatgtcatggccctatctgaagatggcctgctgcaggcatggggtaatgtgcaaaactaaaactcatttccatcctctatacacgtttttaaattgtgaactttttatgcaactgtgacactttgttaatctgatggataattggtcaatcagtagtgctagatcgttaggctaatgggatagctggttacgtgatgatatttcttgcaacaccacacaaacaagaggatataccccccaacttttttagttgttttatttctagctattaacaagatacatgcaacttttcttactaaccaggctataatgagtatggtcagcttggcagaggttgtacttctgaagggctacagggagctcgtgtattaaatgcttatgcaaggttccttgacgaagcccctgagctagtgaagattgttagagtatcatgtggagagtaccatacagcagctatatcagaaaatggggaggtgtaagtcatctcaaaggatgctgatctctgctgttggtgacagttatgtggtttctcagctgaaaaaaaaaggattgatttatagtggccgaactatatagtgctaactgtaaaaataaacaggcaaatcgtctctctttctgtccttttttttggaacatggcacagcagaggaagcccctgcagttagcttttcattaataaaaaagatactaatttacaaagtagaagtaaaagaaattgaagttacagggtcataatacagttcaaaagttgatctctcaaagtatcattaatcctaaaaaaagaagataacaatcctccttgaaaagcattgacaagtcaaaccaacttttttttttcaactgatgacttccttcacactccctttgctgctttattaagatcactatgtacgacataatatatgtgattttctaattatgtagacaccttctcaccttctgtgaacagaaaatgtgtcatatgcttataacagttaaatcatggtattacagaaaataattatgtagacaccttctcaccttctgtgaacagaaaatgtgtcatatgcttataacagttaaatcatggtattactgtacttaaatggcttgtcaggtggttttgcgaattatttgatttgctagtctattttttttatcatatgctcgctttgtttccaactagatgtcagatgtcaatttataatgcatgctaccaaacctttaaaactttgattagtaaaatatacaaaaaaaaaggatccattacatggtaattgtattagtagacctgttaaaattaatttcacaccattgcattgtctatacttttacaatttttactaatgtatagctataaaagaacgatcaagctgtgtccatgtaattttctaaaaaaactattgggaacagagtgcgcgttacaagtattttgagaattttgttcaaatccttcatgtgggttgtaacagcttattttatgccttctattgtggaacatatgtctaatagactaacaggaacatgattgtttctttttaatttttttaaatatcacctaattttgcagatatacttggggactgggaagcatgggacagcttgggcattgctctcttcagtctggagataaggagctgatcccaaggcgtgttgttgctcttgacagaacagtaatcagggatgtgtcttgtggtggggtccactcttgtgctgtaactgaagatggagccctttatgcttggggtggaggacatgtgggacaactgggcctaggacctcagagcggtttcttttcttgtgctcttaatggatctgatatgcttcttcgcaacattccagtcctggtcataccatcaggagttcagcttgttacttgtggtcattctcacacccttgtatctatgaaagacagccgcatatatggttggggctataatagttatggccaagccgctaatgaaaaatctacttatgcttggttcccctctccagttgattggtatgactctcagagtaatattctttcatctgtattgctatttttggtagttaattacagtatgaactttgaactttgcacatttcgcaatcctcagtcttaacctgttctttttaataatataggtgtgttggagaggtaaggagacttgctgcaggtggtggccattcagctgttttaactgatgcatgttctctaaaagaactgtgtgagttcaagctagcagagacagttaacatgtccaatgctcttctaatagaagatgttgcatcgcggactggtggtgatgccttggcacgtctgtgtgagaaattgaggtatgtacactgaaatttggagtcactaatgtttcttgtgtttcatatggtcaagtcctcatgcaatctgttttccaggccagtgagaaacattggtaacataaatcatcattagtgtgatcttagttccatgtgagagtttccatgtatctcggatatgcattctgcatagttgtctcaattattgaacgagcataaaatccacagtacatactaactttgctttcgctgttttcattcattacattagcctattagtttctcctctctgctactgattttggcatatttacagggagcatttggttgagcaaggagagtgtgagctgttggaaaatcaaatgattgaagaggtggaggctaaagcctaaatactctagtgattcatcgctccttcgtaggcattgattgaagcattaatcgtcttgttgcacttcatatgaagtgtgattgtagtgtctggactgaaggctctaattaattgtctattggactgtgaagtcccattggtgtctccaatgtgtatcaaagaaatggggactacatgtatgttgtatgtatcatgagtgactgttgttgtagagaaccaaataacctttggcaacttgagagctgtgctttgtcactgaaactaactgtaagattgagagttgccaggtcatagtagtgtgattcatgtctggtctcttttgttaactgtacacgttggaacgctagactccggttcatgttctcggctatgctgtggtttggtcctccgaatattaagcttttcactaaactctctaacaacaaagtcgttgtagtatagtggtgagtattcccgcctgtcacgcgggtgacccgggttcgatccccggcaacggcgatttctttttccctttctttgtttttttggctgctggcaacggcgatttctttcctttcccttgagattaacccacgcatttcagtttcactacttctgtagtcatcttttttattaagttatttgaaattgggattaatccgcatttcaatttgatttttgtagttcatctgtgctcttttacaatgcttttcaatggagtgttggttagtcgtgtgatttctgtctctcctgaggatttggaggaggccgtttggtttgtgacccaaagtgaaccatgcttaaaacaaatgtcttcgggaaaagaaaaaaggcattgttaaattgccactccttctgtcgtagaatatagcgatctaccattggacaggacatattctatattacatgataatatattaacctgtcaatatcggtagtttttataatacgtccaattatagattgttatattatgggaaggagggagtgtgccatattctctcgcatttcttactgtcaaacacgcagctttgccaaaattttgatctctttacagctcaccaaataatagcttagctaatctcaccaaaatattggtaacagcctagccagtctcaccaaacttttgacaacaatccaaacgaacacattttaccaaaggtgcccattcgctatgagttttttaacacacccgattttgcaaattccagttccagctagatgttccaattgcagagacgtgtaggcatttcaatgctgctgctcagagccccattggttttcctaataaatcaaagcaaaaatttaaatttaagtttggagttgatcttaaaatatgttcacttttaagtcgctaaaaatacaatttttttgtttataaactattgttattctctaataaacagttttgacttgttagaaaatgcaggcaaccaatgagggccttgaccattcgtccataatgcctacgaaatgatttagaaatataatatggtagtgcatacaattctcagaacaaccaacaggtatagtgatttgcaaaggttattaaatacaataacaccatttagcaaccaaagcacgactatcaaaattacatgataaaattattattgtcttgaattatgtaaacgatgataacaaatccttttccagctacaaaagaaccagcataacaacaaagaattataaagttgcttaagtaatctctcccttcatctcaaaaagagctatatctagggggcctaggccacagcaacactttcacttaaagggtactttccatcctgcgacacacaagctcccaggatcaatctacttggccttgccgttctcgacagcagcagtcgaggggttcagctcatcccaggcctcgatccaggtgaccatggcatcggcaagcttgacgaagtaggggtcgatcttgccgagcttctccctgacctgctcggcgagggagaggtagcacttctggacggtgtcgcactccttggggatggtggcgttctggaagaaggggatgatgtcctcctgccagaagatgcccttgtattccttcttcaagttcacgaaggggttgctagccttgctgtgccagatgtacggcagtccagtcttcactcccaggctcaggtggtcacagatgacctaaagtttcaagaattaatattaattattattttgtgaatggaatgttcaactgtgcaatgagaaaagacatatcatgtaatagattcatggtaatgacttataacttttcgacagaaacacaaaccttcatgcaccatccagcccacatgtcgtcgtagcgaccaataggctggccatcacccatgagaccaaagtacattgcaggaccgatgagatcacggtcaaaagcaaggttcatgccacacatggggaacaaggttcccttgggcacagtcatgacagcatcaacatacctgaacaaaacaaaaaaaaacaggggtcagtaaaacttattgatgcaagagaattgctgctgaatatcagatcagtcaaagaacatgcagtacctggagttcctctcacgaggcttgaccatctgagtaggagcatcatagtcagggatgttaagccacaggccgtgagagacagcagtcttggctccctccctgaggctgaaggggtaaccacggacaaagtcagcgccttcgcggtagggatcatacaaggtgttgaagaagaacggggtggacgggctgaggaggttcttgatgtgctgctcaagagcattgatgtccttgccagatgggtccttggcaacctacaatgccaagtcattcagttggtatgagatctataatgcaatgctaccaattgaaacattattacatcaagctaagctattaccattaccaatagaatgaattcgatcgcaacattactagaaaatgctacataagctttgaacttgaatggaagatcaaactggttcttaatatatttgattaagaaaatgttgtggatctcgcacaggagagagagccaaaatcacatcattatgtcaatttcatcagaaaagtaaaaaagcctgaaattgacctcaaatgcaccctcaacttggatcagatctgaagcaattatcccagatctagcgataccaaagcactctgataccgtttggttaatacttgacaaactgaacttgtcacatgtgaagcagacaagaccgcgtaagataagacgaactcccctaaccaaaatgaaaaggacccatctaatgacaatcatttaactaaccaactaactggcaagatctaacatcaactagagaaattgaggcatgcgtaattatcatatactaataattttaacaacacataaagccagaaaccaaacaaaagtactaatccttttcgaacactgcacctacctaccaaccaaccaaccaatgtgatctaccacactagctgatgctcacgctcaggtgaagcaagggatcaagatccgccgatgcgagatccagatctgatcaggccagatctggccaattccgaacgaaccggacccagatcccgggcttcccccaccagatccacgcggaattccgcaccaaaacaaacacagagagatcgagatcgagatcgagaggggaacttacgaagcagtcgtcgtcgatggtgaagacgtacttcttcttggagaccatgtagccgaagcagcggcatgcggagtccttgaaggagatgcaggaggccttggggccgaggatccggttgatgtcgttgcggttgtagagctcgtagtcgaagccctcggggacgcggatggtcttggtcgggtcgccgtcctgcacgatgatgaggtggtagggctggaagaagggccgccacatctccaggaagtccaggttgcggatcgtcgggatcacgatgtccagctcgtccttgagcagcggcgtcgacggcaccgacgccgacggcaccgtcaccgtccccgccatgatctctccctctccctctccctggatctcgcgcgcgcggaggaagaggaggaggaggaggaggtgatggtggtgaggtgtgaggtgtgtgtgggtttgggtgggtggggaggaggaagcgatttatagagcgggagctccgggaggacgacgactttgttattcgtttccttctttgctttgcttcgcttgccttgctttttttttaaaaaaaattgtgtataattaattagataggagtattatattattttgtgcctattttgttttggtttgcgtcatatgtttgccgaattttgggatgcgtccaaatttattttgggttggatctgggagagacctgtcggtgcatggaaagagagaacgtgtgtaccagtgtagaaggtttgaatttttattttttttggtttgttccaagcggtggataaaagataggggtatcttaatatcgtttttattggagataaggggtaaaagtgttaaatcaaatgaaatgcacaatagtggcagtggtttaaagctctgcttatctcaaaatcaatggaaagaaacggccgtttcctaaaatagaaacaaacaaatactccatccatttcaggttataagatgttttgactttggtcaaagttaaactgttttaaatttgactaagtttatagacaaatatagtaatatttacattaccaaattagttttattaaaataataattaaatatatttttataataaatttatcttggatattactattttttctataaacttgattaaacttgaagaagtttgattttgaccaaagccaaaacattttataacttgaaactgagagagtaagagtaagaaacttattttgtctatataatatcacttccaatagatgtttttttaaagcttgcagtttcaattggttacagtttctcaaaggttaaaattcctacttttatattaggtccgaggcattacgcaatgtttgtcttgataaaactagatatactctctactatatcttaagccgctacaagcgactcaacatttacaatcatgagaacctaaaccactattaacgcctcgtcatttactgttatggagaacatgattactattttatgaacaattgttactaaaatgacaacatatttatagttgcgagatatacttacaatctttgtgaggatacattttactattttgtatgaatacatttatgctcacgagggaagaatggtactattaccttgagctctactaagcacttactatttgcttatttgtttgagtatggaataaaatcgggtgcaatagctatggtgactgtaactttgatggtcacaagtgcatgcaaaatgaatccaataaccaactttccgtctcatgcgagaaggtgaatagcgtcgtcaatgatgacttcaccagcacccgtaacttccatctctctaccagtgtcgaccacctccaccgctaccacgttcaacacggagcacatctccacaaccaccgaagtatctccccgtcgaattccaagttctttgtttcgtcgtggagattgctaacttttcacgctcatgtaatcatttgcaccaaacattgcaattaatcgagctttaaaaaatcgggtgcagtagctatggcgactgcaattttggccaatcactatgatatagagcatgcaaaatgaatcaatgttattttttaaagcccgcagtttcaattggttacaattttttttaaggtttaacttcccaattttattttatgtctgaggcattacgctacatttgtcatgttaaaattagatctaatctctagaccttaagccgctacaagtgcaccaagatttacaatcatcggaacctaaatcactactaacgccctgatatttaggatgacctaatctaatctctgtcggcttggcggcatgaatctctcactcgcagtcttcggctagcatagtgatgtgaccatcaagtatatgcatacaaacaagcatgagaaatataaaacaatgccaaagaatacatcggatgaatggaggatctacaagatatttgagtctaatgagttttggaatccagttcgacctccaaagacaacactgacttcaaacagacctagcgccttcatgtcaactccgatttgggtgatcttagacttgatggaaagcttatctcatcgcctttcaaatgtatccggtttcatatccaaattcatctcgagtcaacaggaatcgtaaaaacaagacattattgttgctgaaaccaaacttgggccttctaatagactagctaggcccatctcggaagtgtctccctccacctccacgaattagcacttaactctagatctattttcctctgtaaatgtctatgtacaccctctggaacaattgggtttttttagttgaattttggcaagtgccattcaccttgtctctagtgctcgctcgattaatcagcgagtatagatttagagcccccaatagtgggtgtgttgatttgccgggttgattagatctatcacttcaatcgcaactattactttgtacttaatcacctattcgcaatatttagattgcatcttatcttgttcttgcagtgttctctcgtttgcattgcagggatcatcaaccacgcgccgcggttggtacgacatcatttgtagtgtagcgattgcacagtgtcctggatttgttctggttggtagccacgtgttaacagcgaaatttggtaatcggcaaagacgtcatcggcttagaatcattatcggctgcagcatctcggaatcagccgatggaagttatcaagtcgccaatagtcggattcctgctatattcggttaaggaaatcaatctactaaaggaagcttatccctaggtgaccgagtttaaagaggatgtggcatggcagtttatctattaattaggaatagtttgttagtttccttttatctttaggaaagtgtgtttagtgtccgataaggactttatatttcccttttatctttaggttagtttctttcttgtccgacaaggacttgtatcgacccatgggtataaatatgtacacccggggtctatgtaatttatcttcacgatcaatacaattcggcgcatcgccaccttttaccttttctactttattttatcgtccggcgggacttggcacctgacgcggggctgcatcggtgttcgatctccggcgaaggggtaagtccaatgttccgtcggcccaggcaattgtatcgtttacgttggcgtcgttcaaggctgcatcagtacattcgatctcttggattactctggtttggatgatatatttgcctacctatttatcatatgtctatgttaatctagtcttaacatatcaatttagctctatcggttgcttctcgttttagggtttctgccggtatcggctaaatcgtgttgctagattagattagcttagacatctaccaccctgaaaattcagtcaacggcttgattgtctagatattatgtttctttttatacttagtgctgcatcagttaagtttgatctactaagtcgtgcttagaactataatctctagcctgcctcttgattgccaataagggtttcatcggggtttcagccggtgagttatctggacgttgcatcggctcataaggattgcatatacatataagttggattttagccgatgacaacaaaggtttcactgtttaatctaatcttatggatttcatgatatcggacctccagccgatgtgtgctttaaccctcggatcgatgcttatttattatatcttgtttctagccgattggtttctacaagactatattgttattttattatatcatcatcagccgattgcctttatatcattatctacattggacatatagccgattgcttaaaccctatcgctatcggctggtatcggcatcggctgttatcggctatcggctggaactactccatcggcttgtcagccgatcggctgttttgatctactatttgcatatcttgtcagttgcaggatcaaactgactggcacgcccgcatctaatcaatctttggacctgcacaggagctaagcagatctctcaggccggtgtgttcgattttttcgtcaacaccacgtcacaaacatcgcactcgatcaaagcgagagttatcccctttaccggaagatcgggccacgagagagtgtcatcacatagtcttcttcctcgaacatgaactcaacgagattagaggtagttctagatccctcgtgtcagcctatgttgctcctacattgggtttatctagatctgtattggctcgtcttccattggcgcagctagatctgtctagatgtgttggcgcgttgcctttgctccctcctcctagggggccttgtatttataccctcggatgtcctcttgcccaagtaaaactagtgagacaaatatggatacgatccgagtagttcttgtaatgctagagtagaaccctgcttctcctttccttatccggaacacctttctactcgatataaataccacttaattttcctccttgcgatggctcccaaagcatagtgtaacctattgctgctttcttctaatggaatggcgtgttgcgtgcaaccttttatgtatttgtgaaaaaatgtccttgctataaaaatatcacctgtaaatgaatccataatccatcgaggttatcgatcacattaggattgtgttctcccccttctttcccaactcatctccctctttttacgcacacatgctttttaaacggctaaacggtacattttttaatgttttatatagaaaagttactttaaaaataatattaatctatttctcattttttttaatacttaattaataacgtgttaatgggtaacactgtattccgtgcggtaaggtggagtttccataatgggcagcactgtttttcgcatggacggtgttgctgtttaagattcacacagaagggaagggaagggaagggaaggaggtgggcttggggttctcatcaaagaagatatgacgtgaatgaaagcaacggtaagctggagcacaattaatatatgctcatatactccgtatgtatatggcatattccgttggaatctcttcgtacataacttaacagggtgaaattggatgcgttgggatgaaatcagatggatggtaacaacagggtgaaagggcagggccggatcggatcggagctggtgctcatgattttggtgagcagtggaattcaattgagagcaacaaggtttgccgtactcagcccggtgagacgtgagtagcaaagaagcgcgcagctagcgtggaatttgatttgacccagcttagctactactactagactactccactgcctgcctcgccttcacctcacctgtgtgatttgtgaatgtgctaccgtgaccgtgatgaagggaagcagtgagaggttggcctggtcagtggtcagcacgtcggccacgggccgccagctagctagcgcccagatctgttgggtttctgtacctacccggtaattggtgcgccgcccgctccgctcggttgggtcgcactcgcgcacgcggttaggcgtgccgtatataccatacacacacgtaggtggagtacgcggttaggcggcagcaagcgagaccggggtgtggatcgatcacatcgcgcgcgatggaatcttggaatcggcaaggggtcaggtcaaccaaccatgcgcctgcggtagagagacttgttccactccactctacgactcgacttttccactcaagccggtgtttctttttcatcctatcataggaacgaccacatgtacagattattgtaggcacgcatagcacactcgaacaaacgaagacactcgctacttttttttttctcttgcagtctcactaatttcctactaataataataaataggaaaaaaaccaaattacccgtgaactatcgggtgattacgaattactccctagacccgacaatcggtcatatttcatcttcaactattattaatacaaaatgaaaaaaccctcaattttacggacggttttggttctatgtggcattacaatcaaaatttacttttagaaaaaaaaatgatgggatgaacatgtcatattctacctactatctgctctttcccctccgacggtcccacctctctatctctctctatccctggccgaggagccgtggcagttgcgagcctcctctcgcacgtgctggtggcgcctacggggctccttgcacatgcaccgacagaggccgaggaggagaggcgcgagctgacggaggccgaggaggagcagcggtgaaagctacgagccttttcacgtacgtaccggcggaggttgaggaggagcggtggcggctactgggctcctcgtaacgtgctggcggaggccgaggaggagcggtggcggctccgagcatccttgaccgcgagaaagctcgaggcaacagcgggctcgtcgccgcttgcacgcaatgtcctactccactgatgttgcaatccatgccgccttctatggccccatcggcaccatcctcatgaacgaggtcgacggtgcgagcgatggctctacacaaatcacgccaccgccactggcaacgaccgccgctgcataaagcatgattttgtcccggctgctccaatctccacccacgatgacggtggcatcgatgtcctcgaggcggagcttcagcaccggcagagctgtgcctccaccacagacacacacatagagagagagagagagtacgctgggagggagattggctcgtgggagatagataacaagtgtaccgtacaattattattattttctttgttgactggatttccatgttgacgtcatttgtgcaacatcatggtcaaacccgcccaaaacagtgttagtggtaatttatccgatattaataattgatggtataaaatgtccggtatttaagttaagagggtaattcatactcattcaatagttttaatagggtaattcatacttttttattattataaataatagaatcaacgatttaattctttctatgaactaaaattgggttgttcagctgtgctgcacattgctgcgtcacaggttgatataattaatagtgtgtgtctaatgtataaatacgtgtgcataggacatgtttaatggtatacggagtacaagattattaagaccgcgcgtttttagatgagatgataaaaacttaactattaaaaaataacactctaattactattatttcatttttctttttcatcatcatacaatggttgtttccattttatagaggcaagaatcgagccgttgttaagcataacaaggatgttttgtctcaattctatctctttctttcatgtcaacaaatcccttctttctataaagttaaggctaaaagctcaaacctcgtgcttccacgtcatcatcaaattgtgaaccgttggatgaatacattagatcacttctcagatgttatatggaatgcagcataaagcccaacccattagttaccaggtaagtctcttcgcctcctcaatgctaaatgtagcctacatgaacacattggcccatctctatacacatctacatgtatccaacccgtcaatccgtataaaagagctttatggctgaatgtttcttcagttgacatgtgctacctaaattatctataaattttggatagggctgttaaaaaaaatttctctaagaaagctatttgtttcttcttgagattgtacctcatatctaataaattgatgttaactaagtcccgcagcaacgcgtggggtatcatctactatttctaataagcaagactaacaaccctttattaatgatcattgtacatttacttagcacccacacaaagccttcgccctctgaaagttttgaactttccacataactttttacatatgtgtattttcaatagaactttgagaggaaggctttaataggaattatggctagaaacttaaagtcttccaatgtacaaaacttggttataaaaatgaaaagttcctcctgttcatgggcatcgtaattatagagtaattatatgaaagttatactatagttatatttgaaagatttattctgatactccctccgttttatattacatgtcgtttgattttttcgtagggaaaattctttatgtttggccaagattataaaaaaaattagcaatatctacaacaccaaattttcatgaaatctaacgttaaatatgtttgattttgtattgaaaatgtaagcataatttttataaatttgatcaaatttaaataactttgattacgaaaaaagtcaaacgatttataatatgaaataatatggagtagtagattattcatgagaaagactatcaccagatttttagatatatcctataaaaaaaatcttgcatgattttggtgcctaattgtacaacctttccaaactaccttgactctgcctcaccggacctaactacaacataaatatccctttgactcattgccaagcccacgacgtattgtgttctctctctttaaacccaaatgaacatccctgaccattttaacccaaacactacatcatgaaccatcattatcgatcagagaagaagtgggacgtggccgtggactttgtggtgtggagatgaagaaatcctattgaaatgagaagtggaggccgtcgaggacatgaaggaatattaaggcacgcacgtcgtccgggagagccggagaggtggtaatgaactatactccctccgtcccaattttgagtttttatttacaatgtttgaccactcgtcttattcaaaaaatttgtgcaaatataaaaaatgaaaaattatgcttaaagtacattggataataaagtaagtcacaaagaaaataaataataattgtaaaattcttttgaataagacgaatggacaaacaatacaagcgaaaacttaaaatcccttatattataggacggagggagtaactaacaaggtcacaaggtgcaatatcaaattataggacttgcagctaattaagcttgcttctagtttagccgactgattgatcatgcatcagtaagtcggtattagtaccgtgtggtccgctaatcatcatcatcatcatcatcatcagcatcaacaacaaccttgtacggagctgaatttatgcataccagtagtagcttgttgactctagctcgatcgatcaccaattcggtctaattatttgattttttttgttaataatagtagttttattaaacccagctaaatatattgttctaataacacttctagcctctccaccgtaacagtgcaaacaaccaaacacatatccacacactaagaagataaagtcaatagaaaatcaagagccatctattcgtaggctagatcatcacctatgtgttggggtaaaaaaaaaacttgtttacatgcttcaattgtagacaaggcgtaatgacaaaaccctatagctgggttctcaagaataacccatgactggaggcaatgtgtaattagaaaataatctacaaaggaaaataagcattttttctttaaaaaaactcattatttctcgagagccaattgcaccaatgagttgttgccaccacaattagaataagagatctaagctcttgagtttgtcaccaagcctaaatatacgtggcacattacttggcgaacaaaatgttcaatgcaaccaagattaaagatcaaaccaaccgggctaaacaacattaaaaaacaaatgttttattatttctttcttatgataattcttattacctttctaatgttttattgatatattttcttgatgtaagtaccacaaaaagttctcattttgagagaggctttaacttacatatatttctgttaacattaggaacacgcgtatgtaccaacacacgctaatgagatttagctgagaatctcctattggttgttagtttctatttaaattcatcttgctcatgaaacaaaacttattagcgatgcaggtaaagagatgattatgtactaccaacttagagccatcaatatctcaatgccaagtgaagttaaaagggattgtttggaaaacatttgagatggtcacatgtttatgtcttacaaccatgtagatatgagggtactgttctcataaagttgtattacctaatcatttatcttccaaaaaatcgaacttgagtgctatccttacccgtagaagaatcgaacttgcaaacattagatttggtccaaaagcatgaatcctcatgtttccattatacttgaaatagagtttgtgatcccatatatttgttgcgcaatatttattgtcacacttcattagttgtaagtaacttaaaaaccatttgaagaagggctatatttttaagttctaaatcatgaatatccaaaaccccttaatctttaggacgacacaaaatgtcccatcttgccaattgttggtatttgttattgtcacagataaatccataaacatatggataccactacaacacttcgcctcggagtattccaagggtatcgaatcatagggaacgtgtgtatatctaagaatataatccaatccaaggacaacaactaatgataggcttaggttagagaggattcatatggtttaattaactagacataagttaaaggtaaaaccctatcgattgctttgggcaccagctctcctctggtctgtcaagctgagtcagcctgtagctatgtacccgaacatgtggagggatacaaagaacggacatagctattaccacctgccgcctacttcattttccgtggatcacacaacaaatgaatgtaaccgctaacctagacatcatgcctaagttattgattacaactcttgtctcgctcaggaacttcttctttatccaaattcctagtactagagcacttaatataaatactaagtgacgaacccgcaatgatgagaatatatctcacttaagaaaataaattaaataccaacaggaaatctcaaacacttactttattaaataagcattcgtcgaggtacaagaggagaatgttgatagcttcggcactctttcaaacctttcccccactattctacttattttctctacactactaaagtgatgtctaaaatataaaagtgagttatactctactttattgtgtgttgtgaaatggcttgagctccttcttttatatgtccatatgacggttggaatggcagttgtgaaggccagtgcacccacaaccatcattaggaggtgcacctggccatccacgttgaaggtggagatgaggggcccatatgtcagcccctagaggaaagcggtggagacaggtagggcccacattttcgatcgaaccttagtttttctttgttatgatgcctcttagtttttccttttgttttctcccttccctccttggatcaggctcctctaccttcaaaatcatttaactttctcatataaagacacgatgcatttaaagacagaggatctcgatccctctcgtgacggtcgacaaatctagacccgcaaagataaacacactgttgagtttactagtccaccgtgctagctagctaggtgtcgcgttcaactacttgtgatgtctctggagatcatatcgctaactgatcagtactaactacagtattaaccaatagctgctactctgtccttttcatacttttcatattataagtcgcttaaacttttttctaagcaaccgatcaaatttataaaaaaaattagtaacatctacaccactaaatataacatgtttcattaaacataacattgaatagatatattttgttttgtattacaaatttgatacatttttataagcttgattaaaatttaaatatatgataaagctacttataatacgaaacagacgagtaattaattacgatatatacatactccctccgttctataatacaagagtttttgaagggatgtgatattttctagtgctacgaatctagacagcctctttgtccaaattcgtgatactaagaaatgtcacgtctttttaaaatcttttatattttgggataaatggtgtagtacatatatagtagtgtaggtgcaagttacattttcggttgagacaaatatttgctgggatacgtacactagtagtgctccttctatatattttatattcatcatcacgtaagtataaaaatgtctttttaattgatccttatataacctgacccggtccttcacttaacatgcagtattattatatctatacatacatgtaattggggtattagttaagaactcgttccttgtatataggagagttaaagtctgcttgtttcttatactcacatcaaatgaaatacatggaagaagttaatagccctatcgtttcgcttattagtggaataagtcaaatggcatacttataaacaaaaagtaatatgtgaataaaacttttatatacgttttcttagcgttttaaaagcaaatgctgaaaaataaacttcgatgaaaaaaccttaaaatcagccttaagcataaatgaaaagatgaggccttatgttttaagaaaactttgttactaaatatatagttttgcgatacttcactttaaatctatagttatgtgataaatttggtgctaaatatatattttttgatacatctctataaatatatagttttgtgataatttggttaacgtatatgtagttttatgaaatttattgtaatgataaatagtatataatagagaggcagtagtatgctaaggggagaagctatattgtgttttgacgggtgcacatgaacccttcaaatttataatttcacttaaaatcactaaaatatatagtgttgtactgaaattttctagattttcaatgacagtgcaccctcttgttttaatactagcttcgtccttatgcaaccagcaggctgaatgacgcagccgttgaaagtcaaaatttaaagcctcgtaccccagtacaagcagccacgcaggcatcgagcagcgacacatgcaagtgcatcgcgttttccccggcctttttccagcacatccagcctgtgcgcgcgcgtccctttgcgtgccccatcggccatcgccagcccaccaccatcagctgcctgtgcccaagaaaaaaaaagaagtttgcacgactaaactcgatggattgataaaggaagagtattagcttttctttccctttttttctcgcctaagtgtacttattatatctactggtaatagtagtacgtacgatcgctagcctaactaatttggttctactaattaagatcgttcggtcgcagattttgtcatgtagcgcgcgcatcctgtttactgctttgtgacccatgtacagggaattaacgtacagatctgcacacagtcatggattcccgcggccaaactattcctcctcttattaatagtcacatgatttcccggatgcccacccgccacccgcacgctcgaagaaatcccgtcagaatatatactccccctgtactttcataaatgacgccattgactttttaaccaacgtttgaccactcgtcttattcaaaaattttatgcaaatataaaaatacttatatcatgcttaaataacattttgatgataaatcaagtcacaataaaataaattataattacataaattttttgaataacacgaaagatcaaacgtttgtaaaaaagtcaacggcgtcatacattaaaatacggagggagtatatttctattcttttctcataattagttaggcacaaaattttagagcgatttttcaattattaataaatggaaacttacaaacttaaagtgaggagaattttttttgagaaacacggtataatcatagacgcttacaacacgtgcacgctcatatctttatgaacacatatatacactttatccctataaacatctcccaaagactaaaccggtatgtcatgagattgatgaagtcattatggatgtctcgttgttgacaggtacatcgtctaccaccgaaagaataattagccataaatacgagcaccggtgtcaagtatagaacttgagaattttgattacatgaaagacgcgcagagttacacttgcgaatgtggagtgctcctccttaatacgcgctcgaagagacgaaggctagcacaaaaactttagcttacaaaaatactattaaaagcatgcaaacatgtattagtaattgtaagtatcacctactccctctgtttcaggctataagactttctagcattatccatattcatatagatgttaataaatctaaacacacatatatgtctagattttttttggaataatcaccggaggggagagtttccccacctgaatccactactagaaaaatcatttgttggtacgaaaaaaatcgtggcatcaatactaaaattgtggcaatagatgcatgttgccacaattttaaaatcgttgctagccgtggtaataaatagcgtggtaataggttattgcaacgatttttttttgtggtaataaatttagatgttgccacggaatggatatggcaaaaagtcatattgcaacacttcacatcgttgtaataaaaattattgccaccactccatatgtggcattagttttatataccaaactaaaagttcaaatattaatctatcatcctatctattttatctatttattttttttgatattgtgtcttggctaggattcgaacccaagacctatccttcacgcatgctctcctttaccaactcacctacgcatcaattctgttgaaaatgcatatcgttccatttgagcctacgtaactgagatttgaatcatagatttgaatatctaaaagatttcaaatgaaaaggttattacctataaaattatagatctcgtcgagagctataatttccatataaaatttgtctcaatccgtgttcatatgaaaaaattaagttaaattatgagacgataatttttttattgcaacgaatttgttgatcgtggcaacaaaaaatagtgaaaagtaccatgtactatgtaaattgccacaaaaaataaaattgtggcgatagaacatgtttttttgcaacaatacgattttttgtggcgatatctcattttctattgcaacaaaactactaaataaaacaacgattgtatatcgttgtaataaaatataattatttaccacggaaaaattatcattgcaatagtacaatatattgctacgaattattttttgtagtaataatttggtggcaatagctcaattatcttgtagtgatcttccattgctaaagaaagatagttctgagttacagagattgggctataccagcggcgagccattacagattaaacagaagaaggggggaggagaaactgagaataagagaggccaccaccttccccaaagagacaacaaattgatgttaggcacctgcaaaaaacccaaccaaaagccagagcaacctaatgctagcacccaagctcatcaacaaacatttccttatgcagacttggaaacaccagtactcctcgtcgaagggcctttctgccacaaggtcagcttggtttaatagcgaccaaaagactgtggaagtcaaaaaccacccgcatcaagccatcaagaatccaacttaaacttgttgctgcttgtatcagtgcatgccgacgccctttgggggaaggaagccccattggagggagggccactgaaggttgcggccataggccgctcgcatcgagttttctttaatccggctataacaatttcttgcaagttccacgccctccaacgcccttttagggaaggaagcctcaaaggaggaagggtcgctgaacaatgtggttgaggacatgccaaggaaaagagaggagacgaatagggagctagacaagagagaagtggtagatgggggaatccaatagatggaattccaacaactgcggcagcagggaagggctcaagatcagatgctaagccagccgaaagagaaccaccagctctaacaacaagacaagccatcaagcaaggagcaagcctaaaagagatccagagagaggtgaggcacgagcaacacctagatgatggatgagagccaagctggtcagggcaaggagtagcacaggttcggtggctaaagagacatcacagttatagagcgcctcaaagaggagggaggacaggggagggaagatgttgctgggcaaggtcacatttatagagcatcgtagaccacagccgttgaggccacagcccgccgccggcgccacagagccgaccacgagccgcgggtcggcgcaccgccagccggaaccagctacggtgcacaagccgtcgaggccaaagcctccaccgccagccgcagggggtggggggggagacgaggcccgctgccgggcgccacagccccggccatcgcaacctccgcccccgcggcctccgctgtcagccttcgccactgctacctccgccgccggtcgccactgcgtcttccgcgcgcgccgacctcctgtgccggctgccgccagccgccgagtcgccagacgctgccacctccgcctcccattgacgccgcacaggagtagcttgctccggccagatccggcgtggaggcgccagatccacccgtggggaggctggatccaccgcctccaccccgcgtcatcggactctcctccgcgcgccggcccgtcttccacgcacagagatgggacgccatcgagtgttggcctcgctgccgccatcctggctggccgcacggaactccgacggcgcgctccggcggcggcgagggaagggagaggaggagaaagtggcggcggtggcgctaggtttcccccgagtcgcccgcgcgtgggcgacgcgtggggcaagaatcataaggttctgtacgtttccaggtaccatatatgtctagattcatccatatatgtctagattcattcgcatatatatgaatatggacaatgttagaaaatcttataacctgaaacggaggaagtatatatttttgaacttgggatgaagtttaacgaggccacgacagagacggctccaccactgctacatttcccaaaaccggataacttaaaattatatttaatttatgtttcaaactgttgcaagactatcattttgttccattcaaaacttaattttgcagaattttcatactaactatgaattctatacaagtttactgttttaaactaggtattttaaagtcgaactttactgttccattgactcgttttaccatatttgagcaaaggcaacacaagtgtctatcgacgtcatgacgtgacctccacggatctggtgttgatcgatggactggatgaggtagagccagagagctcgctatggagctggcgattcgagggagagtaacttgttactagggttggagtggtaaatggtttaaccttttagcgtataaaatttgaggattggatctaaaatttataacctattcatttgtaacctaaaaattattttagtgctagacagggttgtgaaaaaaaatccatggaccttaacccattactaaccatggaggcacaacttttctggtttctgctgagactatccgttacagttagagcttatttggaacgtaggattttcaaaacatagctagggatatgaaaaatgtgggatcaagtgtgtcatctcaaatcctttgtatgaaaaattacaggaaaattgcacgaataaccatttggatggagcacagaaaaaatacgggaataaaaaatagagatagattacaaatgaatttttttcgaggggtagaacctcatgttaagaattctccaaaatctcctatgatttgaggcactcctaaggaatttcaaaagaatttagggaagccatttgtttgttccaaatgaccatatagcaattttttccttgaaaaaacaaaccctctaaaattgatttgttccaagagagcccttagggaagtcaatggcatcactgtatcgtgttgattgatgctaattatccagtagctgcgtgaggatgaagggtcaaaggctgaggtatatggttcatggaaagatacaataagttaaaaaaaagatagtggctaacaagtaggccatgttttaatatatatatatacaattttctatttgtatgggtcggactgtaaattaagttattcgtactaatatactccatccatttctaaatatttaaagccattgacttttttaaatatatttaaccattcgtgttattcaaaaaatttaagtaattattaattattttcctatcatttgattcatttttaaatatacttatatgtatacatatagttttacatattttacaaaatattttgaataagacgaatagtcaaacatgtgctaaaaagtcaacggtgtcaaatatttagaaacggagggagtatgacacaggctaaaagcgaaaaaaatgaagtgctaacctgtaaaatttacatgggcccattagaatcacgttagcatttaaaaacacagtattctttcatggttgattcgtttgcttttgcctacgtagaggaagggcaataccgctcgaggctttcctgcgttgtaaatgcctgagtgcctacccagcttcctcctcctcctcctcctcctcctcttcgtcgtcgtcttcttcttcttcttcttcttcttcttcttcttctcctctctctctctctctgggttgtcaagagagtgtagtttgggctaccgtttgttggaaggccctagcggtttagctctttttaaaaagttctaccctacatgtaagtgagatgatcactaacaaccgtcatatagaaagcacaaccgccggggagaaaatgatctcaggatcggagccctgtgaacctttttctgacgtacgtcactgactcaagagattaaagaaaagacactgattcaatagtaaactcctatatatatatactctttttttcttaaaaaaaattacactcgtacgcttgctcggtggtaaaggcacaagtccttaaacttgtcttgactctatcatctatatatattcttgaactctcaaatatattttgggtttccgaacttttcggggtgccatcataagtccaaatggatatcaacccactatgcgtattaacatggcatgccacgctggatcctcctcctctgcggggacttggtgctaacatatggatccaacgtaaaaggaggaaccgactgacaagtgtcgctcacaaacttattttttcttctcctattcttttctttttccttgtcttcctatagttcgccaaagagcagatgctgttgttgacgatgagtgaaggacggaagtgagagatcgatgccctccattgacgtactgaggagccgcgggacagaaccagcggcgaccgcaaccgtgaactcattggttacgagggagggagagaaagaagggcgagtgacatggacatgctagccatgggcacagagtacggtgccagggatttcacctcaccatctgcaagtcgtcaagccaaagagatgggggacaacctccaccaccgccagccctcggaggcaccatcctcctccacacctctctccctcactcatctgtgccaccgtcttctaggagggcgataggatgggcgtgtccctccgcgtcggtagcacatcgcctatgttgttcaagatcgaacagatggtgcatgctcgatgcaatcggcgatgccgatgagctctgtgccaagcacctccgcacctccactccctctcctattgatgcctccatgaatctctatgcctttctcctcatgtttttaactccatcacaacattccagttgaccacaagtggaaaggcgctcacgtctaggctattgtcgggcaacatctccttcttgtcaaagctaatagctagggcgccgacttttgtcgggcgagatatcgcctggcaggggcttgagtcccaaggacaccaccaagctggaacttgaggacgggaggcgggtcctcaccaaggtgtgttctcgaatgtgagtgcgatggcatgagggagggggagagagaggcgtgagggagagactgacatgtgaagtctacccttgcgtgggatccacatattatgaccaagtccacaagcatcagcgtggtatgccacgttggcgcacagagcaggttgagatctatttggacttgtgacggtgtccaggactgtcacacctggagttttcccttcccttaggttccaaa

SEQ ID NO: 58810 - DNA, 2042 bp, Oryza sativa
cccatctcccggaaccactcctccatcctctccaccagcctcctcccgatccctcgccgccggtggcgcggcgagacccggaggccgagcaggtacgccaccttggagaagagctggctgcgcccgcacgccacggtcttgacgcagccgcgcacgacgccgacgatctccgtgccgagcgggccacccacagcctccgcgacctgaaaaccacattccaatacccgatccagcaccagtgtgaggtctcgcgatcaacaatggcggacaagcaacgccccccgacgagacgtacgagcatgaggtaggccggcgagtggcggacgcggcagagcgggtcgccgaggaggtcggtgaagaggcagagcttgccgccgctcggacccacctcgcaggcgcgctcaaccagttcgacgccgggacggtcgcggccgccgtcgaactcccgcaccaggaccacctcgccgccgtcctccggcaaacaagccaccgccatccttgctccgatcaatcaatcaatcaaatccccttcttcttcttgatcgatcgagcggtgcgttgcaatttatagcggcgatggagtggcgggagaggagaaggcgcgcgcgatcgatggagatggaggtagtggcgcgagtggaggagtgggggagtgataggatgggggccacgtccccactttcccgccatctgtacacctctctctctgtgtgctccgggtggggcccacaccccaagttaaactgccccttctgctgctccatgctaaaactggatcgacttgctaattatttgtgtgatttaacaatgattagtgttgttggagtactatcatttttggctcatcagattggaggagtaagagagagctagataatgtaagattcgatagatctttgtttgctgctgtccgatcttgtcatgattattagggtaattaattagttgtttggaaattatctcttttctattatcatactcggggggatttaggagaagttattttctttttctatcttaattatattgaatgacctcctctaatcattctcacataagttatctttttttctagaaatataggagtatatgacatgttgaaattttgtagccagtattttggataatctttttccttaaaaatgaaaatgtttcacatcttccaatagacacatgttctaaaagcccaataaaaagaacttttcaattagagccagaaaacctttcaaaacaataggaatacaaaagaaaaatgtatatatcacaataataagagactctcggttatcctctatgtcgtaatactatatatccaactaaatataaactcaccacatgagtacaaaattaaaaccgacggctaatgaagtcagtcaaacacaacagtgcatacaatgactaaattatttggttggttagtctcattctctataatcggctgttatatctaaacgtagtcttgtcgctcgtggagaaagaaaacacatcgctacttttaatattgtcgttgccaatcaaataggaaaatataataattaagacgaatgctttaaaaagcaacaagacgttgcagcggcgatcggtagctaacgcaaaacaaacatttggtctgagttatcttttttggaataataattaaaaaatggttcaaatatttggcctatgctaaataattacccatgttgtaaatgtcaaatagaaaactcttaaggttatgggagttaggaactatctttgacacaatattagaaacatttcaaaataaagaaaaagagagtatcataataattagaaactctcgatgatccaaattatccgactgaatataacctcaccacatagaagcaaaattacacagctatatgcatcacatgatgtagaggctgagatttttatttgactatcttaaatatattgagtacaaaattgcaactatatatggactaacgaagctagtccaacataacaatatatataggtactacatcgtcatttggtcggttaatattctaatcaagcaggtctcactccctataattcta

SEQ ID NO: 58811 - DNA, 25833 bp, Oryza sativa
  unsure (1)..(25833): unsure at all n locations
catcgccatcgacgccctcgagctcgcccgcgcggcgacgccctccccttctccaacgacgctgcccccgccgacgccgacgtcctcctctttctcccgcctctcgggcctcttcgaccccgagacggtgggggaggggagagggcgagaaccgcggcgacggcctcccgcgcctaccctcccccgccgccgccgccacccagctccttccccggtggctgccgcacgcgccaagctccaccccaccggccgtgcactgctccacccccgacagccgcgccctgctccgtccccgacggccgcgctcagatccttccccggcggcactggcggcgtgggaggacggccgcgagaggccgtgcggcaccggcgtggcctccgctcctttcccgccgccctgagagaagagagtgagagagacgagaagagggggaaagagagggtaggctgacatggcacgatgacatgtggggctcacgtggatcccacgccgactcagcagccacgtaggacaaaaccgggatcaaaaccgccgagagacctattgtgaccggttttgtatagttaagggacccgtggtatctggttttgcggttcgaggacgttttcgtatcccgataacaagttgagggacatctggtgtactttttccaagatatttttcttcactattttcagaagtactaacacactacgtttggaatgcaggtaaattccctaagctcctcctaaaagtgaacttttttttactataataataacattataagtacaaaggcggtgctggaccttgcagtcgaacaagcccttgctccccggataatattgattctcacatattatgagaatatatagttttaaaatgagaaatatattaaaagccaaaaactggaaacaatatatgagagattagaggctaggattatatatctcgtttagttgtaaaaaaaaaaggttctactacctattactattaggggttacaatatgaatacatagtgcctacatgtgacaataacagggtgcataaaactcataatatgatcagccaccattcttcttcattttgttcttcctagcggccaaacactttggcctctgtatctcacaactatacatgtagctatagtaaggtgctatctgtgatttccatccaagtgcatcaaatcttccttgaggcctaacacttccaaacagagcatctaccagtgatatcttgggagcttcagcttcagcttcacagtgggaagatgcatgtgagcagattgtttgatagttatcaagaatcacaagaagttcagttgcttcttcacttggttcattcacccgatccaaagctttaatttgatctgcagcatacatgaatgaccaaatatgctggttcttcttcttgaactctctcagggttgcaagaaccaagctccagtaatgactgttggcatttgatctcagcaatctactgaagacattggcacccatgaaacacccttcagtttctattgcaatgtccatggctattgatgccatttcagggtgctctgaagcatccatgctcccaaatgttctcaccttgaagaagtaccagtaggcttccttggataaaagctgtaatctgagaggtggtgtggttcctaacctcgcaatcttgtctgatcggcttgtgactatgattttactatcgcgaggaatgcgagttttgtatatcgagtatagtctttccaataaaaccccatcgatatttttatctagtccttctgaatacctatccccatctagttcaacaatgaccaacacccttcctacacccgaggcacggtttcgatgtttgattacaccgccatctctaagatccacaatgctttcatcttcaagatcggctcgagtgaagaacacaatttgcgagaaatgattgcgcaccctttcatcgttgcaggcatgctcgacaagagtactcttcccaactctccctggaccaataatcggtagaactcctggttctagtgtgctatgattcccaggttgtaggagaaaattgatgagatattccatctccgtctggcgcccaaacatgcactggtccaagatcaagtacatgctatacggctgacgatgaaggcgagggcaactgcttaagaatgcaatgaactcagtagcatcagcaatggtgttctccaggtccccaagaactctctgcagctcacccaaactctgactgctactgtcactgcagaaacggatacgcttggcatgactgaatttagagatggcaaaagatggactcacttcaccatgatgatccttgccttgatgagctctgcacctgaaggtgtccagggtgtagtagcctctgaacatctccttcctcaggatgctcagctgctccagcatggcttggttggtgatgcaccgttcttccgcctcgtcgacgatgatgcgaaaccgcagcagcagcctttgcaggttctccaatctttcatcgtcgcttggagccggcttttgctgattcaggtatttgcttacaaggaaagatatggatctacctgcaagttcagtcaggatgacagaaatggttgcctccatgttggctggagaaaaccttgcagaatggttctgcaatggaatgagttacctctagctagaagtataacttatattatgtgatctgaaacttctgattgtgccaaaacaagtttttgtattatctttcaattaggattaggattaggagtacaagttgtaacaactaacaacaagcaatgagtgatcagaagtcaaaattggcaggggataacaaattacatagaatcaattagttgatgtcagttctcatggtgttctgcatgtcctgacgtcttgcgcatttgacacgttcaagcttcaactaatgaaagataatacgatatgctgacgaattgagtttgatggcctctcataaacagcacatttacataacagattggagtactcattcgctcagacagtcagacagtaggtgaaaatatttaaaaaatgctcagaactattacagtttaagataattacattatacagcagcttctcagataaacaggtgcaaatcttcggaaaacaacaagatggtgttaacaccaaaatttgacacctcgaacataaatagaaaaatatggccgaatttaaaaaggacctggtttcctttatggggctagtatgaccgccaccgtagagccggtcaaaccggtgatgtgggaccggtctgactggtggcatgtggtcggtcagatcgggtgagtctgactccgagttcaatttcgccgggtctcgagttcccttacttgagaaggtattttttgagttctaattggtcactatcctcaataaaacatggaaagggtcttgtaacaggaccgacccctttataagggctatggtcggttcgattctaacccccaaaccacaatccctataatctatcgaattgttcttttacctttacttttcagccatgctttctactttattttctacctaacaatagttcatccatctttgttgatttgcgccacaaatcatccgacttcactgcaagggtgcgatatctctttgtaggtttatcccgtaaaccttccgattcatccacgagacggtaaatcagtctagaggctaattttgatatctaaatcagctccgctagccagtttagttttgtatcaaggtggttggcgaccgcaagatgtttaggtgtcccgatcgtaattgtcttcttgctataagaaagttaccaacacgattttttgtgactatgctaggaaacgtaaaaaaaatttcggctatatatccgaccgaaatcaatccacatacattcactgccgccgtctacgtattacacactggatcaatgtattcggcagccacactgtccggtcatccgcaacagcaatcggattgctctcgatctgctgccaaaaattaaagaaaatcaaatcaaggtgagtttacaggaatagatcaacaccgtgagtgagtccgaggaaagccgccgtcgctgagtatttttcctatatatctgcagccgcgtgacgacgctgcatagatagatacggacatcgatcaattcgtcaaggccatcaggacttcagcgcttgccgtttcgctcttgtgttcctattttggccgatccagaaaaactaggagccgattcaacgtacgttgatcggcatatacaagccaactaggaagcctacccatcagtacgtggttgctctctgttgcgtacatccattgaaacaaaaaacaaaattcaatcaaagccattgcattgtttttgggaatacgcaaggagcgcatcattgtattaagaggaataaagtttatgcacatcggaaacgaaaaagagagggggacgaggtacaggagggtgactagaaaacgctaaatcttattctcgcaaccagttgggcgacctactaggcggagtttgaagaataagagctggcatagctgctctgccattgcattgtatcggctaaccaatattttggaacttttgctacctgcaaacgaggagaacagggaatatcagttagctatcttgtgtacacatctatttccctattcgcctacgacgggtggttaattatctccatatcaatctaaatcattctagaggctaattttgatatctaaatcagctccgctagccggtttagttttacaaaacccatcatggtttagcttcgtctaaatcgaggtggtttgtaaatccatatcaccgcaagacgtttaagtgtcctattcgtgattgtcttcttgtaaaaaaaaaagttgctaacagatggttaagtgcaaagtttgggcaatgccttgagccggacactcgatcaacgatctaaaaatcaggcgcccaccccgccccgccccgccccacccgtgcaccactctgcctttgaatataacttccctctcatcacttctcttattttgttatgcagagttctcttcacatgcatgtcatgtcatgtctagccatgcatgttcatgtaaatttttgatatatcattttgcgcatttttctctcttcttcatttttttctctcctaaaataatggtccgttctacgatccgataataccgttgtattgtttataattaaatctttatagtaagatatcacatgattatattttagtaaaaattcaaatgttgtttcaccccttgaagaaaattgtttcagtagtgttcaagagaaatgcaacatttaaaaataccaactgcaacaccaataaccacctatatagaactaggggtacggaaacggacggaaaccatctttatcgttttccttttcatatttctttttagaatcggaaacctcggatacgaaaacataatcgaatattatcgaaaccgaaaacggagcgaaaacgaaccggcgcgaatacggtaatgaaaatttatcggaataaaaaacccctcaaactgataaatccaattgaataaattatctatgtttaaaagagtaatgttgttgataaattccaatgtagaacaaaaaatattcttatgtaattttagatttgcataacaaatatttaaaaaaaaacaacagccaaacaccatggtattcactatttattgcttaaaaaaagaatccagggtatttcaatcacaaaatttttggtaattccgagaaaatttccagaattctgagaaaatttccggaaagtttccgaccaattccgagttccgacggaaaccgcccttagcatttccgattccgtttccgagaaaatatttccgaattcgtttccgttttcgaaaaattccgaccgacagattccgttttcgaaaataggtccagaatccgaaaagttttcgtaccgttttcacccctatatggaacattgagtaccaagaagcgaaacaaaaaagtcatatgagagatacaatatatttgaaaaaaatgatattgttgaaatattttgtattattacgaatattaagctgtaactattgaaataatataaaatacttgccaaaactttcctggaacaccgcgtgcaatatttacaaattaactagtgaaatatcatacgaatactagttgaaacatacacataaaacatgtgcaacattgaaaaatatccatcaaaaaagctaaatattcttttcatcgaaatataacaatgtgtggtcttgttctaaatatttaattgcaatgaatttaatagtgcaatcaaattgtagattgaagaagttatttaagagaaaaggatagttcaaatattactaaaaaaaacttataccaactcaactaaccatattttcttttttactaaacgcatgcatgtactagtagtgacttggttaatttctagtaggctttacaggctgcagctacaccatgtctctgtagcagctagctgacagagtgacggaggatgaggcgggtgcccgatttttagctaaaaaatcaggcacccaatccgaagtcgcgtccgcaaagttcccgaggtcgcttatttcttgcaactatatgctgcgacttcagtacctcacagctgaacatgtagtcgtggtaaggtggaaggtgagatctccagccgagaaccttgaattttccttgaggcctaacatttccaaattgaaaatcttcgaaactcaactggggaacttcaacttcactctgagcagagtttgtacaacgatggagcatgtttggaacagaacatgtctgataatcatgaagaatcagaatatattcagaggaaattccgtttaccctcctaacatatgccgattcaaccacctcccaaggaccatcaaaatttgcatagagtgagatattcaacttcctgaattctctgattcttgttagaaccgtgctccaaaaccgagtgttgaaatttgcttttagaagttcattgtagatgcctgaagacatgaagcacccattccattcccttgctatctccatcgctattgattccagctttgggtgctcctctgcatccatgcttccaaacgcgcgcagtttgaagaagtaccagtaagcttcttgagtaaagaactttactcgaagagcttgtgtcgttccaaagcacgcaatcttattagatcggcttgagactataattttactgccatttgcaacacaacatttgcaaactgagtacaaccttctccacacaccctcatcgatgtctctggttagttcgatgatgattaatatcattttgccaccagtggcattgttttgatgcttgattacaccagaatctctaagagtctccatgcttgcatcttcaagatcatcctcactgaaacacacaatttgagagaagtgattacggaccctttcatcatcacaagcatgcgcaatcagggtggtcttcccaactttcccggggccaatgatcggtaggacacctggattttcagcaccgggagtatcctctttgagcaggaagttcatgatgtgctccatctccatttggcgaccgaacaaacacttgtctataagcaagtgcatgctatatggctgccggcacaaacgaggacaaaagttcaagaatatgacaaactcgcgcatatcttcgagggtgacttgtagtctgccaagaacttgctgcagctgatcttgcaaggtctggccaccatcccacaagtatcggatgcgcttggcaggatttaacttggatggtttaaaatagttactcacctcatgatctttggcattgtcttcttcatggccatggcatatgaagttgccgagggtgtaataccctctgtacatctccttccttagcatgttcagttgctgcagcatggcttggtttgtgataagccgtccctctgcctcctccacaatgatacgaacccggagcagcagtcgttgcagtctctcctccacggatggtaatgttggctttgagcacttgttgatcagcaaagatatggatctactggcaagatcactcagaatcacggacaaaaatgtctccatgtctacttctcatatgatcagcaaagatatgatctgaaattttgtaaatcactcaagtggtgaagagctggtacctgagaaaacacaatctgaatgtttatagagggtattgcactggttacatatacaaagaggggatatgatctgaattaaggcagccacgtactctactaactccaagtctccataaagcgaaaggtattgccctgtggttacatatacaaagttacatgtatatctagaatttatttcaaaccatacttttcagtgtgaactgtttggatcctaatttctgttttttctttgcagttccaataatataaccgtacaaggttgactacatagcggagacgattctacaggtttggttcagcgccatggaattctcgtcaagtttcaaaagcacatgcattttagttgaccagttcgcatgctagccaatgctacaacagcgacaggttagaaaaggaataaacattcagaaaatggttttcttcttttgtctcttttgataagggtcaagttttagcttctatttcttttaactagcaaaaaacattcagaaaatgatcccctacagcggttgttatgtccttcaatagctgactatctatgtttcttgaacaataaattatgagcatttttcccatccttgatgaggtactatgaggtaccaatctaatctaaccgttgatttagttggggcatgatggggctaacaaaaataagatctctcttctaggtcagaaatcgccgcatcctctcttccaggtcagaaatcgctgccgccgtcgcgcatcgaggttgccgccgtcgcgcgtcgaggccgccgccgtcgtctcccatcgagcctgccgccgccgccacgcatcgagcccaccgctgctgttgcgtatccagccgccgccgtcgagcgtcgaggccaccgccgtcgtcgagcgtcgaggccgccgccgccgacgattcaccgcactatcccatttgtcctgtccagtcattcagaacattggtgctcgtctcgaatttgtggcaagtttccaaatgacattaaaggtgggtattaaggctctatagaatgacatcacatttgctattgagtcttatttcaccctagcaagataatttccaagatctaaaagcaggggaacaccaaattcccagctcggagcacaggaacgccaaatctgagcagccgaggggaggaagatggtactgacttgccgagcgcgggccccatcttgttggtgagcgtcccgacgatgatcatgcagtcggactgtcgcggggatgggcggaagatgacgcgaaagcggtcgaagtcatagcaggacgcgccggcgtgcatcatctcgacggcgcagtaggccagatcgaccccctccgcgcccagttcatgaggtcgtctaccttggagatcactaactctgcccgaacgacacccgccgccgccgtcgcgtaaccagtagcccgccgccgtcgcgcatcgagcccgccgcgcatctggctgctcctgcctctcgcggtctcgacgccacgccatctctcgcggcctcgacgccacgccatctctcgcggctctcccgagtcccgacgatttttttcttctcgtgaaacaggaaaggacacaaatcacattatagaagtgggagcaggtttcttctcttgttaaaagaagttaattaatgctgacaaattgagtttggcaacctcatgaaaatatcacatttacataggagcttggatgtacacagatgctcatatttatacaacagtttcagacaataacaagatctcgtagcttagatactaaaaggtaccacaacctaacaatatggattactatctgagatggtcaggtgcaaagcttatgagatctcttcttactggtgaccatatgatgtggcctccgtacctcacagttgaaaatgtagttgtagtgaggtggaaggtgagatctccatgcgagaaccttgaattttccttgaggcttaacacttccgaagagaaaatcttgcatactgacctcggggacttcaccttcactctgagcagagtttgtgtaacaatggaccatgtttggaacagagagtgtctgatagtcgtgaagaaccacaagatattcagaggaaattttgtttaccgtccgaacatatgcaggtttaaccgcctcccaaggaccaccaacaagatacgcgttgtatattaagttgttcttcagcttgaattctctgattcttgccagcgccatgctccaaaaccgagcattaaagtttgctttcagaagcacactgtagatgcatgaacccatgaagcactggttcatctccctggcgatatccatggctaatgatgccagctttgggtgctcctctgcatccaagcttccaaatgtgcgcaccttgaaaaagtaccaataagcttcttgagtaaagaaatttactctgagaacttgtgtcgttccaaagcttacaatcttatcagatcggcttgtgactataattttacttccaactgcaacactaattttggaagctgagtacaatcttccccatacaccctcatcaatgtctcccattaattcgataatgattagcatcctgtctccaccaatagaatggtttttatgcttaattacaccacaatctctaagagccaccatgtttgcatgtcctacatcatcgtcgttaaaacacacaatttgagagaagcggttacgcactctttcatcttcgcaggcatgctcaatcagggtgctcttcccaacttttcctgggccaatgatcggcaggacacctagattttcagcactgggaatgtcctctttgagcaggaagttcatgatgtgctccgtttccatttgacgaccgaacaagcacctgtctaaaagcaagtgcatgctatatggctgtcggcataaatgaggacaactgttgaagaacatgagaaactcgcgcatatcttcaagggtgacttgtaggctgccaagaacttgctgcagctgatctcgtaaagtctggccactgcccgtgcagaatcggacacgcttggcaggatttaacttggaaggtgtaaaatagtaactcacctcacgatctttgacattgtcttcttcattgttatggcatctgaagcagatgagtgtgtaataccctctgtacatctccttccttagtatgttcagtttctgcagcatggcttggtttgtgatgaaccgttcatctgcctcctctacgattacacgtgcccggagcagcaactgttgtagtctctcctccacagttggagttgttggttttgagcacttgttgacaaggaaagatatggatctactggtaagatcactcagaattgcagacagaaatgtctccatgtgtaagtatgtagtctgaaattttgtagacctctcaatagatcagcaagaactgggatctgagagaaattatgtagtctgaaaaattttaaaggatcaggtgaagcagagtaggaattaaggctgccacatactcttatactgtggtttacaaaaacacactttgaatgctccacatagtccagtatcccaacctagatatgctttttaatgtgaaccgtttggattcaagtatctgttttgtacattttgcaacaatataataaccatacaagactgtccacatagcggtgacgatgaaagcagtaaagaaagttctacagattggttcagcaccactggtttctcgtcaagtttcacagtcacatgaatttttagttgaccaattccgcgttctagacactgcaatggccttctatttctacaaatgtgacaaaaagaaaggacctgacgaacatgaacaaaagaaatggcaaacttcttcattatgaaactcaacatgttaaaactgttgaaatttgagaagtgcttgtggtgcagctggcatggatagtccttgttttttttttctctgggtcaaaattcaaggctttgcttctagttaattccaagtcaacttttattttcaacttgtctgactgcaacactagtgaaaatgtcatggacagggaggaaacattcagaaaatgttttcctaccatggttgatggatgtgcaaggaatcagctgacaagctaaccacttttttttttctgaaattccttttggggatcaatacgcttatatggagaattgaagtattctgagaaatatggctacagatccttgaaatttgagttacctggatcgaaagaagcagacagaacgttgctgtcagtcgccgccattgcaggaagaacccgagccgccgctgccgccgacgtctccagatccggccggcgccgcagctgtcgccgccggcttccttggccgctccatcgccggccgcgctcggcttccttctcacttcgtggcggacgtcatcgctgctaggataggggaagtacaaccttgccgccattgctggagagtggggatccatccagtcatccagccaccagcgacttgaacccaaaagctttaaatatcgtaacctttgtccttggtaattaattaacttccttggtagagttaaaaataaagagaaaaaagatttttaaaagatatatttgagaaaataacagtgcctttgccttgatgtttggaaggaccagctacagggcgctttcgacactcttgtgctgctaatctgcgggatggtttggaaggagagagatgcgcgtgtgtttgtaaagaactgttttattcctcttaatgcaaaaatacgcatctagcgtattcccgaaaaagagatgtgcgtgtgttccagagttagagccgagtggcgggcatcctctttgccttgattaaagagtaggtcgtgatctgaaaagaagctgggggtttttaaagatttaggagagtagcgtcttgctgtagcttgtttttcttttcggaagttgcttatgggacaacatcaatcattcacttcagcagtctcttgtctaaatttgaactttgtgaatgtgtacatacctttttattaagtaaatttggtccacctgtttgttttaggctgggctggctaaaaaaaatagtgcccatttgatacggttggatgaatgatagggttaattaaatctcctattacaaatttgtcatattggaaaaatgatattattatttatcaaattggctcagtgtcataagtattttgtaaaatttaaattatgccattatatatgtatgtacgagacgtacttgaaccaatattttgcgtaacgtatttttcctacccacaaccattgcgcgctggtctcctcccagccagattcatacgtggggggtgttacgaaaatagatgcacaacggagacacgaatttttacgtggaaaacccttgcgggaaaaaaccacgggcgccgaccggtaatgatcactatagaggagtttattacaaacgtaggggaataacaatgggaacgtcaccccttcccatacggcttacaagagtatatatacgggataatagaaagacacctaataggactctgttgatagaaaacacagggcctgggagatctgcttaactccagtgcatgtccaaaactcgccttcggatgtatgagcgtgccagttgatttgatcctgcaatcaacaagaaacaaagacaaagaaaccgtaattaaatccataaatgatagccgatcggctaaatgccgatgacatgtcatttatctttgagccgatgtcatatgtaaatcgatcggcaattgttaagaaaacaaatcagaactaaatctactcgatcggctgcaaatatcaatgatacataatccttatatcgatatataattgaatcaagtgattgggatagatcggtcaccttgccgagacagtataaatcacttagatcgaaatatatattaataatgagattatatatatatattcatagcatagctgatcagatagatctagcgtgtatcggctaatactccgatactactttatattaagatattaaagcaaatagaatatactaaacagaaatctaatatacttaaatgcaacaagatcttaacatgaaggacagatctaacatgttaattgagcatgtagaacaaaagcaattggatcagataagatcggctgaaactccgatactaccctaatcggcaaccagtaggcaggctagagattgaaattctaagcacggcttaatagatcaaactcaactgatacagcattaagtatgaaaagaagaacaatatctagacgatcaagccgctggatgtttcatagagtggtggatatctcatataatctaagccaacgtcgttatttaacctaatcggctgccttctggtagcagatgttagccgattgtaggttaaatgacgatattgtcaaggattatgcaagatatatgataatttgacggactacataaacaagattagagtatcataaagatggaagcactaatctcgagaacacaagccgccataacaagtttacctcttgttgaagatcgaaaccgatgcagctcaacccgaaagcaataactcgtcgaaataaaacgaaagcaaaaagagtggcgatgcgccgaaattgtattgaacgtgtgtgttaatcattacatagggctcggggtctatttatacccgagaaatacaagatatgtccatattggacacgactcttatctctaacaaactctaagataccacaagtctttgcggcagacttttgctcacatttatctctaaggaatttacataaaatatcctaattaatagatacaattgccttcccaggactctatccatgcgtggcaatcatcttgaagcacatcaactcgaacccaatgtcgcatacgggtcgtattgtcggaatcggctgtatcacttaaccagtccgactcagacttagccgatcccagtcgtagccgatccggactccagccgattattactctgtttccgaaaaaacccttatcttcgattctacttcgatttcattttcatctccaatactgatattaccaaatttggtcgttaacaggctcctactaggaaactaattcgaatatattgtgggcccaaaattcggatcacatatttaacaatatccaccttgagacgaatttcctcttgtagcataaaaacatcaatcaccaaaaatacctcatgtaggtaaaatcaccgcgcgccaaatagtctctaggactatactgtaacacccaccaagcttgagcaaagctcaaacttagtagcaggaactggctttgtcatcatatcaactgggttatcatgagtacttatcttgcataccttgacatcaccttcagcaatcacacctcgaataaagtgatatctcacatcaatgtgctttgttctctcatggaacatctgatcctttgtaggcatattgcactttgactatcacaaaatatattaatgcaagacgtaactccacaaagctcagtgtacaaacctctaagccaaatagcttctttacaagcttcagaaatagccatgtactctgcttcagtagtagataaggcaacagttgcttataaacttgccttccaactaacagcacatcctccaatagtgaaaacataacctgtgagcgatcttcttctatccaaatttccagcaaaatctgaatccacataaccaacaagtccatctctagatctcccaaactgcaaacaagcactagatgtaccacgtaggtatctgaaaatccattgaacagctttccaatgctctttgccaggattagccatgtatctactgacaacactcaatgcatgtgataagtcaggacgagaacataccatggcatacataagtgaaccaactgcacttgaataaggaactctagacatgtactcaatatcataatctgactgtggacataaatctgaagataatctgaaatgtgcagctaaaggagtactcactagttttgcgtcatgcatattgaaacgatgaagaactttttcaatataacctttctgactaagatataacttgccagaatgtctttctctagtaatttccatatcgagaattttcttcgctgcacccaaatccttcatctcaaattcactactcaattgtgccttcaattttgttatctcttatttgtcttttgcagcaatcaacatatcatcgatataaagaagcaaatatatagctaaatcatcaacaactttaagataaacacagctatcataattggatcttctaaacttctgagaaagcatgaaagagtcaaatctcttataccattgtctaggtgactgcttcaacccataaagagatttcttcaacctacagactaggttctcttttccagaaacaacaaaaccttcaggttgctctatataaatgtcctcttctaactccccatgtaaaaatgcagtcttaacatccatttgctctagttcataatcatgcattgcaacaatactaagtaaagtgcgaattgaactatgcttcacaacaggggaaaagacatcattgaaatcaatacctggaatctggctataacctttagcaactagccttgctttgtatcttgcctcatcacttggagacatacattcctttcttttgaagatccacttgcaatggataggtttcttctcctttggcaacttcaccaattcccaagtatgattcttttcaagtgactccatctcatcatgcatagcagttatccatctattgcaatcatcagaaacaatagcctcagaatatgtagaaggttcggcattaccttcaatttcttctgccacactcaaagcataagcaactatgttcgcttcttcaatatatcttggaggaggtttaatatttcttttgggcttatcttttgcaatagaacgttttggagattgatgaacaatagaagaatctgaatcttcaataacaggtgcatcttagttaatagcaacaaattcgttttctggtgcatgtcctgaactgatcaaatgctccacctgcacacttgctttctcctgactctcaacaggaacattagtagaaggtttgtcatgtaacataactgattcatggaagacaacgtttctactaatcacaaccttttttgtttcaggacaccataacttatagccttttacaccagacggataaccaagaaaaatgcacttaatagctctaggctccaatttaccattatcaacatgagcataagcagtacaaccaaatactcttaagtctgaataatttgctggggaaccagaccatacctcaattggagtcttcttatcaatggcataactgggtaatcgattgataagataacaagcagtggaaacggcttccgcctaaaactgtttaggcaaacctgcattagacaacatacacgggcctttgatataattgtcctgttcatacgctcagctacgccgttttgttgaggtgtgtgaggaacggtgtagtgacgcacaatgccttcagacttgcaatatgatttaaatatcttagaacagaactccatcccattgttagtacgaaggattttcaccttcctttcagtttgtcattcaaccatagttttccactccttaaacacatcaaaagcttgatatttgtgcttcaagaaataaggccaaacttttcgcgaataatcatcaacgatagtcatcatgtaacgagcacctccaaaagatgtcttacgagcaggcccccataaatcagaatgcccataatcaagaataccttcagtagtatgtgtagatgtattgaacttcaccctcttatgcttgccaaatatgcaatgctcataaaatttgagcttcccgatgctttgtccatctagcaatcttcgcttgctcaattctgccaaaccaatttcactcgtatgcccaagacgcatatgccaaagattagtagcatcggaattagataatgaatcagaaactgcagcaacattacctaatatagttgtacctcgcagatggtacaggttggcagatttaatatcagctttcatcacaacaagagagcctttagttaccttcaaaattccgtctccaccggaatatttgtaccctttgccatcaagagtacataaagagatgagacttctcttcaaatttggaatatgccgcacatctgacaatgttctgatacagccatcaaacatcttgatctgaactgttccaatacctgcaacctcgcatggtgtatcatcacccatcaaaacagtaccaccttgaacagcttcataggtggcaaaccaatccctatttgggcacatgtgataggtgcatgcagtattaagaatccactggtcactagtttgtgcacaaccaacataagcaacaagcaattctgcatcagatttctcatcagtaacaactgcggctttaccttcctcttctttcttaccttttggtacatattttccggttctcttgtctttgtcctgtagcttccaacactcagatatatcatgtccatctctcttgcagtatttgcatgacttatacctgcctctggactttgatcttccatggtagctacttgaacttttatctcttgatttgctgtttgtgttcttctcctgttgcctgccccgaacaaccaagccttctgcttgtgaatttgaaccttcaaagggtaccatcttcttcatcttttctttggcatgcaaagcatcataaacttctttcaaagttagagtatcatggctataaagtatagtatccctgaagtttgcatatgagctaggcaatgaacacaatagaataaggcctaaatcctcttcatcatactttacctccatagactcaaggtcagcaacaatttccttgaaagcagagagatggtccattacagacccatcatcttgcaacttgtgtaaaaataacttttgcttcaggtgcatcttactggtcagatccttagtcatgcatatctgttccagcttcaaccacagcccagcggttgtctcctccttaagcacctcctgcaaaatattgttagatagataaagatgaatatatgacatagccttacgatcccttttcttctcatcgttggaccaatcctgagtcctcttgtcaaatccagaaagcgcatcatcgaggtcttgttgtgcaagaacggctcgcatcttcacttgccaaaatgagaatcttgtgtcttggtccaggagcggtagatcatacttcaaactcgccatgggaattaatcctgaatttgctagaaagaaattagggtaaatctagcaaaaaaacgcgaaacccggtacacttctcgtgtgcacgtagcgtagatctgaaacttcctggtacacaagcttgtgtgcgcgtagcaattccacgtgaatagaaaatcacgtgaacaggaacctgatcgcttccctcgttgacttccttttcagcctcgggaaccgtgcgatttagtagatgtattgacgccggctgctactcctggacgtgcgcgtagacggcttgctgctgctgcttgccaatctcctgacgcgtgcgccgattccaggacctgggctgctgctgccctaatttcgcgcgggctgtagggatgacgccgatcagatcgatccggcgactcgacgatccggcgcctcgacgaaccggcggcggctgcgtgacgtgtagatcgatctccaaagctctgataccacttgttatgaaaatagatgcacaacggagacacgaatttttacgtggaaaaccctcgcgggaaaaaaccacgggcgccgaccggcaatgatcactatagaggagttgattacaaacgtaggggaataacaatgggaacgtcaccccttcccgtacggcttacaagagtatatataagggataatagaaagacacctaataggactcctactaggaaactaatccgaatatattgtgggcccaaaattcggatcacatatttaataggggggagtggaggtgggcaggtggccactgcccctgggcagtggcaaggtgtagaggttctagtacttgtgccgactacctcgacaccatcactacgctcctcctcatcctcagcgcccatccttgcgatcatcacattcctcaccactcctcagtcggatcccaccagagaacacatataaaccatccgcgtcgatggagctcctatctcgccacttcgctattgcagggagtggaatctaatccggggatgtccctttgtatattttttctttcaagttcatgtaaatggttatacaaaatgtaaataataatttgacaatgtagagtacagtaacatctatcgctccaccaataatcaacttcaaacttgatctatacattgaaaaaaaacaaattatgggatgaataatactatattgttcatatgttgaatttgcccttttcatttctcaatgtgtgagttgagtttaagtttaaattttattttaaagtgatatatgtatgtcatatgaatgttattttttgagatttttttaataactatttgagtggtgtttgagcaaatgagaggacatcccctcaagagtttaaaagtgtttcctgctattatgctattatggtcgctcaacatttagtctataatcgagtttgccgttattcattccacatccacaattgtttgctagctcacgtgtcttgcatgtgcgtcgtgggcaacgttgaggaaagcctcttgaaagcagcacattttacataggagcttgaagtaaacacatttgctcatgcactgggtgaaaaacaattgaaaatttctcagatttagattcagattcagataattacatcatacatcaacatctgagatagtcaggtgcaaagcttctgaggtctctcctccctggtgatcagatgatgtgaagtccatacctcacagttaagtatgtagttgtagtgaggtggaagatgagatcttgacgcgagaaccttgaattttccttgaggtctaacacttccaaacagaaaatcttgcaaactcaccatgggaactgcagcttcactctgaggaaagtttgtgtgataatctaccatgtcctgaacagaacatgtctgatagtcgccaagaaccacaagatattcagaggaaacattgtttatcatcctaatgtatgtgggttcaaccgggtgccaaggacagtcaatattggcaccgtatcctaagagattcttctgcttgaattctctgattcctgccagagccatgctccaaaacctaacattgaaatttgctttcagaagtacactgtacatgcttgaacccatgaagcacccattcatctccctggccatatccatggctatcgatgccaactttgggtgctcctctgcatctatgcttccaaatgtgcgaaccttgaaaaagtaccagtaagcttcttgagttaagtattttactctaagagcttgggttgttccaaacctcgcaatcttatcagatcggcttgcgactataatcttactgccttttgcaacacaccttttggaagctgagtacaatctactccatgcagcctcatcgatgtccctgctcaattcgataataatcagtagtctttcttcaccagtaccacggttttgatgcttgattacaccacaatctctcagagtcaccatatttgcatcctcaagatcatcgtcactgaaatgcacaatctgaaaaaagcggttacgcaccctttcatcggcacaggcatgctcaatcagggtgctcttaccaaccctccacgggccaatgataggcagaactcctgtattttcatcaccaggaatatcttctttgagcaggaagttcatgatgtgctccatttccatttggcgacccaacaagcacttgtctagaagcaagtgcatgctatatggctgacggcacaaacggggacacctgttcaagaacatgacaacctcacccatatcttcaatggtgacctcaaggctgccaaaaacttgctgcagctgctcttctaaactcttgccactgaccctgcagaaccggatgccttggcaggattgaacttggatggtataacatggttactcacctcgtgatctttggtatggtctgcttcatggacatggcatctgaatctgtcaagggtgtaatatcctctgtacatctccttccttagtatgttcagttgctgcagcatggattggtttgtgatgagccgttcatctgcctcctccaggatgatacgggcccggagcagcagccgttgcagtctctcctccacggttagcgctgtcggtttcgaggacttgttgatcaggaaagatatggatctactggcaagatcacctagaatggcagacagaaatgtctccatatgtaacaatgtaatctcaagttttgtagtttgagacaagaactgagacagagagaaagtatgtagtctgaaagtttttagtggatctggtgaagcagagtaggaattgaggctggcacatattccagcagctccatgtcttcataaaaggaaacgaattgcactgtgatttacctcaacctagatttatttttcagtgtgaaccgtttgaatataagcttcaggttttctctgcagtttggattaatataatcatacaagactgaccatattgtgaagatgatgaaagaagtagagtaaattcttacagattnnnnnnnnnnnnnnnnnnnnnnnncaagtttcacagacacgtgtatattttagttgaccagttctgcatactactactaggcaacacaatagccttctaatgtgacaaaaaaatatttgttttgatgcgggcgttatcttggtgacttagctaattggaaagaacgcaatgctcgtgtctttgaggggcacgcagtctcaccggtgaatctttgtgcgtcaattgaggatgagtggaaattgtggtaagaagcgggcttgaccacctctctttgagttgtatagtgggtgcgagggttttcccccatagttgttgtgtatagagggtttctttcttttttgttgtgatagcacgccgtttcctctcggcgtgctttgagacctgtaaattctttcttacctcttagtatattccggccagttattgccgaaccagcgaaaaattgtgaaaaaaaaggacttgatgaacatgaacataaggcatctcaaactttttttttatgaatgtcaacatgttaaaactgttgaaaaatgataaatgcatgtaacatgttaaaatgaaaaagcctgttgtcccaaattaattttccattaaactgttaaaaattttccatcctattacaagttaataaattcccctgttatgccccagtacaaattctaagtcttctttttctttttttttgttgggccaaaattcaagttttttttcattttgttaatttagagtcaatttttttgctgctacttgtctgactgaggagtgaggaccagcaaaaacgacattcagaaaaagcaattttacagtccttaaagaggtaccataaggtaccactttttctattgtaaatttggtatctcttgctacctaggtactataagataccaaattttacactaaattttgatatttgctccgatccagcaaaaaataactcgaggtaccgataccccacggtaccaaatcgtttccgatcgttggatctaacaatgcccatcctgcccagctagacccaacgatcgcaaacgatttagtaccgtgaggtaccggtacctcaaggtactttttctggaccggagcaaatctcctaaatttttggtacctcatggtacctcctcaaggaccgtaaaattgctcttcagaaaatgctttccctactaccatttctgcctatttatacatctgactagctacatttcttcaacgatagaattatggtacatttctggactatctagacactttctctgaaatttcttttggggatcagtgcacacttcaatggtaaatcaatatattctcagaatatgctacagattcttgaaaattaagtacctgaatagagagcagacatggatgtagaggagggatcgccgtcagccgccgccattatcgccaacgtctctagattcggtcggcgacatagcagctcgccggccaagttacagggccatgaagcaattcagaaattccccatcaataatcgacactttaatttcgttagtttttgggagtactacctccatcccaaaatgtagcaacctagaatgggatgagatccatcctaggataatgtcatgtctagatacattgttctaggatagatatcatcccctcctaggttgttatattatgggatggagggagtaaaaaaatgttttttttagagtcgacagtataagtggtactcactcccattccaaaataaaatgattattcgactgtactatatctgattatatatatagtacttgccactattgactctcactgattccatttcgacccctgattttcaaaatgttttttaataatggattaaataaaacccggtctccacatcccgaaggtcggatgtacacaaccacagtattacatcaccaagcacttgggcttacaaataagtttaaaagcaaacgccatcataggagacaaatagacgacaaagacatctagaacaagtctcacaacaaaagatttcaactaacaattcaatcttcctatccaattccacccagattttgagtagaattccataatggtaacttccaatttttggcacccaacagctttctcgtcactctctttaagaagcaaagaccactagcaagcccagcgtgtccccctgaaaataatctgcaatatagagttaattgttgagccattgaagactacatcattcctagcaacctaaagtgcccaacaaatagccacaactcccacgaaaagttgatccctaagcttagatactaatccccatgaccaaccacccagaggattagcaacggaagtaggcacttgtattcccataaccatgaaaagaatattccaaactgaatgtgcaacatgacaataaaaaacagatgttcaattgattcttcagagttacagaagcaacacttaccttttcgtctccttttaaccaaattgtcttttgttaagactactcctttgatataccaaaggaaaatcttaatcctaagtggaattctaagtttccagattatcgactttcttggtaccacattatggtacataagagccttgtacatagaactcaccgggaagactctcttcccattggcttcccatctaaaaatatctggactattagataagttaaacaagaccatttagcataccagcttgtatcacgcattcaggttatcccccaccaaagctctactaaagggcacatttagaggaacattgcccagtacatcgcttactctcgcatgcttgtttattgttagtaaatagagggagggatataacttatcaaaggagttagtcacccacccagcgatcctcccaaaatctcacttgttctccgtgtccaactaccatagatcctagttgcaaaaaatctttcttaaccatcataagcccggccctaaaatgtaaatccccagaccgcttttccacttgagtgattgttcaattggctaagtacttccttttgaacagattttgccacatgcttccctcgttaaacaatttatagagccatttgcttaataggcacttattttgaatgtctaagttttgaatccccaccctccatattccttaggcttacatagaatactccattttgctaccctatacttctttttatgttcatcacattgccagaaaaatcttcttgagaatacctttagttatttcaaaaggttaaactacttgcacaaaaaaagtcagattcagcacttctgataatagagcaattttacggtccttgaggaggtaccat

SEQ ID NO: 58812 - DNA, 2924 bp, Oryza sativa
acgttgcgcctgtctccgccgggagtggaggtaggtgtgggctgtcccatcgaagtgtcattcggacggcaaccataccaatctccgtccataaagagaagaaaagtccagtttggaaaggaaagggtacatgtggtatccccttaagatataaaaggaggaccatgcccacaaagagaggggactggattttcccgggagaggagagggctggttgatattttgtaacttgctcttacacagatccaccaaaaacacaggagtagggtattacgcttcccagcggcccgaacctgtatacatcgtccgtgtctcgcgtttcttcctggcacgcgatctttccacatacagagagagcttgagatctcaccctaagcccccggccgaactggcaaaggggggcctgcgcggtctcccggtgaggagccacgagctccgtcatctggcgcgccaggtagggggctcagcgtgtgttttctgagctctcatactcttccgtgtgcgccaagtttcccttgttcagcctaatggccgagcaagcaaaggcgcacgacctctctccgagtgtgagcggcgacgacggggagccaaacccacgccgtcgagctcgtacgcccccacctcctccacaacaaaatcctaagcagggggaggcgctcgagagggtcgaaaaatccgcagcatcgccagtcgcgggtggtgcagaagaacggcgagatgggaagcgtcgcctcctcgtctacggcgacggcagcacgcctcaaggcgcgcttcaggctgttggcgcgctcctacgtcacccgcccatcgtccctgacccggagtctccggcccagcgatggctggacgacgtggccaacttggtcatgacggcacagcagcgcctgagtgctggtggacggtccgccaccaccaggacctccggcgccgccaccaccggctctgtgtcatcaaggcggagggcgcggcgagcggcggctgctgcacgccattcggctaccactccctcgtcggcgcctccgactcgggaggatcagcatgaagagccggatgcccgcctcgacatcgagcgccgacgtagtgatcggcgtgctccccgcgcaacggagggtgcctcttcgtccagggtgtcacctcgacatggacgtgaggaccagccctccgtgcccccggttggtggtgttggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcgcggggttggctaatgaacctgccacccgcgtcggtccactcctgggaggatctgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagaactttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgttgacatcgatgacggtgatgatgacctaggtttccaagaacctggggccaccattgccactgtcgacgggggagcgtgtgctcacgtttctcgccggagtttcaaggccatgaggcgagagcttctcgccgcggcccctactcatgaggcgacgcgtcgggcgcggtggtcggaggtggccctcacctttgaccagaccgaccacccaccgtgcgttgcccggggagggcagattgcgatggtggtttcccccaccatctgcaatgtgaagttggggcgtgtcctcatagatggaggagcggctctcaacatcctttcccccgcggcctttgatgctatcaaggccccggggatggtgctccagccgtctcaaccgatcatcggtgtgacgccggggcacacatggccgttaggtcacatcgacctaccggtcacctttggtggatcagccaacttctgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccaca

SEQ ID NO: 58813 - DNA, 14591 bp, Oryza sativa
taccatcagattcgcatggctagggaggatgaggagaaaactgcgttcattacccccgtaggaacctattgttatacatcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgagcccctgctactttacttagcggcgaccccccaagtagttagtgcagcgttggttgtggagcgcgatgaagacaatcctcatttcgtgcacccccattctgtgctaacttggcccgggagcgagcggggaggagaggcccccgagtcggacggtggcctacggcccctgacgaccggagccggccctctgcccgcttgtcagacggtgctaggtgcccccgaccctcaggagggccccaaggccactgcgggaaggccgcacttaacgccctttgaccccgaggctaaccctgtgctgactcgatccgggaaagagcagggagaagaggcccccgagccgaacggaggccagaggcccctgacgaccggagttggccctttgcccgcttgtccgacgatgccaggagcccccgacccccaggacggccccgaggccactgagggaaggccgcccctttcatcctccgaccccgaggtcatcggcacagaagacaagtgcgccccgaaaggccacttgaacgaagaacgccccggggatacggcccctagcagagaggatcggccccaccgaagggtgcagcggcctgtctactttgttagtgaggccctccgggacgctaagacccgataccctcaggcccagaagatgctttacgctattctgatggcctcgaggaaactgcgccattattttcaggcacgtagggtcactgtggttacgtcttaccccctcggtcaaatcttgcataatcgagagggtacaggacgggtggtaaaatgggcaatcgagctttctgaattcgatctgcactttgaaccacgccacgctatcaagagccaggccctcgccgattttgtggcagagtggaccccggctccagagaccgtctcaatccccgaggccagcacgaacccctcacagctgcctcacaccacccactgggtaatgcagttcgatggttctctgtccctccagggtgccggtgcgggggtcacgttgacctccccgaccggagacgtccttagatatctggtccgcctcgactttcgagcgaccaataatatggcagagtacgagggactccttgccggactcagggtggcagccggactggggatccgccgtctcctggtgttaggcgattcccagctggtcgttaaccaggtctgtaaggagtaccggtgctctgacccgcaaatggacgcctatgtacgccaagtgcggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcatcaggaacaaggcgttgagcttcttgctgacatccatgagggagagtgaggagcccattccgcctcgcgcaccgtggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgtacggctggccacgggcgacggcactgagctgccaaacccgtggaacatcgaacaccttcgtcgcttctacccctgaggggggggtcgggtgtcaggtttcgggctcgggctaaccccgcacccccctcgggtgtgcagggttagccgggggctaccacacatgcacagccttacttttcttatttcagcatttcaataaaagcagtttcaatttcctaaaggttgtgtctgtgccgtttttccttctgaagaatcttaacttgaaataaggtcactcgtgctcaaccttgccctcgggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcatagcaaaataaagttaacatagaaatttttcatcatttttgattgcagattaagttgatctatacaaaaagaagaaagaaaaagaaaaaattggagattggcgggggcctgggggctcattccaatgcgcccgggtcgccggcctcgtcgccaccgtcgtcctcaccgctggcgtcgccctcctcgtcggagctgggggcgaacgcgagccgaggggccgacccctcgaagctttggacgatgtggttggcggcatcccggacccgcgcgcgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcgaggccttccagattgatggagcgcgaaattgtctggcctttccagaggcccgcttcccgaccggcgcgatccagccgggagactgcatcccaaagcatgccgggccctatctcacccgacaagcggagggcctcggcttccccggtggatgagtccagggcgcgctgcatgtccgcgacggtgtgttcggcagctgcgaggcgggcgactaagtcgctttcgcccgtagccgccccgccgctgcgctccctcgcgtccagctccttttctcgcgcctcgaggttagcagcccgctgctccagcgcggctctctcggcgcggacgcattccagattgcggcgcgcctgctcctcctgcgttgcctcgcggagggacaggctgtccgccagccgttgtgtcgcggcctcggactcctcaagagctcgctcccgctcagcaagcgcgtcctcgcggagccggagcgcggactcctcttcggcgcaggcggcctcgtgcgccgccagcgtcgcctcccggatagcggcggcggcctcgcggtccgccaagctggtctccacggcgccggcatgatcttccagcgccatggcacgggcttcaagggcctcttcgcgccgccgggacgccgcttcagcctccgttgctcgctgctctcgggcagcggcggcgtcaaggaccccctgggcggcgtcgagctttttctttagctccgcctcccagctcccgtgttgaaggcggagggagtcctgcgcctcaatcatcgcggtggtggcgatgagggcggcctctcgctcctcctccacctctcgggcgatctccgccagcgccgccttgcgggcttcaagctccgagatgtggcggcggtgagccttacggcccacctccaccatggcgtccaccgagcgccgcccctcctcgacgcgcgcccatgcggcctcgagctccgctcgttccgctcgcaaggcctccacctgggcgctgaatccatctagcaccgcggtgtttgcggcggccaaggcttgcagaaggggctcggcactcagcggggcggcagaagacgaggagaagagccgccttggagaaaatgcgacgcggctcggcccgccagaagacgcactgagctcggggatgtcccccggacccgtttggtcctgggcgtcgcccgagggagcgggcccaggcgatccgcccgcggcctcgtcgcgagccgccccggaggctgtcgcctgagcgtcgcccgagggagtaggcccaagcgacgcaccagcagctttgtcgtgggctgcctcgaaagacgccatcgcctcagtttggcgggcccgggcggcctcctcccgagcggcttcctcggcttggcgggcccgggcggcctcctcccgagcggcttcctcggcttggcgggcccgggcggcctcctcccgagcggtatcctcagcctggcgagcccgggcggtttcccgggcggcctcttcagcttcccgaaggcgatctgcggcctctcgccggtcagattctcgcctccgttcctctgcggccgccggatcttcggcctcggattggccggacttgggatggcgggaggaacgtgacgggacatcactgaagcagaaagaaaaaccagaaggcaaacaggatgggtaagaaaaaacttgcttttggaatagaagaaaagacggtcgcaatgagcgtgggacgaacctgcgagggggtcggttaaatgaccaccttggaggggaaattaggtttccccgggatggttctgtctcccccatcttgcgcagccgcttcttcttgcgctccccctcgggctgcgaggttggcgcggccccctccgggcgcctgctgctggcacgcaccgccccgccccctcggggaggagatgggggaggtgttcctcccagtttcctcttcccccgggcgtcggtagggcggttgctccccgagcccccgacgcggggcccagaagcacgaccccctccgggggtagattgatccccccggcggctcccacctgcgctgtcatggcccttaggagcctgctcctctgaggccccgaccgccgtcataatggttaagatggaggcgcgatctgggtcgctgcagagggggaggataccgtgggggatgagagacacctccacggagttgagatttagcacccgttggaccagtatcttgaagtcctcgggggcccaatcccatctgactccctggtgggtccgcatgtagtcttcgggcccggtgtactcccaggcggcccgagcgcgccgctggagcggcgcaatccgacgacggaggtagtcgccgtacaccatggcccctgtgagcccctgagatcgcaggcccgccaggcggtcgaggacggcgtcatagtcatcccccagatctactggcgcccgccagctggagaccggcgccgggggctggcttgggagtcggaggcgcgcttcgttggcaaggggggtgtagaaccagtcgctcttccaatcgtcccacttcttgcggagggcgcaggggatgtagcggttcaacaccggcccccgcggctggaagtagcaaccaccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcgaaggggaggaagaagatggaccgccccgggtaatctggtgctgggcgcgcctcgcccagcatcactatctcccggccggtggcagattccggcatgaagcggcgcggcagcccagcctgcctctcgctcacaatgcgggaaggcggtagtacgctaccgtcgagcagagcggagccccgtgccatgtcgtcggagaaagagagggttgagaacgagcgtgtgtggcgaaggtgaggcgcagcaaagagagagtttagggcgcaaacggcgaaggaaaggggaatagtggcgaaaggaagggagcaagtcctttcctcgatggctttatacccttgccatcgctgagtccggctcctcgtttctcgtgcccactatctcgctccctcgttactcgctatctcgctccctcgtttctcgcgcccacgcttccactaattccattcgcccgcttgcggcgcatgaggtggatatgcggttgtggcagtcgagatagatcgtatcgtgtgcgcgttaattacgctcgccgaccgaagcgacgttaccatgtctccagacgaaacgaatctgcacgcccagattcgagtgctgctcaagtgatgtggcagtcttgaagagaccgcccatgactgacggccaagacaccgttaccgatatgcgtggtttgagaccgttgggtttctgcccaatcacggagaccggtcccacctgtcaccaggctttatgagtggcgtcatgcccgaccgcttcccttgagaaggatgatcgccctgacataacgccgggggctactgtcggtgatatgggaccgggagtattgcgcccggaggcttgaggcagattgaatcgcccacgtggcctggcaccctcggggacgtcgggcccgagggtgaggtgtccgccctcctcctgatttccccgagggggggtcgggttgcccctgccccggccccgagggccgaggtgccccgaccccttgtggggtttgcactatgtacataggttgggtgaacacggtagggctcacctaaccgcatttattgcggtctggtcaagcgtgtcacgctgcatgcagcgcaatgcagcgcgctcttttatccggtctgtgaccagtcacagaccggtcagatcaacggttaggtggcgactggcggtctgacgcacgcctcgccccgttccgtcaagacgagagcctctaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggctgtcccatcgaagtgtcattcggacggcaaccataccaatctccgtccataaagagaagaaaagtccagtttggaaaggaaagggtacatgtggtatccccttaagatataaaaggaggaccatgcccacaaagagaggggactggattttcccgggagaggagagggctggttgatattttgtaacttgctcttacacagatccaccaaaaacacaggagtagggtattacgcttcccagcggcccgaacctgtatacatcgtccgtgtctcgcgtttcttcctggcacgcgatctttccacatacagagagagcttgagatctcaccctaagcccccggccgaactggcaaaggggggcctgcgcggtctcccggtgaggagccacgagctccgtcaagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatatgtatgcatatatatgtattgaaacatatatatgcatggtttatatatatatatatatatatatatatatatatatatatatatatatatataaaccatgcagcaacaggggcatgcaaaaaaaaaaggtcagctctatctttagtcccggttggtgttaccaactgggactaaagatagatctttactcccggttatttcacccgggactagagatagcgatctttagtcccggattggtactcccggtttggaaaccgggactaaaggggggttacgaactgggactgcaaagggtttctccaccagtgacacatgattggaatccaggacatgcctcaactaactcaaaaatgaccatcacatggaaccaaattagaaagtgtgatcagcacttttcaaatatatgcattgtatatttttgtcatacacactctctccaagcagtttcaatatttagatactttcaattgctagcaaggcttgttttctttagtttgagagaaacatctgccatcatatttttcattattattttttatatttttggtaatacgtgatgagcagagcatcctaatatacataataaaagatgtttttagttttaaagcgcgcgcatagagtgagtgtgcatctaaatatacactatcaaaacctgatgattttgaagtgtaggcagatagcgagtatttatatgtttatgtgcaactaaatatacacgtcaaaaaatgaccgcacagaccatgcaagaaatggttggcgctaatccaaatatttactaaaaatatatatctagacttgttttttcaaagttatcattctggatcactgattaaaatataggtgttcaattcatgatcatgagcacgtgttgtttgaactaaaggcaaacaaatttgcccttatcatgacaacgaaatggataatgatgacctaaggaaaaaagaagggagtatctgatgagcaatttaggcattttaaggtttgctgccggagaagctgctggccgtcatgattccaagcatgcctctttgcccggtcaaaagacggcaccggtcttcaggtaaaaaaccaagaagggcaagcataatcaacaaatggatagaataaaccatccaagtaccatcatttggttggccatttggcatgctaatcactgcctgacattctggagatgctgaaaggaaatgttcctgacattctacaacgaatcagccgctacaaaacttaaaattttaaaattaattttagagctcattttaagttgtttttaatgaagttttttttcagcattgcttttaagtcactaagaacgtgtataagttttatgccgttacagcttaatgtaacttataatcagtgttacaagaaagataggatgtacagatcagatcatttctaccgtcagcagagattatcatgcatggtaaaatcatacaaggaaaaataatttactgaccacataaatcacaaaaagaaaaggttcatcagtttggcaaaaaagatggccaacctgcccctacttgaatagttccattatcttataacattccagttcataccatgttttgtgttacatttcaagtgcaactgctacagtgcttacctaaaccaaaccccaagtgcttcccagcaacactagtacagcacagttcacatagcattagcatgtcctctcatctcacactgcatcatccattgtggtttcagattttcagtgacctgtcttgcagttgcatgcaacaaaatcaggcaggcagggacagtgaaaagagcaaggaaaaaaaacaacaacgcatcaatgtttcccagatttcttgtgttcatgttcagaaatcagaacaagatggagtgctactactgtttccctcatcacattgtactacagtggtcaactgctctgaaaagtgcaggtactactgttttgccaatctttattttttgacaatttttattctgaaataattacttcctccgtctcataatataagggattttgagtttttgcttgcaacgtttgaccactcgtcttattcaattttttttaaaattattatttattttatttgtaactaactttattatctactgtactttaaacataactttagagactttggagggagtaaaagttactaggagtaatattctgcagtgcacagattctttcccagtgatcattgatcacttttaccaactctcctcgtgtcttttgctgaaacattactccaaaaagtttgttcttgcagtgagaggctcccagtgcagctgaagatctgacaacacaagccttgcagcaatccagccccagatacagatacaagcagccttcaccagacaaggctcgaggagtagatggagtaaatactctgaatattttaaacatgcagatttaaagacaaggatttgattctccatttaaatattttaaagcatgcccatgttgctatacatttctcagatgagagcaaataacagttatatgtgagtggtttaaaaacattgcattgcagcacactggatagtattttactcccaggttgtatgataattatgtctaaagaagttactaagcacaagaagcaaacaggataagaaaagaactgtcatgtcagctgttcctgtccacctaattaaaccccaatgggggagcagtaaacattaaacaacaacattattagtaccaggcttgcaaccgcaagtgttttaattactgtttcttgtttcttgcagcattcagattgagccagtttcttaagagagcctcaccaaccagtgtgtgctgccatttatcttcagttattgcaaagctagctaacatgaacaatatagaaaggcaaagctttattgcaaagcagcaagcatggaccaatagaaaggcagcaaagctcaagacagaggattgctactggccatgtctgaaggaaacaggattacaagagtatcttacacaagattcttgttggttcattaatattaatcactgctcttagccattatcttagttcttaaatctaaatctagagatatcctttaggtatttgcaactatatccccatatcattgttcataactacttcctccgtttcataatataagtcattctattcttcgtttcataatataagtcattctagtattacccatattcatataaatgttaatgaatctaaacatatatgtgtgtctagattcgttaacatatatatgaatatagatagtgctagaaagtcttacattatgaaacggagggagtatatcctttaggtatttgcaactttacctttatcagaaatatttatgttggcaattttctccagaccaggaaagtgtactcctttgttcttctgcaattgtcatccagcagtagcatgctgaaactaaagagtagcttctacttgggctaaactgggatgaagtttccccaagtttaataacaaatttgaaccaaataagatagaaaatctagacaaccaaactactttaatccttgcttcccatgaaaagcacaatactttcagttcttggattctttccactataatatttggtagtgtcaccaactcaccaacacaaacagtaatcccaagaacaccaagcagaataaaaaaaacaataataataaaccatttctttggcattcaacacttgcatcaccataaattactacaaaagagagatcaaacagcccattaatccccttttttctatacaaaaacgaaagtcaaacattttatcattccatgccttcttggcttcttgcaactaccatacatacttactacttctaattactcattactaataaacacttaaataagccaaagccatgaacagtagaattccaagaaacagcagcaagagcaagaaatccatggcggtggcagcggcggcggtcagggcgtcatgacctggacttgccggcggcggcggcggcggcggcggcggcgccggagaggcgggaggtgaggccgaggcagccgaagagaagcccctgctggtacggcaggaacgtgcgccgccgcatctcctccacctcggctcgcctcgccgcgtacatccgctcgtgcgccgacctcctcctgccgcccctcgccgcggcgggcgccggcgaccgcggcggcgcgatgggcggaggcggccgctggtccttgcccccgtccgagccgctccggtggaggagatccttcaagaatctccatctgcgggagcttctcgacgaggaggaggaggaggaggaggcggagg

SEQ ID NO: 58814 - DNA, 13574 bp, Oryza sativa
tgagcagcgcgcgaatctgggtgagcagatttgtctcacccggagatacggtaacgccgcttcggtcggcgagcgtaattaacgcgcgcacgatacaatccattttgattgccacaaccgcatatccacttcatgcgccataagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgaggaaaggatttgcttccttcctttcgccattgttcctcttgccttcgccgcctgagctctaactctttctctgccacgccctactttcgccacacgcgctcgttctcaatcatctcttcctccaccgccatggcacggggctctgctctgctcgacggcagtgtattaccgccttcccgcatcgtgaacgagaggcacgccggactgccgcgccgcttcatgccggagtccgccaccggtcgggagatagtgatgctgggcgaagggcgcccggcaccagactacccggggcggtccattttcttcctccccttcgcaatggctgggctggtcccgccattttcctctttcttcatggatgtcctggagttctacgatctccagatggcgcacctcacccccaatgcggtgatgacattggccatcttcgcgcacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccaacgaagcgcgcctccgacttccaagccagcccccggcgcaggtctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtggtccaaagggtgctgaatcttagctccgcggaggcgtctcgcattcctcaggagatcctccccctctgcagcgatcccgaccgcgcctccattctaaccattatgatgggggtcggggcctcagaggagagagcccctaagggccacgacggcgccggcgggggccgccaggaagaatcagcccccggagggggccgtgcttctgggccccgcgacgggggctcggggagcaaccgccctgccgacgcccgggggaagaggaaacaaggaggaacacctcccccatctcctccccgagggggcggggcggcgcgtgccagcagccggcgcccggagggggccgcgccgacgtcgcagcccgagggggagcgcaaaaagaaacggctccgcaagacgggggagacggaaccatgccggggaaatctgatttcccctccaaagtggtcattcaaccgaccccctcgcaggttcgtctcactctcattgcaaccatctttctcccaaaagtaagtttttttcttactcattttgttcgtcttctggttttttcttctgcttcagcaatgtcccgtcgcattcctcccgccaccccaagtccggccggtccgaggccgaagatccagcggccgcagaggagcggaggcgagaatctgaccggcgtgaagccgcagatcgccttcgggaagctgaagaggccgctcgggaggccgcccgggttcgccaagcggaggaagctgctcgggaggaggccgcccgggctcgccaagccgaagaagctgcccggaaggaggccgcccgggttcgccaggctgaggcgacagctgctgctggcgcgtcacttgggcccactccctcgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccggggggccgagccgcatcgccttctctccaaggcggctcttctcctcatcttccgtcgccccgctgagcgccgagcccattctgcaggccttggccgccgcaaacaccgcggtgctagatgggttcagcgcccaagtggaggccctgcgcgcggaacgagcggagctcgaggccgcatgggcacgcgttgaggaggggcggcgctcggtggacgccatggtggaggtgggccgtaaagctcaccgccgtcacgtctcggagcttgaagcccggaaggcggcgctgacggagatcgctcgtgaggtggaggaggagcgagcggccgccctcattgctaccaccgcgatgatcgaggcgcaagacaccctccgccttcagcacgcaagctgggaggcggagctgaaggaaaagctcgacgccgcccaaggggtccttgactccgccgctgtccgagagcggcgggtaacggagactgaagcggcgtctcggcggcgcgaggaggcccttgaggcccgtgccatggcgctggaagaacacgccggcgccgtggagaggggcttgacggaccgcgaggccgccgctggtctccgagaggcgacgctggcggcgcatgaggccgcctgcgccgaggaggagtccgcgctccgcctccgcgaggatgcactcgctgagcgggagcgagctctcgaggaggccgaggccacgaccagacggcaggcggacagcctgtcccttcgcgaggcggcgcaggaggagcaggcgcgccgcaatcttgaatgcgtccgcaccgagagagccgcactggagcagcgggctgctgacctcgaggcgcgggaaaaggagctggacgcgagggcgcatatcggtggggcggccgcgggcgaaagcgacttagccgcccgcctcgcagctgccgaacacaccgtcgccgatatgcagcgagcgctggactcctccaccggggaggccgaggcccttcgcttggcgggcgagattgggcccgacatgctttgggatgcggtctcccgcctgaagcgcgccggtcggcaagcgggcctctggaaaggccagacgacggtgccccccaccaatctggaaggcctcgctccgcacctccacaggatggcctgggttctcgaacaactccccgaggagcttgagaagaccatcaagtcatcctcaagggacctcgcgcggggagcggtcgaactcgtgctggcgagttaccaggcccgggaccccaacttctctccatggatggcgctggaggagttccctcccgggaccgaggacgacgcgcgcgcgcgggtcggggatgctgccgaccacatcgtcaacggcttcgaggggtcggcccctcggcttgctttcgcccccagctccgacgaggagggcgacgccagcggtgaggacgacggtggcgacaaggccggcgacccgggcgcgttggaatgagcccccgagcccccgccaatctccaattttttcttttcctttcttctaaggccttcatgcctcttttgtgtacaaattaacttaatctgcaatcaaaaatgatgaaaaatttctatgttaacttcattttgctatacatatgagttgaggatgatttgtgccgtggtccttttgcgccttagcttgaaataagggctcgtgcccaagtcccagtcctcgaatggctcgggtcggggctagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagctgtccgaaccgaacccccgagggcaaggttgaatacgagtgaccttattttaagttaagattcttcagaaggaaaaacggcacagacacaacctttaggaaattggaactgcttttattgaaatgctgaaataagaaaagtaagactgtgcatgtgtggtagcccccggctaaccctgcacacccgaggggggtgcggggttagcccgagcccaaaacctgacactcgaccccccccccctcctcaggggtagaagcgacgaaggtgttcgatgttccacgggtttggcagctcagtgccgtcgcccgtggccagccgtacggagcccggccgggggacgccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaagctctgctggtagcgcgcggctcggagggccgcgcgccgccttcgttcttctaaatagtcgaggtcatctctgcgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaacttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccacgacagtggtatgatctgcagggcctgggccggctgatggatttgcttggcgtggaactgacacgctctgcatcgccggaccagatcgactgcgtcattgagagctgtcggccaataaaatccttgacgaaaggccttgccaaccagggtacgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaagggatcgggtcgcgccgacggctgggtaagcctttcttcaaaggcgcccggtggggtctgggctcgcgaggacgcgagccgtgagagttcgtcggctatcatgttatcccgtctgggcacatgccgaagctctattccatcgaaatggcgctccatacgccgcacttggcgtacgtaggcgtccatctgtgggtcagagcaccggtactccttacagacctggttaacgactagctgggagtcgcctaataccaagaggcggcggatccccagtccgactgccactctgagtccggcaaggagtccctcgtactctgccatattgttagtcgctcgaaagtcgagacggaccaaatatctgaggacgtctccgttcggagaggtcaacgtgacccctgcaccggcgccctggagagacagagaaccgtcgaactgcatcacccagtgggcggtgtgaggcagctgagaggggttcgtgctggcctcgggtattgaaacggtctctggagccggggtccattctgccacaaaatcggcgagggcctggctcttgatagcgtggcgtggttcaaagtgcagatcgaactcagaaagctcgattgcccattttaccactcgtcctgtaccctctcgattatgcaagatttgaccgaggggataagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacccttcggtggggccgatcctctctgctaggggccgtatccccggggcgttcttcgtccaagtggcctctcggggcacactcgtctcctgcgctgatgacctcggggttcgaagatgacaggtgcggccttcccacagtggcctcggggccgtcctgggggtcgggggctcctggcgtcgtcagacacgcgggcaaagggccagctccgatcgtcaggggcttcaggcctccgttcggctcgggggcctcttctccctgctctctcccgggtcgaatcagcacagggttagcctcggggtcaaagggtggtaggtgcggccttcccacagtggcctcggggccttcctgagggtcgggggcactcagcaccgtctgacaagcgggcagagggccgactccggtcgtcgggggccttaggccaccgttcgactcgggggcctctcctccctgcctgctcccgggccaagtcggcacagagtgggggtacgcagaatgaggattgtcctcatcgcgctccacaaccaacgctgcactaactacttggggggtcgccgctaagtaaagtagcaggggctcatttggctccggggcgactagaactggaggagagctgagatacgccttcaactgggcgagggcattttcagcttcctccgtccaagtaaacggccccgagcgcttgaggagcttaaataagggtagcgccttctctcccagcctcgatataaaacgacttagggcagccatgcaaccagtgacgcactgcacatccctaagtttgctgggggggcgcatccgctctatagctcgtatcttctcggggttggcctcaatgcctcgggcagagaccaagaacccgagaagcttgcccgcaggcacaccaaacacgcacttatcggggttcagtttcatgcgggcggagcggagattttcaaaagtttccgctagatctgagagtaaggtctcttggttgcgcgtttttacaaccaagtcatcgacatacgcctcaacattacgtcctatttggctacccaaagaaattcgagtagtacgctgaaaagtaggacctgcattctttaacccaaaaggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgcgtggtcttggatgggccgtcgcccaaggcaacctccttgaccgggacctcgtcgcatgtgacgatccgttgcctcggggcggtgggggcagaagggccaagcctctcgtcaccaccctcgggcttggacgcagcagcgaggcggtccgcgcgctgctccatgcaagcgagcgcgactttaagatcgccatggacagagatggggccacccgggcccggcatcttcatctggaggtaggcgtagtggaccgccgccatgaacttcaccaacgcgggcctccctaggaccggttgtagggcagactgaggtccgccacatcgaagctcacccgctccgtgcggaagttggcgggtccaccgaaggtgaccggtaggtcgatgtgacctaatggccacgtgtgccccggcgtcacaccgataatcggctgggacggtcggagcaccatccccggggccttgatggcatcgaaagccgcgggggaaaggatgttgagggccgctcctccatctacgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgagtaggggccatggccagaaactctcgcttcatagccttgaagctccggcgagagacgtgagcacacgctcctccatcgacggtggcaatggtggccccaggttcttggaaacctaggtcatcatcgccgtcatcgatgtcaacagcgggggccttctgcttggcctcacttcgccgtttgccggaaggatccgccggggacttgccctcacggcgttcctgcctcctgtcctcctcccacttcctcgttcgctcagctaggtttttgactgcacgacagtccgcgagatcgtggagggaggtgttgtggacggagcaccacctgccggcggggcgctccctgctgggagtaccagcctctttctttttgtcgctcgcaggcctcccctttcgagtggcccgcggagcgccctcgacggcgaggacatgaccctcgtcgccggaacggtctgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatagtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacaccctggacgaagaggcaccctccattgcgcggggagcacgccgatcactacgtcggcgctcaatgtcgaggcgggcatccggctccccatgctgatcctcccgagtcgaaggtgtcgacgagggagtggcagccgaatgacgtgcagccgccgccgctcgccgtgccctccgtcttgacgacgcggaaccggtagtggcggcgcctgaggtcctggtggtggcggaccgtccgccagcacccaggcgttgctgcgccgtcatgaccaagttggccacgtcgtccagccatcgctgggctggagactccgggtcatggacgacaggcgggtgtcgtaggagtgcgccagcagcctgaagcgcaccctgaggcgtgctgccgtcgccgtagacgaggaggcgacgctccccatctcgccgttctcctgcatcacctgcgactggtgatgccacggatttgtcgaccctctcaagcgcctccccctgcttagggctttggcgcggaggaggtggagtacgagctcgacggcgtgggtttggctccccgtcgtcgccgctcacactcggagagaggtcgtgcgcctttgcttgctcagccattaggttgaacaagggaagcttggtgcacacggaagagtatgagagctcagaaaaaacacgctgagccccctacctggcgcgccagatgacggagctcgaggctcctcaccgggagaccgcgcaggcccccctttgccggttcggccgggggcttagggtgagatcccaagctctctctctctctctctgtatgtggaaggatcgtcagccagcaagaaacgcgagacacggacgatctatacaggttcgggccgctcggaagcgtaataccctactcctgtgtttttgtggatttgtgtatggacaagttacaaagtgtgagcccacctctccctcgttctaggctctgaatctggaaagaatcaacccccttctctatgggcaaggtcctccttttatacttcaaggggataccacatgcacccttctctttccaaactggactgttctttttctctttaatgggcggagatcggtacggtttccatccgggagcccttctgatgggacagcccacacctacctccactcccggcggagacggagatgacgcgggatcgtggctgcccgttgctgatgcgaccagtgtcagaccggtcattcttgtcccccacgcgtcagtttaacaacgtgcatgtttgcccttcttcgagtaacaccttgcctgtaatggttaggatgaagcctggtataaatctaaccagggctaacgtgccatctcttaaggtataacacgctagctccggtttgagacgagtgcctagaggctttcgtcttgacgggatggggcaaggcgtgcgtcagaccgccagtcgccacctaacccttgatctgaccggtctgtgactggtcacagaccggataaaagagcgtgctgtactgcgctgcatgcagcgtgacacgcttgaccagactgcaataaatgctgttaggtgagcacagctgtgctcacttatcccatatatgtggcgcagacttccttaaggggtcggggtgccccggccctcggggccggggcaagcgcaacccgaccccccctcgggggaaatcaggaggagggcggacacctcaccctcgggcccgacgttcccgaaggtgccaggccacgtgggcgattgcgtctgcctcaagcctctggtcatgatactcccggtcccatatcaccgacaacggtgattctggtcgatcgcccataaccgcgggcacggctattcgaatagttttactctagccagaggtgcacaactgtacccacaagacacaatccaccggcatgtcaccgtgccaggccagacacgtcaccatgtcgagtgattgtgacaagacccttcatataaccccctctgaccaagcacacaacacctcaggtttcacccccgcccccggcaggcagcgggcagtcccctctcgtgcctaggtaaatcagaaagccgcataggctgtcgtagggcccatccgaacttcatcacgctcacccttgcctggatgcgtcagccagcggaaagctatacttcaagtcaggcagttacccattcccgcttgtggcaagcgttgtatgtcttccagtgcatcccgcgaaccggtccttaattgccatgggtgcgaccagcaacaccatgcacccatagcccaccattcagtcgcattttagttggataattacgaccatgaaacatggccaaatgtctcgagcacgcagctcgttctgatactaacaaggtctaatactacaattatcccatcaactgagttagtggcaattaagcatggctaagcatatagttatagctaggtcaacatagtaacacaagctagtcgatttattatgcaaggttgacaaaggacagatatcaagtaaatatggcacaagcgagcagataggtaaaccccgatcccatggaattagcaaaacatgcatatttatttgcaaacggtaaaacatttgtaaagtaggatcaaaatgctcaaggggaatgtgtgacttgccttgcttcttcgaacaatcttccgaactcttatcctcgcgaccgcggacttccgaaacgacggattctacacgctggcatacaaaacgaggaaaaactctaataaacaccaagcaaacagtatatcaaaagtaaacaaacatgtagagctcaattttagatgaattttgcaagttgaatggcccagtttggagttcatatgaattagatatgaattttagaagttttgggccatttaaatgaatttctagaattaaactcgatttattgcgaaattaataaataatttctcaaaggaaaaaaagatttgctgatgtcatcaagggggaggggtggcgccggcaagcaggccccaccggtcagcggcacaagggcaccagaccaccgtggaccgggaccaccgaggtggtccactggaaccgatgccccggatcggccctagccgatcgggcggccacgaggcggcgtagccgggacacaggcacggcttagactggcccgaccgagcgacggcgcgcggcaacgcggccaccggcgacgacggccggcgacggcgcggggagcggcggcgcatgcgggcggcgacggcgcacgctagggagcggcggcgcgacgcggcaaggtgaggcggcagccggctgcccgacattgctggcagtggcacggcgcggagcgcggcggcggcgacccggtcggacggccaccggcggcggcggcgcgtcacgggcaggcccgggaggctgccggcgaaggggaggaagagggagagggaggggagtgctcaccgataggtcaaacagtggaaggaggcggccggcggcgagcaaggcgacggtgggcgcctcgggatgacggtgggatggcactccggtgattcccggcgaagaccgcggcgcggcaagaaccggcaggacctggggaaggtatagaagggagctggagtgagggagatggcgcggaacgacggcaaaaggcggcggaacccgacgggaaaggccgaactcaccttgagcagaggggagggattttcggcggtgattcgcgaagacggaggggtggccaacgcgcagctcaacaccacggagacagagggggcgtcggcgcggccgaacgtggctccgaatgccagcggcgaccggctggtggctggggtgcag

SEQ ID NO: 58815 - DNA, 4286 bp, Oryza sativa
aggaacctcatggtacctcatagtacctaggtaccatgaggtaccaaatttataatagaaaaaatgatacttcatggtacctcctcaaggaccataaaattgctcttgataatatgtacttcccctggttcgataataggttgagctcaagctgaagccccgcaaaatagacccttagtctggaatcgagtttcccgttattcattccacatccaaaattctttgctagcttttaaattgattttatggtcctttttagatggtaccatacattattgttgacgtatggttttcatataaaaagttgcacgcttcctctcctttgtccaaccaaaattttcttttcacatgaggaggctaagtcctctagtgtggagattttgcaaaacaatgaaaacttgaaaaaaaaagaactttaatggaaaaaccatacaactgagtgtaataacaatagatttttacatttatacatggcaaaacagttcgatctaaatctttctcttctgacggagcctaatcctgcaggtagttgcagacttgaactcatgaatctcggagctatatatgtagctgtaataaggcggcaaatgagatctccacagcacaagatcaaatttcccatgaggttcaactctccctgacaagatatcttgtataccaatttttggagccttctgatcttctgcatgagcaagctctactcggcaatgttcaaagatttcacagtagtagttcacatttccatctgtcctaggaataaccacacacttgctcttcatcccaaaatcacctgaacctttgttaggcagtaactggctctttgattccttggtcctgaagcgctcacgcaggctaagccagtcgccattgtaaatactagcttgaatgaaggtagccatgttgttcagatcaatgaatggtccaatgaaagtattgtacatctcacgatcaaagtatccattaaacatcgccattgataccgatgccacctcggggtaatctttaggatctgagcttccgaatgcgagaaccttgaagaagtaccagtaagcttctcgagacaagaattttaggcgaagaggttgtgttgttccaagctttgcaatcttctctgatcggcttgtgattatgattttacttccagctgaaatgcaacttcgagaagaggagtacatccttctccattcgtcatcggaaacatcttcagttagctcaacaacaaccaataatctttctcctccacttgaagctaatgatgagttgtgtttatgccttatcactcctgaatctcttaggataagcaatgatttttgctcgctcaaatcgctatcactaagaaagatgatgcgagagaagtggttgcgcaccctctcatcattgcaaacatgctcaacaagtgtgctcttcccaactttggcaggaccaatgattgataggacatcaaatatgtcactatatggagtttctggatgtaacaagaatttgatgatatgttccatctccatttggcgcccaaacatgcacttgtccatgaacatgtaggtgttgtatggttgacgatgcatggaaggatagttgttcagaagcataacaaactcagccatgccagccatggtgatctctatgatgtcaaccatctgatcgaactctctcatatctccatgtcgtctagtaccagtaaggactcgagctcgcttgatagagttgaatttagacaaagataaggtgttgtaactcacttcattgtcatcgtcgtcgttcatgtcctcctcctggtgtttctgaattctgaaggtgtcaagagcatagtagcctttgtgcatatcttgtctcagcatgttgacctgacgaagcatggcttggtttgtgatgtgcttcccctctgcctcttcgatggcggtggcgagccggagcagcatcctttccagtctctgaatcttctcctccatgaacgtcgccgccataggcggcgatgacggcttcgaggagcatctgtctatcaagaaggagacggatctactggtgagttctcctaggattgcagagaagagagtctccatttgggaaatggaactttccttctccccttgcaagatggttcagacaacaatttgatgaatggatcaacaaccagaataagaggaatcctgcaatcgtataatggcaagtgctctagcttgtctgagtagcatttttttgatgccaacttgtttgactagtaattaaaatgacatcgattgatggtgaacaaaattttgtggatgcagtggttctatagaaaagtatgcaatcaatcaacaccaattattctttttggggttgagagttgagagatttgcttaagagttctgtttgatgactcaagtactgaatctactataaagcgagactttcgttgtgcatgatattttttcttgtattttctgaccagtgttgaccaaatacagggagactacacctttctatagacttttacatatttcgtcaataactaattcctccaagcaattattgacctatacagatttaattaacttgttgtaaaactactcattttgcaaacacagaagaaggttaggctagttatcatcccagattaaaaattcagtcagaggaaccggaaaaaggcaacgctggaatcattgtttgcgatttcatttcgcacatttctacttgtaagtttggttggttgtgtacatctgtttggatgtagaggctggtttaatccattatctaaaaaaaatgtactttctattcacggcacgggggttcagagaaatttcagaaatcttgggaattttcagaacgaaacaatttgaaatttaaacaattttgactaaatttggaccaaattcacaaaaaatgaaaaaaaaaagggaagaaattttccgaccaaattggaaatatcagacctatgttatgtgatcttaaacgtctgatcgtgccaatacgtgtttgtactgtatttcgttaaggattaggatgctttcttgcaagttgcaacaaggaatcgatggtcagaggtcaacagtggcaggtaatacggagtagcaattaacataggatcaatcagttgctgtcagttgtcatcgacttctgaactaatatccttgcgtcttagcatgttgacatcttcaaacttcaaatagcagaaaattattagatgctgactagttcagtttggcaacctcttacaaatagcacatcttacataggatcttggatgacatactcgctcagatactaggtaaaaacatttcacaaatgatcagttttacattacagcataagataattacattatatacaacacatggtcagcaggagcacagcttcagaaaacaaccagattgtcagctgcaaagttccagagatctcttctttttggcgaccacatgatgtttcctctgtacctcacagttgaacatgtggttgtagtaaggcggaaggtgagacttccacgcaagaaccttgaattttccttgaggtctaacacttccaaagagaaaatcttgcatgctcaacatgggaacttcagcttcactccgagtaaagtttgtgcgacaaagaaccatgttctgaacagaacatgtgtgatactcatcatgaatcacaaggtattcggaggaaattttgtttactgtcctaacatatggaggttcagacgcctgccatggattctcaaaatatgtaccgtatactaggagattcgtctgcttgtattctctgatgcttgccagagccatgttccaaaaccgagcattgaaatttgctttcaaaagtccactgtagatgcttgcacccatgaagcacccttgcaactccctggccatttccatggccattgatgccatctttgggtgctcctgtgcatccatgcttccgaatgtgcgcaccttgaaaaagtaccagtatgcttcttcagtaaataattctactctaagagcttgtgttgttccaaatcttgcaatcttatcagattggcttgcgacgataattttactgccatttggaacataactcttggaagctgagtacaatcttgtccatacaacctcatcgatgtctctgattagctcgataacgatcaatattctttctccaccagtgcattggtttccattcttgattgaaccacaatgtcgaagagttaccatgtctgcatctttaagatcatcgtcactgaaacacacaatttgagagaagtggttacgcaccctttcatcgttacaggcatgctcgatcaaggtgctcttcccagctttcctcgaccaatgatcggcagg

SEQ ID NO: 58816 - DNA, 2127 bp, Oryza sativa
tccgttgataggctacccctgtcagtgagctgtacttcctcccatagaagacgtatatgatggcaccaaccgctagccacatcgaaacacgaatccacgtatgaatcctgcgaacgatgaatcaaagggtgtgagtacgtgtgatatcagatatgataatatccagatcgttttcagaagttgctaatctcacaactcacaagtataggtttagatagttcattctattttaatctatccagatcatctgtttacagtgtattgtgaattgaataatggtgattttggtttcatgattttgcaaatctactagataatataataggagacggtgcaagcttcaagatgcaaagtaaatcagagcaaaagctaatcttgaacccaagttgctcacccaaggttcataagcaggtatacgttgatgagaatgcaacatactggaagtataggaacaaatgggcacataaaacctgaggaacaaaggagacaatttgatgttatttgtaaactgtatagatcagaagttacataaattttgtcaatttcgtagtagtataatggccatagtctttgtacctccggtttgtcttaaagagctcttgtcttgcccaatgaaccagagtgcaatggtagcactaaccaaaagcaaactaccaaaggcacctgcaatggatcgcaaaaatctacagaaaggaaacagatcaaatgagtgggtgtcaagagcaagtcaaaaaaatttgcagtgggtggtttcattttcacttacaacggaaaaaaggagaaagaaactgaagaaacaatggtgacaaccccaagaaaaattagtataatgcatgctatggctttctgtcgccttatcttgttggcttcattggcagtaggtatgtcttgaactgaacgcattaagaagggggaaaaaatcagaaagttagtaactatgaggctgttatacaaagtattttgaaagtgatgaactaatgacaaacagataatacattaatatcatgcaaaggcaattgagaagtgggattacaaccataaaacaaaacaatactaaagaggagtcatcttttttatcaaagtatcaaaccccctatcccaaaaaaaaagtatcaaacacccaatttatgttagtagaggcaatctggtaaaggcaaacaggaagcataagaactaaatcaggcatgtgcagtacttttgatgtttaattagatacttcctccgtattttaatgtatgacgccattgactttttgaccaacgtttgaccattcatcttattttgttctgggaagattgttggctgcagggcacttcaatttggtcactggcgccggcagtatgggcggctgtcccaggccgcttgcggggcaagcgcacggtggctgaggcgctgcacgacaggagatggattcgcgatatctcttcggcattgggggtgcaagcgatccttgagtacttcaaattttgggcgctccttcgatcagtgcagctgtcagaggagccggacaggctttcttggcattgggagaactcggggcagtactcctcccgcttggcttatcgtgttctcttctttggaagaactcacttccaacacaagccaatctggaagtcttatgcccctcctcgatgtcattacttcctttggctggtcgctctcaaccgatgctggacggtggaccaccttcgaagttgaggcttgtcgcacccggatcgctgccccctctgcgatcaatgcgatgaaacgattgatcatctcttggtcgcatgcccagagtcccggcagctttggtggattgctcttagcgctattggtcattccgaatgtctaccactcaacgagcagtcctgccatacttggttgtgtgacagtcgcaaaaggatgattaaggatcatcgccgagggttcaacacaattgcgacactggtagcgtggacaatctggaaggaaagaaacaatcgggtcttcaaccagaagagcaggccttggatggagatagctagggctatgacaagggaagcggacctttggcggatgactagatcagccataccggccatggtagtccattcgtttgtacatgggtcgccaaatccttcgggagattaggctttttttttcttt

SEQ ID NO: 58817 - DNA, 9391 bp, Oryza sativa
gtcggcggaggacatcgccgcgggagcaggagacgggaaccttgacgagaaatcgaactcgaactcatactcctccccgtcgccgccgccctcgccgccgtggtggtggtggtggtgggcggggctcgccggcgcgctgaagaagccgccggggaagggggcgtcgcgggcggcggggctggacggcgcgctgacgaacggggtggagcacgcgctgtcgcccccggtggcgaggtggtggtcgtcgcggagacggtgtccgccgccgcggccgacattgcggcggcgagtgggggggagtgatggggttggggaggtaaaaaggaagcagcttttaaagcgcttgtccgacgcggtcggttactggttgttttgcggtttagtccctgcagaaactggaaatttgtaaacattcataataatggtgtttttctaaggagctactacctgttttttattttattttgttattttttttgcggggttattttattatttttagaaacatagtacaaaagcagacgcttataatgtatgcatactcatccctataaatatacacatgcacacactatctctatgagcatctctaaaagactaggccggtgtatcttggaacgtgaatatctttgtttagattcgtaagatcatgatacattatatttaataataggttgcttttattttatggcgagggaagtattcttcatccaacatagtaaaaatatattttctgattacatggaagataacgaatgaaacatataagtggtggagccgtggcggagaaaaacagagtcaatcataggctacaaagaatgtttttactaaatatcaataattattattttcctgtgttgccctaagaaaagatgataggaatattatcgacagagcttcgaccagcttgaaagttggttccaccaccgaagcatatggacgtactccatccgtctcataaaaaattaatctagaattgaatcaatctagaattgaatataattgaatgagacattatatagtttgtccagatttattatactatatgatttcttatccaatcttatattaacttttttggaacggaaggagtacatagtcacccttacaaatcatgtattaattttttccatttttcttctttatggatagagggaaggataagtgggatgttaccggggtttataaaaccgccggtaaccacacgattaccgtggttattgggcttaccgcggggtacggtaaaaggaaaaccacggtaacctccttaaattcaaataaatttagaactttttgaaattttgataaattttacacgatttcatacggtttgccacggttaccgcggttgctgcgtggtaactgtgtttaccgccggagcacggtaaccccgaccccagtggtttgggaaaccctggatgttactcatgaatggtgcgttctctatatgatccttaatttcatgcttgtcatgaaatggaacaatactcgtttgcaaatattaagaaagtatacttgtgacttcttcatagattttcttgtcatactgtaatttcaaaaagaacaacaactattatatggatttggtagataatttcatgaatggaaattcaaggagatgagcaaagagtctcgaaagattaggcatgtcgacgccgtatgtatgtacgtatgcaagaattttgtcaagctagctagtacgtacagctacatgatatttctgccaagtttttcccatatgtatatatatttatatatatatatatatatatatatatatatatatatatatatatattgaggaagtggccccatgtttcgcttattcaagggcatatttgcaaacgaaaaataatttatgaataaaacttttatatacaggttattagcgatccaaaagtaaaagctgaaaaataaacttcgatgaaaaaaacccctgaaaaataaactttgataaaagaacctcaaaatcaaaagtaaaagttgaaaattcaaaatttggctgataagcataagagcgaatactatagtaggctacaagtcgattgtaaaaaaaaaagatagaaggatagcgggctatacatttgtagccaactgcgttgtgtgtgtatgagaggtggcaccatatattaatggtttattgataactatcgtatgaatgagctattaaatcggctatagataatttaaagctagtagttagatatactattaaacatgctctaagaccattcccaacccaataattaggatggtgtccatagtattaaataagctgctatctaaaataaaaaatgatatggcaagtgaataaatgaggaaagagaaggaaaccatgtcttgcatgagatatggtttctacacaacatccaagacatcatgtgatataagtaccattaaattttaatatgaaatagtagaggctgtttggatgctatactaagtttgccaccattcactatactttttatgccacacttgtctaagttgtggcttaaaaaaaaatgagccacaccttaactagcaaaattggattgtgctacactttagtgagttgatgacatgtggggccctaatagatgacaaggaatcttgccataagtgtggctatgaaccaaacaatatgctaacttagtcaaacttgcctaacatgaggtgtggcaacctttggcaaacattgggagcaaaccaaacaatcccgtagtgtttgcattggaagagtagtgtatagtaccagttttttttgatgacgtgaaatttatggaaactatgtcaatgttttgagttaggaatgacataagcataagtggaaagatgaggccgcgtatgtgagcactcagctcgatggggaagcgtgtgcattcatcgatctataactccatgaaaaagatcagcttttaattttctccgtgcagcacgggcgtttttcttgtatcactggcttttattaagcttgctgtttgactggctgataagtatattgtatatataccacatatcactagaattacttaattacgtactctcccggcttaattccatatcatagttttccgtatcagtatttattaacgagtactcatattctttccttcataattaactgaggtcatgtccttcactaaaacacttatactagtattttgataaatctcaagaaagctaaaacaaatctcaagtgtgttattttttttacaaacctcaaaagagagcatggagaattcgctttatattaaaaagaaaagagttgaccctttagagaaaaaacagatccaaaaacttcacaactccattgttagtttagagaaaccgaaaaaaatccatatggagaggcaagacaaaaaaacttgcaatagcacaactgctgcgatccaatacaagtcatttttcccgggcttatcacaagacaagcagctccgatatgctattgcgattgacggactcaaccactactcaactccgaagcaagaccttcgaagtgaagccttcaagaaaaaaataacatcaaagacgctgacaacgcctgtttacaacattcgactaggtttttacccaaaggaaaagaaaataaaccatcagcacaacgccaccaagaaggaaaacggctcctacatacgtcaacatcactatcaccagtcaaagaccgggcagggcttacgccataggctcctttaagtgttgatcacaatcgcctctataattacccagctcgctacacctagcgcggcagcttcgactccattgcaagacaaaccgctggtgcaagcagaggctagcacaccaaaccttcccctcgcggaacgatcataagcttgtgtgttatcgttgtccagctcgtcactcccagcgcagcagcttcaactccggcataacaaacgcagctgcatcgcaaggctaccaatcgcacgttcaacttttcttagctgtcacaagatcttctagcgtcgtgccaaaaaagttataactttttcgcgagataactttttcagctacttttagcaatcacaaaaaagttatccggaaaacgaaagtgaaaataaattgttgaaagtattttgtaatcaaactaaacacaaaatcaccttcgaatgctaatcctgatcgagcaaagtattattagttttccactagtcgcgcatgagcaaacagttaagctctagcgtgatgatcaatagaaaactaactcttcctcttcttcctattatctccatcgcaaaatataacaaattattggacacggttattaaaaaaataggtagaattaaatagaatgaggtttttttattgagaaataaaaatgggtgagaaaagtaaatagtgaagggttataattagttagaagaaaatgttgcttaagaagttgttataatgtgggataataacttctattaagttttaaaagttgttacattttaggacaaggaaatatatcttttcttctttggaagaattacaaatataccactactttcaccctctaattcaaaatagccattataaaaccatcaattacaaatttgccattaaaatcggtgcatgtacacggcgtatgccattgccgtttagtttggtgcaattaagagggaaaaaattataaaattaaagtaaaaaaaaggcaacacgataagactattttgtccttcccagattcaatcccctatctgctctctctctctctctagaagccagaaaggatcccctctccctcgatgaaccctagaacccaaatcccttcatcccttctaaatcaagagctgatcaatcgaaaatcagttgcaatgaagtaagagatggcaatggaaaaactcatgaagaagggcgtcggcgacggcatgcggcgtcgtcgggtgttgtggcagcaggcgacggcggcaaaagcaggcagcaacagcgaccgtagcagcaccagacggcgtcggcggcggcagcaacagctgcaccaggcaatggcggcagcagcaccaccacgacagcggcagcaccaccaccaccattatcgagagccgacgccggcaacaccatcggcagcatgcggcggcggtagtatgtagcagcaacactacatcaacagcagcagcaacaaacatcaaggaagactatggaactaagagattgtattttacaaccctcatgtcaagatgatgccagtaagttcgactattttcttgctgccttaggtgctctaatgtctatgccaaaatgatgtaaattttgcaattttgtggcacgggcatccttgtcctaatttttagaaaaaccaaccttctaacaccgttagtttaaactgtcagtccaatggcaagtatattgggctcaaggtggcaaatttgtaaatacagtttttttaatgacaaattcacaataccggttcaatccagtagcaaatatacaattgaccctttctcttttcagatagcagatggagtaaaccactgttaccgaaaagtccttggagtacttcgagttaacatccagctctatcggtaatcagcagtgccgtatggctcaccgacagtcgtccgtgcgagatcgtacggctgatcttatcttacacacgctcacagctcagcacagcgcgggcccatctgtcagacttttgagaaggaaaacaactggcaagtccgttgtctccattaaaaacaatgaaaattttgatattgtcctggaaattttggtttctggcactcctttgtttcttcttgggattagttggtggcagtatgtatctggcgcgttggcatgattattattttgcccatcaattaagatgggaaattaaatagagtaggagagttccatgggaggaatccgatccaaactagctgacatgctgaagccgaaattcaaattgtgaagcctaattttaaagttgattttggtgtctttttattaaagtttattcttcgacatttgcttctaatatcctaaggctttgttcggtagatgaaaaactctccattccgcattccgcatgtacgctttctaaattacttaacggtgtattttttttgaaagaaatttatacgatagttgtttaaaaaattatattaatctatttttaaaattaaaaataaataataaccaattaattatgtgctaatggcttacctcattttacatattttctcaatcttatatttttccctcctctcaaacacacgtaagattagaaatataagttttaactaaagttattttctgttatttgtctatttccctaaggcttaccaccattactcaaacgaccaaaggctcaaaagttccacacaacacaagcgtaatagcttactttttgcaaaccaaaactggcccattaaacaaggagcccaaatgcataatcctttctttgcacataattggtatccactactgttataaaattatcttttttaactcattatgtcatcaacattatattagtcattcgatcaatatgcacaccattagatctttatttataaaaagaagacccaaattgatggacaggcccagctagacacatcttcactcccgcacatctctccaattgacgcacgccacacaaggattaccaaattaccacggtgatctccatctcaatgcatgtattttgtatctacccaacaaaagatgagttgcattattctttcttagtcctctcacaccggtcatacatagggcctgtttgggagatgtttgggagagtttctacttgttgcagcttctcccagaatcagaagctcccctaaacaatccagtttttgatttagattcttagaaactgtagttgtagaagtcaggaaataaactagaagctaaaaactggaaaacccagcttttccagatttttaaaaactggctaccaattagctgcttctcaaaatcttaatcccacaaacatgcccaaagtctttggccactactctctccgtcccataatataaggttcatccctctaaaatccattatattatgggacagagggagtacctagaagtacatttgcagaaagaatatatctctctttacttctgatccaactggttaatttagttaaaagaaatatttgatagaaaattacttttgagataaaattgtatttttgcatttctggttaaccaccttatttccattggaagtaattcagttatatctcaaggatatttatatctcttcgaatgtcttgctctgatgccccaaaaatgtctttcggcttgaagcgaatttcctacatatttcggcttcatacatatttttccaaccatttccttgatgtttgaagtaccatggaaaggaaatgacaagctgaatggaacactgcaatttgcactatgtacgaagcctaaatcaataaaactctacataccacagcacagtaccacacaacataatcaatttaatattttaaaattagattcgatgtggatctaaaataaaatttcatcgaaaaaaagacgagagaaaaaaaatctgaccacaacaatagaagattctctcttttttctccttgcctatctctaaaataaatcttcatcaaaaattcaggtagttagaaagtttgttactaaggccccgtttggcacaactttagctcccaactccaacttacctggagcgggagctgtgccaaacgattcagattcacctttttttggagtggagttggcagagctactcctagaaaatgaactacgggggtggagctgggtttttgctgctccacagctccactccaccccaaaagacccactaccctctaatattttagtgtatttacacgaaaatgccactcaactaccctttcaccccttctttcctcccgttctctctcctcccccaatcttcctcccaatcccgagctagtgcggcggcatcggcgggctgcggcagcgttgacggcgacgggcagcgacagcggcgggcggcggcggctgcgggatgacgacgggcggcacgcacgcgcggccggaggctggcggcggggggctgcggcagcggcggggagcggctgttgggggacgaggacgggcggcgcggcggcgaggccagcaggtggcggcggcccatcttcttccccatcctccgacgacggccacaaccggttgtggcggcgtctgcgttggcagcatacgggggcagcaggctgcggcgcatcggcggcggcaggcggtggcggcggctgcgggcggtgttgcggtggccgcgacaggcggtggcggcggctgcgggcggtgttgcggtggccgcgacgggcggcacgcggcggcggcgtcggcaggcgactcgcgtgcgggggcgtcggcaggaggcagcctgggcgacggcggcggcctgtgcggcggcgcttgcgcagcggcttgggaggcggcggagatgcgtgggcttctcggcggcggtggctcgtgggctgactggctacggcggcaacgtcaaggcgacgcctagaaggtgttcgatgaaatggcgacaaaggatgtagaaatatggagctgagtaatctagccaaacacttttttacctacctcagctcctagaggagctagctctcactggagttggagtttggagttgggagttggagtcaggagctctaccaaacggggcctaatattttgagattcgcaaaaagataaagaagaaaaaaacctttatatatactgcctcctgtatctctcgcgagtacaaaaatactgtagcttcggaagaagaagaagaagaaaggggtttcccttccgtacaccagcagcagcatcagcagctgctcctccccgcccaaaaaaatccaatctttccccatggcggagcccggggaggatgcggcagcggcagcggcggcggcgtcgaccaagtacgtgctcatcaccggcggcgtcgtcagcgggctcgggaagggggtcacggccagcagcgtcggcgtcgtcctcaaggcctgcggcctccgcgtcacctgcatcaagatcggtccgtgtgtttcttcccccattctttcaactctttgctcatctgaatgcgatggctaaaaccctaggaaatcgagtgtggtttgggggagtgcggagatggcgattgtatgtgattgctggttgaattcgaatttatggcatttgttgtgcttattcttgatgaaggggtaaaatattgccgccttgtgatgaatttggtaggggttagggcttttttcatatctttcttgatttgggggtgtgtcaaaagcgtcggcttgttggtttatgtttggagggaggtgaaaggtggccgctttcttgtttatggtaatggagtattgaaaaggttgcctattattgattcagccttcatggggggccatgattgtgggtgcattcttgtcttggttatgttttggtggtgaaaatgctatcatttttctgtagaaaaataatctatcaatgaa

SEQ ID NO: 58818 - DNA, 570 bp, Oryza sativa
cctgcagccccgatacttttaatgttaccgttgcccatcaaataggaacggataataattaagaggaacaattaaagaagcaacgatgaggacgacgacgaggaccggcagctaaagcgaaacaagacattcggtcaatcggctgctaatttcctcctgtaggtcgatcgatcatggggaagaagagaactgtgcatcgaccatgacaacaaacctatctaatatcgatcgatcgatcgacaaaattatcggatttatttatactacacatggtggttcgccatttttctgttgatcacacctgcaggtgtagtgtgcacacgtcagcattcgatcgggtggccgcagcaaattaccccgctctctctgtccccttcttccggaagatctcgtccgtccgatcagcagcggacggcccggatgacttgatggagtgagtccgggtggggcccacaagggggtagtggtgggcccgcgagagagagagagcggcggctttggctgcgcggcgacagcggtggggcccaccggagtatcaacggtcgggaacgcgacgacgagagccacttg

SEQ ID NO: 58819 - DNA, 1164 bp, Oryza sativa
aagtaatcggacagcgagaagtcaatactccgatcaaactagtgatcttactatctatctgagtagacattctcacattcatatgatttgccaattgccagttgacaccaacgcagcatgccattaggcactaggcacaaactgaaggaggagagatactagtagattctaagaatgcattacgcattgtattatcttgaagcaatccagaacccaaccaaacagattcagagttcctccaagaccaactcctaataatctatactcttcttaaacaccaagtataatattttttttatttaccatctaattcatcatgttttctactaactaccccatatacttttatgctataaaataatccatctacatatatgattctatcatatttcacctgaacaatagaacatctccaggtacaaaattgtcccaaaaacctcactattaaattgttttaatccgtagcaaagcacgggctagtagtaacaatactccaaagatgaactgctgctacaactaattaaaagaaacacacgcctcatttcttctagggtgttctacgcaggatgaaaacgaagaggcggagattagaacaaggcgacgcgggataccgatggcgatgaggtcaggaacggacagcgccttggcgaggtgccgccctttgcccccaccggccggcgcccccgccgccgaggactcggcgcggtcggcggcggagcacgccggcttcctccgcaccaggcactgcaagtcctgcagcgagaggcgggtcgcgatggccgagcccgacgcctgcaaatcctgccacgagaggcgcctcgccatggccgagggacgacgagtggctgaggggaggggaccgagggaggagagatcaagaactcgttgttttggtaggcagttgacttttctcgataattaaaacaacaactagccggaaaagtcgggcgttgacttttatgtgtcggtgttgggaaacacttctacggtttagcgagatagtagtggtaaaattccattaatttctactgctcccgatttaatgtgaagcaaatcatcaaaagcgctattttttatataaaaaatattttgacggtgcatataatctttttttcgaaagcattttctagttcattaatttctacagctcccaatttaatctga

SEQ ID NO: 58820 - DNA, 3731 bp, Oryza sativa
ataatagataccctgagtgaaggtccccttagagatggcaatctcttgcatcatgagagtaacaacatcgaactgacggccctgaatgatggcatcgataacgtgccaagccactcccctaatgtcatcattgttacccaggcgagggaggatgctagctctcacaatcctgttgaccacacttgggatggtcctcaacccggcaaccttcccatgtgtgtaccgcgctccaacttcataaaactgagagaggtagtcgatggagagcggattatgggtgtgctcctcatgcaagtcatctccaaagtccaagcgaacatttaggagccgccggaattgcctcctggagatagagcactgaagggtgtcggacatccacttcatctcactatagtccccggccacccacactgtagcataaaacttccggatcaaatcttcattgtaatcttgcttaagagttaaaatccggtcaatgccaacagtcctgaagagatcctgcaagcccttaaactcggtagtctcattaatgtctctccaagagatcaacttatgttctgcaaaagctttcccagcatagacttgctcatacacactcttctggaaagcagtatgaaaacggggatccggggtgtcccgaggcctcaaaaactgatcgtggtgcctcaagatggtatattgggatggattcctcatgtttacaacaaactggatggagggatcaatattcatctcatcacttccttcatcctcatcctctccacttccactgtcatcatctccactttccccctcgctagccccctcaacattggcctcaacctcttcatcactttgagcatactcatctccgcttgactcctcactcacgggatcaggagtgggcgcacgacgaccatgacgggtgcggggaggcatagctgaaaaacaaggagcaaaggatggataagcaacaattttagaaaccacatagtgaagtgggaggaagggcgagtgctgcctatcaggggcggtcagactgagagccacggccggtcagaccgccggccctcggccgatcagaccgcgtgccctcggccggtcagaccgacggccaatggctggttagaccgcctttggtcagaccaccactgacaagagcacacccaaatccttccacaatccacataaatgattctaaaaattgctaggacagtgttgcacacgattggaactagaacatcaaggtgtgtgtcacgaccggaaataacccaacgggcgttccttacgtgcgtgcattattccttgtcccaggaggcaaggtacaccaaaagttgatacaattcagagtttaacaagcggaagcgcaattaattaattattacatgggcggcgaagacccagcacacaagaagacaaacgaaaaacagcggaagactagggtgacgaccacagacgcttgacggcaggcacgagctagacaccaaagccttcatcttccaggaactcctcttctgggtttgggaaaaattgagcaagactgagtacaaccaccgtactcaacaagacacacccacaagtgcagaataaatgcaagggagtacaagggagccataaattaggggttagggtttgcagtaaatagcattaaaagacacttagttgctcaaagctattttgtaaacatggtcctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaaacactaacttgggtacattgctcggcttgcccataaccgagggcgcggctattcgaataggttatactctgatcagaggtgtacatctttacccacaagacacatcttcctcacgtgtaaccacgtgccacataccaccacggtatacggacggaagacgtgacatagtttccaacccatcctagccatagaaaagagtaccgacccaaccccacctacgcccggaacccccgggacaggtaggcaggactgagcccctaacagcaggacaccggtcctgtgccatgacatctcgactactgggccgcagctcgtgtagcattcatttgccctagagatgtccatcgacccccgacttcgtccatctccatccgtgtacttttgtttataaccagactgagccacaatctaagccttacccactagacatgtggaagtacggtagtgttttgcaacagaggcccgaagaccggtccttatatggccgaggtgctactatcaaaaccatgcaccccgagcccagccaaaaaccattttgagggttttgaatagagggggaggtgtgaatccaattccaaaataatccatccattccgtagtgtccaggtgatgagaatattcccaaagtctagagttgtaaaaccacctaatgttgcctaattaaccagcgaagcatttacctaaaatcatactagtggtaccatgagtagagtgtccactagttggggttctgtttaatctagggtgaacaaggtaataatatcaataacaataataataaggtcataacaaaggtacataggcatggctagataaaacagtgataacgcgggaatttaagtaaagcgataatgcaataatttaaatgaaaataattttataaactgggtttcaatatgttcaaggatgatgtaacttgccttgctcgctttcccaaacgtcggcttcaacctccaccaagagcggatcttccgaagctgcagcgtctacacgaccaacagaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgagggggaggggcgcgcggaccgggtccacgggagtagggcccacgcggcagcctcatggtccacggtggaccgggcgcacccgggctcgcaccggccggcgccgtgggccccacgtgtcagccacacccgagggcgcgggcggctgacggctggaccccacgcggcagccactcggcgcgcccgacggcggccactcggcgcggccggcgggaggcggcgcccgcgcccctatggtcgccggcgacggccataggcacggcggagcggcggccgagagaggggaagggaagggggaaaagaggcggcggtccacggctcaccctaggtcgacggcaacgacgaaaaaggcagccagagcggaggaaggcggcggcgcggctcgggtcgacggggtcgacggcgttccggcggtcggcggacccggcgagggggtggacggggtcgatggcggtgcggcgaagccggaggaggcgacgccggggcgggagacggtcccggcgagcggagaaggccggccggtggtcgtcggcgacggaggagagagagggcgacggcgcgagctcgattccggcggagagacggtgcggcaaggggcggaaacgggcgggggaggcgcggggccagtttaaatagggccggggcgagagagggcggccggag

SEQ ID NO: 58821 - DNA, 20002 bp, Oryza sativa
ctgcacccccaccgcgttcaatgctatctgtgaggtgattatgtttttgttttttattatttcacataagttaagattgctctgaaattaactaactgttggattttcagttttctgaacaattttcacttatgaaacaggagtgttgacatattacgtagctctcacaggaccaaaaagggtccctgtctttatccccatgcaatagttcctgctaagaagtactctggaaatgagtacacattatcatacttaaaatcctctccagctgaacaattgccagttgcagtttcctctgtgcaggtggtatgtatcggttctttcttagtagctaacatcttaaactacaatatgagtggtattctggatttatggaattttttggctcttctttttcctgctagtaattattatctccagatgatgtcatgatgagcttaatttcattaaaaaaatatccacagtattcagaaggtaaccacaattgccaattggtaatatgcccattcaaactattgtggttatgtacttatgtggaactgtaaattatgaaaaaccttcccttttaatacctctgtggtttagtaaacagcttttgccacttctctgcctgtttttatggtaaaaactcagttaaagattttctttaaataaatcacttggcactgatgaaggttcgcttctaataatctagcattctagccctatgtgttgattataatttttgacagaaacgtagcacagatgatccgcttgatactaagacattaccttgtgaagtgaagactggctgcactctatctcccatccaattaaagcacatccaagcaaatgctggtcatgttcctttgtgtattcatcaagacatgaaagcatcaatgaaaaggaaaactgaagtgccagaagtgacaggatctaagagcttgactgtcatcgtgtcaactgctggaaacatagaacatgattttgacatcatgaagcttgacctaactgccaacctcctgagcaaggtacatgtatcatcctgagtattaaacattggacttggctctagatggtgaactccccctaaattatgatatctgactgcttactaactcttttaaatattcttttttccggtgatgtttcttagaaattaaattttctttgataatattataccacttcctgtttagcattttctccctctctttgtgcttttatgccgtttatttttaagttatatcaaggtatcaagctatttggttaaggtgtggctttattccattacttgtgtttttttccctctctttcatgtataccattcgaccttgtttgatctgcaatgtttgctactttaagaaagaagataaggagctctttgtattataatgagctttagattcacattctcattttacaggttgaacaactgtttagagaaaagccaaacccagatgatttagagacagcaaaggcgatactcaaggtgagaaccctcttgacttggataactcagtatgtaagcattggatttcatccaatctccgcttgttctaagcattatgtacttcaatgccatttaaacttgaaccaggaacaagaaaaggtccttttagatgcagtccttaagctttctgaagtatcatatgttggtgagtcgctttttgtatacttttttgttttctatagcttagaatgttagttcttttaagaaaatattttagtatatcaactacactactttagggggttctgcagactctttcctttttttaaccaaaaaaaatattgcatcaccatcataatatattcctaccaatgaactactggatgagtcctcttagaagttaccaaaactcttagatatatatttagttattgtgatccgtatttggcataatagaatgtgctatgagactgcaaatataacaatatttttccacctgaaaatattgaatttgatgattgacccttatgaagaacggcatccatcaaatccctctgaaaacactggattcaccatttctattttttctatcttcatcaaatccctctgaaaacattgaatagcaccgatttagaactgacatccttctctttgtcccatctactccgtagaggagtgtttcagcaccaactgccagccagatgagttcaaccagcactatgagtatgagagcgacgacgagatgccgcagaagacagcgagcacaaacgacgccgagacgccaccaaaaccggtgagcccaagcgacaaggaggcgcctccgcagccagtgccaggacgtggtggtggcgccaccagcaagggtaaggcgaagccccgcgactccggccggagctccggcggtggcagcggatcaggcggccggctcgacgcagcggacgaccaacccacctccgcctccacgtgcacatcatcaagcacactgtcgccgcgatcagaacgagagggggaagccaaagcccagcgcgcgcgcgggagggtgtttgaaccaccggccaagcgggccggcgcccctccgtgaggctctcacggtcggaatggctctggtggtgaatgcgcgcgcgactgtgttcagctggaagcccccgcaatgtgaattcgcttgacaacaacatcatgactgaccatcaccaactctgctactgcaaaatttgacagttttttgctggagacctctcacctctgatcaggtaaagtatagctctcgcctctgtccggcctcttaagctttaagcacaaagtggtacatagaacatagttaatgtaactagctagtcctttcttccatgcacatataggtccatcggtagtcactttcaattatcaaaacacattttgagacagtttcatgttcccactaggttatacagtacctaaaaacatttcattactcactatctgctatgcacttgtggcatatttttttgtgctttgccatggattggaaacagtgataaaattgatggttttgatagtgtactgaattaggctgcattctcaggcagctttaagatgttgcctgctagtagcatagtactatccctgcactgcagttctggaaagtggtcgctggctgtgcccatgtgagtgaagatggtggtaatgcctgtgccttgtctatcccatgcaattctccctattcgagctgtagatatcatgccattaggtacagagactcgagtgaacagcattagatctgaaaaacttgcattggccttttataactgctcgcagctaccactggtcccggtcacaagtacttcatgttttttgttggtctgtccagctccagcatggttaaactgtacattcatcacggttttgtgatggctgagtggcttactcatgcaagatctagttatgcagagacagggattggtcttaactcttaaacaaagtgtatcatcatgatgtgatcgtcgtctaatcaataaaagcttccttcatactccctcagtttcgagcagtcgtttagtcattttcctagtcattttttaaaaaagtttgattaaatttatagaaaaatatagtagcatttctaacacaaaataaacacattattaaaatatactaaaagttaattaaactaatttggtgttgtaaatgttactaaatttttttataaacttagtcatatctatctattatatactgaaagtccattaaacttcttacaaacgctctcaagctgccacgtgactctcaaaacgcttttaagtcgtcacgtggcacaacaagagagttgagaaccccctagggcccgcacgtgcagtgcatgggttatttccataacgtgaactaacgaagatagttcacgaagattagttccatatataactgtgtatgggaggcaagagattcgaaattaatttcaaagcaaaatctaatcacatatggcaagattaggcacgtgcagcgcatggatttgtcatgaataaacgaagattagttccataattgtgtacacaaggcaatatttcaaatctatctcaaagcaaagcttgcttagtttcatgaggcaagactacatatatatacaccggcttgcatacatatatgtacacctcaccagcaacacctttcaatccgtctgcaacacacaattttggtggctccgtcctcctgtcctctgcaataagaggcctgcggcaatttggacgagtcacccttgcaataagaggtctgcggcaccagcccaatggctgacacccaatccattaattaagggaaatactttctcattccgtcccaaaatataagaatctaggattgaatatgatgtttcatagtacaacgcatctggatagactccctgtcatgatacattgtaatagaaaacatctcattcaattgtagattattatatttgagacggaggaagtagataggacatagttactgaacaggaatcttaggttattatatttgagacggagggagtagataggacatagccactggaaaggaaggagataaagagagcagggcaggcaggtcgacctaggagataactattttttcatgtacctattttttttcaaccataaattcataaattctttcaccaagagaccaagtcataatgtaaaaaatcataataacaacaaaaaaatgatattttaaataagatgcccgcgcaactgcgcaggctaccttcctagtttaaagaaaaaaaagtcaaacgacttataatataaaatgaaaggagtattaaaaaaattagttgtttgaattgagaagatatcttgaagtatataaattttacgctaagaatgttaaaattacccttccttttaacttaggaaaatctctagtttacatgatcggatcccctaaaatcttgcacaggttcaacttacaccataaactgttaacatcttctactagaagtctagaaaacatcatgtagctaccaaaaccctgcaaatcacacctcgagcaaggtttggggatgcttttagccttttaggtgatttattagcacctatgcgtgataactgctgaaagaatattgtctgtccttactccaaaggtgtgtttagttcacgccaaaattgaaagtttggttgaaattgaaacgatgtgacggaaaagttggaagtttatgtgtgtagaaaagttttgatgtgatggaaaagttgaaagtttaaagaaaaagtttgaaactgaactcggcccaagtggtgtgaatattgtgtaaaaaaaagggggaaaaaagaatgacgcggaggcagccacgagaccgctttaaatgcaatttacaccaaccaaatatccatggtgtaaattggaccagaccaataattgtgaaaccaaaaggaaaccgcttcgtgctgctctacgtttttttaagcaagtataggccctgtttagttcgtggggagtaatccattactctcttcccttttagtccctaggaatccaaataagagtgactaaaagtgactaaaagtgtatattggaactaaaatccattagtctttccatagggactaggcgtgtttggaggtgggtgttaggaacccatctcccatacacagaaaacggagcgatccattaacacgtgattaattaagtattagctaatttttttttcaaaaatggatcaatataaatttttttaacaacttttgtatagaaactttttgcaaaaaacgcatcatttagcagtttgaaaagcatgcacgcggaaaacgagagaggagtgttgaaaacttgctcttgcaaacacaccctaaagtggcagcctctctcttctctccccctcggtccacgtgcctttagtcctttttagttcctagatccaaatagtagggactaaaaagtttagtccaagaactaattttagtccagggaactaattttatctttttaatatactagaaaaagtgtacgtgtgttacaacggaaaaactaaatcgtgacatattttttatgcagtatttgagcattgtgaattgtgaaattgtctcacgtggctggttattgcattgcgatcgcttcatcctgattatgaaaatctcacaaaaaaaacataataggaatattctaaatacataaataatagaaataatatgaagatatgcctacatggttgtttatgcagcaacctttgaaaaatagccaagccatatcatctcatccatatcataatcggatcaggaagagcatgcagccggtgctagctgcgcttctttctaaactaataaagagagatttacgtatgcatagtattctagcacgaatcgatctgatgacctgttctcttcttctatacatgcaagcaaaaaattcgaaacagacatgtacatttgaacttagactaccgtattcatactcgaattggacgacgcaccaaacaatcagtaaaaacatcttcaatttttataatagtagagatgtttataaatagcttatagtttgctatctactgttttgtgatttgttcgaaattgtgctagttccaaccaaaatacacccaaaatatgttgacatcacacttcccaagttgatgctgtgccccccttaatcgcttgagctgtaacccccatatgatccaagcgtgatgcgtcgacgtcacgaaccaatctgcaagggacatccaaaggtgcaggctcacgtcctatcatgaattttgcctttgtcgtcctgcaaccatccaacccaatcttcatttttccttcacccaactcttcacttatccccgttctatcattttctttcatttcatatagtatatatcagtagagagaacagtaaaagttatcttcatggagtagtacacaccatttgacatcctgattatgtatagtaatttgaaacacggagatttcaagtggagttccgtagtcatttcatttgaaaatggttcggccaaaattcggtgaatgtttgttgggggcttggagtgacgtttgctactactgacggattttcagtaatagcggtgatccgttttgtcggctacggtctgtgatcttcagcacgccactcgcgctgcgcccaccattatgcatggcaaagccttctgccacgtcggcggcggcggcgccgccggcggcgagggtgctgatcggtgccagcgtcaacgtggccttcttgctcctgctcgccttcttcttcttcatctcgccacgcggcggctcgccgccggaggtggtttcgtcgtcgaaggaggtcgggatccgggggcgtcgcgatggcggcggcagcggcggcggcggcgtgttccgggttgagagctacggggagaggtgcgagcacgtcggcgaggaggatggccttgatcgccggcgattcccgcgtggctacgtcgactacctgtacctgttcgactgcgtgttcggcgaggagcggcgggttcttggctacgccgtgatggcggcgtggctcgccgtgctgttctacctgctcggcgacacggcggcggtgtacttctgctccagcctcgagggcctctcgcggctgctccgcctctccccggcgatcgccggcgtgacgctcctgtcgctcgggaacggcgcgcccgacgcgctctccaccatcgcgtcgttcgcctccggcgggggagagggggagaccaccgccgtggggctcaacggcgtgctggggagcgcgatgctcgtgtcctccgcggtgctcggcgtcatcggcgtccgcctcggcgcgcgcggggtcgccgtggacagggtggacttctaccgcgacgcgtctttcctcctcgccgccctcgccgccgtggccgtcgtcctcgccgccggcgaggtgacaatctggggcgccctcgccttcacctccctctacgtcgtctacgtcgtcgccgtcgccttcacccacggccgcgccccgagcaaaggccacggcgcggaggcggaccacacggcggacgccttctccgagctctgcaacgtcgcagagacgaagttctacggcgaccaagaaccactcctccccgacactgcaccgctactcagctactaccccggcgacggcgacggcgacggaggcggcggcggcggcggctccaagaagaagatcaggagcgcgttctggtcggtgttgcgcgcgctggagctcccactatggcttccacggcggctgaccatcccggacgcgagcaaggagcggtggagcaagccggcggcggtgaccgcggtcaccatggcgcccgtcctcctctcccacctctgcagccgcgccaccggcatcacctcgcccctcgctgtcctcctcggcgtcctcgccggcgcgtccctcggcgccgtcgccttcttcaccacctccccggacgcgcccccagccgacccctcgccgcctggctcgccgccgggttcgtcatgagcgtggcctgggcgtacgccgtggcgaccgagctcctcgcgctgctggtctccgcggcgcacgtcatgggcgtcgactcggcggcgctggggctcaccgtgctcgcgtgggggaactccctgggcgacctcgtcgccaacctcgccgtggcgtcgcgcggcggcggcggcgggggcgcgcaggtggccgtggccgggtgctacggcgggccggtgttcgacgtgctcgtgggcctcggcgtgtcgatgttgctgtcgtcgtgggcctcgcatccgcggcccgtggcaatgccggcggaggccggcccattccagacgctgggcttcgccgccgcggggatttgctgggccgtggtggtgatgtccaggagagggatgagggtggacaggacgctggggtttgggctcctggccatttacttgtgctttctttgcatcaacatttctcaggcacttggaccggtatgaactttttttattttttttattcttttcataaggggcccggttggccaccattttgtgttggcccctccgcgcattgcaacgaaaattttaagggaaatgttacaggacagtatacagaagagaaaagatatagtattattagtacacgagctttcaagaaaagatatagactttggaataatatcgagttcgataacaactatcagtgacaataataccataaacattgacaaaacaatgagaataaaagagagagagcatgtgtgtcagcaagcgactaaatagccacctcacatgcatcaattcccaaccaaccaacatcatacatttttgcaacatctgaaaaacatgttctgaataagcattgcaatgttatgatgattcaattaattttgtcccctccggaatccacaatgttcagacataccaggcccaccgttagctacttctccatcgacgcgtcggcttcgtcgatctcttgattttgtttcaggtttttattttccacgttcatctcgcgatcggataaatcgtgctcccaaaattttggtgaaccaccgttcatgttcagtcacctgtccatatcaaattattatcagtagttagctgtaccagcatcccttttatctctctgaattattgtctcgagtttaagccaaggaaaagaacacctagatcatcaggtggtcctacttaagtgcatacgtgcaaggcacctcatggtgggaattagcctggaatgtagatctgtaatctgaaggaatccatgtttcattgttcagaaaacactgtcggcgtgggtttaaggaaacaaaaatggacgttatagttctggaattgtctcttccaagaaaaaaaaattgtcggtgggctaattgcttgcaagatactactgtagcaatgctgattgtaacatccatggtaactcaaaattgacccaaaatttcactcccttgaatccgtcatcccttccggtcaaaaaaaaaagtcaaaccgcgacaaatctaccctgaacatcaacaatatgtacttaggttgtgttatatcttctactttctcatttttcacatgcacaattcttgaattgttaaaatagtgcgttctttaaaaaagttatctataggaagttatttttttaaaaaaatcatattaatctatttttcaaaatttatagccatacttaggccctctttgtttaggcttataagccaacttataagtcgaaaagtctaagcctaaacaaacaagcagcttttccgtttggcttttttgaagccataagccactctaacactattaagccaaaagctaggttggagaagcttttttggcttatgtgaggtagatgtatgactcaactactaaacttaggacattaaatccaccggcttataaatcatataagccaataagctgacttaaaagtctaggccaataagcctaagcctaaacaaagagggctttaatcatgcactaatgagctatctcgtttcacatgcagggacgagaagttcccaacttctccaaaacaaaggcttaggtgtgagttcggaagggagtttgggtttagaaatttcctcattcctgttaacacgctttctaaactgctaaacattgtgttttgtgtaaaagttttatatgtagaagtttcttaaaaaaatcaaacaaaccattttcaaatttttaagtaattaatacttaattatttatacgctaatgctcgcgtgccatcaaaagtcctatccgaacatcacatctgaactcatccttacatgcgttatattgtcattaattctatgaaatactcctccattgaaaaatctcaagcatgaccaaggaaactcatactcctccgattcatttagggcaatcccaacctaaaaaccatcaattattttccacatttatcatgtcatataaaaataagagtaaagtgcatagacggtccttaaacttatagagatgtatcatctagatccccaaactctcaaaacacatatccaaatcatcaaacttgttaaagtgtgttatctacatcccaaatcgccacaacccctctagcatcatacatggcgcggcgctgatatgatatgccacacgggcgtgacgtgacataatcttgactgacaaataagacccacttaaaaaacttacttttcctttttttttcttctttccatttcttttgcttgttctttttcttcttcttcctctcactgtaactgtaggtccgccgcacggggtgcttgggtcacatagaaaggtaaagaaaagaaaaaaaagagaaggagaagaaacaaagtaagtgggtctcacttttcattcaagataatgccacatcacatccgtgtggcataccacgtcagcaccacgtaggaccctggaaggactgtggcgctttggaacattacacattttgacaagttcttggactttgatatgtattttgagagtttagagacctaaatgacacaccctacacgtttaaggactgcatgtgcattttactctaaaaataaaaaaaacggttcgatgtagagactacataaaatatacccttctaaaaaaataaaaaaaatcatgtcatatagatgctatatagagaaactacttcttccgtttcacaatgtaagtcattctagcatttcccacattcatattattgttaatgaatctagataaatatatatgtatctagattcattaatatcaatatgaatatgggaaaaactagaatgacttacattgtgaaacggagggagtacatatacagtaagtaattttttattcaaaataaatctgcattcaatggcctctcttctccccccttttatcctcccatctccttattttcattattgatttttattataaggtggagggtagtgactgatccatttaatccagcatggccaactaacatccccttgttcattcaaagctttgtatgcattttgatttttaggaaaacctaagaaatataggcttgagatttttggatggaaagagtaaataacttttttttatagcgaaagtacctctatcttgtgggctttactccgtattttcaaaccatcatcttgctgatttaaacaagccaaaagtaattttgtttaactagaggctgtaccattcgtaattccacccaatgtttccttttcaatggagaaaatttctaaggattctggaaaaggaaaaaacaaatcatgtactataaaaatagtttgggacattgggtaaaaggtgcttttaaaaatacgcattttttgcccgctgctccgaaggtgaatgcaccaacccaaaaaaggccaaaaacagacagcatctggtgcgaaacgtcatcggccgcactcgacccccaacatctccaagtgatcagcaacgctgaataattaaattatcaggcactgctagaaatagaaaaatgtttaaatatgaacaaagttagtgcacgcatctgtcagtcaccttatcatcatgtgacgagagcatgtgaaaaagtgaaatccaatcgctgcatactcctatgctgctatgcacccgtgatggatgagagatccaaatccacccaaaggttacgaagaccaagactacattgacacgtccttctgctgcttttttctggcagtgtgtactgtaacgaaataaactgaaactgcatcatctcgaagtttcaagatagtgttggacactctaccggtttggacacatcgggtaaagtaagataagctgttataattaattgagtattaattatattaaaaatatttttttaaaaaaaacatatttcctccttcctaaaatataacaacttttacccctcaagatttgtcccaaaatataatacttctccaccaacattctcttcccaaccaatcacaatcctccaccgttcacttttcccacctacctacactactcaatcaatcacaaccctccatcattcacttctatctactttcttaataaccatgtacaacactaaaaatacttatattctgagacggaggtagtatcgtttaacccttggagaaatgtacgcgcaaaaaacgatatactccctccgtccaaaaaaactcaacctagtattggatgtaatgtttctagtacaacgaatctagatgtactcatgtccagattcgttgtactagaaaacgtcccatccaatactaggttaagtttttttttgggacggagggagtacctctttcctcattgttcttgagacgaacgtacattttgaccgtaagttgctgagtttttatcattaacattctctaaaaataatcaaattatatatgtggtctaaaattgtatcagttgatttataattaaaagtattctagtaatagtatcacatattttagttttagttgctttaaaactagctgttagaattcacctattcttagtcaaagctaacaaacttttagcaaacttttcatgacgttaagagtgtttgtaggtcttatttgagaagctcaatattgtgaaaaaaacatttgatgagtactccagtgtttgtaggtcttatttgagaagctcaatatagggctggataccacctagccagctcgattcatttgaactcgtttctttcaagggaattcgtttgaactcattatctaaaaagcatagctggtcttggcccataagctagctcattaacacacttatcgcaaatttataatttcaaatttatcttttcggaaagaaaagactaagcgctagttaatagcacaagaccagctaaatttcaagaatgcacataactgctcctctaaattttaggctgtattatggaatctctcgtgtaaaatggaactaatcattaacgtatgattaattatgtgtttactaatcttttgaaaatatagattaatacaacccgttttaagataagtgcagccgtggatatccgtgcccaacgtttgaccatccgtcttatttgaaaattttgtgaaaaaattaaaaatatttagtcacacataaagtaatattcatgttttatcatataatagcaataaaaatagtaatcataaaaaaatttaaataagataaaaatagtgtaaaactgtacttattttgagacagaaggatatatgattttttcaagcaattttctataaaaatatttaaaaggacatacggagtactagtagtctgagatatatgcgcacggaaaagtggtcggcgagttgaaatgggaggggaagaacgcagccgggttcccacttttgcgcgtgggtcccacctgtcagccgcccgaccaccggccgacagtgacctcactccaacccccacagctctttacttatctcaagcccaatcacaacccactcccacctagctcaacctcacgctcaagctgcatctctctctctctctctctctctctctctctctctcctccagctccggcgaccatcctgcccgccgccattcgccggaagagcccaccagctgcaccggcgtggcatcgtccacttggcgagagtggcggagctagatcggctatcgatatatacataggtggtggatgcgtgcgtgcgaggtggtgagggtgagatgaggtctccggtgggccgcagggaggtggtggtctccggcgtcttcaccgcgctcctcgtcctctccatcctctccctcccgtcgctcctcctcaccggcccggcgtacaagagctggccgttcttggcggcggcgagggacgactccaccaccgggagcggcggcggcgcgggttactacccggtgtcgttcgcgtacctcatctcggcgtcgacgggcgacgcggcgcgggcggcgcggctgctggcggcgctgtaccacccggccaactgctacctgctccacctggaccgggaggcgccggcggaggagcaccggcggctggcggagctggtgtccgggcagcccgtgtacgcgcgcgccgggaacgtgtggatcgtggggcgccccaacctcgtcacctaccgcggcccgacgatgctgtccacgacgctgcacgcggtggcgatgctgctccggctcggccgccggtgggactggttcgtcaacctcagcgcctccgactacccgctcgtcacccaggacggtaattaattgccaatccttaatcgtaattaccatcgctaataatcgctactagtaccattttagtgtttgtgggaaatgctaaattaattatctgctgataattgcagatttgatggatgtgttctccaggttgcctagggatctcaacttcatacagcataccagccaccttggctggaagatgtaagaactccaatcgtcactaacttgaattgtttcatcagttttcaagattagtttttgattgcttcttcttggtttcaattattcgcatcaattggaataacttagtggcaaattatcaagtgcaaacccccgatttcaaatctctcaaattttaaaagaaggccttgattttgatgaggggattgaaatatgctagctctgcagaaagaagagggcgcggccggtgatcctcgacacggcgctgtacgaggccgaccggtcggagctcatccgtccggcgaacctcaccaccaaccggcgaaatctccccaccgccttcaagctcttcacaggtacgcgcaaaaacatctcaactaaatcaacctcaattgcgctacgaaaacccctcacacatttccgagacgacacagaaaaaaaaacttgcatacttcctccgtcctaaaatgctacaatctaggatgaacaacaaatctggataagagattgtaacacaagtttatccaaattcattgttttgagacgaagatagtatcattgtattgtattaagaaggatgagaagatcgtgtacagagtacaaaccataaaacctctcgtgctggaaagaacatgccactatatgtagaaaaatggatgcgtgtcagcgaccgatttgggatgcgttttcgtcaactctttttctggtaggagagtgagtacggaccgtacattgcgccaccggttgatctgtcacaccaaagacaatgccattgacggtatggttgtacagattgatcgttggatttgtggctttgtttgttgttgaagtaatagtaagatgcgtcatttgataggcacgggcagtactcaccttggaatctggcatacaaaaagaaaatcttatctgaaaccgtatctagtcaatggagcaggtacaggttgtggagttgtgctaagccaagcccctgcattatcaatttatcactgcatgtactggagatggttaaattaatctgatagatctgaatcagtggagatcgaggaatggtttagtgttagtttatgctctggagttgccgaatccaggcaggccaaccaatgtgctgtgctgttgcattggcaaagcaaaagcagcttttgtttcgatctattgggacaaagcttgatggagtactactactcacttgcttccgtattcccaaaaactcacttgcttccaagaaacggcagggatatagaaaattttggaaactatgaacttttacaagagttagtttaatttatgcagcatctctatttcaaaggaggcccaatgtgttcaccttcgtccatgtccgaccatttttcatttttcagctagcaatatagagaaatttgtgaaaacaaattactagtaggttttgttatgagtgatggaactgggtcaaatcgagatgcatttgataggacagtggtaaggggtgtatgattttaagcttgaggttctgtattcaatccttaacacgttcacaaaatcttctaaaaatgttttagaggtgcgtctctccctctgaatcttgtttttttttttaattgggtcgaatctctgcctatcgaacaagcattttgactatagatgggagatgcaggttcagcgtggacgatgatgtcgcggcagttcgccgagtacttcaccgtcggctacgacgacaacctgccgcggacgctgctgctctactacaccaacttcgtctcctcgccggagttctacttccagacgctggcctgcaactcccggcggttcaggaacaccacggtgaaccacgacctgcacttcatccggtgggacagcccgcccaagcagcacccgctctacctcggccccagggactaccgccggatgctgctcagcgccgcgcccttcgccaggaagttcagggaggacgaccccgtcctggacaggatcgaccgggacatcctccgccgcgacggcgccgccccgggccgggctttcgcctacggcgggtggtgctccgaggggggcgtcaggctgtgctccaacccgcaggaggccgggaggaagggcatgataaaggccggtgcagggtccaggaggctcagggccatgctcaacaagatgatgaatgcgagaaatttcaggaggcagcagtgtaggtgaaactagaggcatttttatatacagtctaattctgatgatcagtgtgtgtgttcatgtatataatagaggagaaatcgaattacaggaagaatttgaggcagttttggttgtctggagggaggttaaaagtagagtgacagtgtaatctcacagaaataagaacatgggggtcattagtaaggttgtaaaaaaattgacaggattaacgtcagcttgtgccttggttggttcttcttccatagggctattgctgaggttggcgcattttttactgtgggaatgacatgatactactgttggattaaacctgtatgcttgaatttcgggagccagtttgtctgcattttgaaagagaaaagattgcatcatttgttctccaacaccatttatttgctcagttacaaaagcccttatagagttatactgctatactatgtgttgaaagtaatatgccaccatgtaaatcttttctagtgtggtactttctgttgttgcaaaattaacttttttgggggtgtttagatccaccggcaattttttttaccccgtcacatcgagcgtttgaacacatgtacgaagcattaaatattgacaaaaaaactaattatattgtttgcgtgtaaattacaagaagaatcttttaagcctaattatgcctaatctgacaatgtgatgctacagtaaacatttactaatgacggattaattaggcttaataaattcgtctcgcagtttacatgcggattatgtaatttgtttttttattagtctatgtttaatacttcaaatgtgtatccgtatatctgatgtgacccggcaattttttttgccggtggaactaaacacatcctttgtaagtttttcggatcggcattgaagtaaaaccctgaccaaattttattaagagcctgtttagatcccactctaaaattttacccctgtcatatcgaacgtttgaacacctgcataaaatattaaatataggctaaaaataactaattgcgtagagagtaggtgaaaattttaaagtgtgtgggagtgaatagcattttttgtgcagttcagttagaatgtccgcctgcgaaaataaactcttttttttgtgtgtggttcacttaagaggaccgcacggtcctcttaaatggaccgcacgggaaaatgagccaatttttctgttaccgtccgcacgcaatgtaaaagggtccctgtacaggaaaatcatttgcgtagcagcgtcgatgctgttgcctacaccaacgttgcccaatggatgatggcagggttaagaaaatgggagcccatattccagggtgacaaacttctagtatgatgcctgtaccatgtccataaactttgaaaggaccattttttttattttctagaaacaaaagttatttgtttgacggtctaaaattaccctgtatcaactgtgcattacttcttgattaaagctttgagaaagcaaaaatgatcatagctaggtgagatgaaactctgaagcttaagccaatattgtattccaaatgtgtgatggcacacttgtttttttagccaaaacattctcttaatcttgtgcattttgaaggaaattgaaatctacaagtaatgcgaggagatctacagatggtggtaccaaattaccaatcatgagcggacgcaatggatattacgtgtattcgtgggaatacccaaaaatttcagaaaaaaggatatttgatatatgtaggatatgcagtgatgaatctagaaaaaaaaactactgggattctacacatactatataattatctaattattaactaaaatatacaaattaatatgatataaaatagctcgaatcgaataatttacgtgtggtcttaggactagaatgaacgtaggaatgccgctggatatgcatatattcattgtgtctcaaacttcattttaccttttttttcccgagaatatagggtgtgtttggttaccggccacactttgccacaacgaaggttagataagttgtgacagacataaaagtgtggtgaacaaattagcagtcataaaatatgcaaagttgataagaaaaagttaagtctgacatgtgggaccagtggcggatccactgttggggctggttggtgggccagccccacctccaatccatgcatctagttagctactagaaaattaccgtgccggttggcacgctaataaatttatagccatgtgtgtatatattaccatgtgtattactataagatattgatttctaccaaagcaattgctgtcagttctttagaaatataagatatcaacatggtaatagtatttgtcttaactgtattttcaacattatatgaaaattcttggtggtacttgcttatgtacttgtaattttgcttatgttttctttatcttcaattaaacctgtagtagattgtatgtatttgaagatttttgatactaagattattgctactacttctttggtgcttttaatttcactatttactgttttattttctataaatataggatgttactatcatgaagttacttacctcgattttgatttaatatgaagtaattgcatttacgaaaaaaaaattatcatgggttagaaatcctaatattttttcccttttctttcccttcattttttatttattcagttttctattgctccatccagccataaatatttggccaaacatctgtaacttggccactaataacttctcgtagcttataggcttggttctttcccaactttctcaactctcctcactcgttttccgcg

SEQ ID NO: 58822 - DNA, 10056 bp, Oryza sativa
  unsure (1)..(10056): unsure at all n locations
aaagatccctcaccataacttgttcgccgtaattctttacaaactctgatgactcgttagcttcagtattgccagttaaatcatcactactagatactgttccattagaaacagcagcatgctgccatattgtgatgtgagcagcagaattaacattaataatgtgtttaaaaattaaaaagagagagagatcaataggaaacatcatacagttacctcagttgggatgatttgtgcaatagacactgtatcacttatggtaggagttggcttgcaaaatggatctgctggcccagaaacctgaccatatttctccaatattacaccagtgccattccatacaggaaaggcagcagggattggacctgttcgatgttcagaatcctggccatttgcccccaacaatccttcaccggcactgtgtataggaaaggcagcagggcaaggatctgtgtgaggttcagaagcctgaccatttgcccccaacaatccttcaccgccactgtgtataggaaaggcagcagggcaaggatctgtgtgaagttcagaagcctgaccatttgcccccaacagtccttcaccgccactgtgtataggaaaggcagcagggcaagaatctgtgtgaggttcagaagcctggccatttggccccaataatccttgaccaccatcgtgtataggaagagcagcagggcatggacctgtgtgaggttcagaagactggccacttgcccccaacaatccttcgccaccattatgtataggaaaggcagaagagcaaggacctgagtgagcttcagatgcctggccatttgcccccagcaatccttcaccaccattgtgtataggaagagcagcagggcatggacctatgtgaggttcagaagactggccatttctccccaacaaaccatccccaacaccatatgtgcacaaggcagcaggggcatctttcctggaatcagtaagtgcatcatcagtttctagttgatgctcctgtagctgcttctcatacaacttctgattgaaacttgcattgtgaagaacagaaacatcagcttgtgctggagatgttatttcccttcgattgtctggagctgtttgctctgttttcatgggcaagttaacagcagctgtatctggacgtatgcaagaagctttctgtgttgaagctgggtcattgtttggggatgctgcagcttcaagcacttcagtgttgctatgactttttgaacactggtcctgtggagcattgctaatattgctagattgaccattttctgagttctgtttcttcaagttcacatcttctttgacaagtgagggaactctcagtgttttcgtttccactgtatcttttttaattgaaccattcatacatgtgatcttctcggagatcattttatttactgataaattaacagtacaattatcactgtacatcactgagctccttgttctgtcgcgcacataaaatagcatgtatgctttctgcctcagcacatctgcctcacgaacttggtaaacctgggtgtattaatgtatatcaacaaaacaaacttcaaaataaaaaaaaagagaggaagaaactgaataaagaatgccaggagtgcagatgagaaagtactgaattaacataagatcagctcaactacaacttggtgtaccaatcccaccaacagaaaatgaacacataaacaggccaaagaaaaggattaccctccatccctcaaagtgaacacattccccatatcctcccttaagttgactgtagaccactacataatatagtgcacgaagaaggtgcctgacaaaacaagttctctagcattcataaagtactagtactattttaagaagacatattacaaggtgaactcttgtgagcagagagtgagggacataagtatagactatagagttggtcgacttcaccattgaatgtttttggatataacatggtgtattttggctggtatttgttattacacaggacaagacatggttgatggaggcaaaagaaaaaaaagagtaactttaaaaaagcaatatggcacaatacaaggatgtgacttgcattaatgtaaaaaagggttgtgtcaatgataaacagtaagaataaattcatcacaacataaaaaagaataaccttgttatcatcaagattgtgccatatgccactagaagtccgaacaaagcaataatagtgacctgactgtgtattccaaccagcatgaaccaaaacaccataaaggctgtatttgaactccataccctacacacataaactaaggactatgagcatgaaagagaatcttattaaaaacatgtccaaacttatgttaaaaaaaaaagaacaccattaaaaattacatacctcaggattgctgacatatggctttaaatttaaagttggttgaaactgcacttttttgtcgatcttgtgacgagggttgaaaggactaaagcgctttagatgaattgtcaacacagagggagccttctcaatcataaacctcttcttggctactactttctgcctgcagtgctcgcagttgtactgcttttccccaccatccagtagctcttccgcagtaaagtgttgaagtgcttttaccagagtagcagcattggcaatttcaaggctgagatccaggaaaggatcaaatttgttggaacagtgtgagcaagttgtgcatctcacctgtcatgcatatagatatagtcagccagtggccatatgggtaaagttttacttgctattatactagtaataagttaattaagcatttggcaatttacctgacttcttaagagaccaccaaatattctgtgaactaggctcttctcataagcacttggcgacccacttggtacaccagaaggtaaacaacatttgtgcatggactcaagcaagctaaccattagctcatgtgcgtcttcctgccttgagatgcggaaactacgagaaatgcctaccttgcagttaaagattgcacaagggttgaataaaattatagatagatacggtatttcaaaataaagtggatcaattattttgcaatagcatatgaaaggatacatcttaaatttctgacaatgtgcacaggtctcaatatcttcccagttgactgtagagcagaatttacatgtctttgaagagcacataaagcacagaatccgatagtccgaccttaaaaaataataaagtgatattataagtaactacagaaacagggcttgccaagaaaacagaaaatgttattatattgttctctggagaaatgatacagccgcaaaaaacagaggttgctccagaacaggtgatgagacatagtacattggtcaaggcatgtaaactaaaatttatatctgtttcgttcaatccaaatagataagaagcagctctagctctagatgcctcgagactgattatagagagaggaaatatatttgataaccaccaccatagaacatccgataagaaaatgcagagtgctcacagacagcaacaaaggatggttcactactctcgactttcattgacaacatcatcatatcatgcagagtatctgaattgctgatcgcgaccagacgcaatgaacttacatgaggacatgtgctccccactctgcaagtaggccacgaacggctcggtatacgtcaagcattgcagaaccgagttgaggtagcaggtattgccaaaattttgcaagccagctccctgttttacatagatagggcaatagggcatctttagtgaagtattcacttgcaaagcctcgtgtttcaggtgaatgagcagattactccagtaaaaaggaccttcaatacgcggatgcaaatttttgcgcataactattccaaaatgtattctaaacaaaacataatacagttaaacgtgaatatatttttttcattacagaacaacaaaccagcatttctgaaggaaaattcataaaatgtatcttataattactgattctattcgtaaaccaaaacccctctaataatctgaactgcaacaactaaaaccacctaccctacatgtatatactatgctacctagattcaacaaaatgtgaaacgaaaaattgcaggcttacacactcacaattctccgcaagtacatcctcgcgacgcgaagctccgggtcgatcccacccccgctaccctcccccttctccaaccccctgaccagcccctcgctcctcgccgccgccaccaccgccgccttatcggcatccgggctcaggatctccacccaaaacctccctcccgccccctccaccgcacgcggcggcctcctcgccgcgtggaactcaatcctcctgtgcatcagcccctcctccgcctcccccatcatagggttttcgcgctcgcacggatcggaggatcaccggattttcggggcaatttctcggattaaaacctgcggcttcgatcgattttgggattggatagtgtgatttttcgcctcggcatttggtgggcgagagagagagagagaggcgaagaggtgagagtgggaggtggtggggtttataaccgacgtggcttgtacggatggacggctgggattgaacggattgggttatggactgatatgggccgttggattggtttcggttttggaagctctccccccacgatggcggccggagctcaaccgcagcgccgccgcggcggcggccggagtgtcgccggagaaagcgacggttgagagggagacaaaatagtctagtgtccagatgggttggggttggggattcgtccaacctgacgcatcaacccatgttggcaacgctggattggagcgcgaccttgtcgttctcggtggagacagagatagtcaggcaatcagctccgattttgtacgcgctgcccatgaagaagaagaagaagaaggtgagcgattctgcagtcgtaatcgtctcctcgcatcagctaatgccaaaaattaatttttaaaatctaattttaaagttgattttttaatcgaagtttattttccaacaatgacatttgaatcgctaacaacacatatataaaaaatttacttataaattactattattgtgtattattagtatttggcgaaacgatgcagttcttgaagagtttttcatccgctctcgttagccaaaatttaaatttaaaggtgattttgaagatttttattattttctatttttttcatataggcttttaaaccacaaatgatacatacgtaaaatattacctacagaattattcttgcttgctctgtagtcacggtttaatcggtcatactagctgggagcaatagtaaaccgtaggtgactagtctgaagaaaagaaacaatctgatcctgaatttctgaatcttcgatgcattcttgcatcactgcatgcatgtcccttttgatggtggacgccggcgactcgccgtcgacttgtcggtgactgctggccacgggaaaccaaacaactctgatgcaggtagcaatcagcaaccacaaagaaacaaattacatatatgcttttttcctgtgctagtacggagtagtagtaggaagcttgagaagatgccaaaggaaaaaagaaatccattgcagattgcagacaggtgacgtgcttccaacccctttgggcgcagcacaagcttactgaagcaggctacaattagttaatactaataactactctcaagtctcatgatcattgttgctgtcatacaccggccaccggccatcttaagctccagctcccagctgccttgataaagattactgtcaaagtgtcaatgcttcctaatatgagtcaagatcaagatccagcacatgaaaactatctcactgcagagtttaggatcagagattttcttttttcttttgctaggagatacaaagattctgtaaagctctctctttttttaaatctaatctcttgcagctcggttgaaaccttcaggtgaatttggtttttacaggattactagtacaagctcagggtgaaggactgaagagcatgtggcttgttctgaaattggcggcagatgctaactaccaaccgccgcccccacccggatcccccaaatcaccgtgactcactctctaatcatcttccttttctgttaacaaaatcatcctagtcacgttaattggcgtagaaattagagaacccttaaaaaagaaattagagaacccagcagccagcacaaaaaagccaaaaacgaaatctgaaagggaacaattgcgaaagcaacggatgcttagcttgctctccccaggaggatgaaactgactttttttttctaataactaatgttacaattaaaacaaacagtaagcagatttatcatgcaaaaccttcctaaaatgtaatttactgcaccattatatttgctttttttttaaaaaaaaagttcaagattttttggacaagcacattgaccatcagtaaagattgtcaggttgggtaggttttccatgaagttgacctaaaatacttattttgaaaccaagcacaatttttttcattgacaagccaaataaaaaaatgggagaaataataataataaattcttagaagaaaggggtagagtaaagagcagattaacagctgcgcctaaaaataattaaatttagtcaaacgcccaatgcttcgtcttcctgcttccttgagtttcttctcctcttcctcctcctcctgtcgccatttcccatatcgccacctagaatcaacaaaagcgaccaccttttctccgtgcgcttcgattccaaggccctaatctaattaggagctcaccgcaacaagattgctcggagctttcgagcgtttcttttttttttttgtttccttccgcgatatttatattctaatgctgcaactagctgcccgaatcctcaaaggcggagcattttctaaagtggagttctcaaaaaaagcgtcttcttggggtggattgcaagttggtgacccaaatccgtcgctacgggtcgggagttcttggatttcccgctgattggttcgcagattggagctcttgatttggttgcgccatggcgctgttccggaagttcttcttcaagaaaccgcccgatgggttgcttctaatcacggacaacatatacggtaatggaagtatttccttttgcactgccatgacttatgttgcttgccaagtttaccatggacagattcatccaacctagcttctcttttgaaaaggtttcagcttgattgatatggataggctgctaatttaagcatagttgaattaagatttggcacttctgaagtgttggtagtatagtgtatcacaatatggattagagacttttagggccatgagagttatacgtaatgtagtggtggaagatttgtgtttttgtctgtttattgcaatttgaatggttaatcgtttcagttatgttatattctccctaaaaagttgtgttatattccaaaagaactgtttcatactttcgttatctgttcattagttaactgtgtgaagataaaagaactcaaaatagagccgaggtcctgaggatgcttgacacatgtagcttttatctatttcagtttttgatcattgcttctccatgaaagagatggaagaagaccattttgaagcccacataagaggtgttgcagcacatcttctagataattttggtgatcattcattcatgatctcgaatttcggcattcgagatgaagaaagccccatatatcacattttatctgagtatggtatgaccgtcctggactaccctggccactatgaggggtgtccacttctcaccatggaaatggtccactgcatcttgaagtcgagcgaaagctggctctctttgggtcagcgtaactttctgataatgcactgtgaacaaggatgctggcctattctggctttcatgttagctgctctcctgatatacctgggacagtattctgatgagcagaaaacactggatatgctttacaagcaatcgccagtagagctcttggagatgttttcacctctgaatcccatgccgtcgcaattgagatacttgcgctatgtttcgatgaggaatgtcgtgcctgagtggcctccagctgatagagccctgacgttagattctgtgattttgaggatggttccagattttcatggtcaaggtggtttccgtccaatattcaggatatatggcccagatccgcttatgcctactgatcagactcctaaagttcttttttcgactccaaagagaagcaacgttgtccgtttctattcacaggtaattgccttgtcttttccctggtcttgcattgtggttgttttgaagtggacgcgttgtgacgtacgttgcagcattcgtatagctaaaactacttcgctgtatcattaatagggttctatgttgattatatttgaagtttgtacaatttctggtctaaccttcatgaaattgaactaaccatttatgatcttaggcagatgaactggtgaaaataaaccttcaatgtcatgtccaaggggatgttgtcctagaatgtatcaatctgtatgaggatctggatcgtgaggacatggtattccggatcatgttcaatacaggtttcatcaggtcaaacatattgatgcttaatcgtgaccaaatagacattttatggaacacacaagaccaattccctaaagattttcgagctgaggcaagtgttttataccaagtggcaaactagcatatttctgtttatacatggatttttaaatacaccttctattatgttaggttattttctctgatatggatgcaactacttcacacatcacaacagagccggttagtcatcaagagaaacaaggacttggtattgaagagtttgctaaggtgcttgatatattcaaccatttagactggttggatgggaagaaggatacttcgcttcacatacctcaacgaaaagcatcatccacttctcaaggaaatatagatgaatctcctgctgatgggtccgagactttcttcgatactaaagaagaacttgactttgatagtctctctggtgaaagctcgtcttcgcttgttttgaagttaacagatgactatgttatggttggttgcactgaacttcaacaagatcccctacattcaacctcagctgaagttccatccaaaatacaaacaatagaagtagctccttcacgaacaaggcctccatcggtgctgttgtcacctactaaggttaagatgccaaagaccagtgcttcatcaatggcactaccttcaagcacggtaataccccaagcaccgtcctcaccagttcagccacagggactgatagattctgcagtgcaaattgcaccagcacagtcagcgtcaaaatcagctgagaactctggttcacaaactccagtaaaccaagaaccttcacctcttaccgtaaataattcagcatcgaccgcatccttgatagctttgtgaacacntccgcttcttcttcctccgccgcccactgtttcattagcccctgtttcccccattttacccataaatactagtacaagtataatcagcgtttcccttagatcgatcatgccctccccttcacaacctccagaatcatcagcctctccactagctcttgcaagaaatgaagagctagttaaatctcaagaaccttcctgtgaaaaccttgagaagtttccacctgaattttatagagcttccagtgtcactgcattgtcatcagattctctattgtccatagaaaaggaatctagcagtacaagaacatatgtcccagaagctttgcctgcaatgcctctgacttcagacactcggacctcattaatttcaatttcaactgcagcatccccacccctgccgccgccactgccaccccctctaaaaccatctactgtgatgtttcctttgtcatatggtaaagaggtagcaagcactaaagaaaaggctgcaccaactcagcctccactcccaccacctccaccgccaatacaaccaacattgatttcaaactcgatatattcatctacttcatctgtggtttctgcaccactaa

SEQ ID NO: 58823 - DNA, 27895 bp, Oryza sativa
tcttgtttgggcgactggatttatgttcttaatttcctggcgtggatattggcaggaattaattgagactttaggtcttgtatttatacccataggtgtccccttgtccgagtagaactagggagaccaatatggatacaatccgagtagtactggttgtttccatttagaactctggttgtctttccttatccggaactcctcctatatccgcaggttgtttccgtataggacatggtatgtggtgggtcctgccgagatgtagtcgactactattaggtatgtggtatccataaccctgacagtagcccccgacttcaatgcaaatgaacgaattcatattctcaactgcgtgcagacattggagtaactgttatcgagctgatgtgaccgttctcggtgagtttagagataacgttagacttcctttatcagactcgtgcgggcaccgaaagggtttgtctaagtcaatctctgatgtcaaccaaggaagtacagagcagacgactaagtctcccgtcttgctgtaatcgagaatttggattgaagtcaagaaattttatctcggcgggtacaccatttcttcattctgtattccttgtcgagatccagcaatcgttctcgagcgatcgagaaggcgtagagtctgcgacgaagccttgtcaacattggtcgtactcgccttagtcgatcttggtgtagaaccatagagacatggagtcttccataatgtcgaatagaattttcctgaaatcaatactcagaaaagaatatcaaatagaaatagcccccgagcgaacgctcaaagggtgacatgttataatatgtatggaaaactaaaaatgaattaactttaccgaccaatgttttgtgtatgagcgtcttctctcttaccgacttcgatcagtcagtttgtagagtcatacactctccctagtccccagccttgtcgtcggagaatcgttctcagaggataaggctcttggacccttgacctgccttagttgaacaagcactgatcctagcccccagccgtgaagttggaaaactcaatttccgatcacacggcttggttaatacgcacgacgagaactcttacacgaccaggtcttacatggtcttttgtctctacaggatccgacaaggccttatcggctctgggcatccccagccaaagttcccttaggttcctcggaggccttgtcaagatgacgtaaagggacagtaggataggtttcaacgctaggtgtcgtcgtggtaagggatctctgggtaaaacacttggcgatattgtatacctgctatcaactttgttgaagtagaggtagtaggagaaatcgctacaccgctggtcgaggaccaggtagtagtcgtaactcgaccacttgaagtggaaatagtgggagaatcgctacaccgctggtcgaggaccagggagtagtcgtaactcgaccacttgaagtggaagtagtgggagagacgctacatcgctggtcgaggaccaggcagtagtcgtaactcgaccacttgaagtggaaatagtgggagagacgctacatcgctggtcgaggaccaggcagtagtcgtaactcgaccacttaaagtggaagtagtgggagagacgctacatcgctagtcgagaaccaggcagtagtcgtaactcgaccacttaaaattaggcgagagagatcactacgctttactggttcgagaactaggagtaggagtctcttaatcacctataggggcgctaaagttggtttattacatgtgcatatcatgtggccagcatgactcacatacccaacttatagcatatccggatgtctgctcgcaatcatgttgggtgatcaagccaacggcgtttgcgaggaattatccgttgacaaccttttctcgagtagtccagccatggccggtgctatgagataggtcgtcggtcttcgttggtaagttgggtgcgataactccgcatttgtcgagaatgttctcgataatggagtgtactcgaccataacctactcgagtgctcaattgttcctgaaaaatattttctagaaggcaagatatatagcagataatatcgagtatgtactcaaaaaactgcatggatcttctagtattatcaggatataacgagcagatgtaattatcaggcattatgtaaaccgtaaacaagcatgatttatacagaagaaaacagagcgagcccccagcgttagaccgtagttggcctaacatcggaagtactcgcgcaatatatattgtataaaaaacatgctctaagtaaacgtaataaattatagatctgacaatactgtatgatctgaataggtacgataaattgtagataaaatattgcgtatctttgtagatacatgccggatgtatctacgaaattagtagattaattttaaaaaaataatcttactaattaccttaattagccttagtagccaacctaaattgttctctggtcacacagtgactagcacacgtatgggtggctcgtatgggctccacaatgtgcatgctaatacacgtgtgcatgacaatgcaatcggtcggcttctcgtccgctcggttgtcctgctgctgcacgtgaaatctcaaccaatcgggttctgattccagattgtattgattaagcttgaataatggatgttgatcctgattaagcttgggtcttgggaaccgcgcgctgcatgcaaccgtgcgtagtagatgccgatcccgatttgatctgtcagaattccggcgatgtcgatttggagatggtcggtcggggacgaaacctcctgatcgataaaattaaatcgatgtcttccgcggtggcgaaaatcttgaagccgatctcgccggatcgaatagttaatgacgatgattccaatctcgtcgggagacgtactccgatcagattagatcttttcatggtcaaagttgtcgagtagcttgttgacagaggatccatctcttaaacccatctcgtcgaaatcctaaagcaccaaaatccccctacctggcgcgccactgtcgacgtttgatatcgcggttctagtatttggacagtatggggatcgttggtactaggatatacgcgagactgaggtaaaagagatggagacagggatttttatacaggtttgggcccctgagttgtcaggtaataaccctacatcctgttggccgaagccggagttgctttttattcaccataatcacaccagtacaatatgtggggtagcttatctaactgttgtcgacatggcggtctgaaaggctgactcgtagtcgacaacagggtagccttcctcctcgaatccatgtccggcgagatcagagatagcgctttcgtctctcctgacggtatccgaagacaccgtaggggaatagccatgcctatccctgaagtcgatatctggcgtcttgtcttggcgtatgtaggcttgtattggcttctgttgttccgtatattgtggtggttgttgattgtagtgggtctcgatcgtggtgaccatgttgatcgtgtcccctctcctcgtagggggtcttgtatttatacccataggtatccccttgtccgagtagaactagggagaccaatatggatacaatccgagtagttctggttgttttcatgtagaactctggttgtctttccttatccggaactctcctatataggacatggtatgtggtgggtcctgccaagatgtagtcgtcgactactattaggtatgtggtatccataaccctgacacatatcctttttaatttcattatttgtgtgaattgggaaagacaatgatttcatatgtgcgtcaggcttcgatatccagaggactttgttcttaaggtgccttcaatagttcttgatcccaatgttgcttcttccaggaagatattaagctgtaacagtccatctgcagtaaaaagaatcatccagtaaaaaaaaaagatatgaagtacgctatttttttataactagttttgcagccttgctctatgtttttttaaccaaggatatgtcgtcatatcatgttagattcaagcccactagttgccactttatgaagttattgataacacaaagacaaagtaagatagaaggagttgcatggttgttaatgttaaacacacaaccaaacggatataacaactaatgcacaacacactttatagttaagttagcccaaagaaaataatggttaacgtcatatgaaaaacatttttttcttggataaaatcaaatgaacaataccaaataaacaaaaagcattagtataatggttcttgcacaaaatgtgatccagccaataacactagttttaaggagcatgattggcatttattttttccttgaaagaattgtcgtatgctttacttatttagatggttcatccataataatagttcatgccaaacatgcttttttttctttgcaaaccagaagatgtttacaacaacatttagcctgagtttttgttttgagctttaccaactcaacttcctcgttgttcgcacacatgcttcccaaactggtaaatggtgcgtgttttgccaaaaaaaaagaattatacaaaagtttctttaaaatatcacattaatcaatttttcaaaaaaaaaccctaatacctaattaatacacacgctaatggactgttccgttttgcatgtttgaagggagagttcccaactccaactaaaacccatccttaagtcttgtgcttttcttccttttcaactaaatttgtttgtcagttatgcaatacgacacattcaagaaaagaagttatgaaatatgacaaaaataccattctttacataacaatgcactgccttacaaaaaacagacaaacaaagagacttgtctatggtgatagttaaagtgtgtgcgcacaacatgaacatctgtacttgtaaagtgatttacctgtttcctaagtgaaatttcctctatcagtcttatcccggtggtagtcattccaccttgagttgtagctcatggcaaaccttagtagcccttccaacacaaacacaaacttaaaaagaacactttgattcaaaagagaaaagataacacaattagatgaatcaacagggcaaatgttacctgcttgttcagggagagatgcccatttccaggttccttcttcattctcctggatgaagcatgtgaacttccctctaaggcccatttcaatgttttaataccactttccatctccttgattttttgtgggaggtcaaactaagtttgtactttgcttaggaaatgtgggttgtgtgtgtgtttgtgtgtttactcacgcatacacacagggacaaattaagagatcgagagaaagatagagtcagagtcagagtcagagagagagagatatgttttcctcccatatatcttcattcatgtctagatttaaggtttgtgttattagaatatcatcaacaataggtatggaatgttaagagagtcttgcatttgaggtaaaagggacgaatatcgaccttctccatatatatcgacctttcatccagactaatgcatggctccttaaatcattagggaaacattctggtagtagccaagttttgcaagcataactaatttatgcatgtggtgtctgcatatcaatgctttgcacaataaaatttaagaaagaaaatccaataagcttaggacaacctctaaatggaccatgattctacacagccaggtgagtacactacttcaggcttttagtaacatgtcattctgtcaattagctgaaaacaaatgtgttattgagttcttggaaatgctgtagaagtaatgcatgtacaagggaaaggagtaatacatgtaataatgtaaagaatcacaactcatcgacttatgaggtagtgtggatcatttatcatagcacacaagagcatctgttcagtttcctaagacgtcgcttatatttccgaaatcaaatatgcctcataaagttgaacggagggagtatattcaatacttgcttaagagaatgcgtgcgatagagaatgcgtgtgacataaagagtcgagaatttatagtgtgttagtaggatatacattgtcacgtaaccgtagtcgcggagtgtgtgtatattgtcacacaaccagtcgatcatggtggttggtcaaatttataatttgttagtggggtatgttattgtcacatggactttcttctagtttttagaaaagaggaattgtgagaagccgactatcctttagtactaattttgagatttgaacccaggtgagttgggcgaacaccctcacaccacaccaactgagctatgctcagttctcctttttcatagtttctaccagttaatagaacataaaaaaaacatgtcaccagtattaatccttacaaacaagaatgcacaatcttatataaaataaaacaaacaagcatgttcatctatagcgataagattcttgtattgcataaagaatactaccgaacaatgtacctgtttgaaaacctccttggtgaagtttcatctcttaatgccatccctcggttagtcattctacatagaattgcagctctttgcaaacctcaatatcccctgcattccgaattaacacagaacaaggaatggagaatagaataagcgaaattcacaagcaaaaaagaattccaaatgaaccaacaattcccctatccttcttttctatatagttggtacccacttagagttatttactgctataaagctgagatttggtgaagccacgtcatcctatgaaatagacggtcggattgattcaggccagcctttgtgtcaccgttcgattcctctccggtagtgaaactgtcgcaataaaatggcaaccgatggccgtgtttaatgcattttaattccttcacctaacgcatgtttttattcatcaatcccggtatatcttcatcgttgataatgacgcactcaccatgggtcaccagttcagtgcgacctgtgcggctgccccaacgcccaagaacaggtacttgcccttctgatactcatgtctcatgtagctgatcatctttgctgctactttgtttcaggctacttatgagattcgttttttttttgttgtataattaatcctttcgtacaacctgctcacatatattactgtcctatctgattgattaaataagatgcagtgtttgggcaccaagaaatatttgttccatgctttacaaagtgatttttacatttttgcgatgtttttaccgttgattatctcctacattgccctaccacagctcacttatgaagtgcacttccagtagttgcagtggtaattaagcagcgatcgattccgctcatgaaaatggttgcttgcataagccatggtgagtttccttgacgatccatgtttcctacagtttacacgttaattgatccctaccctaaaaccttgactcttttgcaacctttagtctattattctgtactctgtacatgcatcattaatttactttagagttcagccaagtttttcaggtgaaggatatctatggatccaaaatatatgtgttccttggccaagttttagttaggtggctatgtttctctccgacatttatgctctctgaaaaaaaacacactccatatttaattagcaattctatttgagaacttttattaacctccatgaaacttgaaacttggtagtttcttctgcaatgaaattatgtgatgagttttcagctatatgatcctgatcattgagattaggtaacttctctgtaggatatgagctgaaaaccttctaaaacagggtactgaaatttgtctaattacatctgtaaagacaaggtccaaacatatttttagttttttactatgatgcttgatccaatttaattataacagcctttgtttcattaaatttggtttgcaatttttacaagtttatgatttttagtaaatgatgcctttattttgttaatatctatgtagaaatttgtttcttttatttgaaacattgacggttttgtccttccaattggaggttttggccatcagctgaatatttcatatatacaatcatatatttttgtgaccataattattttaagatatattctaagcagattataagcaactttaattatattgtttgcacaaatattacgtaccgagaactactcttttatgcccgcaacaatgcgcggggcatcaactagttaaccatgataaaccatgataagaacaattacctgaccatttcaggtaatctttgagggattgatgcattaatgaagcagatcaacttctcatcttcctccactgaccttttcagtcgttctagacatattcttaatttttattagtgaattaagtttaaaccttactttcgggggtgcgtggagtgtgtgccagagtcagatagagccttgtaatgttttagatgaatgaagagacaaagggagcaatggcaagcacttccccacattccttagctttatttatatccaaacttgaaggatactacctccttgaaggattctacctccgtttcaaaaagacttaacttttcaacatgaatatcgatggacaagagatccatgtaaaaagataaagtctttttggatgaggatagtatgttatctgccagtaatgtcacaggaaaaaaatgacaagcatataactcctaaaattaccacgcactactttatgaaaaatacaaacttgtccaaatgtaaggtttatgttatttcgacgagtttcttttgtcatttatagaacatgtcaaatgaaaaggttaacatgtcaagaatcacactcaagcagataaattgcgctgcctctctaatttgtggcattgtgtcagcttcctaaatagcagagatcaaaatttcacataccccttaatccttccttataatctagatattttgttaacctgtcatcagcatctgtatatttgctaaattaataggatataatccacattgtaaatagaaacaggaaagcaagaatatccacacagaaaacaaaatatcaaacagagacaagagaatagggttgaatagttttggttcatgaacttataataaactggcgagaaatgcgtggattctgtacattattttaagtacaactaatctcgagtcgaatcattgtacacgtaaatatatttgcaagctctccaaatgaggctttgccacattaatattgtgatgcaatcagatctgattcaactgaatgttggtcaagggtgtttgttcacttcacatctcaagcttgctagcaaggtaccaggaatgcatggctaggctgccgaatgacatgatgttggccaaagacgagagcccgtggatcatcccaaacttcttgttgattgcggcaagggtagggttgttttttgccacctgaacattcttcgaccacccaacctcctcaccaatgctcaggtccctctcaatcttgtgcctcttcttcatcatctgcgaggatcaaacaaccaaatattatcgtcgcactaggagatgaagagaaaggaaggggatcttctaatttgtttaggcatggttaccataggtcttggttcatacaaaaaggcaaatgattgacatatcatatacaactaaatattctattaaagaaaagcattagtgttgctgcactttataagagaatcataaacatgttttgctagagtatgggtagttaaatatcattgaatataaaacaaataggggatatggcaacgtatcactgtcaactactcaactgcacatcactttacacaaaaaaatgactggatagaggcacttcaaaggattaggagtttcagtacttgaaaggaagcagaaaatagcacaaattatgaactaaattaagaatatcagcagtgagatagcttactagtaatcaaccaaaataaggatgcttgtgaatttaacatatagattataagtacaagtgactatatatagttgcatcaacaagttaatatgcaaagtataatttatgttgcttaggaacaacaaagataacctactactatctgatacaatcttctacatccatgatgaccatcatgtaatcaccaacactatggcatcacatatgtgcttattctgaccaataacctaaagtaacacatgagatctaacagggatgaaggagtctaacgtcgatcaacattcatacatccataacaaagtactaaaattgcacacttcatatgccatttaatgaagaaaaatcttcaagaagatattaaacattttaatggaagagttatgtcatggtaaacaacaccacactgaagcatagttgcctttaaaaacttggcattataggttatagcaatgagcactataatgcagctataggaggtctcaatttggtaaagcaattacataagcaatcaaaataattaaaggtaatgctgatgctgttctctaattagcaacatccctacccacataatcaagagcatccaaaattagattcaagttagagtagcacaaatatcaacctctcaactctggaatccactataggaaaagaagcctgcaacccaaaactatcactatcccgcaactaaaagttactagtattagccaatcaacaatcaagcaatgcaagaaacgcttgttaactaccagtagagttgattatgtattgttgcgtcatgtctcgccattttctaacaaacttccataacaggtgaagtattatttatgctgattaggatgatatatatgaagaataaatcatctactattgctaatttgccatcaccaaccctaaactgacagcttgtagtaatcttgtacaaattaagtaatagctgacctcgatggtcatgggggtgaacacgagcaggttggagaggtcgaagccaagggcggcgaggaggaagccgagctggtagcgctcgacggtggacgccgtcttccacgggtggaggtaggcgaaggcggcgacggagacggcggcgcaggcggagatgagcatgaagtaggccgggaacaacttcccctgcaggttcccgaactggtgcctcggcagattcctttccaacacaaacaaacaaccattcatccaatcgaatccaactctcggatcagatttgaagtaatctcagatttgaagcaatctgggttcttggaattgggggaaaaaaatcaagaactccccaaggtttttgggagtggtgggattacttgaacatgatgatgccgccgatgaaggtggcccagagggcggcgccccatgaggtggcgaagcagaggaggtgggccaccttggcggccgcggcggcgccgccgccggagccggagccggagcgggcgccgaggaggacgtcgggggcgaagacgacgcccgccgcgaagaagcagaccgccgccaggaaccgcgtcgcccaccccatcactctctctctatctcgatctcgacggtctcgaggaggcgccggcggcgagggggaagcggcggccggagacgaggaggaggtgtcgagatggaggagggaaggaggtagttggagagaagggatggaaaaggtgggttttttaggggaaatttggcccttctagaagtaacaagggtatattcgtaaatttaaaccgaatttggaaataaattccaggcaatatactacatgactttgttattgaggccccattcagtttaaaaaaagaaacttgcatcgagtgttatggtacatgtatggagtattaaatgtggaaaaaaaaccaattacatagttttcgtgtaaattgtgagacgaatcttttaagcctaattgcgctatgatttaacaatatggtgctatagtaaatatttgctaatgataaattaatttgtcttaataaattcgtctcgcagttttttggtggaatctataatttgttttgttattatacaatgtttaatactttaaatatatgttcatatatccgatgtggtaacaaaacctaaaaattttccccaactaaagatgaactaaattccaggcaatataccgcatgacttgtttactgagtagagaagtcaaaaaatcgtggtttgatttcttgagactgccaaattagactgttgttggttctttatggcaatatcaaatggttactttccccgtcctcgatgagcatgttttttaaccactaaacgggttattttgtaaaaaacttttttttattaaagtctctttattttttaatttatataataagtaataatcggttaattatacactaatggttttttctcgtttcgtttgctccaaaaatttcagtccaaacacaattccgaacgaggccttattcctactcttcaaatcgctgtgaatgtgaaactacagaggctaattgatggacgtgcctggtttaggtgggaaaaatttttaggtttgattgtcgtattggatatacggacacacatttgaaacatttaaagtttaataacaaaataaattacagattccaccagaaaactgcgagacgaatttattaagcctaattaatccgtcattagcaaatgtttacttagcaccacattatcaaatcatgacgcaattaagcttaaaagatttgtttcgcaatttacacacaaactgtataattggtttttttccacatttaatagtacatgcatgtgttcaaacattcgatgtgatggatgaatagtttttattttgggcactaaacataaacaaggcctgcgaaagggcctgtagcctagtggttacaagagcatcagtagcacatgaggtcctgggttcgactcctcataggagtgaatttttcaggatttaacggcgttgtgcttttagttgtaggcaacgtacccgtcgacagcgatgcacttgtagcttcgtcaatctctccagaatttgccggcccagtcttcctgtagtgacttcgtcaatctctccaggatttgccggcgttgtgcttttaattgtaggcgacgtacccgttgacagcgatgcacctgtagctttgtcaatctctccaggagtagtgacttcgtcaatctctccaggatttgccggcgttgtgcttttagttgtaggcgacgtacccgtcgacagcgatgcacctgtagcttcgtcaatctctccaggatttgccggcccagtcttcctgtagtgacttcgtcaatctctccataatttgtcggcccagtcttcaaagatgctcataggggtgagtgtgcgtgagttgcgtcaatctctccaggatttaccggcccagtctttaaagatgttcataggggtgagtgcgcgtgagttgtgagtgtctgcagtacgtagcgtttagtttatatcaggacaaattcttttttttttcttatgccggagcggttggccgtttggaaaaacgatatttgaccgttggaaaaccgttttttcagtagtacgttagacgtataacttagtggattatacggaatataagacaattactaatgtttttgatgatgaagatacttatttgagttgtacactaagataaaattaatattagtggtaaatgttgtgttaaaaaaaaaaccatgataccatatgtagatgtccaaaacaacatattttaacaagggaatagattctcaattgtatttgactccgaatcccagaggctatcattgataaaaatacataatatataaaaccctgtttcatggatctttgtcatactcatgtaaaagttgaatcatcaatgtatacttgcaacagttctagagaattttcactttgttgcgggtggatagaacctctatctaaaattctgagctcccttatcacatataaatagttgatgtttagttatgacaagatttggtcaaacttttaaatatttcacaatcaatagcctttcaaatgactagttttttaaaaatgatatgcgcaatttttcctttaaaagtactacaattattgaaaaattactttagcatacgaaattgactgaaaattcccttggaccgaatcttgttaaaagtgtcaaatatctttcgactagagagagcaaacttagttaaaaaagtatacatcggtaaatatactggcagttaaaaaacttgcgaatgtaactataatgtaaatataatatactaaataataactacagtataatttagtttataacttttaaatagttaacttatgtactccctccatttcagattataagacgttttgaatttggtcaaagtcaaactactttaagtttgatcaacttcgtagaaaaaagtagtaatattttcaacccaagacaaatttattatgaaaatatattcaattattgatttgatgaaactaatttagtattataaatattactatatttgtctataaacttagtcaaacttaaaacaatttgactttgaccaaagtcaaaacgtcttataaccaacctgaaacagaggagcatgaaattacatatttctttatacaaatgcagtttttagaaattcttttttcatatcactatcttcccggagaggtagcagaaatgcgagaagagcccagccgccgagatgacgagggccaccgccgagaagctgtgcgccacccagaacctcgcattctcggcggcgagggtgctgctgctccttgctgcccgagcattctgccgccagccgacgaacgagccgtcgccgccgatgccgaggcttctctccactttgtgcctttcacgcatcgcctgatcatcgaaagatcacatgaacaattatttaatttcgccatgcattttgatatataagtacaagggatttctggttggtgatatattgacgatacagaaatctttatatttgcagaaggaattaattgatactgtatttgtggatggaggaattaataattactacatggtaaataaatctcccaaacagtttattgactagccattaatttgtacacctccattgtttgctcgttggtttatatatatcaactgtaatcaaaatttaaaatttgaaatgtaagagttgattttgaggggattttttatcacttattttttttcagctttagattttaaattttgttataagaaaataaatataaagtttttactcatagaatagttttggttgctatgtcaattttctaaccgcttatcggttgtagagcagggtgtgttcgttggagctggttcccaaccagcacagtacgcacggaaaacggagcgatctattagcgcgtgtattagctaatttttttttaaaaatggaataatatgatttttttaaacaactttcgtatagattttttttttaaaaaaaacgcatcgtttagcagtttgggaagcttgcgtgcggataacgagtcggagggagctgggaaccagccctttcaaatacacctgtgttcagcaggtgaggttgggaactcacctcccgcgcatgcaaaacagagtgacatattttcttatgattaattaagtatttactaattttttttgaaaaatagattaatatgatttttaaagtaacttttgtatagaattttttttttttgcaaaacatacaccgaatatgaatatggaggaagtaataagtactccatccgtcccaaaatataagtattttagcacagtgacaagtcaaatatttttaacttttactattaataaaaaaaataaaaaagatcaataatgtaaattgatgttactagatttgtcattaaacaaactattataatatacaacttttttttattcaaaacattttatttttatagatattgttgatcaaagtagtatctcgaaaaccgtgtcagagcttaaaattgttatattctaggagggagtactaattaaagactgtatgttaaccgtggtgttattgtttaaaactggcatgctgcgtgcgcccttttagctttgcgaaaatgtttctagaacctacaggtctgtaatatttaacgcgtggtcaatgctcactgagtcactgtcgattgattattatttataattcaattataatatttatggccccgttcgaaaccacataggatgtgattaaggttagacatgaaaaaaaattagtgcctgattaatttaattattaaaacttgaaaataattttattaaattttttattttaaaaaatttctatatagaaagttttcgtacgaaacatgctaataaaaacttttgtaaaacttagagtgaagtgcatgagcggtccttaaacttgtacgagtgtgtcatctagatccatagaccctaaaaatacatttgcgtctccaaacttttgttggctgtcatatctaaatgggttccaacccgttccatgcgatgatgtgacatgccatggtgtcgcctacgtgttagtcggaccacatgtgagtcacatagaataaaataaaaacatattttctcttctttatcttagaattattttttaaaattttattttttcctctctttataagaggataaaatatggtttttaattttatttatatatatgagtaatatatgggttcaactaacacttatgcatcaccgtagcttttccacattagcgtatggagcgggttattagaaacccaaagacactaaagacaagtacgaaaacccaaaatattttattatagaagtttataaacctagattatatacccatataaatttaagtaccgcatatcgcatatgtacttggctccaaaatttatgtcttcgatctgaaaagaatgtacctcgagtgtcctaggggtgaagataagcaggttggcgaggtcgtacccagcggcgacgaggaggaccgcgagctgccggcgctcggccggcggccacggcgggcggtggagccacgcgaacgccgccgcggaggccgccgtgcacgccgcgttgagcgcgaagcacgccgggaacaccttcccccgcagcctgcccatcgcgtgcctcggcaagttccttaatcaatcaattaattaatccacgtgagcacaatgattaattaaactaataaagcagggttaatctctcttactgattaattaatcaatccacgtgaaagacgacgattaattaaactaataaagcagcgttaatctcccccctaattagttattctctctgtctcatctctatctctactattataaaaattaaagatgtttttactagtattttggtacgccatctgtgtattagtcggttttaagttcgtttgcttttggaaatccatatccatattgtggtttttaagatcgttcactttttttaagatcgttcacttttgatagtacagaaggaatcatataagaaatctgtttgataaaactcgcatgctaacttaagacgatcggatcctatttgcagctcatgactttctaaaaatatatatatgtaagcgaactcacacagtgaattttcatcttaactaaaccatataacaataataagattaaattaggcttcatccgttgctacgcacgggtattttttatagtaatatataaaattttcgaaggatataatacatttaatactacgaatctggaaattaaacagaatatacaaatctctccaaaataagaaacgcccagcggttttcgccagttccacaagatggttgactaaccggctagtctgagtttgaggtctcaatcctttctatttgatattagttcattctctagtattcgtggtttctatatatctctttaaaaaaatttaaattataagacggaggaaatacattgaagctgcagggagaaaatgtgtagtacaggaacatgatgacgccgccgacgaggatggcccagacggtgacgccccaggaggtggcgaagcagaggaggtgcaccgccttcgccgccgccgccgccgtcatgccgagaccagcgccgccggcgaggaggaagaagacggcgagcagcagcagcagcatttccgaccaccgtactgaatgcacgtaaataataggcaccgagctggttgatcggcttacagataggagaggcaaactcgggaggcttacagatatgtttttataggccccgttctttggttgaatgaagtaaaaattaaaagaccaatttttgcgactatagtgcaaattaatgccattattataaacacaagattatgagttagcacaagattatgagtttttagaagatactccttccgtcctattttttaagtacagccataagttttcgtgtacaattttaacagttcgttttatttaaaaaagttgacaaaaattaaaaacataagtcacacataaagtattattcatgttttattatctaataacaataaaaatactaatcataaaaacatttcaaataagacggacgatcaaagttggatacgaaaaatcatgactacgtttaaaatgagatggagggagaatatgtttttttctagaaaatatgttatacaaatagctacaggcaatcagcaataatagtttttaattacacgcacgtcacgcacacactacagataactaacatcttcagttgagacagcgatgatatgaatgtgactagttggtggtctataactaataggaatggacgaattaaacatacagtaaatagtttttaaaaataaatttaactagctgatcatatatattccccgaggaaaaaaattaagttccaaaaaaaagtgatgtctatcgttccacaaaaattaagttccaaaaattaagtttggagctaagattcgtggagttgtataaatatgttgtataagtgttgtcaaattttttcataatcatttttaagcaaacgagggaacatctcctcaagatcaaaatagtttcccaattccatatactctgtttaacagaccttgagcatagtatgtcaccaacctaattgatcaaaagtaaatataaaattacctagtcataactaacatagtcatttactaggaaaattagagccccatcgtttggcctaaacagccaaagaataagccaaaatttgaatttttgaacttgattttgaagttgattttgagatgcttttaacataatttttgttagtgttggcttttaagtcgctacgaacaaatctataaaagttttacttataaattaatttttattttctaataagccattaggcaaaataggcaaccgatgggagccttactgatgtaatggggctgcacccattgaattggggatttgggtagtagccgtccctgttctagaataaataaaaattctagtcctcctccccatccctagggtgccattttttttctttgttgtcggctccatgcaggtacaagaggcaaaagaaagtctgggaggcacgcaacaagccaacagtagagctaatatggggctaaaaacttttaagtctctatcacatcagatgtttggatactaattataaatattaaaaatagactattaataaaacctatccataatcttggactaattcgcgagacgaatctattgagcctaattaatatatgattagcctatgtgatgctacagtaaacattctctaattatggattaattaggcttaaaaatttatgtcgcgaattagcttttatttatataattagtgtctaaatatagagactaaagttaagtccctatatccaaacaccaccttaagttacgctgtcaccccaagggagcgagtaaggagcaatttgtgattatgcaatcggaggctatagctagttttcggtgtatatatacatatatacagtgcgcctaggaagtagggtttatccggtccaaaacagtttgtctgaatgaaaggtcttacgagggaaccaagccatgagggtcgctatttccggttttttccagtatagttccgagtgttcgttgtatataggcaaaatttgacttcagacactgaaaaattgtgtaattagctgtgagacacccgaaagacgtgaatttacccgagggctctaaaagtgtggtaatttgctgcagaacactggacgcattaaaatataatatccactgaattgataagagataaatcatataaaatgacagttttgccccttctcttcttccctctctattttcttgtcctttttctctcattgacacaccctctctctacttctttctcgcacgaaggcagcacagcagggcgcagcagcgcgtgagatcgaatgctgattggcgcttgcgtgggttcaagtgcttggcgtccttgtcattatcgtcgcccacgccgccgcccatgtcgccgcaagagatgacgtcgaggtcgtcgctcctggaccgacccaccttgttctccacctccgacgcatccctcgccttcgtgcatcctcctccaccgccgctatcccgggctactaccgcgtccgcttgcctccgagcgaggaggacccgccacagccacgccctcctccccaccgctcccgcaccgcgtggcatacggttgatgagcccggcgacagcggcttcgatggcggcaatggtgacggaggtggctgcggccaggcagtggcggcgtcgatgacagtcggcgagcgcggcggcagcggcttcgacggtggcaaatggcgagaggcgctgagggcaattttgtctttttgaaatttctctctcatcttttttatcagaaatgatacaatattatctcaggtgtcttacagcaaattacatgaattttgtggtgtccatcagcaatgacacgattttacggtgtctcacggccaactacacaattttttggtgtcccagggcaaattttgcattgtatatattatgccaaacatgaattttcagcacctctcaaatctacaacgctgtagccccatcatcaattattagaggtccagaaagttgagaacaacacaaacttctgtgttttagtgttttcgttttcaatttgtacagtcatacttcacagctaacacgcaaaacaaaaaatacactcaactttttcttagcttatggcttgtctttgccggtattcacaacatcaaaacagtgacctttttactaagtctgtgattcacgcaaaattaccagaacatgtgaaagtgttcaaaggaatttaccaattgatttgcagaggggaaagctaatccatatcattttgaaattcaatccatgatactgagttttaatatctcgtaggcgtcggcaaggtaaaaatacttcatctggaaacaatattcaacatagagaaacataagcttttgttaccacgattatatgcaactgaaataagaaaaataaattgagaaagtatcaccaaaagtctaaaacgattatgtgcagatactgtgttgatctaatgtaccttaacaaagacgagatctcacgtgaccttcaattggtttggtacccatacatggacggtgcataactaacaggatatggcaaattaaacatacattcaacaagttaaaaaaaaaacattcaacaagctgacgatatgcagctctaattgtcactgttctttcaatctcaattcaaaaaatatatagctggcaaatatttctctctctctctctccagatgtcactttgttcttggcagttggcacaagtaacttttagcatatctcaaatctacaacactgtagccggttagccacatcaccatgatgcgaaataatcactccaccgataatgttgctagatgtttacatataaacagcagcaacaaatgtacgcgcatgtgtggatcagtgttcttcacctccagaacacagaaatctaaaatttataatagagaactcaatatcaggaggaggcagctctttacttcatgtgatcattaacatgaaaggaaattcctttaggtttggactttggaactagtgtgaagggattagagcactgataatctctaacttgacagtgagctttgaaacagccaagaaccactggtcctcagcaagggaggaaccactcagctttttgtttctgtatggtatttgtttcccaagagaaaagcattgcacgtataccgttcataagccaactgccctgtaaaaacaataaaaaccaattagtaaaccaaaacaaatggttcaggaagttgagaacaatacaggactaatgaatgcaacaacaaatcaggactggaggaccactgtacctatcgaacctacaatgtcagaatgtacaaaagagcaatatcaagctgaaatccctgctgctttccagtccatgtgagtataaaagcatcattgtttccttcccagccaaattctgtgagcaagttctcaaagttcattggaatgcttagttggtgttacatctttagtgggggcatgttggtagactactgatcgtgatacactgattttttccagtgactattttctgttcacaattattttaaaccaaaatctttttgaatgttttcgctttcaatttgtatgatgatgcttcacagctaatcaaatacaaggaaaattacaaatgcagttaagtttttcttagcttatgtcttgtctttagcagtattcacaagatcaaaaatagtgaactttttatgaagcctatgatgcaccaaagttaccagaacatgtgaaagtgttaaaaggaatgcaccgatttgttctgcaattgtttcctgagtagaaagcttaaatccatataatttttgaaattccatcgatgccatagagcttaatatctctatggcgttggaaggtacaaatccttcatctggaaacaatattcaacatagagaaacataagcttttgttaccacgattaggtgcgattgaaataagaaacagagtgttgagaaaatattgcgacaacagattatgtgaagcaattattgaggtgttgatctaatgtaccttaagcaaagatgaggctgttttgcacctttcactgaggatagggcatcattcatgtgtaaattagcatgcagtcaatagatcacacttcacgcattgacaacttgaacagcaacttcagactctatgctctgattagagccacaactcgactgagcatttctactgaggtatttatccattaactctcctgcctcactgaattgacccatttttgcaagtgcagcaacaattggccaatatgattgattattgctcgtgctgcagccactgcgctcccttgcaaatagaatttctttggccttattgactctcctttcatcacatagagcttttatcagggaattgtatgtgtaactgtctggaaccacaccaaatctcaccatgtcattgaaaatatcttcagctttatctaccttcctcatccggcaaaaactcaagatgagggcattgaaggaatatgcatcaggagtaacgccatctattttcattttattaagaagatcaatagccttgttaacatgccctgctgaacaaagtgtgtgcattaatacattgtaagtctgagcatttggtctaacaccccactctgccatctcttcaaagcaaacaaaagcatcatccagttgatgggtattgcacaggccatcaataagagaggtaaatgtaatgatatctggcatgaaaccatgttccataagcatcttaagaacaacctttgcattatgtacattccctaattttgaatatccacttattagtgtgttaaaggtgacaaggttaggcaagaaacctttgtcttgcatctccttgacaatctcctctgctttatcaactgccccggccttcacgaagcaatctatcaccatgttgtaagacatcacactagacaagagtccctttaaaaccatgtgccccaaatagtggtttgccttcgaaaaattcttgcagttcagcaaggatttgattaccataatatatacatcaaatcctggattcccgccattcttaatgaaagaatctagtaactcacatagatcactcacctccaggcatttcagagcacaagacatgacaatgccaaatgctgtgctgtcaaggagataacccctagcactcatcctcttctcaaactcaactgcctctttggccatgtccttcttcgacaggcaatacagcatcgtgtggcatgcgctcgggtgaagggacgtctcatggcctagccaatcactcaacatcctgtatgccttgtctctctccaagcagcgaaacacgccatgaaccagtgtcctgtaagtggcctcgctcggcgccacgcccttctccttcatcttgtccagcatacggaacgcctcctccaccctgccggcattgcagaacccgtccaccagcatggtgtacgtgaacacgttcggcctgatcccctccccctccatctgcctcaccagccggaccgcctcatcgacgatcccgcgccggcacacgccgtggacgagcgagttgtacgtgaagtggtcgggccggcacccgtcggcgggcatctgctggaacctgaggtacgcggtgtcgacggcccccgccctcaccgacgccgcgatcagcgcgttgtacaccgccgtgctgggcctcagacccagccgcggcatttgcacgaacacctcgtgcgcgtagcgtgcgagccccagcctgccccagctctccaccagcgcgcacaccagctcctccgacacctcgcacccgcaacccctcacctccgccaccagcctccccgacagcaccaccggcccgcgccgccacagcgcgcccacgagcgcccgccgcacgccgccgtcgcgcgcgaagtgggcgccgaaccgcgacgcccacacgtagagccgcacgcagagcagcggctcccccaacccctccctctccgccgccgcacgaagcgcgcggacgacgaagcgggggccgaggcgggggagcgcggcggcgaactcggcgttgagacgggggaaccagtcatcctcggccaagatcgaggcggcgcgggcagggtcggcggggtccggtgggttcgcggcggatttggtggagaggctggatctcggtggggtttcggggcggcgatttgcgccggagaggcggcggcagcggcggcggcggaggaggaggagattggggtgatggatgctcctcatttgcggtttgcatccaacaaaaatcgccgcctttctggtctgggtgttcactaatcactactgcctctctggctctctgaagcaaggagaagcaaggaggtagacctggccaaatgggccgtgccaagacgggccggcccgagcacggcagtactgtagccggcccaggcccggcacggcacgccagcctgtgggccgtgccggcacggcccgttatcctgtgccgtgtttgggccgatgcctcagcccgtgggctggcacggcacggcacgtttactgtagcgtgccggcacggcacggcccaggcatggcacggcccaccggcccatttatttttcctacgattttctaatttttcccatatatttctcatattttttatttttttccacattttatcctatttgtaccatatattttatgatatatttcctaaattttcctcacatttatcctatatttatcatttttttcctttatattatgttttttctgccttttttctttttttcccttcaaatttcaatttttatgggccacatgtactagtgggccggctaccagcccacgtgccactacagtagccgtgccggcccggcacggcccagcaccttcttgggccgtgcttgggccgtggccttggcacgtgggccggcacggcacggcccgctacaggagccgtgcctaacgggccgtgccctagtgggccgtgccgtcggcgtgccgtgccgtgctgggccgggccgcccgtttggcctgctatacaaggaggagcaagtaagtttttttttttttacattaaaatatatgacgccgttgacttttttccaacgtttgactatccgtcttatttaaaaaatttatataattataatatattttattatgacttgattgatatgaaatgttttttaagtatgacataaatattttcatatttgcataaaaattttgaataaaacgaatggtcaaatgttgcttaaaaagtcaacggcgtcatacattaaaatatggatgaagtattttctccatttcacaatgtaagtcattctaccatttcccatatttatattgatgttaatgaatctagattgatatatatatatctagattcattaacattaatatgaatgtgggaaatgctagaatgatttatattgtgaaatagagggagtacataataaaaaaatctaacttaaaaagagaaagaatgccaccctcctatcctagtacaacgaatttgaataaaatattctttagattcgttgtattgagtttttttttacaaaggaagtactgttttaggcaaagagtatactgtccatgaaaaacttagctgagtacacacttcatcccataataaatcaacttctagaaacgtatttttaggaagtattgattataagaaatactttagagaacgatatactccattccaactatataggataatcccaaaacgtcttattatataaaactatcataagaatataaagtgtttatctatattcataactaagagcttagtcggtttgaatgaaaaaccgatgattttggattcttaagaattaatttctagaagtgacatttaatttgtaggaatgatgtataggaaaaccaaaaaaaatcctcttggagagaaaacatatgaaattttttatccactcatgcgtgcatgtattcctattcttccattttttttcttattgttgtgggtcaaaaatcctcccaattaacaagcatataagggagtaatatggaatggatgattcggtcttttatgtatgccttagtgacaaatacagttatactcatcagtcatcacacgattttacttctattgaatggccttagcgtgatatcagtatatcacacgccatataggatcaattcatctatacattcataaggcatgacaattagatatttagatagcctatttagtttacatgcagtgtatagtgtggctttgcactcctctctcctcttatatatacacacatttttttttgttaaaaatgatataaataatgtttctctgtgccatcttttcttccaactatgaaaagggtgagatattgaagtgaaccaatgttataaaaatgtttattccaacaaacggactatatatgatttaaggtttaggagatatggagcagatagatattcatacagcgagatagaatgacttcattcagtgtcatttagtgtcgttcagtgtgattagttattttactatgtattcgatccaataactcatcgggcactacaagaagcaggtcatgaagaaaaggttcatttcatacatcgtaaccaagttagcttcacagcatcaaacctaagtagaggaatatcacaactctagtatatgattgatgtgagatgatgggtatgaagtattatattgtttttcgttatcactacgagaatgatgctataagttataagtgctatgaaacaaaacactataaggcttaatataattgtgatgtccattttcagtgacaatacatgtcaaattttataaacaagagtaaatttgacaaaactatatgaatgttgatcaaactatcacaaaactatatatgtaaaatgatgtatcacaaaactacatacttaacatcaaatttatcataaaagtacagatttaaggccaaattaaagcatcacaaaagtacagatgtgataatattaaatttgtcgcaaaactacagattttagaattcaaatccctagcaccattgttatgttggagctataagtgttgtaattttgtgactaaattgtttctaaatatacagttttgtgataattttggtactaaaatataattttgtgacactccgtcttgaatgtgtagttttgtggtaaatttgattttaaatttatagttttgtgatagttttattattaaatattccctccgtttcaaaatgtttgac

SEQ ID NO: 58824 - DNA, 4510 bp, Oryza sativa
tatctttatggcaccatcattgtcacataggagtggggttttgggaaggatatgccatagtccaacaatgtttgtttcatccaaagcaattgggcacaacaactacccgccgaaacatattctgtctcggcagtaagagggctacggagttttgtttcttggatgaccatgacacaagggatctaccaagcatttggcaactactggatgtgctctttctatccactttgcaaccggcataatccggatcggaatagccaacaagcttaaatttagcaccttttgggtaccacaagccaatagtagaggaatgctttaaatatcttagaatccttttcacggccactaagtgacactccttaggagcggcttgaaaccgtgcacacatgcaaacactaaacatgatatccggcctagatacggtaaggtaaagcaagctaccaatcatagaacgataaagctttaaatctaccggtttacctccctcatcaaggtcgagatgcccgttggttgccataggtgtcttaatgggcttcgcatcctccaagccaaacctcttgagtagatccttgatgtacttggtttggctcacgaacgtcccattcttgagttgcttgatttgaagtccaaggaagaagctcaactctccaatcatggacatttcaaattccctagacatcatatcaccaaattccttgcaaaatacctcattagtagaaccgaatatgatgtcatcaacataaatttgatacacaaagaaatcatcaccaatgatttttgtgaaaagagtgatgtcaacttttccaattttgaaatcctttgacaaaagaaaatctctcaatctttcataccaagccctaggagcttgtcttaaaccataaagagcttttgagagtttgtaaacatggttaggatatttagtatcttcaaaaccgggaggttattcaacaaagacaagttcggcaatttcaccatttagaaaagcacttttcacatccatttgaaatagttttatatcaaagcatgatgcaaatgcaagaaggatgcaaatagcctcaagtcttgccacgggggcaaaagtttcaccaaagtccaaaccttcaacttgtgtgaaaccttgtgccaccaatcttgccttgtttctcaccaccaacccgttctcatcttgtttgttcctaaagacccactttgtccctatgacattgtggtctctaggtctttcaaccaaagtccacaccttgtttcttgcaaagtttttgagctcttcatgcatagcattcatccaatccggatcacaaagagcttcatctacatgttttcgctcaagacaagaaacaaacgagtaatgttcacaaatcgaagtgacacgagatcgagtttgaacacccttactaatgtcacccaacacttggtcaattgggtgatccttggaaagagcggtgtgtatccttggtggcataggtggttcttgtgccttctcctcctccacttcaacttgagcttgacttggcatagcggaagtagatggctcatcttgagtggaggtggatggcttgtcttccacttcaataggcttgacatctccaattgacatgttcttcataactctcatcaagccttcatcacctacatcatccaaattctcgtgcccctcttgggagccattagtctcatcaaattgaacatcggcggtttcttccacaatacctttgttcttgttgtagacccggtatgccttgctttttgaggcataacctagaagaaacccttcatcacaccgactttcaaatttggttagtctaacaccctttcgatgaatataacatttacaaccaaaaactcgaaaataggcaatattaggcttcctcccaacaattacctcataggaagtctttttcaagacacgatgcaaataaagcctattggttgcatggcaagcggtgtttatggcttccgcccaaaaggaatcggaaacaccatattcatcaagcatagtccttgccatctcaatcaatgtacgatttttcctctccactacaccattttgttgaggtgagtaggtagcgaaaagttcatgtttaataccaagatcatcacaatagtcctcgatattggtattcttaaactcggaaccaatgttacttctaattttcacaagagtgcaactaaattcattttgggccctttttgcaaactttttgaaaaggtcggcgacaatagacttatcatgcaaaaagaacacccaagtatagcgagaataatcatcaacaatcacaagacaatgactattaccaccaatgctcttataggttgttgggtcaaacaaatccatatgcaagagctccaatggtttagatgtggacatgatactcttagtaggatgagaacatgcaacttgcttgccggcttgacaagcactacaaagcttatctttctcaaacttcacatctttcaagcccataactagatcacgttttgaaaatttgctcaattgattcatgccaacatgggctagccttctatgccaaagccaacccaaagaagtttttgcaactaaacaagttttcaaatttgcttcactagaattgaaatcaaccaaataaagatttccatatctaaaacctttgaacacacaagacttgtcaagaaggctagaaacaataacttcttgcgggaagaaagcacatgacaagctaagatcacaaatttgagcaaccgaaagcaaattgaaatttagagatttaacaagagagacattatcaattgacaaatcattggagatagcaattttacctaacccaattacctttcctttgctattgtctccaaatgtcactttctcttgttcattccttcctacctcaaatgtggtgaacatagccctatcaccggtcatgtgttgagtgcatccactatcaagcacccaatggctcccaccggtgtggtagttcacctacaaaagaagatcaagctcttttaggtacccaaacttatttgggtccttggaggttagagaccaaagctttgggcacccaaatgtcattctttttaccaccgagtataggggaacccacatatctaggaacaatgctaccatcatgagccttcctaagcatataatgagaatcaaacatgcatgtcttaggaggcttaccaccggggcaatcattcaccaaatgcccaacctcacgacactaggggcaatacttaccattgctcttgacaaaacgagtggcacggtgagaaggtttcttacccttctttggaatgaatccaagtccctccttgttaaggatgcaccgttgctcactcaaaatcttgtcaagagtgttcttacccttgaagcacctctccaacctcttgttgagcttagccacttgctccttaagctcattgttctcaacaacaagtgaggcatcacaaatagatacacaagagctagagctagagctagacatatccacaagatcatcacaagaggtagaaatgctagatgatgcaacataagcaatatggaaagtagcactatcatcaagcaaatcacaagatatgccaacatcaattagagctccatgttgagtagtggaaaggaggttgtcatgagcttccttaagcttctcatgagaaatggtgagtctctcatgagaagtctttagctcctcatacaagacctccaaagaagcatgatccttctttagggccttgaacttgacaatctccttctcactataagcatggagctcctcaaacatactcacaagctcatcataggaaacatcatcacaatcatcatcactctcactatcactaagagatgttaccttagaggagccttttgccatgagacaaagtggagcgaagagtgatggagcctccttgatggcaacaacggccatcttcttcttcctggagcttgcatcatcaccatcttcttcctcggacccggatgaggcgagctctcctcatttgagtcccattcctcgatgaaggcctcaatcttcttgccttccttcttgagcttcttcatgagcttgtagcctccactcttcttcttggatgacttgtctccatcatcatccttggaagggcacttggaagcaaagtgtcccttctcaccacactcaaagcacctcaagttggagagagtcttgttgggtcttctatttcttctcctatttgagttggagccctttcctctctcctttctccttcccaagaaatcattgaaccttctagcaagaagggcattctcttcttccaagttctcattgacttcattcaccttgcccttgcccttgtcttcaacttcggcttagagagtaatgcacttcttggaaggtgaggcttcctccatttcctttttcttcaacttatacatgtcattggtgttgatcttccccaagaggcttgccggtgtcatccttgacatgtcggagttgatgagcatggtgacaagggtctcatacttctctggtagagccctaagcatcttttgggcaacctcaagatc

SEQ ID NO: 58825 - DNA, 13633 bp, Oryza sativa
agccttcccttcgtgtttcacctcgttcgacatcttctctctaggcggtgaagcccaatcaggagagaccaagctctgataccacttgtaagatcgagatgtcgactagaggggggtgaataggcgatttaaaactaaatgacacctaatcaaaactaacctaagttgctaggcttggtgagggtcaactctaactatgcaactaagttaggttttgcaaacctagggtgatagaggctcaattatatctctaggaaagtaactcacactcctatgtcaatgtttagcaatcctagggtgatatgatctcaagtttgtctctagaaaagtaaattgcacaaaagtaaatgcgacaatcaaatgagacaaggagacaagagatttttcaccgaggttcggaaactcgtcggtttcttactccccgctgaggcgagcccaactccaccgctcaaccacgtagcctccgcacgcccccttcgtcaaggggtgggcatggcgggagccggcccatggagaggactacccaagcctcgatcactaggttagttctttcttcactccgaaggtggtgaactccaaaccactcacaaaccggcaccgggcctcctccacaatcttctcggagaggtcaccgggcagggcacgccggtgagaccgccactatgtggccggtctgaccgcccctggtcaggccgaacccagtgaatgtgtttgtgtgtgatgaaaaagtgagcacaagtgataatgcaatgacctaatgtggcaattaaaatcatctctttgctaggtcattacccctcttaatagtacggcgaaactagaaataaactagcaaatttgatcgccctacaccctgatcaattctaaattaaagcactagttttaccgtcttctttctctttgccttgcgccgtcaattttaatccatcgatcgtcatccatgtgcacacatgacgtggacctaacttaaaatattatctcaaagacaacggttagtccacaattagcgcttgtcattaattaccaaaattaacaccgggggcctcgatgcttcaacgtaggtgttagaacctaatatcacaagtgttgcaatacctcacaagtattacatgatgccccataggaatcatctgagaaccataggtatcagaacgtggtatcacaagtgaaaggatcttgatatcacctgcggaggggggggggggaggttgaagaggcgtttaaaactcgtaagtcaatgaagaagataaactttttggatattttggaatattttcggatattttggaatattttccgatattctgaaatattttgggatattccaaaaatctcagattttttagcaagctagaaaggcaaacaaaaagggatggtgtaacaggtagttaatgggtttgcacaaacaacgactaaactactagcggcaccaaatagcaaagctagaggagtaagaaaaagatatcatcaggattcttgcaagttgatgtgttaccaaagatcaaatccttggggggattctacactttgttgaggagcccataatgggccgggtcttttccaactctatcctcgctcttccctttcggaggtaagatccgaccttcacatactccctcggcacaccacaaacaaatcggtatctcgaggtttactcctaaccatctaggtgtcctcaaccaccaagagtaacaaatgccacagagatttcttggcgatgaatcgagtgctcaacaaatcttcacgaagtcaacaccaagcactcaaacaaactcaaatcaaccactcacgcacacacacgaaatctgagattgaagatcggtggagaggaagaagtgagaaggcaaaggctcaaactgaatctcaaatcaacacaagcccagggcaaagaataagaaatagagccagcagccctagcttgtgggtggagggggttatttatagccacagcctcagatatgcccgttgatggcaaagattaaatttttccaaaattctgaaaatcacaagaaggcaattgcatttcagcagcaatttttgtaaattccaaaaagtgcataattcagcagagaaaaaagcattttggaaataccaaaaatattttagaaaaatccaaaaatcacaagagaacaaaatcaactttcggaaattccgaaaaccattttcggaaaaatcctaaaaacaccagagagcaaaatcaacttttggaaattctgaaaaataccagagggcaatttgctggccttatcaattttgaaaattccgaaaagatctttcggaaattccgaaaatcaccaaaatgtaaaatccaataatgagaaacacttcgaaaggatttttgagcaccaaactcaaaagcagatagaaaagttgtaccaatatgaacaccttcacaccatcttctttctttgcttttatcgatactaatatggttgatacttagcaacttatgacttcctatggcctcgatcggtccattggtgtttggcaaggcattttctccttcaccactgcgtcggttcctttgcgccaaacatttgcttgatcttctcccatgcatggtccatcgcgtagcaagtcttgccaacccttcaccacctcttgccattttccgtcacttgtagaattggatgacaatgaaacctcgttgtattgcatatttttcttcatcatcttcattggttcttcatcggacaaatcccttgcttatacattcaataagtgcattaatcccttaatcgtttgtcatcaattaaccaaaacccactaggggcatagatgctctttctacaagtattgcttggtacctcgcaagtatacctaatatctcatagtaatcatccgatacacatcattatcaaaaactgatatcaagtgtatcgcctaatacctcgcaagtatcacctggtagctcacaggaatctaaagcacgactgattggagacatccccaatgcctaggtagatgaaggctgagatttgcctgattctcaagttcagagagaacccttctatgttgcatgaggtatccctggttggcttcagaaagaccttgtcacgaaccttccccgcttggctagtgagggagtaagatcacgtctcgtgggtaaagcatgcaccctctgcagaggattatcaaactattcgaacggccgtgaccatggtcatgggcaaatgtgaggtgattcctctttgcatagatttgtttgcctatactttgtgaaaagtgtttgtgggattgggaaccattactagaatcagtcatgatgagtaatagaggaccattacgtggtctgaaaatgatcttgtgtagatcggggtgtcgattggcattatagattaggcttccctagtggaagcagtgtgtgctagagattatggacaactcttggagccaaagagatgagtgatgagatgggctacccgatggtttgaaagtgaaaagaaactgatagttgagaacggagttagaagctgcttgatggcagaataatgttaaccaactaaaatttgcttcgtccgtttgagttgttgtaaagcaatttgccaacagtatctaagcaaaaacttctttctgaccccatgattgagggcacttagtggttcgcaaaatgttcttttaaaaagaaatggttgcgaagtaaacccagcctcccttcgaagtcttcatgctcacgtttctcatgacttgctgagtgttggtgatatgccctagaggcaatcatagagatgactgtatcacatactatgtttacatatttatccgacattgttccttgaaatagataactcattattggttaataaatgtttgattctttcatgagactcttgatgttgaatgttactatttctaaaggatccctgatcatatatcatatgtggaacaaatatgtttaaatgatcagcacatgtattagttgatgatcatgtctcatggatcatggtatagagataccaaattgataatgtggatgatgtgggaggtgaggtcccgaatcaacttctttgatcatccatgcattcgttatgctcggcctcttttccttcgtccaagcaagtacatctgtaaacgaaaatgtttgttcaagtatataacaagcaaatctaatatagaacatatgcacatttggttgattaatacctaaggtagtcatggttatatccgagtgttaacaaccaaatttggtaatttcagtatcggagatggagataaagtcgaagcggaatccaagatggagatcgttccgcaaacagagcaagaatcggctaaagtccgaatcggctgtgaccgggatcggcagagtccgaattggataaggttagctgattaagccgagtccgataatatggtgaggtacatgttgtcgggttaagttaatgtgcttcatgaggattgccacgcatggactaagtcctgagaaggcaattgtatctattaattaggatattttatgtaatttccttagagatatgtttgggcaaaagtctgccgcaaagacttatggtatcttagtttgttagagataaaagtcgtgtccgacacgggcatattttgtaaatcttgggtataaatagaccccgagccccatgtaatatgataacacacgttcaatacaatctcagcgcaccgccacccttttactttcattttgtttcgacgagttcttgctttcgggttgagctgcatcggtttcgatcttcaactagaggtaaaacttgttatggtggcttgcgttctcggaattagggcttccatctttatgatactctaatcttgttcatgtaattcgttgagttatcatatatcctatataatctccggcaatatcgttatctaacccccaattggctaatgtctgttactaaaaggcagccgattaggttaaataccaacgttgactaggattatataggatatccaccactctatgaaacatccaatggcttgattgtctagatattttccttcttttcatacttatagctgcatcagttgagtttgaccttgtaagtcatgattagaatctcaatctctagcctgcttttggttgccgattagtgtagcatcggggtttcagtcgatcttacctaatttaactacatttatcttatatgcttgattgacatgttaaattgccctttttgttaagatcttgttgcatttaagtatattaggctttcgtttgatatattttacttgctttgatatctcaatatagagtggtattggagtattagccgatacatgctagatctatctgatcggctatgctatgaacgtatatagtcttgttgttaatatatatttcgatctaagtgatttatactgtctcggcatggcgaccgatctgtcccaatcacttgatttaagtatatatcgacacaaggattatatattgttaatatctatagccgatcgagtagatttaattttttcttacttgttcatgattgccgatcgatctatatatgacatcggctcaaagatgaatgatatgtcatcggcaattagccgatcggctatcgtttatggatttaaccgcggtttctttgtctttatttcttgttgattgcaggatcaaatcaactggcatgctcattaacctaaaggcaagatttttggacctacactgaagttaagcagatcttccaggcctcgtttttttacatcaacaccgagctagttatgttctcatcagtggacacacgttggggaacttgttgttggatagacccaactcgagacactgcaagagccatatgtgttgtgtcatcagtgatttcatttagtgttggtgttgaattcttagacatgagattatcatggttcccaacatatgtagtagcttacttagggactgctaaacgctaccccataattgggtagttataaaagtagttttcgggtatgctatgaaacatgtagtgggatatgaataatcatagtgtgatttgcccctcctatggagagatatctctgggcccctcaatgttatagattatagagtgcatggccatgccaaaggtgattgaggagtgtcacgccctaaaaatcctaaatgtataaactgttgtttaattggaattgttagaaattattttaaaagcctacaagctaaactctaattttctaggaaaattttcaacataaaaatgagctccgtcgttccggagtagagcgtttccattgaggaaggttccgaagcgtttgcggaagcccaaggcaagtcacacagatcccaaacaaccctttgagcatgttgaacccgtttaaagctattattttatttcaacttatgcattattttcgaatgtcattgggtggtgaacctttcccagttaattgttggccgaagatgactttattttcctatgggttataatttgattagcatgaaccttatataatggattggtccagctaaatgctatatatatgtttgcttagccatgcttagaaacattagctaactaaagggattaattataaactatgttatatttttattaatgatggttatattaaatggtagctcacgatggttaatcgtgtgaggttaattaattgataattaaaacctggttaaggtgggttgtgagcatatggttttgatggttgtgctcatgacaattaaggaccggttcgcgagctactgttgtgaaacatttatcgtgccagccacaagccagcgtgggcaacggctttatcttttgtatagcgtgattcattatagtgcgccagactgagaagtggcgagaagtccacgggggtcgctggggagtccaggtgtcacgaccggaaataacccaacgggcgttcctgacgtgcgtgcattaatccttgtcccaggaggcaaggtacaccaaaagttgatacaattcagagttcaacaagcggaagcgtaaatagttaacttattacatgggcagcgaaggcccagcacacacagagacaaacgagaaacagcggaagactagggcgacgaccacaggcgcttgacggcaggcacgagctagacaccaaagccttcatcttcaaggagctcctcttgtgggcttgggaaaaattgagcaagactgagtacaaccaccgtactcaacaagacacacccacaaatgcagaataaatgcaagggagtacaaaggaattatactataaaggggttagggttgcagtaaacagcatttaaagacgtttagttgctcaaagctattttgtaaacacgattctcgaactatacaatattaattatcaaggccgtgaacccacacgaacctgccttaacccaaggcctatgatgattcagaccgaactggcaacccgaccctgggtcccagctcgtcccaagccaacccaggccaaccattccacattttagttgttaagcaggttttaagaattgaaacgctaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagctgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccattccatagtatccagatgatatgaatatttcccaaagtctatagttgaaaaaccacctaatgttacctaattaaattgcgaagcatctacctaaaactaaactagtggtgccatgagtagagtgtccactagttgaggttttgtttattctagggtgaacaaggtaataataacaataacaataataataaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccatataacagcagaaacaaagcataaaaatgggttcttggcttcataaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgagggagagggcgcgcggaccgggtccacgggagtggggcccacgcgtcagcctctcggtccatggtggaccgggcgcacgcggctgacgccggccggcgtcgtgggtcccacgcgtcagccgcacccgcgggcgcgggcggctgacggccgggccccacctggcagccgcgggacgcgcccgaaggcggccttgccggcacggccgacgggaggcggcgcgcccgcgccccgatggtcgccggcggcgacctccggcgcgacggagcggcggccgagagaggggagggaagggggaagtgaaacggcggtccttggctcaccccgggtcgacggcggtgacggaaacggcgaccgaagcggcgagaggcggcggcgcggctcgggttgacgaggacggcggtgctccgacggtcggcgggcgaaacggaggagtggacgaggtcgacgaggacgcggcgaagccgaaggaggtgacgccgagacgggaggaggtccggggcgactacggcggcgaaccggagctcggcggcgacggcgaagagaaaggacgacggcgcgggctcgattccgatggggagagaaagcggcgagcggcggaaacggaggagagaggctcggggagcgattatatagcgtcgggagggggagagagcggccggaggggaaggaatcggcctgcggaaatctcggccgccattgatgcaccggcgaagatcgcgggagtgaatccggacgaatccgagggagagagagaggggaaagtggggggaaagagggagggaatcacggggagtgatttccccctctttatggcgcgcggggacggcgggatgcggcggattcggcggcggcggcggcgctagggcacgggcgggcggcgggcgcggcgcgaggtaggggatgacgggtgggccccacccgtcagcgagggtggcgggcgggcccgcccgtcagcggcgcgcgcgcggggaggaggccgatgggccgcgggggagaggagagagagggagggagttgggccgagccggcccaagagaggaaggggggggggggaaaaggacttttagggatttttctttttataaaacccttttaactttgtttatttcttctcaattattatttgtgctctgaaaatttcactaaaatttatttacgcattttaggcttttaggaaatacacaaaaatcctccaagccttatttgacttttatatttgcacattttaattgttggaggctttcacacgaattttaattattctcggcacaatttcgaggatgtattttagagtcgttttaggacgcgacagggtcccagctcgtcccaagccaacccaggccaaccattccacattttagttgttaagcaggttttaagaatttaaaacactaacttgggtacattgctaggcttgcccataaccgagggcgcggctattcgaataggttatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccaacctacggccggaacctccgggacaggtaggcaggattgagcccctagcagcaggacactagccctgtgccatgacatctcgactaccgggccgcagctcgtgtagccttcatttgtcctagagatgtccatcgacccccgacttcatccatctccatccgtgtacttttgtttataaccagactgagccacaaactaagccttacccactagacatgtggaagtacggtagtgctttgcaacagaggcccgagcttaatccttatattggccggggtgctacttcccacaactggcatgcacccaaaccccaccggaaaacaggttttaggggttttgaaagaggaagagaggggtatgtccaattccaccataatccaacaattccataatgtccaaatgatatgagatttcccaaagtctaaagttataaaaccacctaatgttgcctaattaaacagcgaagcatctacctaaattcatactagtggaaccatgaatagagtgtccactagttggggttttgtttattctagggtgaacaaggtaataataacaatagcaataataatgtcttaacaaaggtaaataggcatggctaaataaaacagtgataacgcgggaatttatataaagcgataatgcattaatttaaatcaaaataattttataaactgggattcaatatgctcaaggatgatgtgacttgccttgctcagagagaacggccttccgaacctttggcgacgaccgcgaaccacgcttctggaacctccggaacgacagaagctacgcgaagcacacaagcaaagctacaagcctataaagaaacaataacaatacataaaaagaaagcatacggttctttaggttataacaaacattaggagacttgaacgggtcgattcagagctcgtatgaccaagatatgatcatccaaagtttaatgctgttatatggagatttgcggattattataattaaactttgcaactataaaacatgtgtaagcgctagcctggaaagacaggaaggctgcgccgttgacatgcggacctcacatgtcaacaaaaaggaccgcggtagaccgcgtacacagagacggtccacgggtcgacggaagcggatcccgtgtgtcaaccgaggcgagtggccgacaaacggactccactagacaccacacggcctgcacacgtggaaaccacgcggctaccgagcgggcacactaacacagacactacacggtcaccacccgcacgcgtgaacgactaccgacaccggtacacgggtaccggggtcgacaaccgcacaacgggtacggggtgacactgaaaggacgaggacggggcagcgagaggacggatccttaccaccacgcgacgaggcgtgggaacaacaacgacgaacgggcgcggcggacggcgagggaacgacttcggcggcgatccttggacgaaggcgagacgcggccggcatgaggcttgacgacgcggagccgaggacaaagacgacgacggctacagcgaccttgacgaaacaccgaggacggacgagaacggctcgacagagggacgaacgccacgacgaccgggaacgacgggaggacgacgacgacgacgaccggggccggcgaggagacgacgagggcagccggcagcggctgcacggaggcgaggatggcgtggaacacgccgctgcgatgtcgacgacggaggcggcgccgcgagatgacgagccggcgaggatgaacggtgacgacgacgacgaacaccggcggggttcggtcgaaggggaggcgaggccgagggcgtccttgacgctgcgatgccggaggtggagacggcgacgtcggccggcgcactggcacggcgaaaggggctgccggagtgggtgccgacgagaccgaggaagaggcggcgcgcgtgacggcggtgagggctagggaccacgggagatcgcgggagtgggctaaaacgatagaacggagcgaggggattccgttttatagcggagggaagcgagccgggcatgggagagggcggaacggcgacgggaaacacggccggcagccatggaaggcggccgggaatggcgcggccgttccgggcgattgggggcgccattcaaggggaaaaacgggggaaatcaaagaggaatcaatggggattaattccccccaatcaatttggaaagagccggcttgaatggagcggatttggaggaggaacggcgctagggttcacgggagagagaggaaggaggccggcggctggaggccggggacgcgcctgacaggcgggacccacgcgggaggcgcgcggtcaacgcgcggcaacggcgcgcacgcacgcgcacgtgcgcggcacgggagggaggcgcggctcggcttgggccgggcgaagccgaggcggcccaggaggagaggagggagaggcagcccgggagggagagggtggaggagggagtgggccgagagggggaggggaagagtgggccgggaggaggaggagaggcccgggagaggagggaaagagagggaggagagggagactttggccgcgggccaagagagagagaggaaccttgggccagacttggcccaaagggaaggagagggttatttttaggttttcgttttattaaactttgataattgtttttgttgcttaataaatatttccggcgctctgaaaattcaagtaaaatttgagggctccttttagaccaaggagaatttaacaaaaattctccgggccacattcgaatttttcttgtacgtattttagtgtttgccaatttcttttcgaattttaattaattctattattccttttagaaaatgatttttattttgggatgaatttatcaggacgtgacaccacatcatgtcaccatgtgcctcaataccaccacggtacctcggaaaggagttgtgacaataacccttgcacaacataacccattacagcgcacctttcctggatcataatcacccccttataaacaaggcctggtgtcgcgtcccaaaacggctctaaaatacatcctcgaaattgtgccgagaataattaaaattcgtgtgaaagcctccaacaattaaaatgtgcaaatataaaagtcaaataaggcttggaggatttttgtatatttcctaaaagcctaaaatgcgtaaataaattttagtgaaattttcagagcacaaataataattgagaagaaataaacaaagttaaaaaggttttataaaaagaaaaaccctaaaagaagtcttctttccccccccctcctctcttgggccggcccggcccaactccctccctctctctcctctcccccgcggcccatcggcctcctccccgcgcgcgtgcggctgacgggcggacccgcccgccaccct

SEQ ID NO: 58826 - DNA, 884 bp, Oryza sativa
attcctgcagccccataaaatcgcattgagttatacttctaatgtttttaatgtttgatgtggttaatttatcttattaaaaaattatacgaatacgcacaagtatatcattcttaaaatacttttaatcataaaaaaataattgtctagtattttttaagaataaatcgataagcagagcggtaaaagttagtatagaaaatcagtgtttgtaggagttctataagaaaaaaatagtatttttttcctttttcataatatattgaaccatatgagttgtagaatatatttttaatagatgacgccgttgatttttgaataaatgaatgaccattcatctccttaaaaaatttcatacaaatatataatatataaatcatgtttaaaatatttggtaaaacaattcacaacaaaatagattataattatataattatgtaagttataaataagacgaatgatcaaacgtgcgatgaaaaatcaatgatatcatttattaaaaacagaggtagtactgaaaagaattaaactgtgttcgggaggggcctggcatgcaaaacgatgttcgcattaactcgggattaattaagtattagctaatttttttaaaaaaaatagatcaatatgatttttttaagcaactttcgtatagaaactttttgtaaaaaacacaccgtttagtagtttgaaaagtgtgcacgcagaaaacgagtgtgaggagttgggaactccagcaaagaacgcagcctttagatttagtcatctaaattgtagtttccgaagaatatgtctaaaagtaaaaggatcgatatgacatgtattagtgaccagcggagtatatgcaaaagcaaatataagagcaaggtcaatagtgcagctagcag

SEQ ID NO: 58827 - DNA, 6195 bp, Oryza sativa
cgccacctctttaaccattgcagcccgcactattttctcctctatcatcttgcccacctcttcctctccatcaccctgctcaatatcatccccaccttcaacctcccgctgtcctatttccccttcatgcatagccggctgcccttcctcatgcattactttatcacacacctcctccaagagacttacaacagccccatcaatgattttcgaagccatttctccgaaaaacttttcctgcaccccatccataccttggttcccattgtcaccactgaaatttccctccatcttcccctcctctttgtcatctaacaccatatcatcactcttcgacctcttggtctccttttcccttaattcatcctcctcttgacccccatcctccttatcatccccaccatccccaccttgctctatctccacctcatctccactttcgtcatatcccttcttttctaactcaaactcaagctcaaagtaatgatctccaatcactacatccaccctcctaggaaccaactttggacttaaaacagccatgaaaattcttccaaaggtattcttccttgtggttttcatatccaccatttgggtagcacccaacaaggaccctaccgcccaaagtgtgagatattcccttaatttcttcctcagcccgtacacctttacccaaactttgggcaaaaggtacccttcctcttcttcaaaccattcctcaaattgcaagcgcatcccggtggctaacccattgtccttcacatcagcccctccaaatgcaattgctcgttgaagttcaactttcgatggaaaaagaacaacaaaagagttatcatctttctccgttggctaccacttccacttgttagacacaattctttgttgttcctccaccacttgctcctttagtcaaaacacctcctacacatgataccaacgccatcttagtagtccccttcttactccttggcagcgggttgtgtggtatgtggtggaaaccaagtccctctaccgagtaacctaccacttgaaccgctggcttaggaagcttcaaaacagggcagcgatggttcacatggtccttgtaatcacatatgtcacaataaatctctgtgctgcaatttttgaagcatggcctttttgaaaacatctcgagcatactttccctttctctacccctagttgctgatcctcaaacaaagatggatcacactccatctccacaaagtccccattttcttctttcttctcaaccattggttgcttctcctttcttgccagcaccaggacctccacctcccccactttcacccggcctgcaccaccattcctctccgagctagcagctccccccttctcctctccctttcttcccatatcatccattttcctctcaaaagctggacgttgtgacccgaatcctcttgctgaccctctccctggtcttcctgcaaaaccgccgcaccttgggccaaagccacgagcccgtctcgggcggtaaccatgcctctgccacctttgaccgaagctaccctgctgcccaaaaccatagcccggatcaaaccccatgcgacttccctgaaagcctgttccaaaaccttcctcctcctccctgaagctacctctttgcccccaatctttgttgctgcacccatcgtaatcatctttcctccttgccatccctcccttccgaacctccttctcctcttcggctctaacctgcagctcgccacctacacacagacccccttcttcgctgcctctttgcctcccctctctattgcgaatgtttagccctagctgcgactgccgcctcggtcgctcaatctcccccttgttacgttccttccgagccaaagaatggcggcccgcgtgcgagaggagtcggcccaacactgaacaaaatttaacatttactcccctatatctcccttgccgatctgcaacgtgggaccatccatattagtgccgccgtggagaagactcgaacagacagacgcctcgtcttcttgcgctaattgtcgaccagaaaactgaagactacttgccttatcgaggttccccgagaaagtagatgcattaacatcctctctttttgagaacttcgccggcgttttttctaaccctgccgtcctcttcctctgccaatcctcaagcgctgctgagaggaaggtttcaagcttcctgggttgcgagatccgccgtgacggcagaggtcctttccagggtttacacatcgaaaccttcttcctgcaaaccgcagccaccaatctatctacaagatggttcttccccttcgtccttgtgctccctggaaacgaatgagcctttggagatgaatttgtacacaacaaatactctcccgctgaaagaatttcatcaagcgtgaaaccttctgccatagccttgcgtacgatgcttcctttttgaactgatcctaccacctcctcttctcggtgacaaacctgctcttcttcctcctcactatcttctccatcgagcacccaaaaacgtgaaccaatagccctaggcctagtttcacctctggtctcactagcgaagtgttttgttggtgcggaaaaactgtccttaggacacaattccaagtcacacgcgaggttcacctgtgacggcattattggcaggcatacttcttcttcctcctctaccttcttctccctttgcaactcatccctcaaaccaactagaggctccctcgtcatcaccggctgtggccaactcgccgagctggctgccggagccaaggtcagcctccgaccaccatagccaccgaccatcctagcactcatcaccacgactgctcctccaaaaaaccacatctgccgctccttcctccgagcagacagcgaacagcgcaagaaacgccgttcgccggcagccagcgccgccgctcgctgtcgaccgcttagcctgactgccgtcgcacaccgccggccaccggtcgccgaccactgagaagctgcctcttgcctagcccttgctagctaggtccagcttgccaggtactgaaattggacgaaaaaacgagaaggacgcttccgccgccgaccgccgcacgccgctctccggctgtcgcgtcgccggctgccctccgccgctcgtcgctggcagcaggcctccgagcctggcaaccaacgcacgccgccggctccccgtgccgccggacgacgccggtaaccgaccgccgaccaccgtgcagctgcctcttacctagctccagctagctaggtccagcttgcatggcactgttacacgaaggaaaacttacaatgccaaccgccgcttgccgtcgaccgtcggccaccgctcaccggtcgccgccgatcgccggccgccagccgccgctcaccgctgccccccggataccgaggttgcttagcgtgtggtaccaggacagttagtgtcaattgctattaattagacatctaatggcttgtaagccacaaaattaatttcactctacatgtatgaatataaagatggacgaagttggaacaaatattaccatatgtcccatacatatatattgcgcagttaatattctaattacatgtgttaagtcatttaaaattcatgaaaatgctctcaagctgcgacgtggtgctctaataaattagggcaaatattagaaattctaagaaaaaaaatcaaagtatctatttcttgattttcacttaaatcgttaggtccaatattataaaccattagattaaattgattctagaacaaactaaatactacgaggtcccacctctcctcccgcggcataggtacgcacctacgtacgcttcccctccctttttttcattttttctccttcttttttttcctatgcatatgcttccctccctttattcctatatcatacgcctttatgagacgatttaatcaaaagaattttgagtatcttgcactcgcatttttcatttacggtcatactacacggtatatatatagatggactatataataattaactagcaataccttttaataatataagtgcccgcacatacgcgcgggccaacttcctaatttataagtaaaacttttatatacatgttcttagcaatttaaaagtaaggctgaaaaataaacttcgatgaaaaaaaacgccaaaatgagttttaaatttaaggttgaagatttaaattttgtttgataagaggctttgcagcgggtggcaacggatgtggtttaccagtggatggtgatgtttttgttgccgttgttgtggacgttgacgatgacgaggtcgccctttcgcgcgtagatggtcgggccagggaactgcccgttcacggtgaggatgctcttcttgtggcacagcctcgtgtagttagtctccgtaatctgcagatctcatcacgcatggttaaaactcaaaactcatttcgtgcattcattaattcctgtacatcgacgacattgatccgcgaacacgctagaattcaagtagatcatcacttgcaaagaaatcgtagtggcgagtcttggcgccatgagcggggttaactactgcaagtgctaacaccatgcctgctagtaaccaaagcaataatgcaggtatcttgcctgttgatcccatcgccgaacgcacacagtattcaatctccaatccaagcgtataagaacacacagagctaattgagattcttgtacgcgcgaggtagttatttggttcttcgcagtagctaactagctagtgccgtaagctgctgctttgcctgagatggccatcatctgacgaatatgtatttatagggaacgcatgtatgcatcatgcatgaacgtgacgactgatgactattctcccacgaaattagcaatttattaatcgttctccagccgccacggcgtgaaaacgttaaaatggcgtgagttgattggcgacaaaactgacggcatcttgaagttcaaatggctcccgaacgagaaaattacatatctaccatcgcataagaattgcttcgctagaataccatcattaaaataggcttcactgaaataccactctcaaaccatgggtgttcactgcaatgctatttttgtgatttcttgcatttcgaaattatttttcctcaattacatattttcttggaccgttctacccctgggtcacatgttgaatcacatggtggctggtgtgaatctcgcgagcggagggtgaagcggcgatgccggtgctcgtgcggacgccgcgccgcggggcaactgacgggtgccgcgtctgccgcgctcgtcgtcgcctccgtcgcgcgaaggagggtggcggcggggaggaacgactccgacgccgcgccgggggagaacacggcgctgcgaacgcgcttctacggctgcatccgcgtgttcctcgtcctgtcctgctgctgctcgccgtcgaagaagtggtgtctctcctcgccacttgcttctgtcgggagaatgctctcgaattggaatttcagatagactgttcattcgcttgtcttgccacattcataatctgcctgaatcaaaatattcgaattttgagctgtaatagaaattcgatccctagttctagtttttctctgcgcgaattgaacaggaggattctgttcttttgggaattcggattttgtgtggactctgcattggattgggttggatctttgacctgtgttcctctttgacccgtaaatgtttctggatggtttctgaaattatgaagttgccgtgatcttgcttgctccatacggagtacactataacaagaacataatttggtgttttaaaggttgaatttcggcatctgcaccagcaccggcgtcgccgcttctccaagggtagaatggtccgagaaaatgtgtaattgaggaaaaataattttgagatgcaagaaaccaaaaaatggcattgcagcgaacacccacgctttgagaatggtattctagcgaagcccattttagtgatggtattctagcgaatccattcttatgcgatggtagatatgcaattttctcctcccggacatgcgcatcctctgtttcctgcttcttcaaccaaatcaacactagatgtacatgttggttaacttaattaattttgggcatatgggagcagtcgaggttgttaacgaaccgatgccctgtttagtttcaaagttttttttctaaactttaaacttttcatcacattaaacctttcata

SEQ ID NO: 58828 - DNA, 7342 bp, Oryza sativa
cctctgatcagagtattaatctattcgaatagcggcgccctcggttatgggcaagccgagcaatgtacccaagttagcgtttcaattcttaaaacctgcttaacaactaaaatgtggaatggttggcctgggttggcttgggacgagctgggacccagggtcgggttgccagttcggtctgaatcatcataggccttgggttaaggcaggttcgtgtgggttcacggccttgataattaatattgtatagttctaggatcgcgtttacaaaatagctttgagcaactaaacgtctttaaatgctgtttactgcaaccctaacccctttatagtataattcctttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctctgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaagttggtatcagagccaccgttgaccctaggacgagccgtagatcccaagccttagcaatattttcaaaaataaaaatcttttgttatttgtgaaaactgtctagtctctctctgtcttgctgcttcatttatcgccaaaatctgacctttaaaatgttgtttttctttttgtttttgtttgtagatggccagcagcgtcacccgtcgtggtttggacatgactggcttcgtcttggagctgcggggcatgtgcgtggtcttggggtatccacatggagtggactaccaggccaggccgcttccggagcaggagggtgacgatgcagagccccacgctggttgggaggtcactgcagtgatcctgtctggctctcccgagcggacttcgctggcagtcaccgcgggtggagattccttccccgccgcttgccagaacgccgctctcctcgctatcggcactcttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgtatcgacttccaccagatggtacgccgtgggatggtcgagaacaacatgaagatcctggagctgcgtcaggagaacctgcagctcaagaaggacctagacgcggtggaggcgcagctgcatcagctcaagatcgcccagggagaggtctgccgccccaagcgtcgccgcgtctggtggagccgttccaaccaactgatgagttgcgaagccaacccgctcctggtcggtgcactgaatcaaccctagcttcttctcgattgtgcgcaaccaatcactggcttccataggatcgacggcaatggcaaaggttggaggctcagttttgagaaattctgataacttgcactgttgccggactgtaggcacttgaacgttggttgtccctgctgggctgctccaattctgtaatagttgaaaggctgttgccaacatgttggtttggttaaccacaacttggattagctctggtgaggtttcgttggtgcttctctcattcccattggcttgggttcttgcgtcatcggatccatcattcccatagcctttgttaccagtattatccatctgtcacaaggtaggggttgagaggggaagcatacaaggaaagaatagaccagaactagggacaagaccttaaaggaactaactctttttgttgatgtgttgtttgtttcacttattctgcaagttgattaagcaaacaacctagcatggttacatcaccacccaccgatgcaaaccacgcgctacacacacaagcaaggaacacacgactaacaacactaccctatagggtggcttaggttctgcgacgggttcccaagatcttcactccttcacagctggcttcattgcttccttcgcttcgctagcggatcctgcagtcttccggagcttcggcaaacaactgacgacatcttcttcctcgcaaagctgaccatctagtactagttgaaaatccgaagaaggaagaacggagtaaaccttttgcaaatagcattaggggaaggagaaaaaggaactttcgcaaataatttttatttataaaatatgtccttgggttttatccacttggcttatcctacagtcgagatggctctgataccagcttgtcgcgaccgggaaaattgccttttcccgaacgccagtgtattaatccccgtcccaggaaaagccggggtacaccacacaaacatgatatagaagacacatctttattatatcgataatatttacattattacaaaggcacttcaggcctgacaagcaaaaataaacagcagcggactagcggcctacggctccatcttcacaggcgctcaactggggtataagccaggactccacctaagacatcttctccaaagcttctcttactgaagggggggaaagattgagcaagaatgagtacaaccacagtactcagcaagccacaccggcagatgcataattaatgcaagggaggtacaagggaataataatatagggattaaggtttgcagtaaacagcatttaaaagtcacttagttgcccaaagccattttgtaaagacgatcatagaactacacagtattattaaacaaggccgtgaaccctcacgaacctgccttaacccaaggcctacgatgattcagaccgaactggcaacccgaccctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaccataattcaacaattccatagtgtccaaatgatatgagaactcccaaagtctaaagttataaaaccacctaatgttgcctaattattcagcgaagcatctacctaaatttatactagtggaaccatgaatagagtacccactagttgaggttttgtttaatctagggtgaacaaggtaataataataacaatagcaataataatgtcataacaaaggtaaataggcttggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccacgaaccacgcttcgggaacctccggaacgacgaaagctacgcgaagcacacaagcaaagctacaagcctataaagaagcaataacaatacataaaaagaaagcacagggttctttaggttataacaaacattaggagacttgaacgggtcgattcagagttcgtatgaccgagatatgatcatccgaagtttaatgctgttatatggagatttgcggattattataatcaagttttgcaactataaaacaggtgtaagcgctagcctggaaaagacaggaaggctgcgccgttgacatgcggaccccacatgtcaacctaaaggaccgcggcagaccgagtacacagagacggtccacgggtcgacggaagcggaccccgtgtgtcaaccgaagcgagtggccgacaaacggactccactagacaccacacggtcaccacccgcacacgcgaacgactgccgacgccgatacacgggtaccggggccgacaaccgcacaacgggcatgggcgacaccgaaaggacgaggacagggcagcgagggagagggaaccttaccaccacgcgacgaggcgcgggaacgacaacgacgaacgggcgcggcggagacagacgggcacaacggaggcgaacggcgaggggacggcttcggcggcgatccttggacgaaggcgagacgcggccggcgcgaggcttgacgacgcggaggcgaggacgaagacgatgacgggggctgcagcgaccttgacgaagcgaggacgacgaacgagaacggcttgacggagggacgaacgccccgacgatcgggaacgacgagaggacgaggacgacgacgaccggggccggcgaggaggctacgagggcagccagcagcggctgcacggcggtgaggatggcgtggaacacgccgctacgatgacgatgacggaggcggcgccgcgagacgacgagccgggcgaccgacgggacgtcgacggcgagaacgatcggagacgacgatgatggcaggcagcagcggctgagaggaggaggggacagcgtggaacacgccgctgcgacgttggtgaaggtggtggtgcagcggggcgacgagccgacgaggaggaaggagaggccggcgcggagacgacggcgttccggcgaagttcgggcgaggaggaggtgatgccggggatgagagcggcgtcgtggagccgaggaaggtggtggcgacgtcggccggcgctccggggacgtggcagaggcggccagaggcggagaagtggtggcgacgccactggacgccggcgagggcgcgtctccggtgatttccccgcgaaacggagggctgaccgagggagagggggcagctgcgaggccgagggagaagacggcgcggccgggcggcgctcgggcgaggagaggaaggcggctggaggtggccggcgcgagggaaaggggagggcgacggcgggaacgcgcctccggcggtcaccgcgcgaaacggagggtaggccgtgggagaggaggcggctgcgatgctggaggaggcgacggcgcggccggaagacgctccggcgaggcgggagaggcggctggaggccggccggcaacgtgggagagagggggcgacggtggggaggtggctagagaccacgggagagctcgggaagaggctaaaacggtagaacgggggatgaggatcccattttataggatgggggagagagccggccacgggaggagcgggaacggcgacgggaatggcggccggcggcaaaggaaggcggccggacttggcgcgtccgttcccggcgattgggggcgccgttcaagggggaattaagggggaattgaagaggattcaatggggtttaatttcccctattcaatttggaaagaagggcattgattcgcgtggatttgagggaggaagggattagggttccacgggaagagagagagaggtggccgggcggaggaggaagaaggcgacggcggcctgacgcgtgggccccacgcggtcgggcgcgcggccgacacgcggcaacggcgcgcacgcacgcgcacgtgcgcggcacgggtgggagcgcggctcggcttgggccgggcgaagccgaggcggcccaggaggaggggagggagagaagatgggccgggaaggagaggagggaggggcggcccagaaggaggaggagaggagggagtgggctgcccgggaggggaagagaggcccgggagagagagggagagaaggggagggagagaaagagagggaggagagaaggacttttgggctgggcttggcccaaaggaggaaggagggttatttttagattttctttttaataaactttgttaattgttgttgttgtttaataattatttccggcgctctgaaaattcaagtaaaatttgagggctcgttttagaccaaggagaatttaacaaaaattctccgggccacattcgaatttttcttgtacgtattttagtgtttgccaatttcttttcgaattttaattaattctattattccttttagcgaatgaattttatttcgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctaacaacacttcttcactctggactgcttggctcgatctcctgttgcagatggaatcttctcttcacctgacttgtccctggttgaacctttagctgacttcgactgggttgcggcacttgaagatggggcttcagttccagaactttgcatagttcatatctttggagtcaacctcatacaagttacccacttcatgtcatgcgtcgagatcagctcgtctttactaagataccatgcttgtcataacttgtcatcatttagcattcaacgtattcctttacacctttgcccttgatgtgttctttcccgatttctcttattaatcacctttcgacctacttctttgcctggtaataaacatctttttcgatatcttctatcagtcatcttttgaccttggtcactaagtactcttcactccgagagttgtggatgcttctggtggcgaggaggtcctttggtctgctacctttcagtgaaaccttgaagtgtttcgccaaaagctacactgactgtcattgcctttgatccggaaaagacacatctgaaactcttagtccaaacaaatgtctctttggttaatcacctgattttcttttccatcctcaggttggttattagctcgaggttagaatatagttc

SEQ ID NO: 58829 - DNA, 23739 bp, Oryza sativa
tatttttagttaattattatttttccatatctatatgcacgtgtctggtcataaaaccaaaaatatttgtgaatcctctttagagaaggataacatttcttactattagcttattttaaaaccaatatatataatagattaactataaagttggctataatatatttcttctctctctatctctcatttatatatttaatatatttgtcttgtagcttgtgataagctaactcttgaatgagagtcaatacccttaaattttttgggttcatctcagcatggaaattgttttgcatcccttggtaacaaatgaatggtatatacagtatgtgcagtagtacttttttattatttttattttttttaacgttttcccgtctcttgggctagtggcccgactctctcatccctccggcttccggaatccccaccgccgaacgcacgatttcttcccgacgctgtcacttgctctccccccacatcggcggcggcggaggcgcggcggttggcgtcctgcggctgcggagcgagcggagaagccaaggtcgtgtgttgggtgaactcccagcctcggccgctcatcggggagggcactgctgcacaagggaagcggtttcttggttggggtttagtgtctgcattggatatgagtcacgggttcttggttagattctgaagaggttcttggttagattctgcgcatgatccaaattccgtagaaggataaacagattcgttgagtggcaaagaagaggtggtaagcagatgggtgtggtgacaaggggcaagaagaggaggctggatgatgaatccagcaacccacaactggcgcctcgaggaggagaagacctgataagccgcctcccggacgatatcctcaccggcatcatcaccctcctccctaccaaggacggcgcctgcacacagatgctctcgcggcagtggcgccctctctggcaatctgcgcctctcaatcttgaggccagggtcaatggctgcacgttgggaaaggatgtggccaccatctacagcacgctgctaacccacagtggtccggtccgtcgattctccctcagctagggatgtgacgactgtaatggtcactttcccgtcgccgattccattgttggatcccccaggctcgaccacctccaggagtttgaactgttctatgatagcgttggcgttcaaaatcctccggttccaccgtcggtactccgtctatcttctactctccgtgttctcaggattctttcaacgtgtgacacacttcagtttcccatggagactgcttgcacgctcgatttcccacacctcaaggagctcaccttatcccaagtcaacattgcagatagcattctccatggtattctttcacgatgcattgtcttggagagcttggtgctggatgcgaacaggggttgtagtcgtctccgtatcagctccttgacccttcaaagccttggtgtgtcagatacttatttctctgtagagggaatgctggaggaagtcattatcgaggatgccccgctcctggaaaggcttacaccaccagttatatggcatgaaggctttgttattcgggttattcaggcaccaaaactgaagacattgggttatctaagccagaaaatttccacacttcagcttggaaacatggttttccaggtagcttcatacacatatactgcaggcatttctttctcttgatatgttatttcttcacaacatttcattcaccatatctatttcagaaactggtgcctgttagtctgtccaatgtgatgcgcgctatgaaaattttagcccttcacaccgctcctgatctggatgttgttattgacttcctaaaattctttccgtgcgtggagaagctatacatcgtggtgagagttttttctttgttaaattcagtgagtacacactcattttgttctattgtgccatgccatcggccctcttcttgaatctatggttatatcatgtttctttcaactctcttttctccttgttaggcattaaatcagggaaacttcaagaatgtacggcgatatgtttcacttgagtgccttgatctacatctcaagatggtggaatttattaactatcatggaaacttatcagatttgaacttcatcaagttcttcgtgttaaatgctcaagtgctagaatgtataaagtttgtagcctgtcgtgacaaatgtgatgcaaaatggattaaaacacaacatcagaggctacaactttattccagagcttcacgaggcgttacacttgattttcaagctgattatggggtggatagtttggtacacgtgaagcacatcagtgatttgattacagatgatccctttgatagatcgttctgtagatgccgtgatgaggaaatatgaattcctttgaagctgtttatcagttgtatactttggtaagtttgaagcgcatttttagtttacacgcctaaaatttattattttggcatattttgttgcaagcctggaatatttattgtgccaaagaaggtgaatgacattgatctattttagtttcattcctctttctgtgtggtatgactctgtgttcctctcctattgtacacaaaactaggctaggttggtgttgttattgtagttttaattccactctgagctacatcattcattcttgtttttagtacctcattttggcatcaatgcagtctcacaatttcattagaattttggtttctgttttgaggtttttcgtcactggtttaatgctgtcagaatattgttttatgtgctgtcagaatatcgatattggttcatgaactttacgcaagtgccggtttgatacacactatattttcacctcaaatggatacaaacaagttgtaagtaactgagttatattagcaaatttgaatggtcaagaaataatagatatttacttttaatttggttttgtcatggaacatttatgtaacgacctagtccaatggcagtaagcacggaaggagattctgaatattgaatccattgtaagccaagcatcaacattgttatttttattgttttctttttgtgccacacggggctttagtgagacttcagttttaagttaagatattcgtctgtaagtttgagattccctttatagaggattgatgaagacactcgatctaaggcctctgcattctttaccaccgaattatgaaagcaatcctctcaactgtactatttgtgtatgtaccagtagtaagattgcaaatttgtcttgttttcatgctatgtgtggtacttgaaagacctaattgcagtattattctacttgcaggtgtatggtcatattgtcatattgatattgccaggcagaaaagactgctactgctacggagacaaccgagtgctgttttgtattctgttagacccaaggccaccttttggacaattcactggggatttaagttgtgacattattgtactctatatatagtaagtaagtaagtttgtgttttctctcaaatcctgtggccatgctaggactcatgtttagactgggaataaccacttaatgatcagtagtgggtagttttaagttgcttttatggacaacttagtgtatgaatctgatggattagtgcgttaaatactatcggttcaacgaaaacggtaacctccttggtatgatgggattaggattggtgacttgcaaaagatgaatgtttatgctccttggtatgatgggattaggcattggtgagttgcaaaagatgaatgtttatactgttctaacttgcaaaaggaaaaatcctcctagatttcctaacctgcattttggatcatgtgcgtgtagcatattaggaatttccgtgatattatttggtaagcggtaggccagtttaagaaaaggaaactagaaaaatatatcctgtgcattgctgtggtaattacagttagacatgtctaaagaaaaaaaaaactaacgcatgaacagatttatttttcatgatctatctctcctcttaattaggacccatctatgcaacccactatggatgctcttagtgcgtagtaattctatcagtgttgctgtcatattttgttcgcacgaacacagttcaaatatcaatccatttcgagatccaaagaaaagaaaccaggagctaggtataaacgaataaaacatttctcgtgacgcttcaatcctaatgaaattattgttgaccacaggtagagtcctcaattttttttcccgaatgttactcgataaataaggagtttccccgaaacagaatcatctagatctgttacttgataaataaggagttaaggagttaagctagctgcatgctttttcattccttaaatcatatgacatccttgttccctcacacaatatatataaacctcgttcttgttatatatgcttgtctccatgatcagttcgttgcacattcaaaaacgcatgatgactatatatattggtttattacgcatgatgactatatatcggtttattgcttcaaaaactcatgatgactatatatatcggtttattgctatgatacatgtgatttcttgataggtaaacatcatatttagcactacgatgagatattggagaggtaggatgagatattggagaggaggtcatcatatttagcactacgatgagatattggagaggtaggatgagatattggagaggaggttaccaatagatattggagaggagggtaccaacaagctttatttaacagtaggatgctatgtttatttaacagtaggatgataaacagtaggatgctatgtttatttaacagtaggatgatatgaaatattggagagagataatggagggaggtagtaggagatatgagatattggagagaagtaggatgatatgaaatattggagagagataatggagggaggtagtaggagatatgagatattggagagaggcaaagcaatgcccgcatacaatgtgaattataccgacattcattttgtttgatgttcttgcagatgcggtgccgcatataatgtgaattataccggcaatcattttgtttgatgttcttgggtatgcggtgataaaattactgtcgtttgatcctttgatagattatattatgataagttctgtattgattataagtaagaaaagtataaacaattgtacatatatgctgaaaatcaccccaaagagaaatgtccaccaacctttatatattttctctaaatttgtgaaaaatgactcaaatttgtgaaaaatgattctaatgtgaaatctagacaagatatgtgatatagtctctctcccttcatgaaaatttatactcagactgtatctaaataaacgtatcgtattagtacgagaagaactgaaaaacatattattacgagaagtatctaaatcaatgtatcgtattagtacgagaagaactgaaaaacatattattacgagaagaaagaagaaatgaaaaacatattattacgagaagaaacaagtacgagaagaatgaaaaacatttctaaaagaaccaacccacgagagaaaagagaagtaacccatgagagagaagaactgaaaaacatttctaaaaaaacatttataaaagaaccaacccacgagagaaaagataagagataaggaagaaaagagtatccaacaatggagaaaagataagagataaggaagaaaagagtatccaacaatggagaatttgttattcatttacagatattatttaatccattgatccatatatgttctaccgtacttgcttttctaagagaatctgtaccatctttaaactcaaaggttaatttgatccgtgtcattgcaaatgtatctattctgatgaatagcataacaattcgtctatttgtagccgtgccacttaaattttacaaaattggaaccataccatcgttgtcacattttctatcttcttccccatattgcacgtaggacccaccagtcagattccatcttcttcctcatcctcccttatcttcttccttcgacgggaggagtggtggggtacagtcggtgcggccgcgcccacatgtgcgggctcccccaacggacagccaacacgggcccccaacggcggcgcgggtcgtcaacggcgcggaggaagcgctcggccttaggggtgaggtgagcccacaggagtggctggaccgacccgttcgggctatggaggcaccggagcgcctgcacgcgttctagcaagtggcagagttggtgcccatcgcgcatgcgcgggggcggccgtcggcagcgcgcccccctcttgctttgttgtgtctccactcttcatccacgtcgcgttcatcgagactgcctccggctcagatgcctcatgctcctgctccaaccccaagcctcagaagaggccgacccggactcctcgcctccacggcagcgatgggacggcaccagccaaggggaggacctcagcgggaaccgaggaggctgatgacagcagcgacgctaccttcacctctgacatgtatatgtcggggtcctcttgttcgaggtgcggtgatcgagataaatgcattgttatttctccgcatgcactgcttgtcatcggctcattgctgatttcatgtctacggctgttgttgcagctgttctatacgttcgagacgatggaggagaagatgcgagcaatggcgaacctaccgcagtgcgtcttgcctccacagttgttgctcaagtggcccaaggaagcatcattctgtcagttgttgatgcaccctgtgccggacacctgaccgaaggaagaaggtaaagaaggatgaggaagaagatgaatctgacgggtgggtcccccagtgcagatggagaagaagatggaaaacgtgatagcgatgacatggttctaattttgtaaaatttgagcgacacagctatgaatagacgaattttaatggtatttatttgaataggcacatttacagacatggatcaaattaaccctaaactcaaactgtttagatctagtaagtcagagtgttttttcactctgaggatgcatgacacctgtccgggatatacatccggcagtccaagaacatagatgacgatggtaaagcttaaaaattataatgagtgtacaaattaaaagatgcgatttctttgtacataggttagacaacaagcatgcagtagaatatttacagagggcacaaccaaattgatcgacacaaatttgtatcgtacacccgcccactaacatatatgagaagaacgatgatcgacacaaatttgtatcgcacaccagcccactaacatatatgagaaaccatgtttccggtctcagtggcgcagctagggggccagagggtgccaacacccccctatccaaacaccaccacctagtttttactctatattaaagttaactaagataggtatttatctagtttatttgtatagcttgaaagtattatcagtttagttagttagcaagtctataaatattagcaagaaacatgatctataaaattagtttgtgatttctcatctttttcaaagtaaaatagataatacttatttgtgagattgttcaatagtttacattgaaagaatttagcaataaaaactagtttcaaactttcaatgatattattaaagagctaaaattcaagtttattttaaaggactagtttacgtattgattgttattgatggttactatttgacctcatttgctatcaatattagttattcggtatcatggcttatgctcaccccacacccccctattcttaaatcctggcttcgcccctgtctggtctaccaacttatcagaattactataacgtatatgcattttcagcgcacttttttttcataaatgaaagttttcttactttcatataaaagttctttgatgaaaggctttcacataaaatttttcggacgaagtgtgtgctagggataaacctacgctaaacagtagtaccccagcttattattggccacttcataagtttacgaagtttttttttaaaaaaaacaatggtttactgatagtagaaagcatggcgcatcaagcctcacacaaaaatctgatactcctagttcccaacggtaggctataccgcccacagacatcaggtcttgggcatcatgcacgaattaatataagtatgctttcggtggtacttcctccattttataatataagtcattctaaaattactcatattcatatatatgttaatgaatctagacatagtctaaatgtggacaatgctagaatgacttatattataaaacggagggagtagcaatcaaagtcagtgacaaattttgatagtaccaacccactaacacaataactctactggtgtagtggtgtggttctcaacttatcatcacatacatatagaatatacgttcactttgccatcttattgtgattcatcatgcatgaaattaattagatactagaggaagccaaaaccatatccatatgtcctacattaatgattttgccaattacaagccatgagaaatatactaggggcggaaattttatgagatcatgtaggatcccctttgatgttcacttgatattaaaagaaaggatatgataacgtttgagctgctaatcatgttaacagatgatattttgatgatgtatagctcaatcgcttatttaaattaaacagggtgtacggagagagagtatctatgctcctttcaaaaactttagtttatgtaaattgacccatgatattttctgatattacgtaattaatagtcaaatatttggttcagtcaaataaatagcataagatatttttaggcgaagttccatttcacctaaaatggaaaaaaatggtatttcaaccagtcgacatcgtttgaaagtggcatttcaaggaaaccacactgtgaagtggcattcgagcaaaacccaatctcgaagatggcaaaaatatcaattttctcctctctaaagtaaggagtaaagtaattatttttactattaattactccgtaatcaatatagacaatgggcttagttactgccttagaccaggagtatattgttcatgaaaaattatcctttgtttataagaaataactacctccatctcaaaatatatcaacctagagctggatcggacatattctagtccaacgaatctggatagccccttgtccattggactaggatatatcatctctagtcctaaattgctatattttagaacggagggagtactagacaacgatactccatttcaacaatatatgataatccaaaatgtcttatcataataatatgaaacagagatgattctttcttttatgtaggagtatatcttagtgacctttacgagaaactagcatttggctcttgcgttgcaccgagattttgattaaagaaattatcattaatccactatatcatctgtgtgctgcatatatttgttaatagtatgcgaatcctttagcctcaaaatatgttccttttgcttaaaaaaagagtttggtggggtcgatcgattgacacgcagaccctctagcatccagtccctttttcgtgaaaataaagcaaaaagttgataatggagtggcatgccaccctcttttaatagagatatcaggtatagaaaatatagctttactcatcacacaattttccttctattcaatggcctttctttcacacaagatgagcccactatcacacgccatataggatcaattcatccctacattcataaggcatgagaattatatatgtatgcatgcagtgtattggcgggtggttttgcactcctcactcccttatatatacacacatttttgttaggtaaatgatatgaacccatgtttcccaatgctatctttttgatttaacgatgacaaaaaaaaagagatattgaagtgaaccaatgttatcggtaacgctattccgcgctgtattagttcgagtgccgcacagcgtcctctgtttttcccttttttaccacctcatctttcctatgcatcccaccttttctcagttcgtttttttcattttttaccacttcaccttccgtgtttcttcttttccatctcattctttcttcatcaatgggcccaataaaatatcaaccatccagatttttctatttttcgttccttctatatagtttttctgttttcgcggttttagtaccgtctagtttttctttctgagttttctgttttttatctccgcacgtttcagaataacaaatttactcgtttttcatttactcccagcctcccacatttcctcattcagaagtaacaaatttattctcattcagaagtaacaaatttaatcgcatggatacctccacatcgtatgacgccatgtcgtaaaaaaaatactattaccttacaacactagtaattcttttaccaatattataaatattgtttagatttcgtggtctgtaagtaaaacaattactaccttcctctcgatatagcgcatgatctcgtagccaccgtgtagtattatgtttactgatgtgttcaatacataatataagagtaaaaactgagatttcgtggtctgcgaataaaacaattaccaccttcctctcgatatagccatgatctcgtagtcaccgtgtaataatatgtttactgatgtgttcaatacacaatataagagttaaaattgatactaagagtattgttgatctgtatcacaaaatagtcatatgaatgaaaaaattacaggctcaatcacacacaatcaataaaattactcacaggtgaatcaaactagaaaaaaaaatgattcagtcaaaaatccatttggtggctttattggatcttgctataaagatgaagagcacagtctgtgtcttgtgattggtagtggagagggcaactaggtggcaagcagtagtcggccatggaattatggaaggatgtagtggtgtggtatagagatgagctcgacgttgcacagtattagccatccatcatctagcaagcacgaaaaaaaatacaaaaacattctcgttcatgtcaatagagatgacgagtaaaacaaaaatagtaaacaacatccatcaccggcggactccaccctatcctctgcgcccagccacatggagcacgatgtgcaaatgtaggacctgtgcagcccatcaattgagatcaggtaacattggagattgcacgttaatttgatttgcaaaaaagaaaaaaaaatttgggcttcatgcgtgaagttgaaggagagtatgcagatgcaaatcagagtgtcattttcttacttgcttgttctatcaatgttggcgatgtggagcagccgctggttgttgctattggcctaggtaaacacctccttgctggttaaggtgctgcccagcgtccggcaacgaggcccgaagcagtgctttcacctcaaccgccaccggccaccgccatcaaccgccacggtgttgtcgtcctcctccatggtgtgtcgccgatctgtgggctggggtggtggatcgattcagatccgaaaaaaaggaaaaaaatgaagtgggggcgagagtggttggttgggtatgggaaaaatagaatttataccggaagcagagaagttgtttttatcgaagtaaatcatttactccgataatggtgggagcatgtggggttggatcggaagcagggagttgtttttattatcgaagtaaatcatttacttgaataaaggtgggtggttgaggcgcgcgatacgagtaaatcgtttactccgactttggtaggagtgggatgacaggatgtggggtggggcgggcctgggttgatgcatgtttgacgcttggaatattaggagcacgctgcgctcctactagtagttctaccaatggtatataaatatttattctaataaactagactttgatttaagatttaggagatatgcaggagataggctatctgcatgaattatgatgggtttatgggctctaaattaaccaattatgaagaagaaatctattccatacatagtaaccatttggagtcacacacaagtagaaaaatatcatatgcacatcaacagtctatatgacatgagagatgatgtagaccaaacagtgaagaactaactatcaagttaacaagtctacatgacatgagagatgatgtagactaaacagtgaagaactaactatcaagttgtgccattgtcactttgattcttacagctactgtggttttgttgttgttattttctttcccacaatgtgataaaacactgttgatactaagcgctataaaataaagcttaatataaaagtggtgtccacatcgttatgtcaaattcttcgtaattcgataggtattgtacagacacaaaattagtaacatgggtaaaaataaacattttaggagaaaaaaatgttttgcttccgtgataataataataataataataataataataataataataataataataataataataataataataaacggtaagttacatttttctacgtttccatctatccgtgatcttctgggccagtgggctgaccactggaatccccaccgccgcacgcacgatttcattcccgaagctgtcgcttttctctcccctcatcggcggcggcagcggcggcggcggcggaggagcggcggtggtcgtcctgcggcgaaggtcgtgtgttgggtgaactcccagactcggccactcgtcgatcggtgatagggcaccgctgcaaaaggcaagcaattttctcgttagggtttgctccaaaccatctcgaatttcacatgtctatatggatcgagagacctttttttccactctaaatctactaccgcagaaatttgtttaatttgccccagttggcattcttgcatttccgaacctgcaggggtttacagtctagtgtctgcaatcacttcaacaaaattaaacaagtggttcttggttaggttctatgcctgatccaaactccgcagaaggattcaagatttgggtgcccaattttttttgttggatcacaagaaggaggtggtaaacagatgggtgtggtgacaagggccaagaagaggatgctggatgaggaatccagcaacccacaactggcgcccagaggaggagaagacttgataagccgcctcccggatgatatcctcatcagcatcctcctcagcaaggatgctgcccgcacacagatgctttcgcggcggtggcaactgctctagcaatcggcgcctctcaatcttgaggccatggtcgatagcagcacgatggggaaggacgtgaccaccatcgacaccgtgcttcaagcccacaggggccgtgttcgtcaattctccctcagctggacattggactacaaccacttcttcatcgtcgattacttgcttggatcccctcagctctgcaaactccaggagtttgaactgttctattttaatattgacgctcaaaatctgtggttccgctgtctgtattctgtctagcgcatactctatgtgttcttaggatttgttcaacgtgtgacacacttcagtttcccatggagactgattgcatgcccaatttcccacacctcaaggagctcaccctatccaacatcaacatcgtcgatggggagaggggaggggcagctcgcggtgggaggagcggcgttgccggtggggagtgcgggaggggcagcacgcggtgggaggagcagtgttgccggtggggagagaggaggggcaccaccggtaggagagagaggtggcctgcggtggagggagggaggggaaaaatgaattagggttatggattttttttgccccggcggttttgatggattcagaaacgatctgagccgtccataaaaacgaacagctcagatcgatcccatgtcgggctagcctccattgtcgggccgcatcactgctgggccgcgcacacttcatgggccacgcgtgggccgacggtccaacaaaacacttaggttagacattcggttggagaccacacaacagtgaaaggagaagtaggaggagcccaattagacttcatgttgggctgaacgctttcttgcgggctgaggcggaggaaggagaaggggaaagcgggccgactcaattgcgggctaaagaataaaatgggctgaaaaaggctcagagagaaaggatgatttttatttaaataaatgctgaaataatgtttgtattatcaaaattagcaattaagctatggaaattccaataaaattccaaagagcataattaatcatggagaatttaataaaattaaatccaaccatatcattttatttctcacacttactttacttgtaaactaatttaattatacacctacctacttaaaaaatacccaaatatttcagaaaatttgtatttcaattaattacataatgtaaatctttctcaacttttcctcaattttctggtatttacatttctcgttgcaatgcacgggtacttttgctagtacgtagaataacatatataattcctttctctatccgtttatctcatgacgcaactcaaacaaaggatccaaaatgatccagatatgttctctccgagagtcctgtcctttgcatatcatgcagtattatgctaggattggttgagagaacgtgtgcagtgtgtaacaccaccggtcctagctcgatgtctcctattaggacccttctaattaaatgcaacccactatggtcgctcttagggagtagtaattaaatcagtgttgctgtcatattttgttagcacgaacacacatttcaaatatcaatccaattcgagatccaaagaaaataagaaaccgggagctaggtataaacgaataaaacatttctcgtgacgcttcaatcctaatgaaattgttgttgacaacaggtagagtcctctaaatttttttcgccgaaacagaatcatctagatctgttactcgataaataaggagttgagctagccgcatgctttttcattccttaaatcatatgacatccttgttccctcacacaatatatacaagcctcgttcttgttatatatgcatgtatccatgatcagttcgttgcacattcaaaaactcataatgactatatatcggtttattgcttgaaaaactcatgatgactatatatttactgctatgatgtgatttcttgataggtaaacatacatctctctcattagagagaaaggagggtaccaacaagcctttatttagccggatatttagcactagatgagatattggagggaggtaggagatatgaaatattggagagaggcaaagtaggcaaagcaattgccgcatacaacgcgaactatatcgacaatcattttgtttgatgttcttggggatgtggtgacaaaattgccgtcgattgatcctttgatatattatattatagtaagttgtctattgattagaagtaagaaaagtataaacaattgtacatatatgctgaaaatcaacacaaagagaaatgtccaccaacatttttatattttctccaaatttatgaaaaatgactcaaaatttgtgaaaaattattcttatgtgaaatctagacaacacatatgatatagtctctcacccttcatgaaaatttatactcttatcagactgttactattatctaaattgatgtatctcattagtacgaagaactaaaaaatatttctaaaaccatgccaggaaagaaaagaacaagagcatccaacaacggagaatttgtttctcatttcatcctatgagttagagtttttcaccaaggatggtcaattataaaaacaaagaatattcattttgcagagattatttaatccattgatccatatatgttctaccgtacatgcttttttaagagaatccgcaccttctttaaactcaaaggttaatttgatccatgtcattgcaaatgtacctattcagatgaatgccataacaattcatctatttgtagccgtgccacttaaattttacaaaattggaaccgtatcatcgccgtcacattttctatcttcttccccatatgcacgtaggacccacccgttatattcatcttcttcctcatcctcatttatcttcttcctttgacgggaggagtggtggggtacagccggtgcagccgcgcccacacgtgcaggatcccccagccgacagcaacatgggccccgaacggcggcgcgggttgttgacggcgcggaggaagcgctcggccttgggggtgaggtgagcccgcaggagtggctggaccggcccgtctgggctatggaggcgccggagcgcctgcacgtgttctgctaggtggcagagttggtgcccattgtgcatgcgcaaggggtggccgtcggtagcacgcccccgtcctgctttgtcgtgtctccacccttcgtccacgttgcgttcattgagtccgcctccggctcggacgcctcaggctcctgctccaatcccaaggctcggaggaggcccacccggactcctcgactccatggcagcgacgggacggcaccagccaaggggaggacctcagcgggaagacgttaaaggaagatggtaaaggaggatgaagaagaagatgaatctgacgggtgggtccccagtgcagatggagaagaaggtggaaaacgtaatagcaatgacatggttctaattttgtaaaatttgagcgacatagctacgaatagatgaattataaagtcatttatctgaataggcacatttacaggcacggatcaaattaaccctaaactcaaactgttgagatgtagtaagtcggagtgttttttggttctgaggatgcatgttacctgtccgggatatacgtccggcagtccaagaacatagatgatgatggcgaagcttaaaaattataatgagtgtataaattaaaagatgtgatttctttgtaaataggttagacaacaagcatacagtaggatatttacagagggccaaattgatagacacaaatttgtatcgtacaccagcccactaatatatatgagaagaacaatgatcgacacaaatttgtatcgcacaccagcccactaacatatatgagaaacaatgtttccattctaccaacttatcgcaattgctatttaacgtatgtgtattttcagcgcactttttttttccataagtgaaagttttcttactttcatataaaagttctttgatgaaagctttcacataaaatatttcggacgaactttttgaagtgtgcgctaggaataaacctacgctaaacagtactagggtccccagcttattattggccacttcatacgtttactacgaagtttaaaagaaacactggtttactgcgcatgtagtttccaacggtaggctatactgctcacagacatcaggtcttgggcatcatgcacgaatataagtatgttttcggtggtagcaatcaaagtcatcaacatatataaatttttataaattttgatagacactatcccactaatacaataactctactactggtgtagtggtgtggttctcaacttatccttatataatatagaatatacgttcactttgccatcttattgtgattcatcatgcatgtaattaattagataagccaaaaccatatccatatgtcatacattaatgattttgccaattaattacaatctatgagaaatactccctccgtactcgtaaaggaagtcgttttggacagcgacatggtctccaaaatacaactttaacttcttgtttctataaaaatatttattaaaaagtgatatatgtatacttttacgaaagtatttttcaagacaaatctattcaaataatttttatatttttaaactcaacaacttaagagttattcatgatttatattcccaaggtttgacttaaacattatcctaaacgactttctttacgagtacagagggagtatattggggacggaaattttatgacatcatgtaggatcccctttggtgttcacttcatatttaaagaaaggatatgataacatttgagctgctaatcacattgttaacagatgattttgatgatgtatagcccaatcgcttatttaaattataaacggtgtgcacggagagagcatctatgtactcctttaaaaagctttagtgatggtggcagtaaatatgccacattttaatagtttatgtaaattgaaccatgatattatgtaatagtcaaatatttggttcagtcaaatgaatagcataagatatttttaggcgaagttccatttcacctaaaatgtaaaaaaatggtatttcaacaagtcggcattgtttgagagtggcatttcaaggaaaccactctatggagaggaattcgagcaaaacccagtatcgaagatggcaaaatatcagttttctcctctctaaagtaaggagtaaattaaagtattttttactattaattactccatagtccatatagacaatgggcttaattactgccttaggtaaggagtattttgttcatgaaaaacttatgctttgtttataagaaatagtacctccatatcaaaatatatcaacctataattggataagacatatcctagtccaacgaatctagacaacccctcgtccattggactaggatatgtcagatccaatcctaaattactttattttgggacggagggagtactagacaacgatacccatttcaacaatatatgataatccaaaatgtcttatcataataatatgaaacagagatgattctttcttttatgtaggagtatatcttagtgacctttacaataacttagcatttggcgcttgcgttgcaacgagattttgattaaagaaattatcattaatccactattgctatttttttttctgcatgtatcatctctgctgcatatatttgttaatacttaatagtatgtgaatcctttagcctcaaaatatgttctttttccttaaaaaagagttggtggccgggttgattgacatgtagaccctctagcctcctgtccgtttttcgtgaaaataaagcaaaaaagttgatgatggagtggcgtgccactctcttttaacagagatatcagatatagaaaacatagctagtattactcatcacataattttccttctattcaatggtctttctttcacacaagatgagcccattatcacacgccatataggatcaattcgtccctacattcagaaggcatgacaattatatatgtatgcattcagtgtataggcgagtggctttgcactcctcactcccttatatatacacacattttgttaggcaaatgatatgaatccatgtttccctgtaccatcttttgattcaacaatgaaaaaaaagagatattgaagtgagccaatgttatataaatatttaggactttgatttaagatgtagaagacatggagtagataggctatctaattaaattatgatgagtttatgggtgctaaattaacttattatgaaggaaaagtctattccatacatagtaacaaattagagtctcacagtagtagagaaatatcatatgcgtatcaaaatatctgatatgagagatgatacaaaaacaaaaaggaagaactgttatgtcattgtcactttgattctcatagcgtgatcgtgtcgttatcattttcattcccacaatgtgattaagatattacaattataataataattgtaataaatggtaagtgcagcagtgcaattttttacgtttccatctatccgttatgttctgggtcagtgggctgaccctcttccatcccgacgctgccgctttctctcccctcatcttcggcggcgacggcagcggagggcgcagcagtgggagaagccatggtcgtgtacgtgttgggtgaactcccaggctcgtcgatcggggaggacacgactgcaaaaggcaagcaaattttcttgttagggtttgctcctaaccatctctcgaatttcacatgtctatatgcatcgagagaattcaccccctaataccgcagaaattcgtttaatttgccctattttacattcttgcatttccaaacctgtaggagtttagggtctagtgtctgcaatgatttcaacaaattaaagaaggggttctcggttaggttctatgcctgatccaaatttcgcagaaagattcaagattcaggtgcctgacttttctttggatcacaaggaggaggtggtaaccaaatgggtgtagtgacaagggccatgaagagaggctggatgaggaatccagcaacccagaattggcgcccagaggaggagaagacctgataagccgcctcccggacgatatcttcaccagcatcatcactatcctccccggcaaggatgctgcccgcacacagatgctctcacggcagtggcgaccgctctggcaatcggcgcctctcaatcttgaggccatggtcgatagtaggacggtggggaaggatgtgacaaccatccagaccgtgcttcaagcccacaggggccgtgtccattgattctccctctgctggacattggactacaaccacttcttcatcgtcgattacttgcttggatcccctcagctctgcaaactccaggagtttgaactgttctattttaatatttgaactccaggattagctccttgacccttcaaagtcttggtgtgtcagatgcttgttcttatgtagagggaaagctggaggaagtaattatcgagaatgccccactcctagaaaggcttaccccaccatgtatacggaatgaaggctttgttatttgggttactcaagcaccgaaaatgaaaacattgggctatctaagccataaaatttccacaattgagcttggaaccatggttttccaggtagctgcatacatatatgctgttgccatttctattttttggtatgttatttcttcacactctcatacatttcattcactatatccattttcagaaactggttcctgttagtctgtcaaatgtgatgtgcactgtgaagatcttagctcttgacagagctcctgatctggatgttgttattgacttcttaaaatgctttccgtgcgtggagaagctatacgttgtggtgagagttttttctttgttaaattcagtgagtaaacacccattttgttctattgtgccatggcatcgaccttttttttttaatctatggttatgtcatgtttcttttaactcgctttttttccttgtcaggcgttcattcaggggaacttcaagaatgcactgcgatatgtttcacttgagtgccttgatctacatcttaggatggtggaatttattaactatcagggtaatatgttagatttgaacttcatcaggttctttgtattaaatgctcgagttctagaatgtgtgaagcttgtagccgctcatgacaaatatggcagaaaatggatggaaaaacaacagcaaaagctacagctttatggcagagcttcacgaggcatcacatttgattttcaagctgattacgggtcaaatggttcagtacacatgaagcacatcagtgatttgactacagatgatccctttgatagttcattttgtagatgccgtgatgaggaattatgaattcctttgaagctgtttatctgtcttatatactttggttgtatcaaccgcatgcttagtttgtacatctgaaatttcttgttttgcaatattgcggtgcaagcctgggatatttattgtgccagagaagttgaatagcattgatctattttagtttttttttaactctttctgtttggtacgactgtgtgttgctcctcacctattgtagacaaaactagactatgatgttcttgttactgtggtattcattccactttgagctacatcattcttggttttagtacctcattttggcattaattcgatcccacaatgtcattgcaatctaggtttcttttttgaagtttctcatcaatcatcactggttttttgctgtcagaatattattttgtatgtttgaacatcttcctgtacttacgcaagtgccagtttgatacacactacacagtttcacctcaaatagatacaaacaagttgtaagaaactatgttagcatgaaacaattgaatggttaagaaatagtggatatttactttaaatttggttctgttatggaaaattatataactccctagtccaacggtagtaagcacgaaaggagattctgaatactgaacccgttgtagccaggcatcaacattgttatttttattagttttctttttgtgctacatggggttaagtgaggcttaagttttaagttgctaagttattatttttttatagtttatcttttggtgctacatggggttaagtgagacttaagttttagggctgtgttcttaagtccaagttcccaaccttactctctcgcttacagcgcgcatgcttttcaaactgctaaactgtgcgtgttttgcaaaaaatttctatagaaaagttactttaaaaaattatattaatctatttttcaaactgctaatcggtgcgtgtttttgaaattaatcacgcattaatccattacttcgttttccttgtcagaggtgagggttcccaaccctcaccaaagaacacagagttgctaagttattggtttgtaagggtgtgttcgctagtacaggttcccgggaatagtacgcgcagaaaacggaacggtccattagcacgtgattaattaagtattagctatttttttcagaaatggattaatttgattttttaagcaactttcgtatagaaactttttgcaaaaaacacaccgtttagtagtttgaaaagcgtgcgtgcgaaaaacgagggagagaggttaggaaaaggaggtgcggaacacaccctaagttgagactccagttacaatggtggaatacacatggaagctatatagcctatatatgatataagagtggaagctccaaaggtgaatcaggaatcttggtatgagatgatagtcttctttcccttgaaatggaaaattagaacgaaatattgcttttcttttttacttttggcaggatcaaatattaccatttttaagattccaagattttatagtttggcgtcttgacttttaactattttcatggcttaatccagctcactccgttagtgtagctcaactgcatgcttaaggttcatggtggtggaaactgcctatctatgttcaagttctaaacttggcgagatgcctgtggtaattttgtgaacctcaagatatgacgatccattcttcagatgtactcatatagatatagatagggagtgcatgtgtgtgttcgaaacacaatatatataagcgcctacgtgcgtactgtgtttcgaaaaaaatatcaaagtttgacatgtcacgagtttggatagaaacggtggcataaatttctgagcgatcaattatcatttctgtaaaagtagcacggtttctgaacgatttttaatcctaatgaaattgctattgaccacatgcatgcttcaaatcttgaagcatgcatgtggtcaaaaacaatatatggtataatggagctatgtaaccttactctaacaaaacaacatgggtatatataggaagaattattatatatatacggtagcataaaccacatgtaatcgtcatatgttaatcgttgttctctcacttacccaatatatgcctcgttcattttatatgtgtgatgtgtccatgatcagttcattgcatcgagtaacggggctgcaggaat

SEQ ID NO: 58830 - DNA, 3279 bp, Oryza sativa
ggtggttttcgtgatttcgtcgtagcctagcggaggtaagtaggcacgcactcgatcaaagtctcaaagggcacctttgcatgcgtttggcggccacgaagcttcttcttttttaaaaaaaagaagggccgccaggaagattttgaaatcgactactcctatcaaacactgcactacagtgaacaaatcaaacgccctgaaaatcaactgtaatccaagacaattttactgtaatccactaaaaatatgtcaacgcaattttagtttttccccacaaataaacaccgaaattgctatgcatctattgcaagattttttttgttagagatcttgcaatttttctgaccattggatttttatattgagattcatgttagggacttcccataaaaaaaatgcaaatgcgtgagagaagggatccttaccacttgaccgagttgctgatttcgtagccaacaagatatttatagcataactagaaaggaaacccgcgtatatacacatgaaacttatttattattcataaaaaaatattaaaagaagtcatatctctccatatttattataacgaccgtaaattatcttataataataaaagaaagaaatttttataccgtgaattgactataaacattaatatcttaaatgataagaatatctcgagtgtcacaagtcatcccttaaccattttcatatctattacatccttcgacatcgttagtagcatcctcatatcctccgatgacttcgggcttgttcactttgctatcatttttagcattgctaaaacttggtaaagttgctaaaattttggtaaggttatcaaattttggcaagattttatatgtacttactaaaatttggcaacaaactaaacgtagccaaaattttaacaactttaccaaaaaaatggtatggttaaaaatgcatcaaattgaacatgcccttctttgccccttttgccaattatgcatttttagtctctctcttactcatctttgatgctttgagcatgcacaccctcctaagtcatgagaacttacccatcctccattttcaacgtctcgtactatcacctttccttttcttttagataacagagtatttcattaatcaatgagaacgtctgacatttgcactaactagaagtgcacatagtaaaaaagaaaataaatgtaaaaatgctagacaacatgaacatattatgttgctatatgctgcaatgtgacggctttgctctactaaaaaaagaagaagacatagtaacaatgtaacataaacacctttctaactatttacgcttttttaagctcttttccgttcacttctggactttttggctgtgtgcctacgagtagaggaggcagaggccggagatgtaatccatttccattattaaaaaaactatttacgctgagcgcttctctattgccaacattatgggtgtcattattgttgtctatcttgaaaaaagaaattacgatttgtcatcggagaagaggaattcattgtcaactaaaattcaagtgtttcttaggagattcatacctatataatagaaaattcaatccgttgaaaatattgaaaatatgcagttctcatgttctaaacttgtcattgattatttgttgtagcaccttaaatattggttttgattgcttacgtatggctatcaaaagtgtattaaactcgtttcacatctacactttctttatgttggttatttatactataaaagagaatggagggagtgctatattttgtagtataatcacatttgtgcaatctaaactagcaccaaaagagtggactgaaaacaacatacataataattggaaaaaaagaaaataacttcatcttttcatttatgtttatcagccaaaatttaaatttacaaccttaaattggagttgattttgagattttttttattgtattttattttccagcctttgtttttaattcgttaagaatacgtatataaaacttttattcacaaattatttttcatttgcaaatatattgtttcgcattttccttctatatgcttgacgaaggggccgaaaatttgtttgtattttgaggggccaaaagcccaaaattgggttcattttcaattcacacaaaaatcgcttcccacaccgacacaccgtagtagtagtagtagtagtagtggtggtagtagtagtagtagtaccgtacaagccgcccttgtccgccttcacttccctaaaccctaaaccacccactttccccaatccccacctcaatggaagaagcggacgacgccccgccgccgtggaggcccagcaagccggcggcggccatcgacggctcgtcggggcccctcgccgccgccgccgcgcgcctctccggccgctcccgcgcgctcccatcctcccgcgacttccacttctacaacaacttcccctccttcaggtcccccgtcggcgccgccgccgccagggcgggcgcctccctcgccgccctcggcgccgcccccttctacccgaagcggcacccgccgttccccggggacgacctcgacgacgcccaggactgggtcgtcggcgtcatcgacgacctggccgagcagttcggcgcctccatggacgagttcaaggcggcgcgggaggaggaggaggcgactggccggagggcgacggaggaggacgggttccaggttgtttacggcaagaagaagaagaaggtgatgggcggcggcggcggcgaggagggggttggtagaggtggtgaggcgtttggtggtggttctggctcggtgaagatggccaccagggataagtcggccgcgccgggggcgaaggcgaaggtgccattccacattcccaccatcccgcggccgcaggacgtgcaccgcatattggtggacaactcgagcaagccattcgagcattcatggcttgagaagagcgatgatggttcccgtgttgtccatccattggttagtgttctgctaaataccttacatttgtgctaacctcacatcacaatagttgtccttccttattgcccttgatttgattagtttgattataatgaaaagattccgccagtaaaaagcaatgattttttttatttagtgaagcatgtagagagattatgggattaagagatcagcaagtaatgtaacagctgattatgtgaaaaatagaatgtacagtgcaaatagaagttggtaagatggcacatgaatataaaagaatcatgtattctgctagtggagactatggtattactaatgggcaacatggctat

SEQ ID NO: 58831 - DNA, 873 bp, Oryza sativa
tgaacacagcctaagaagaaatggaaaagtaggacatttccctttccgcactgcaattaattgagatccatcattggacagattagaaagaagtggatgttttcttgttctgcatttatatttctatcaccaaatgtgcaaaacaattcacacaggaaaagatccccatggaacaattggttgacagagattttcctgaaagcgagccgataaagcctcctgctttggatgataccccttttacacatgtcgaagacttgaaatccttggaggtgctagctacaaagctgaagagtgcaaccgagtttgctgtaagttttagtagtagtttttactaaagatattttctttttggcttcaaacaaataatattgaaaatattcagaattctattactcttattagctgagattagcattgtaaagaccagggtttcaattgtcttttttcaatatatcgctgagcaccgtatggacacataggggtattgctttcctattataacttctgaggagtggatgttgagagttaaacaatcatattccatactgcaactgtagcctctctttatatattatatattttggtgggaatctgaagatgaactgttggaagtaacatgtgagatcagttatgttatattgatctcatgatcctatctgccgccaccacgcaactatcttttaccaataactaacaaaagttggtggtgaattgatggattctgcacgttgagcttacatttagcaaccacatttgaaaatttgcatggactagttaagttgaaacttaggaaaaagtccactccccactcaactctttatccggttaattttacaccctgaacttcaacgccaattagttttcatccct

SEQ ID NO: 58832 - DNA, 32367 bp, Oryza sativa
ggaacagcgacaacctgatcgagatggagagataccactacttcgcgtcgagctgccgggacttcgggtcgccgtgggagtgcacgcactccctgtcggagcggggcgtggacgagagcgagcgcgccgcggcactgcgcgtcctgcggcgagtccacgcgggcttcttcgccggcggcggcggcagcttcgtcgcggacgtcagggaggtgatcaggcggacgcggcgcgaggtgctgctcgggtgcacggtggcgttcacccgggcgatcgccagcgacgaccaccactccgtgtggaggagaaccgagcagctcggcgccacctgcgcagacgacgtcggcccggaggtcacccatgtcgtcgccacgaacccgacgacgttcaaggcggtgtgggcgcaggtgttcggcaagttgctcgtcaacccagagtggatcaacgccgcgcatttccggtggagcaagcccaaggaggaacacttccccgtccgttggtaaaccggatcgaagttgagattgtcagttacctcgccaccagcattttccagtgttgcacgtactggtatgccaatttcattgcatcgagcagtatcgtttgacagaaaaccccccttacaaatcttgcaaattttgaaccatccgattgctttaagattcatgcaggcaaccaaactctaaaaatcctctcgcctctctctctcccgattcatcacgcgccgccgctcctccgccctagcgcgccgccgcccggcctcgccggctggccgaatggtgtcaacggcgctcgcgaggcccccccgaccggccccctccctctccctctcctctcctttgcctcaagccggtggcgacgagctgtccgtcgtcttccccgtcgccggcggcggggcgccaccaccggccgcctcctccccactctttccgctttgcccccgccgccgtcctccagccccgcggcttcagcggcgccgccgccgcccgcctgatccgccgggctgccgcctcccacggccatccctctaaagccggcgaactcccccttcttccccctccccctcccccccacccccaccccaccctgggaccctaattcgtcagccctctaccggagtttgggtttgccggcgccggagaagaagaggtggtcgccggagttggagaagaaaagcacgaatcgtgaagcacatctagtgatccaaaatttgcaagatttgaggtaggattttctgtcgacagagctttagcaattccgtaaaactaaactttgtggaagtatctatatattgtcattctttgagactcttatcttagcgacatgcatgcatgcatctagaaaaagtggttgtgccttatattatggaatggagggagtatatactttggtggaacaggaaactatagctaatgatgtattttgtaaggtgcaataacctaagttttgtattggaaataacgggatttatgtctacatatatacatatggcacacaacaccatacatctcatctagtttctttaattatcagcactgagctcctttattagtgggcttgctggaggctagagcccaagcagttaggctgaggaagtgaggatggtgctcgctggctagtctgatatgtatacgggggctaaggacatgatatgtgctccctccgttttacaatataacactttttagcattgcctatgtacatatagatgttaataaatttaaacacatacatatgtctaaatttattaacatctaaatgaatgtggacaatgctacaaaatcttacattgtgaaacggaggaagtatatgcgatgcgtcggctacatcagagtttcatctcgttgagtctgggttttgatcttgcaccttatctaacgttttaaaactttgaccttttggtttctgcaaacaaattaaagacttatgggccttagcctataggtttagacaatgtaggccaagttattgaattgcctacaagtatgaaagtaccaaattacctataagtgcaaaaggctcgttctgtctacaatctaaccttgtcggtggtgtaattatgggcaattagtgtcacccatcgaactgctattggtcggtcaagtgggccatgaatgtgtcatttttttctttccagctaaactcacataatcgtatatatcatgcctctagataggggccacgtaatcatggtaactcaccgtaccatggtaccgaggaggtaccaatgataattttaggtatcacaaatattttattgttgcattatagagatagtgatatagtaagagtatgatgatatatccatggcacccactacttagaatgtattctctatacctatctatacctatctagttcatccccacttagtgtaattgctaccatttaccatttatatgtattctcatgcttccatatcacataaattgatttggacctgcgttagcgaaaaaaaaaagattcaaaccattaattagatcagagcagtgtggtcagatcgatactaaacatcatggtcatgactagacatagctaaaattagaggtagtaaccacttccactataaaacttgctcttagcaagctgtctgtaaggcttttcgggccatatcgtaagaggtttgtagagtatgaagtcaattaaaatggtttggctaaattttggtggagtaaggaatatgttcatgtccttatatattttcacactagacaatgtatgaaacatgggaatttcgctatcgtcacgtcatgatacaataacatctcttgtaaatatatgtccttttattttttggggaaacatgttggcattgcctcagatgttcaggtttggttggcaagagaagagacaagagggtgaagaagccgacatgtgggttccacgctgactcagtcaggttgaccactatcaagttgtcatgtgagccaaaaccggaaactatactgccctagaaccagtggcggagctaggtttggaggaggagggggctcagccttcttcttcctcctccagccccctctctccccccattttcttcttcctctccctcttttccctcctctcctccctcacatttccatggagtccagcagggtaggggggctcgagccccctccaccgctgcctaggatctcaggtacaccaatacacaattcaaacacgtcaaagacgaagggcttaaagtgaacttattccctcaacgcacgcacaacactgaattaagtgtggcgaaaacaacgggaaatcggcccatttcctatatcctggcccaatatcaatccatttttctagggaaaaagtgcgccgaaggtccctcaacttgtcatcgggatacaaaaacgtcctcgaaccgcaaaaccggatatacagggtcccttaactatataaaaccgatcacctgagatcctttggtggttttgaccccggtttttgtctacacggcggctgagtcggtgtgggacccacgtggaccccacatgtcagcgtgccacatcaccacccattacttcccctttcttttttctcttccttttgatacttctctttgccgtgagggagtagcacacggaacaggcagcagcgagccgggttgaccggcggtcgacgcaggtggcctacgagcgcgcggcggccggcgaagcggagaagagcggaggcgcggagtggcggtggcggcaggcgggcgagcgtggtggccggcgtcctcctcctcctccaccgccgcatcgacggtgtgtgccctgtttctctcggtggtcgtcggcgtcgccatggtagtcgtcggagtctgttagcaacccgatgcaccaagcaaatagcaacaatatctaaaccaatttgaggtgaaattgagcaagtagctgagtattacaagcttctagaaggttctatagagggagacaggaagggtgtagtggctggtaggaaggagtagtgagggagagagatcgacaaggttcctgcccaaacctggtcgccgctgccgccgtggccgaagccgccgattgccagttctgttctatttcccctcctctcctgtaagctgctgttgcccttgtattgtttcagcttgggcttgcttgggcttcttggcaacgggttgcctagcggcccatgtgtagcccagccgagaccctgacaatcccttcttcttgaaattcggcttgtccccaagtcgatgaagaaaacctcctggatcgaatgatgtttgaagttcctcttgtaaaacttgatgctcaagtacagcaaccataccaatctgtgtaggagcatcagataaccaggcgttgcatagcatgatcaaccatgcatatatcccagtcattaccaccatatgattgtcccttcttggattgaattcaagtaaaccggccatggagaatctggatagtactgcactaaatgtattccactccaccaccagtataacctcatgtatctcctctgatgcatgtactaatcttagcccactagaaagaaactgaggattgatagacaattcggtgagcacttgccatgcaactgtagctatcagttttgtatactgtagagagtatgtgtgtcgctcaataatctgatccactaaatgtgtttcagccacctgattaagcaagaaaggcaattgatttccatactttattccatagttatcggtgttctgttggctatacatgcattcttcaccttggatgacatttgcattagttggcaacaagcaatctaaagtattagccaagatgagcccttgagcaccactactgtgtaaagccagatctgggattttcttgagtgcatcactgtagatatcatccaagttttcttcaccttggaacttccatgcataaggtttcagataatcatttagctttgccggctggaacgaggccttcatcacctcccgcaccgccaccggctgcgcgcggtcgacgagcatggagaggagcagtgacaggttctgcttcagcgtgcggagcgccgggcggatgcgggcgtcagcgacaccgccgacatagagcccatcgtagaacgagtggtgcgagtcgaggaagatgaggcggtacgcggcgacctcggcgacgtgtccgaccgcggattgcgccgcggcgcgcgcgcggtcgaagtgggagcacggcgcgaggaggcgggcggtggcggcggacgacgacgacgagcacctgccgcgggagaagaaggagagcgacttgtcgagcgcgtggacgtggctgaggatgaagtggagcgtgttgagccggacgtagaggcgctacgtgccgcggctggtcgacgggcgcgggttctggccgccggacgccatgccgccctggccttggtggtgcccgtgggcgcgcgggctcgacacgggcacctggcacggcgtcgccaccttcttccacagcctgatgattatcgagtcctggttgcacctcgtcagcggcggcagcgacgggcacgcaccgtgtccttccattatcccagctacccgcgttctcacaatggaggcaccgtggagttcatgtctctcggccggagcaagaacgccatcgtcggcatcgaagaatggctacactacttattcatccaatcacagaatctccaatatgatatagtactactatttactagtataggaatgaatattcagggttagtcgtacactcataccataaactactacttgcatgctccatggctatcacaattgtatgacaaaatgaagatccactttcttgtctctcatgctcgtcctcaactgaaacaagacctccaaaaagcttcaggatcaaccaaaccattacatacacaacatacagactataaaccttcacaatcatcgatcacaggctataaacaatgacgaatcaagcaataaaaaggagatttttttaaaaaaatatcatattttcacggtgtctggtgtcgctagcggcgaagaacggcggcctgtacgtcatggagatgtatccccggggagacggccatgtcaccttcgaggtgctcgcctacggccgccacagccagccgccgcccgcctacgtcggcagcagcggctgggccagatgcagcatccaactcgaggactggcactggcgcgccctcccgcagcctccctacgtgcagtacccgggctacgaacgcgacgaggcgccgccgtgaaacacccttattacaatatcacggcgaccgcggtggtcggcgactcacgtctctggatatcgacggagggcgtccgcacgtccgcctttgacacggtgcgagatacctagagcaagcagggcgagtgggcgctgctgttcaggggcaacgccgagcacgtcgcggagcacgacctctggttcggcctctcgcgccacggcgacaagctgtgcgccctgcggcagcacccaccaccctttgaccgcttgacgcggagctccccgccggcctcctcccctccccacccgccggtggtctgcagagagagagagagagagagagaggaggaagggagagaagatgggaaataaagggtggtgacatggcacactgacatgtggggtcccacgctgattcagccgtcacgtagaccaaaatcgggatcaaaaccaccgaatgatctcgggtgaccggttttatataattaagagataccgtatatctgtttttacggttcgaggacgtttttatatccgatgacaagttgagggaccttcagtgtactttttcctttttctagtgcacatgaaaaggacaatttcaaaattgagattttgcgagcaggggcgatctgtggccgtccattcgttgtggacgttaaatcgaccccgtcgatttgtgatagaggttacgccgcatctgcgcgacccgctaccacccacacatcttcccgtctcaaaacaaaaagaaacaaaagaaaaaaaaaatccccatttctctaaaaatctagaggcttcttctcttctcctctctctcgttccccttcgtttcgattcgtctcgcccaaatcttcaaatccaaatccgcagcggaggcggccggggcgcggcggccagatcctggaagagaatccattccgggaggggaatccgcgcatgccaatgtcggatcccacggcggcggtcatccccaagccggggggcatcggcgtcggcggcggaggcggcgacgacgaggagccggtggagatccgggaggtgtgggcggacaacctcgaggaggagttcgcgctgatccgcgacgtcgtcgacgagttccccttcgtcgccatggacacggagttccctggcatcgtgtgccgccccgtcggcgccttccgctccccggccgactacaactacgccacgctcaaggccaacgtcgacatgctccacctcatccagctcggcctcaccttctccagcccgcgcggcgagctccccgcgctcggcccaggccgccgccgatgcgtatggcagtttaatttccgcgagttcgacgacgcccgcgacatcttcgcctctgactccattgagctcctgcgccgtagcggcatcgacttccgccgcaactccgagcgcggcgttgacgctcgccggttcgcggagctgctcatgtcctctggcgtcgtgcttaacgattctgtatattgggtcaccttccacgcgggctacgacttcgggtacctgcttaagatcctcacatgcagcagcctaccggacacgcaagccggcttctttaagctcatgaagatatatttccccaccgtgtatgacatcaagcacctcatgaagttctgcaatagcctgcacggtgggctgaacaagctcgccgagctccttgacgtggagcgcgtcggagagtcccaccaggccggttcagatagcttggtcacttcatgcgcgttctggaagctcaaggattcgttcttcgctggctctaccgagaaatatgctggagtgctgtatgggctcaatgcggagaatgttgtcagtgcgcattgatggatggtactcctctttgaattttagctttgtgaatggattgatttaggacagaaaatgtgacaaatgatcaagatgatgttatgtaggtcaagtttgtctcactccatttgggtttaatgtgatcctagtgttcttcagttattcgcgatgaaatagtgaactgtatttatgttaagttgttctgtccgctttcattttctcctacctggtttagttagataggaaagaaaaatcacctttaaggattaggagatggtaaaatgaatatattttgttgctgttttgtcattgatatgtatagcatggaagctggttgtttccaaagagtggggtgcgggtacatcaaagtgctcaaacatgtaacttgataacattacaatacaatacacagagcgcgacctctcttcacatgggtattttagatgctgttattttaatttcccagaataattagttactctaatatgtatccttctagagaataacacaatgcaatattgagaataagggcatctctctatttcgactttgtgctgcagtttttggtaatctgaggtaatgctatctggtctacattggaagcctggaaacatttacggttttcagccaaagttttctactatttgttcatcaattcaattatccagtaagcctactgcctagcgaatagttctgggcttctggccaatgttcactaggcaaaacctctgtactccatggagtaaaactacagtgaaatcctgcaaatatgcaaattctgcagatttgctaacaaaatattagatacgcatctagctatatgtgtctcttgatccagcaattaagtcacaatgatgcacagagcatgaatactagcagtttactttttccataataggttgtgggttacagtaacaaatatgcatgtcttgagacagtgatgctgatactatttcccttgccttcctgcaacacttggattgaatttctacttatccaacttatattctagatacaacattgatccatttacattctttgtgaaaaacttatcataactagatgagctttgaccacaagttacatcattccctgcaatttaatagcatcagattatttcattgctggatgtaccggaccactcttttttgctttgcaactagaatattagttcctttggcactaacatgtcctcaaatgttgcatgtggagatgaaatctagggcatttaattaagttactaacgagtttatttacaggttctgttggaacccaatttagagaagaatctagttagctacatcttctcgttttattaagactcaacttggacactaccttaatcccggttgattgccattgtccagtttatttaaattcatgtatataatcggtccttcttaagttcggacattgttggagagctattctgaataaaggtaatggtggctaacaagaaacaaggtaaggattgttagaaactggagaagtttgggtgccaaaaagcttcaaaagtattgaaattgtctaatgtttcatattttgcaggtaaacctgataatactttcctagtgtatcattttttaacgggatgcatttctggtgttaaaatgtggtactcgtcatgccaacttgtgcatgggttcaatttgaagactgagaagccttgtgcacgcatgaactttcttcatcacagattgatggcagcagcagcctatctcaattccccaaatctccagggatgagatcaaaccatctgcattgcacaagcttcctcccatggataatgcaaatgtgtaatgcttatgcaattgtaatgtgtagtgttaaacagttgtggtcatttttgtgagatctgaatactgattccataaatcggggctggccagaaacaagtgcttattgcatccagagaacatgttttcagtttgcctcacaatttcactaaaaatatcagtacagatttgttaacctccaaaaagggaacacagaaggcgagctaatatgcaagtttacatcatgcaaagaaatggcctgaagtttacattagaaagaattaacatttttcctgtcaagtctctattgacaatgaaaatcttaagcaggcaggagtcgttctatcatccctggcttaccgtcaagatctttttctcaaaacaccgtaattggatcaaaagttcaaaacagttgccatcttaagtaatgcagcgcagtgcactgttcaccctctaatctgcaggttcttagtgtaattctgcgttttttggctgcaaccacaaagacagtcgggtgagttatatttgccgtgtgtgctcataagcagcaactgttcatagcctacccatttacttttcacgtgatgtctatcttgctggcacgtatgatcaattggtccatttcttcgtccatatctatttgatctcctgctatcatctgaggaatattttgtggcacaatgtcagcattaatatatgccccaagcaatgacttgtacaggggcaagcttgtcaagttgaacttttgaagaacctttatgaatctatctgcatcctccacactgccttgctcctcgaaatactttgcaatggcctccaacagctcaagtggaggtctccagtggcaagtcttcaacagagataagcccttcttcatggcattgacagctttatccatctgcttactctgaacaaatccctccatcagtatctcccaagtcttgtaattcggatgcgcacctttctctagcatgtggagatgaagcctctcagccttttcgatccatccattcctcacataagcaccaaggagaacatttgaaacccgcacatcgtgcttcttgctttctgcttcccagcttccaaaggtccactcggcccgaccaatgtcgccaacttttatcaagcataccatagcagacatgtagtttgcagcagggattctacctggaacaattttactagcctcccacagcctaataaccccatctctgtcattcagggctgcataacatgtcataatgaaagagtaccctaaacgccctgttgatgacaactttgtttcagccgttctaaggcaagcaagagctttactgctctgtccatacttcttgaagatgttagctaatgtacagtatgtgctccaaccaacctcaaccatgtcatcattcagcatctccttgaatgctgattgtactgaggctaagccagagacctcagcacatgcattcatccaaatgttgtaggacagaacatttcttggaatgttgttccgtttcatcagataaattacactaaggaccttctcatactggcacgttgcaacatatagtttcataatttcattgaaagaatgaggatcgacaggcagtccatatctctgcagctcagccatgaaggtttcagctttctgcacatttctttctgtaacatagcaatggagaagcgggaatgacgcggccttcttggaagcagcagtacttagttttctgtagtactcctcagcttgagaagtaccatgaacttttgcaatcaaatccagtctaaccatatgatctgagggcgatagtctaaaatcattgtgcgagtccatccatgataaaatctgcagcataataaaattccgtttaggtagtgccccttgcatcgccactgcgcgatatagattggaacagcaataaacattcagctgagctgtgcaagtgtgtcaataaatcatataacaaagagtgaaacaatgttcactttgcagcataacattataaggaattattaagaagtttgaatcaaattgttgcaaaggtgaaaaagactcctatgtcctatctgtatcagatttttctcggttcaaattcgttcatcaggtagagctgtttggagtgtgctcacctccagggcttgctcgtagcggcgcgcgcggcgaagccggacgacgtcacggcggagctccggcggcgagacgcggccgcgctcccgagcccatctctcgacggcggcggccgcggcggcgcgcccgctcttcctcgggatccggaggaggcaccgcgacagtaggtcgccgccgtcgccgtcctcgcgagcagtcgccggaggagcggaggaggaggaggaggagcagcagaagggtctagggtttgggcgggaggcgccgacgaggagggcgagaaggcgcgagcggcgcacgacggcggccatgggcccaaacaatccatgggcttgcttgctttaagaaagtttaccttcttctcaatccctttttttaaaaaaaaaattagtaaatttcagaaaactgcaactatagtcataaaactgtagtgtgctgcaacattagtgatctatttcagtttgctgtaataataacgtggaaaattatcacaaaattacaacttttacgtgatatgcgtagaagttacagtttcgtgataatttatcacgctattgttctagcaaactggtagttttgtgactataattgcagttttttaaaatttactcaaaaagaaatgaagtgatagcataaatttgtatctcaattatagtggatgaaaatttagacatgtttttaaaaggctaactcatacgtgagacctaaccggattctacaacttcagtttcgctcccaattattttagataatagattaaaccggcctctgcatccaaacatatatgcacagccaagaagctccccaaatatatgtcctaaaatgtaaatccagccgcgccacggctgtctgtgccaaaccaggacgaggaagaagaaactgacagtaagctcaggtttatacaagccatcaatgtctctctttctaggtcgagttggcaacccatctcgtcctccagattactactacaatacatatattgacatagatacacaggcctagactagattacatcacaaactaacactgctagctagtacacagcatacaatggggggacatgtacacagatgcagacgagagatctgtcatatgcaagctccaagggagtagaaatcgccgcaccccaggtcgtcgctgaaggtaacatcatccttctcctgcatggaaatcgagtgtcagatagcgaaacagcgccgtcaacaagatgactattgcttctgatggtcttatcatcagcgaaaatggttcaataagtttgctggtatgtgtcacttttgtgtaatcttaatatggatgtcatggtaaaaaaaattaggtgaaggaaaaaatccttaccactttgactatggaattgagaaggccgtcgaagctgcagctgctagagctaagttcgctctgaagtttcgggatgctcaaatcggaggcgttcttcggcatcgccatatctcccgaaacgaggaaatctgtcttcatttgtgggataactgttgaaccacttgaggttgcttgcccaatcattctggcaccaatattgctactgttactactgctattgttccatctttggctcatagcatgatgagccccaatgttgcttgccaattgagagctcggtacagaactccatacgaacttgagatcaaacagactgtctgcagtcctatcatcgaacttctgtttcaaaccgtttccacctccaaaattcaagtacttttgctctgtatctggaggtaaaagcatcgcgccaccaaaagagctagctccaccttttgtgtctcttgctaccataaggtcatttgaagagcgagcaggtgcacacgatgaagatgtaccacccaatttgtttgcacaggtattgttaaacgaaccatggattagcaacccgttggcggaaaatcctgataaaggaatagtactctgctgggatacacgagattcaagcagaccagatgaaactccaacggcgccttcaatatgttctgaacttacagaggaagttcgaattgatggctgactgacaattttggcttgtgtgcactcggctagttcttgaggcagcaaaggactgcttgtgacactttggagtgtgccagacataccattagataggccattcccagaaaggatggtggacagatcatcggtttcttcatggatccacttctgttgcatttgggtctgcccaagcgatgttgccaaaccttgtcccaagtttcctttctggtttcctggtaagctaaggtggtacttatttgcatcattaatggaatggctcaatgtatggcttccgctcatagtctgaatcgattttgaagcaggtaccccctgagttccaagagctgctggattgtttctaggactgtttaacaatccatgtggagtaaaagatgatagagctgcggaagaggtaaaagcttgataaccctgtagtccttcaaatccacccatgtgcagaaaggggtctctacctcccaaagcagcaacgatgctaacttgttgcgacgccacagcgcttagccgtttgagatagagcctgtacttctgcgtggtacacaaagcttgagattagactctgcaaacaagttgtagtgtttatctgtgaacaatttgcttttagtgtctcagcatgagtcacagaatagcaccggaacttgtttttggttcaccatatatgtggttgctaaatctgctagaaggtttagagaagtgctgaaaaatgtacggccttttcctcaacttaaaggccactcatttaattgttacagaatctgctcttggaagcagaggggcaaagtacacaagactcaagttagaataggccttaaatgtgtaatagctctgtgttgataaaggatgccacagtgactttctatcagccatatttaatacagtattgtaaaacagtcagcgcacaattcattggtattgaagaacttctgaattcggttaatatttcttcagggccttagtaaagttgaaagatggtctatcttaagctatagtttcctctgaacagtaaaaacttgtagtgcaattaattacaatagctgctagctgtggtacagatttgttctattcaaattacatcattaccagtacatgctaataaatagaagatagtgaaatgagttccttgcctgtaggtgacttgcaacattttcccttgtgagtttctcaacattcatgagctcaagtatcctttttggcacagcctctgcataaatagaaaaaaattataatctcatcttttcacttatgcttatgcttattagccaaaaattgaattttcaaccttaaatttggagttgattttggggtttttttcatcgtagtttattttttagcctttgcttttagatcgttaagaacacgtatataaaagttttattcacaaattatttttcatttgcaaatatgtcgtttagttttttcctccaatatgccaaacgatggggccgtttctctctctctctctccaaaaaggaaaagattagggtgtaacatgagtcaccataaaaaaattgtgaacagcaaaatggaggcagtggtgagaacatactgtcaattccaagctggttgacagcagcgacaaatttccggtgtagttcaactgaccaaacaactctcggcttctttggagccgagggatcatcaatatcttgagtattgacctcaccctcatcctcctcttcactacagtactccttcctcttcttgctgggcctcccactttgatcaggtgatccacatgtaacatggccatgcacatggtctgaatccgcatttggtggcttgttgcactcttcatagaaatcgagattagcacggtcgcgagtactgaatttcctcctgataacatgctgccagatattcctgagctcttcgattcgaacaggttttaggagatagtcgcaggcaccatgggttatccccttcaatacagttttggtctctccattcacagataacactgcaaggaaattactaattggttaacatcaacatttccccctacccgtcatagaaggaaataagtacagtacagtgctcaggatttgctgaataaactgaaattgaattgatgctctgcagatacaagaaaaatcttcactcacagtggctattactatcaagaacagttgaactggattattggatagctctgagaagggataagattcatgacttactgatgacagggaggtccatttcaagccccacaagctcaagaagcttaaagccgtccatgtctggcatatggacgtcgctgataactagatcaaacatgtccctgttttcccgcagcattttcagcgcgatagcagcctgatttgttgtcgtcactggaaaaacaaaacaaaaattactctttcaagtgaatagctgttgaagatacaggaaggcatctgcgacaacaacaattcaccctaaacccccccccccaaaaaaaaaaaaaattgcagcatgcatttcttttatcaacaatgacaccataaatccagatcatgtaaacaatttacaactagacatctctgtagctgcatgcagcatatatagtatacgataacttcatgaaatattttattgaataaacataaagcattaggcaaaattctgaagaacatacatatagacatctaacaataaaatttgtaagaattgatattgctgttccaagacaaaaaaaaaaaccaagactgaactgcaaaaagaaaagaagaagtatttaccatgatactggcagcgcagcagcagggtctcgagcaccttgagacacaccgggtcgtcgtcgacggcgaggacacgcataccgacggggaactggtccctcctcctcgccgccggcaccacacccttcctctcctccgccgccctcatggcaacaaaaaacctcccaatccaattcacagcacaaaacccaagaacagcaagaaacctcccaatcgatgaagcaaatcaagaacaaaaaccaaccaccttataaccaaagttgcaggatgctgggaagcagatgtgggcaggggaagattgggattcagcttcaaggcaggcctcccaatccccagcaagaaagcaaaggcaaagagcccaaaggtacaaaaccaacaacctactactactgctcctgctgctgctgctgctccccaactagaacaggaaaagagaaagggagaagcaaaatggaaagaaagaagctggtggtggatttggacagggagaggagagagctggagagagtgggcatggagcttcaggaccaaacccaccaccatctccaccaccccatcattattgaggcaaagaggtgggaaagcaaaagggagggagttggagaagaaagcagagttctctctctctctctctctctctctgcagccaaaaaaataaactaaaaaaatgggaggaaaaaagcagagacactgactgttccagatggccaagcaagcaagcaaccaacctcagcttcagctcacacacatgtgaactactcctagctcagcagcagcagccaccacaactcccagcaagaaaacaagaggagattggagcaagaacagcaagaacatctcaagggagaagaagatgagggagagaatgtaagtagactgtccatctgtctgaattttaaggggtcaaaaatggtggagggcaacagaaattggggcccatttcatccacaagctccaaccgatcgctacagacgaaacgccatccctctgtagtctgtagtatgtactaccccgcaccggcgaaattcttgcgtctgtaaattttgtattgtatctcatgtatcaattggacggggcaaaaaataattttccatgaacatgttaaattggtactagtagtaatgtttttttttctgaggccttaaattagtagaaaatgggcattccatatgacaattccgtatctcatttttaactttttttaaaaaaaatatcattatttttttgagaatttttttggaacaaattttctgattaaaatgatccaaacttttaagagttgtggaaacggatgagacacatctcgatcacacaagtgaatatagcattgcaagctagtagtatcaacttgccacgcacaaatgaatagtatcgcacagtgactgtactcctacattgagggccttttgatttggagaaaaaaaaatataagagtaggagtttaggatgattccaaccctataagaaaatttcctaggaaaccctttaaaataaaggattgaatcatattgtatgctttaaaattcctatagaatgaataatcctagaaagattttgtgaagaaaatttagcaagagtttcaacctcttagaaattttcctttgaatctatccctttataagattattgtgtttttcctgtgattcaatgaaatggttattcttgtgtttctcctatattttataatcctctgttttgtacatgcaattgttattagaattatacgttttttttctatttcttcccttttttttcattggcccctacggagtaccaccaaacagtataataccatatacatatttactgcttgtataaaaatactgtagtaattatagagaagcgtacacgaacagaagacatatgcttgccttaacaactttagattcttcacacggtataccactactgcagctgggccccaaattataatcatccaatggagcaaacaaagacgacctgatctctggatctacaagtagttaatggtaaaacaccattaaccccaaagtaaaactccccttaaatgcgtgcctttaattgacgccatttactaacgcttttaataaccatccattaaagctttggatgattgattggaagggggcaccactccctcgcacacgaacgagattacgagatgaagattgtcacgaaaatgcccgaccgaccgagcgtgcttttttgtacggtctcattttctaaaacatgatataaacgaagacgctcataaacacacatcatatccttattagcatctttaaaatcctaatttaattactccctctatccaaaaatataatgtacaatcatgttttttcatgcctcataatataaaacatatgcgtatatatattaactagcacctcgatcctctaaatttggtttgttttaaaccatcgagctcttcaattatattgcttgtatgcatgaatgcgatccaaccaatgagaatgattaagggccagtttgttttgaggcctaaattaggcttgccaatttttttggcaaccttaacaataattgtgtatgtttggattgaagccaaattttgacatgcctatataacataggccattttaatagccaaattagtttaatttggcttcaatccaaacacatgttggccttaccaaaaattggcatgccaaaacttgtcaaaattgccaaattttggtaaggccaacattggtcacaaaccaaactggccctaattttttttcttaatctttatgttacgagtggtgagcatttttttttatagatggagtagcatctttgaaagactggactaatataacttaggattgataaagtaacacgtgtatattgtcacacattgaaaaataataattagacgtaaatacaagcatctatatcaagtccaggacttgaactcatgtgaatcggtttctaatcaattgagttatgctcacttcaccatacgatattattctaaccctatataaaataataattctaaatcatttcaatcttgtattaccatctccactaaataattagaatgacaaaaacaatcgatcatcggttaaagtgatagtagttttagatattgtttccgaccgttttcacccctagcggcgcacacacaaatcacctctatttcccgtgctcgcgcgcgcgcgcgcgcacggtgggggcggccacacggggggtcgtgggggtgtcgatgcggtggtttttcgcgcgcagccagccccctttgtcgtctcgtctgccacccacgtccccatggcgctgctgctgctgctgctccttgctgcaacctgcaactctgcaaggccaacaagacaagcggaggcagcagtagcaggagggcatatgcctcgtttcccggactctccttccatctcatcccttggttgacccatgggtttgaccatctcaaccgttgattgatcccacatttttttaagcaaaaggtatagtcaatgagtactccctccatcctaaaatatattccatatctcaaaatatgaagaattttaaatagataggacattttctagtactatgaatctggacagactctctgtacaaatttatttaactatcaaatgttccatctgtttaaaatctcttatattttaggatggagaaaaagtaaatagtattgaataagaagaagagagtataaataaacaataattatgtgcgttaaaaaggaggttgtatacaataaacaatagttaattagtatttaataattgaacggttaaacatttaaagacactaaggcaaagatggtactacactaagcttagtatttgcaaatggattaattatgtggactaataagtgtttacactcatatactgccaggacatgagagaggagactgtaatttgtaaatagctgcatgtgtgggtttcttgtcattttgttcatctttctcgtgaagttttttgcgtgaaaaggggaaaactggacgtgccggtataaagtgagccagtactacaattcactgcctatatatgccacgtactcgatccaacctgctacgttgaaaacttttgcgtccatgactcactgcacgttgcttccggcgatgaactatcaagcgtcatatgcattcacgtaagctatatatatatatattattcccttctcctaaaatataaaatattttatataaatgtaatatatttaggatcataaatctgatttgactttctgttaagatttatagtcacacacccacctatttttttttcatattttagtacggatggagtatatgtattggcccacatcaatttaagtcagataatgcatcaggtgtttgcatgcttaattacgaccgttaattgtgacagcggggcatacatggctaccttcaatacgggtcaacatttactgttcacttctttttaaagcccgtttgaatgcgagaaattgtatgtgttcacttcacgtggaagtatgaaataaaatatactaggatacctcctctccggaacgcaaaacgatatttgcattaacatgtgattaattgaatattagctattttttaaaaaaaattgattaatatgattttttaagcaactttcgtatagaaacttttttttaaaaaacgtaccgtttaatagtttgaaaaacgtgcgcacggaaaaccatgatagggagttgggaactcccaacaaagaacgcaccctaattaagtactcttttatattcatcaccatataaagtactttcataaactatacacgaatttctattagtcaatgataaaaaaaattaactggcttaacaccaagtaatttaaacggaagtaatatatatgttttaacttttattaaaggtgactttttatactaatttaagaacgtgttcaacctataacctatacatatatgtatcgttagcaaactcctttttttatgccatacatgacttgtgtgtcgcataaacatccgcgagcacccaatagtacgatgataacactaaattaatattctccccgcttcaaaatttagcaatctatgaactaaattcatagtgttaggttggatctaatctcatacataaattgttatattttgagacgagtaataattaacatatttaaagtactcatctcacacttttcccccgcatgatgcaacgtttaccgacagtttatagcttccaacaaacaaatgagaagatggttgcatttaatttaattagcttgtgtgattggtgagtggtgaccaaacattatgtcatcgatcgatcccatgcatgcatccacgcccaattttttcatatacaccctccgtccctaaatatttaacgtcgttgacttttttatgatatgtttggccgttcgtcttattcaaaagatttaagtaattattaattctttttctatcatttgattaactgttaaattcacttttatgtatatatatatttcacaaaagtttttgaataagacgaatggtcaaatatacttaaaaaaaatcaacggtgtcaaatatttaaggatgaatggagtatatttttctccgatccatggagcacgcgtatagaagttcacaaaacatatggtaactaaaaaaatattcacagcatttttttctgcagggaaatattcacatcattttcacaggccacgtaagaaaagaataatattcgtcgtatgaagtcattataatcttcctttatggatatctagaaggcatatgcatgcatgcattctgcgatattaatatatatatgtaaccggcgctgccggccacgtggttaattagacagttaattagttgatgatgccaggtggtgtttaattactgtggaaaacttctactagacgtctgaatatcttgttgccctgatgataattagtatactgataaatggttttaattaactaggcatcttagtcagcttcacttaagtgcagatcttaaggtagctaggcccagtcatagttccaaactttttttttcaaacttacaacttttccataacataaaaacttttctatacacacataaacttctaacttttccattacatcgttacaatttcaatcaaactttcaattttaaccaaacttttaattttgacgtgaactaaacacagctctagtggggttttttttcttccaaatagctaaatgattgaataatgtatgtgatcactattcgagagcacaaacgaatggattaaacattatgaagttaaagaatagatctaaactagttttgtcgaaattcacatataaaagttttttttctcaaaaatcgtatagtttgggtgcacgtaaaacatgtggcatatattaatcgatcgattaatccttccttagaaaaatgttcaagggtcttccgactagttccacaaggtggtggctagactatctgggttcggagcctcaccccttttaattatttgatattaggttatttcctaatatttgccttttttttattaattcttcctttaaaaaaaagagtaggttgatttaatgctaattgcattgccatgtttatttttttttctttttgtgtggatgacgtcgcacgcgaacacgattcgaaccgaagtccatttttcctgcgcgtgtacatagtatatacgtacgcgtgtagtggacggttgcttttcatctgctttcttcagagaagctctatgtttattatgatacgcatgcacgtcgctcttatatatgtttctataatattatgcgatgattctcaatcatgcatgtttcaatattacctaaccatttcaaaattgaacgcgatctcaattatttaactacatatacgcatgcatgtgtgtatatatatacagtacgtacaccaccggctgcatgccggccaatgatcgatatgatctggacctgcttttgctagcttaatttactcgtatttataattttttttgactgaattatttataattgtttgtaaacactgctccctccattccaaattgatggtacaccaagaccaagaaaagctaataactctctcatattatatttactctagcaacaaacttgatgcatgcatcatccacactattttctagccaatagaaaatcaagatattgcatgtgggttataaatacttgtgtggatgcatgcatcaatgcccatttactccaatgcaccaataacgaatagacttaatgaataaacacaaatatatagatcatttaagaataaccttaaaaaaattatatgcagatcaattttgaatgaagggagtagtatacatgcctcttactacatatttttggatcgatcacttgagaatttatggatggagggcacaagctgcattcacgtacgacaaatgcgatctacacccaatctttgcgcgtaaatttctgatcgatctgcatttaattcactctccatcgaaagttcatttaagagctagctaggggccgaccatcgatccatcccagaagtaattactactctagttattgatctgggcccttcatgcaaggtcgaacccatcaacatgcacgtaatataagctgtgtttagttccacgctaaaattaaaagtttaaagaaattagaacaatacgatggaaaatttgtaaatttgtgtgtaggaaagtttgatatgacggaaaagttgaaagtttgaagaaaaaagttaaaatctaaacatggccatactctacatctaaaaataacacataagattaagtggtgagatgaaaaagagaaatgaggaaaaatatatgtatcacctttaatcatgtaaggggcaatcttcacacaactaaaaaaaagaaaaaaaagtgaattggacaaacaaataaaataaaattattggggttagtgtgctacagtacagaggtaatataaagatgatgtattgtatataccaccttttatagataaaattgaaggtgtcaactacctttgctataaaacttgttcctatattactcgtttaattataattagcatttaactgcgacgctaaaacgcacgcttgcatgcatggtacaatattggtactgcaggagtatatatatgtacgacgcgcatgctacctgcagtatgtacatgtccctcgtctgtgcgttgcacgcaccgttttagaacgcaaggtaatattggtttaactttgatcgatcatatataaacataattaaaaatataaatttcaggtatctgaagaaaaatggatgtatatatagtctaccataacgagagatttcttcatagtattacacttatgtaatttctaaaatttatatcgaagggctagatagtcaaatttttatccccgcaaaaaaaaaggatagtcaaatttatagagtataatgttaacttagaaaagtcacacacggcttgtttatgctaccagaggaaatagctgtataattaattaattaattaattaagcccgacttacgtacgtactctttctataaaagaaacttaattgcaagctattggtcaacaaattagtggtaagggtaggggccgggtgagcagaaaaaaaactgaaccgaaaagaccgagaccgagaaattcgatcctagacagtcaaagaccgatttttttcgatcaatttggttagtctcctcgggtaactgaataaactgaaaagactgaattaaaaaaatgtttaaatgcaacataaaatccactaagttcaataggactagactctaattttttcacatccctacttcttctaagcatgcaacctaacaagagtctttattcatatgtgcttacaatttctttttttgatttttgtgttggcatttttcactatttttttgcatatataaaaatgttgttgaatttcggtcaggaccgagaccgagaccgaatttgtcagtcctgacatttttgcgttgaaattcggtcttcacattccaaagaccgaaatgaccaaaagaccaagactgaaattttcggtcaggttgtatgcccacccctacgtaagggtaagtgcgcccctcacaaatacacataaacacatataccctacatcttaaattatatggtgcaattaacaccaatataaagaccaagaaagaattattatcacctttcgtttggataactccaataaatacaatgcatacacccaatgggattagagattttgagagggtggatgattttgaaaaagaaataattaaagaggagagagatgtgctagtttattgcatcatgcgtgctttatattatgaaacattgaaaaatatggttgtgtcttatattttgggatggagaaagtaagaaaagtaatattgcaaattggtagttaagggatactgagagcaagtactataaggatatatgtgttggtctaaaagtgtcgcataagataagtacttgatgagatctactccagaagaaaagtgatgagagagactatgagctagtcactagttatacaagaggcaatctacatatataatctccaaagaagagcacacaacgaatgtgagatagtgtgaaagtgaacataaggctgtcatgggttggcctaataatgttgattattttcatacagcttattaataaaaacttatttatgagcatcacttttatatatgtcatagcgactttaaaggcaatgcataaaaataaacttttcttttgagatggaaataataaatctcaatagcatcaaaatcaatttcaaaattaaattttacaattcaattttggtaacgatttataagctgtatgataaaagataggtatagtatatgacatggctaaaattaaggtagcacattcactataaaacttgctctcttaatttaggaacacaacttcttccattcccagatcgatcaaggatcaatatataagttgggacaaagttgcaaggctaattaaagtctttttagggtggaatagtaattttgaattttgatttggtggttgttttagttccaccaccagcttgtcataaactatatattccatgctgctagctagctagatttggcctagatcgatagctagcacttgcaaatttattaggtttggagctttgggatcctacgctgatcatagagagatcgatcacttatatataggcactcgctgtcgtgatagatcacatagtcctaacacatgagatcctgtaagattatggagtatcacacaggtcatgccaagttgtagaatcaattaattaacggcggccgtggcgtctgaagaaagaacagctagcagtggtaaaaaaaaaaaagaaatcaaagatatgtgcctgccatgtcatttatcacatgctacgtacaacgtgttggcacatacagtaactgatgagcaattcaagctatgcattagggtgcatttctttttagctaacgattacatgttatcacggacatgtttttttaaaaaagtttataataaacacggtactttttcaatggaatatgagcaatgctagcgcaataaatgaccacacatcaatctagccggaaaaaaaaataaagggtaaatagctaaagtggtcctccaagttttaattatctgaggctcagtttagtccttgacattttaatctatccatattagtccttcaagttttcgttttagttcaaaattatccttgaacttacttagaagccacatggctaaacataaccaacaactctcttgataaatgacacttatactcccctcattcacatatataagagaaaaaattgcatgcaatgatttttttatagataatgcatagtaatttatgtaaaacgaaaataaattatgtacttgcaggtgtatacgatagccattgtttaagtttcatgtgcatatgttgaaataatgggaaatacatctgcaatattgtttatttattttgattttcccttttctaatgtatagttgcatacaaattaagggcaaaacggacattttgcaatggaaatattgactacaaatatccatatggcatattaagtgggcccaaggatgattttaagccaaaacaaatacttagaggacctatgtggataaaataaaacctgaaggaccaaattgtgccttcggtgaaatttgcgggactaaattagctattcacccaaaaataaatgacaaagttacttctagtcaatgtattagtaaattactaatttacccttaataacaaacggatcatatcatttctatcgatagtataatactactagtagaaagcaccggagcatcactcaatattgaattcattcattcatgccatcaaataattgttatgaacaacgcaatttcacaaatcatccatagacactttagagtttagaacgcatcatatccttaggccagattaaccaaaagaacatcaataagcaggactatatatagcaagtactttctgagacgaatattattggtgatcccgggtacccgggtacgtacaaatcagggtgcatgaacgacatagcaaaggcaggactaacaaaaacggaaggcaaatatatatatatatatatatatatatatatatatatatatatatatatatatatatatatatatatatatatatatatatatatatatatatgcatgcatcagtgtgcattcagatcggaagtggtatataatgtggttgtacgtagggtaagaattaagcgtgcgtggcaataacatcatagctttgtgggcaattgttcgtctcttctcctcacatggaaattttgagagcagagatcgaatcgatcgtcgaagaacgtacggtcctcaaccaattaataagcacatatatatcgtcttgagatatcgatcgagctggcgactgactagctagtaaaattgtttgaatttttctagacaaactgtattaagtttgatcaagtttataataaaatttagcaacatctaaaatattaaataagtctcattaaatctaacattgaatatattttgacaatatatttattttgtgttgaaaatactactgtaattttattaaatcaaatattttttattagaaaaaagaaaaggtctaacgactttaaaggaaaggaagtactgtatattgttgtacgcatgctagcaagcaaatgcaaggggcagtctggcagtgcatatatgatagcgtaatgatgatttgttcctgcggctccctccgagcactggtgaccagtttaggttatgtttagttcacataaaaattagaaattcgattgaaattgaaacgatgtgacagaaaagttggaagtttgtgtgtatagaaaagtttcgatgggatgaaaaagttagaagttttaaaaaaaagttagaaactaaacaggccttaggagtacatgttggtcaggaggacgcattctgcatttctgcggcaaaatcaatcgtattttccgtcgtggtgacacgtcgcggctcgccggggccgggctacgagcgtgaggtccccgcccgttgcagactcagcccagcccggcacgtacttccaacttgcctcgccgtgcgcggagaagaatagtgggccggcccaacttgtcggtgcaccactgcacctgcacgttcgtgggtatcgcgttacggcccatactgctctcgggctgcctgtctacaatacatgggccaacatcgtcataccagtccacttctgacggtatgagcttttgccgtttctccttgcttcttgcatttcgatgacgacaacgtactctcttcgtctcctactttaatcatttgtcttgcttaaaatactaggcacaaatatatttaaaataagacggacaatcaaaaacttatggttgcacttaaaataggacggagggagtaaatgctgcttgaaacaatgttaaatctagaaagagtcgctcaaaggcatatggtacctgagtttctgcaatcaattcgaattaatcgattcccttcttttgcatttgcacatctgcagctaatagtacaaactgaataataataagtaagaaaacagaaccccagagggctcgtaaactgaactacagaacattgctactacatatctcctgcttccactaagctcccctcgattcagctcacggctaacactttctcatcgcatctccatttctccatccaagctgctacccacaagtatacatctgttctccaatctgatgaaactcacactgaccattcttgtgcagcatcagaattcagaacacactccttttccttcacataagctgtctcccttccctgtcagattcttcgtcttcttcttcttcctccatacgatcatggagcaacgacagctattgcacggttagtagattgtgacaagtgacaacggctaaaaacgatggaatcagctgctctccagtttcatctcttgccgaatctcaagcacttgttgtgttttacttcggtcatgttattgttcgaggacgacggcgccaactggggcgctttggctgtcttatccttggagagcttctccatcgcgttgatgaacttcctcagatgcctgatgtattcagggtacgtctccaggttgcagtggccgccacctttcacccataagggctcgtacttctccttcgcgagctcccatagccgcttgccgtgggagaaatcgacgatgtcgtctgctgtgccctgccattgtcattcagcaggtaagttctgagttctgatcacaccaaccggggaaaaaaaaaacagttgagagcagcaatgaactatctcagaacttaataaagtcttagcatgttttctgttgaactgtaactagtaattggacatgagatatatactgaaaagtaaatttgaagatgatttcagacttgaatatcaatgaaaagctaaggaggctttgaatcagaaatgaaaagggtacaagctactcacatgtataaccagcactggacagtcaacctgctttattttgtcgatgttctgcagacatgttagcagtaaccagattaggatggtaaatgacagtcgttttagaagcaaactgaaatcatggtccagagttccagacataccttgaagatatcaaaccaaagtgttacttttaccggatatagaacccgaatgcctgaaagtatagcactgtgaaggacaacccctcttaatttttccaagcgcgaggctaaatgcaatgttggtccacttccaactgattgtccatacaagattagatcctctggttcaatcccgtacaccttcgttaaacagtcataaacagcctctatgtcacagtatgtgttgtattctgatggcttttgaagcagaaaacatgataagaaaaggaacaaaattaggtatgtcttccacaaggcgaacaattacctagcttaattacttattgtaagttcgtagaaaggaaaacatttactatcgttcgttctgatcatcagaaagaattcgttaatcaacaaaaccatgtgccacatatgggaacaactgaacaagcacacatgccactttatgagctagtactacttaaccaagttcttcaagtagggatcgataatcaatcacctagaagttggggttgatggtcccttggtataacaactttgacaaaaggatgactaacagaacaaagttgccatcatggtcgagaatagcagaaagcatgtgtgactttttccgatattcataatgaaagtaaaattgaaaaaggctaaacagccatttgccaaagtcctattccagatgaggccaagaaagacagaatggctaataataattgctttgagaaaagctgcccatatacctatagaagaacaggatgttgattatgaaaaaagcaagggaaacaatccaatccaaagattgtcgcttgagtcattgatgaaaatatggcataaacatacaggagacatcatgatcacaaaaaagtttaggtgacaatctattcaaagaagacaagtttactgcaaattaacctaagaatcaagtttgagctcttaaaatcactgaggaattcagaatcttactttgcctgtagaggccccatatcctgaataatcatagctgcagaacgaaaccaagtaaaaagttcagtcacatgtaacacacaatattggtcatgtccatcaaaggaaaattgtcatgatattaatttgacacaattgtccatgttttatatatttattgatggaaataaatttcaaatcccatgaggatcaaatagcaacttttccagtaggggaaattctttcgttcttaaagttaaaaggcaggcatcaactggatccccaaaaggtgaaatagataccatttgaatgtgaagttcgacaggactccatccgaaataatttatagcagaattattcatgatacatttttactctatccacacagcaagactatatgcaaattatcaatccacgatccaaatgccacaaacagttataacagtattataagaataagatgccaagcactattctcttacaaaaatgatgctctgtaatccttgtatattttaagagaactgcaacaaacaatgccgtaaaatttttttaccccagttccccaatctagagaaatgccacaattctaacaaatgactagaatcgctgaaactgaattcgaaagcaatagcagcagatcacacacagcagcatgcatctgcattggagcagaatctgacagtataaagtacaatgaatcatccaaaaaaaagtacagtcttaacctcgtcggatggcaacctggcaagaactaaaatctaaaacggagggaagaaacgatctgtttttcaactcttccataattgtggtcaggccatcaggatatccaagaaactaaatctaaacataaaagcagaagtcaaagcatttattcaggaaaggagtggtcgtcatttaatcaaacgagcagttcgttcctaacattgaaggtg

SEQ ID NO: 58833 - DNA, 824 bp, Oryza sativa
ttcatttgccctggagaatgtctatcgacccccgacttcatccatctccaatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacagtaaccaaaccattccatagtatccagatgatatgaatatttcccaaagtctatagttgaaaaaccacctaatgttacctaattaaattgcgaagcatctacctaaaactaaactagtggtgccatgagtagagtgtccactagttggggttttgtttgttctagggtgaacaaggtaataataacaataacaataataataaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccatataacagcagaaacaaagcataaaaatgggttcttggcttcataaggaaaaattagagacttgaacggtccaattccgagttcaaatggccaagttatggccatttga

SEQ ID NO: 58834 - DNA, 24151 bp, Oryza sativa
  unsure (1)..(24151): unsure at all n locations
ccatagaaccgccaaggtatacaaacttttccatgtgcgttggcctaaccataagcaaaatacttctcgggagttctaacccaaactgccaaagaaaattcccataactttgctaattagatgtgtttatctctaatattcagctacaatatacactacgctgtcttatgcacgattcgaagttgtttgcagtttgaaccaacaacggcacatttttgggttcatgtcatttgataccctcgacacctaaggatatgcccgttggctaatatcaatatgatcatcaccaccaaaccaaagtcaaaatcaataatatattgagctttccttgttcaaaggtaacacggattctgaatttgtttttaagcttatgtagtttttaattttatgtcgtgctttgctaattttgtgcatttgttatgtgtgactcatcaatatttttcagcattcttgcaaggttgtttcacttcaaaatggtcattggcttagtcttgagtatgatcctgtgagggtgagttttgcatctgttcatacatttttagattggatctggatagggtgagctctgcatctgtttatgccttttacattggttatgaaagaggagaaaaaaaatgaatcaatcagctcgaggagtgtttttttctttcaagcaataaaatgatcgatctatacatttattcttttcctttcctgcaactaagaaacatatatggtgaaaacccataaaaacatgatctaaaagtttttcaattcatgaaaaattttactagagatatatagggtaaattaaaggcatgaaatatacacacaagatctcgagtccaaacttaactttatttgaaagtaacaaacaagacaaaatttaggtgaatagcatcatatatgatactatttacctaaattttttcttttttttatttctcccaaatattgaagtcgggtttggactttggagtttagattttgtgttaatgtatttcatgcctatatatagagcctatctctatttgtttcatgaaagaaaaaattactcttgttgaaatggaggcaggacctactttgctcgattggagctaaccacatacttttccttatcatatttatctcacagaacacatgacagcattcacgcccattgtacattcaaaaaatgcatgatactatgtgggttggttgctatactgtgatcttatccatatataaatatatattaaatatatattttcgaatggcctatcagatttgactggcattatattgatagggatcttctccatataaaaacatacatcttctcgtgcgagggaggctacatctgcctccatgtttaggtgccatcaaaccttcaaactttattcagcgaaggatgagatattggagagagccaaaacgatgcctagatccatagtgctcaagctaacaaaaccatcattattttaattcctatgttcctataatgtctaaggtaaatttttctacaggacatcacgacttcatggttttggcggtaacacagcgcacagggtgacttttggaaaagatactctcaaatattcaaatattcttttagggagacactctcaaatttcttttggtgtagacactctcaaatgttggatatttctctctatttcattaaaataataatttccggttgaagaggagagaggaatcgcctaaaatgtaaaaaatatcagccctcccatctatcttctcttctgtctctatcttcctcggcgcagaggcccggcgcgggcgtatgtgcaatgtaattttagtacaaatacactgtaaattttagtaaaaaaagaaggaaagaaatagagagaagacggcatcagcaagaaaacatgggtgtgtaaatcaaaatattcacatggccccacacagcctcatcgcccctcgcgccctaatccagcatgaaatccgcacaaatcatggtgtagaccctacggttaaaaaaacatcaaatacaaaggaaaaaatcacacgacagatatatagaaaattcgccacgtacttaaccctagatatattttcctctataaatgtctatgtacaccctctagaacaattgagttttatttagttgaattttgccaagtgccattcatattatctctagtcctcgttcgattagtcggcgactatagattcagagcctccaatagttggtgtgttgatttgctgggtcgattggatctaccacttcaatcgcaactattcctttatacttcatcaccaattcgcaatttttagattgcatctcactactagaaaaatgatttttgctagcggcctatggtgccgctagcatcaaaaggccagtgaaaataattcatttgtgctggcggacaaccaaccgcgaatgaaaatagggtttctctggcggcaacaacgactgacaacgaaaattggttttccctggtggcaatcttaagatacccaccagcaaaaacttttttggagcgaacaaaaatgaaaatccaggtccaaaatagtttcacaaattccaaatcattgtcccaaataatcacaatcccaaatccccaatcacaatccaacttgcaacatgttcagattcaaatccacatccaagttttcaggaaacaattcaaatccccatcaaaagagtttattagattcaattaacatgtaagtgtacatgcatacaagcattttgaacaatagcacaacattgaaaaaacagcatcaacaacagcgccacaggtttttgtggccgtcgccgaccgagcagcagctgagatggatctgatgagggagccatcggatttgggaaccctagccgccggcgaggaggtgttggcggcgagaccatgggattgtttagtctacatcacccgcccattagccttaccctaccctgttcatcacaccagtctgatcgtgacattttggttaacaaaatgatataaatccatgtttgcctatccatctcttttgacttgaacggcaagtagtccatagacaggggacaatttaggcattctacagggaggtgtagttattcactgctagacctttttattctcaactgttaccagaattcgggaatcacaaatgatatatagataacacttttttcttccatatatatcaaagatgcatcagcgatagatcacagttttttttatgcatgtttttatcagtgcctcgtatatatacatcgattattttttatacatgtttttatcagtgcctcacatcgattattatttaatttttgttttctgatcacagtattttcatctctttgatggttgttgaaaggtaagcaggaacatgttctgctcgattcggggctaaccacatgccttttcttatcatatcatgtacggttgttgtcccacataatactagatagaactcatgcacattagtctagctatattcaaaaacacattataactatgcctggtagatactagatagaactcatgcacattagtctagctacattaaaaaacgcatgataactatgcctgggtttattgctatctatggtgtgagtgataaacatcatcttcttgtaagtgatgagaggctatatatattctccatttctttcaggagccatttgaactagctagtatgatgagatgccggaggatgacaaagtgatacacatatgctacggcgcccatcctaatcattgctacgagacgtaatcttcactatctcatgtattcatataaatgaagacacaatattgtcccgggttatattcatttaaatgaaaactggattgttactatcttatgtattcatatatatatgaagacacaatattgtgccgagatgattattcaatggattattgtaattactagtagggtacctgtgcgttgctatgagaaattttgttgatcactggaaaaaaatcgggcaatccaatagacatccggaagtacggatggacggagtttggaggtggtttgacggtcagaccggcagggtccgagttcgagtctgttttcgtcgggtctcgggtttccttgttcgggaaggcttgtttcgtgtttcctttggtttctatcccgagtttggcatggagaagggcctgtagagggcaagaccaacccttatttaagggacaaggccggttcattgtaaaacccccgaatacaatctacttgaatcgttcttttactatgttttctattttaccctagtttagtccatctttgtcggtttgcgccgtaaaacatccgccgccactgcgagagtgcgatacctctttgtaggtttgtcctgaaaaccttccgttttacccacgagacgggtagttatcctcatattgatctaaatcggcctagaggctgattttgatctctaaatcggctccgctagccggtttagttgtttttctacaaaacccatcttgatttggccctttggctagatcgaggtggttggcgactctaggatcaccgcaaggcatttaggtgctgcgatcgtgcttgtcgacttgtcacaaaaagttgccaacacgattttgagatgcttatggctaagtacaagaaaggattagccggtcaacgatttgataatcaaactagtgattcaaaaataccaagatcatctcgttggaagagatttggtcaaacaccaaagcaatcggagccatcaactataccaactccatataaacctccagttgtgatgccatggtatccatatccaatgttactatatggttatccttttatgtattatatgccatggatgcctcaaccacctatgccgtgtcatcaaggattgaagcaatcacctaggacgataccaagtcattctaactcaagacaagaccgtttcccacgaaagaatcggtccggtcgatcaaaggtgaaaaaggtgtgggtgaggaaagaccaaaaagtgggacatttcctttcatgacgccttgatcggtcctaatgtattgtgtagtaatcacgttgaactcgttcccgctcgtcatagttgatgaataaattccttgattaaatccggccatataactcatagccgaaattgctgactgaatagattaatatacggtccttgatttccgtcggtatgctactgtgtgtatgtagcaaatatttagaaattgatgctattctctaagctagcaacacaatccgaaccatcacttggtttggctattccattattgtctaaattaataatacaatccggaccaacacttggttcggctataatggttgttgcatcattatctaagctagcaagacaatccgaaccaacatttggtttggctataatcgttatggcatcactgcacaaattattaacacaatccgaaccatcgcttgattcggctatacatgatattgcactatcatctaaactagcatgtaagctactgtcatccactcggctttcctgagccagagcttcattcaacacatgatcaacatcaagaaatatctggtcattcaatctctctttaatagaatcaagcaatccatcatatgcaatgttggccaaatctttgtcagttattttcaaactaaaacatcggtttttaacatccctaaacctttcaatataatcagcaacagattcattgtatttgtgcctaaccgatgttaaatcaaacaacctaagctcagtctcactagtgtggaaataatcatgaaatttttgttctaattgagcccaggaagaaatagaatttgccggtaaagaagtaaaccatgcaaaagcagtaccgaacaaagataaagaaaacaagtgcaatttacatgtatcccaattagcctcaccacattgcgctaaaaattgatctacatgctcccatgtggtcctactatcctcaccactaaacttagtaaattcaggaattttataaccacgaggatatgggataatatcataaaaattaggatacggcttttggtactccctagcacgattccttagctttgcgaaattctccctgatagtatttctaaaccaatcctccacagtttcaggctttggtggatctggtggtggacttggtggcctaaaaggtggttgttgcggcacaatattgttatattggccatacctagtatcgggaggatatcccctattaatatcattgtaggcattagggatatgtggaatagcatgactaacagtattaacaggtgatgaataataattaaaatcagtactgctagtcgtggtatgaaaacctggagaaactcccagggaaccggtctgaccggcccatggctcggtctgaccggtggtcagtggtgcggacagaccggccacaggaggtccgatctggccaaaatagggcacggtctgaccggctatggtaggcacggtatgaccggcataggatgcggttagactggtgtcatgaccggtcataccgttagctaggttttgcatatagccgattcctgtgtaatcggctgtataatcacccattgaacaccccccctagcattataagcatattgtataggagcaaaactagaagtagcatatgcatgtacacaatgattattaacgttttgaatagcaaaggacgggttgggcgaatcgaaggtgaaaaaggtaaagaaggtgtgggtgaggaaagaagctaaagctccggaggttgttactatcaaggaaaagtctcaagatgttcaagtacctaccggagatgcggcaaaaattatacaagtggagaagactgaggccggcaccgttactgtcaacattggcggtctaaccgagacagctggccggtctaaccgccagtctacggccggtctgaccgatcctcctgccggtatgaccgacggcttgcagccggtctgaccgggcccagaggccgatcagaccgaggggcattaaaggtgagcgggaaaattgagagcaacacaggagcttctacatcgaccaaaaatattaagaatcattgtttagctcctggaaaacaaccatagccgaagtggataccttccggcttatctcgctctcaaaagaggaggctacagcgtcttcgagccataggtcaaaagaaaaaagaggccgaagatgtaaagaacaaaacatgcaataatttagagcctcgaatgacacctaagcgagtgtggagacctaaagaagtaaaagttaaaagatcggtgatttcacggagtagcgatggattcaattcgatgagacaagaatcatcggtcattagagataagtctccttcacatgatgctatggatgttggtgcggtgttcgtcttgccttcgaaatcctgcaatcaagaaagctgactttgcttgggggcaagacattaatatgctcgtgaagaaaccaagagaagatgaacggcgatggatacaacatcacatctttgagccgccgtttgttggatgctaaggcaaggtatgggtttattgtgttcatcatcatattatatgcctatgccatgttagaacattgcttgatatttagcacatgtgtgttttgcttatcaaatccatattatacataaatgttgcaaatgccagttctaagtagtggaattggtagtttggcatataatttgtttcaagtatgatttggctcatgagtctttaatatttatttaaagccaaatcgtatgtgtttttatggatcaccatataagatatagatatcatatgtattgcaccatgaaagttttgcttattagtaattcggctaatgtcaatggtcaatgtgatgatttgttctagagttattttatttcagaacattggcattgttaatattttgcatacatgctcaagccgattacttacatttgtagtttattggaatctatgcatgtgatacatatgactttggtgattcattattgatcatacttcaattggctaagtgttttgatgccatgatgattattgtttcaaaagccatttgaattagtattcatctagacatgttagttggatgttatagtttttcatatgtctagagagaaggaattttggtccaataatttgatacaccaagcatctggctattatgtgaagaaaaattatataccaaaggccgatgcttgattttaaaagtttggacgaaattggcaaagtcatagaccaggggcggtctgaccggcattgcacggccggtctgaccggtggtaccggcggtctgaccggctctgcatggccggtctgtccgggcagacagggaggtctaaccggcattgcgtgtccggtctgaccgatctcgggcagagagctgggggcacgttataattgatttaaagaccgaattaattgtgaattcagacatttgtgcccataagtcagatagattggagaatccctttgaaaagaatatttgaaagatcctagtcttgggattgatcggaagattcggcggcaagcgctcaaatattatatcgccgaaaaataaatggagtattaattggataatgatcaatctgaagttgctaggagagtagtacatgaagggatttgtgaaattcatcaatcggcccgtaagataaattggttgcttaggagagtggggtttcattggccaaaaataattgatgattgtttcaaatgttatagagggagtgaagcttgttaacggattggcaatgttcagttagcgcctaccgctgtgttgaatcctatcattaaactatggccgttccgaggttgggctttagatttcattggtcaaatttattcttcgtcatcaaaagggtattggttcgtactagttgtaatggattacttcactaagtgggccgaagccgtgccactcgagaatattacttgtacggaggaggtaattgactttattttgaaacatattgttcatagattcggtattcctcaaacgttaaaggagcttctttatgtccaaggaaatgagaagttttgccgaatcttatgatattaagttgttgagttcttctctttactacgctcaggctaatggataagccaagtcgagtaataaaacattattgaaattgccgttttgccagttgaggtaaatcttgtctctcttcggtatttcaagcaagacgacttgtctgttgaaaattacaagaccttgatgggaagcaattttgaagacgtcatcgacaagcgtttgaagactttgaaggagatgaagacacttcaagatggtattttcagagagcaattaatgagagatagcttgaagaaatacttaccgagcatttggtaagatgcttaggaagtcctatggccggtaattggattatcgccctgagataacatgttctatgcttttaggttcacgtatgttcaccaaaaaggcagggggcatgtgtttacacccaaatttggcacctatgaacgaaatagggaaaattgccaaagtttggaaagtgccgggtttccttcactagggccggtcagaccacaggtatgtgggcggtctgaccggctagtaggaccggtttgaccgcaggtatgtgggcagtcagaccggcagggtccgagtccgagtctgttttcgtcgggtctcgggtttccttgttcggaaaggcatgtttcgtgtttcctttggtttgtatcccgagttgggcatggagaagggcctgtagagggcaagaccaacccttatttaagggacaagtccggttcattgtaaaacccccgaatacaatctacttgaatttttcttttactatgttttctatttctattttaccctagtttagtccatctttatcggtttgcgccgtaaaccgtccgccgccgctgcgagagtgcgacacctctttgtaggtttgtcatgaaaaccttccgttttgcccacgagacaggtagttatcctcatattgatctaaatcggcctagagactgattttgatctctaaatcggctccgttaaccggtttagctatttttctacaaaacctatcttgatttggccctttggctacatcgaggtggttggcgactataagatcatcgcaaggcgtttagatgctacaatcgtgcttgtcgacttgtcacaaaaagttaccaacaaagtgcttcggttgctgctgctgcgacttatttgataattgtaactaatcacgattaacatgatcgagccgtgccgtcaaaagcgaaacaatgaatccattggctggctggttgcttagttgaaccgtaacagtcagatgttatacgggccgattagacccataaggtccatagtttgtttcctttctcaattaatttcacgggtgcacagagattaggcccataaggtccatagcttgtttcctttcttaattaattcgtgcacataaccaagcaaaatattccatggcgggtgttgcagatctgctgcttggagtgccacatatctgatacagagagagcttcttggcagtgtgaagatctggaggtgcttgaaaatgctgaaaaaaaaaagcatgggaaagatccacgtgcaatgtacagtctcagccttttataccaagaaattggtgaaattagaggctggataggaattgaggagttggcttcttttagctcgaatactatctgctcagacacagtttgctgatgctaaaaccattattgatgcggctctcgatcagactgggaaatggagtcaaggagatttattgcgaaccaaacccagaactcaaggctgcacagggctaactcagggactgctgtcgagacatacaccaaacttctcgctgtcattcaactcagaaccaaaagtctcggtgctgggatcttcttggcaaaggtgctttaaaaattctattttgaaattcatcagagataatcaagtttcttgcacaatatcaattactcttacactaatagctcttgaaactctactgtttctgtttcattagttatctggtagcattttctaccagctgaacacacaatattctacgttcattttaattcccattttcatggcaagagaataattcctttgatgtaacctacctgatctcctttctgaaagcatattatctgtttaaaatgtaatcccgaacgatcacaattaagaaatcacatctcattttttcaaccagcaaacattgcccctatcaataaattgcatgatccacactttttatcagtaaaatcaactacagaaatcacaaatgccagcaacacttctgcaggaagacaacagagcatgttcaaccagtgccattggcaatgataaggaagcttcttgcgttgctccttccagtttacattcacatcaaggaaccaaacagctggtaatcagagtagtaaaacacagtactggctcatggtttatctgaatgatggagtataaagtaagtatagtgcactactcgtatacaatagcaattaatatttagcagaaaaagagtgtgcatataggtaaagaaggtatttctttgaattgtttaacaaattggtcaggaagacgtgtgaagaacagatcaaatgcattgtttcttccagggaattgattaagtcagatatgctgtagtaggagactttccctcctggtaataaccactctttccatgtattttagaaaatcgtggccatgtacacctatttgctctaaggttcatcaagataaaatgaagatcatcgtagcttgagcctgctgtacgcaagggccaggtgtttttccatagcagaacaaatgtttattgcttaaacaaataacagtgaaaattattcaaaggaaatgattatcggtcagtctagaatatcggaattaccacacaagcaattcacttgtcaatgtcaaaatttgaccagatgtattgcttataatatcaatttccattatgtcgaataatacactgttcatccaaggtgtacatatataacaataatgagatgagttggccttaccttgatgcaatgtagaagaatcgttcacttccaattggcacgttattaaatcagcagcactttttttggaaagctcgcaaagtggggctgttcacacgacgaaaaagtgaccgaagatactttttattagtacatatatatattacaactcaagctaaagcggatgctaaaagcaaaatattggatccttttaggtacttacctacatcactattggtagcagacttatttaaaacatgactttcctccttcttccgttttcttctctcacggtcattcttgttcctctcatcctttttctcctgggtcaatgatgcgtactagtttctagcacgctttcttacaactttagcatgggtaaggttagtaacatctccatgcgaacctgtgcacatgggcaaattgctgggtgtactgaaggacgtatcgcggtcatccgcaaatggttgactattaggcgtaactatacgatgcataactttatggcccacatcaaaagaatatattcagtgttggttgatacagatggatatatcaaattaaattaggaaacacacattctgatgaagcataccatttgaagcagttggagtgttttgttcagaggtgtcacagttatctcccctagcccgcgtatttctcgctccggaagcaagagggactaagaaaggaacacatgtgtgaaattagcatgcaaaaaaactttattgtactttgaaataaaaaacattaaaatttgctgcacattaaccagttaaaagaacatgatcagaaagaaaccagctgatgctttgagtctagcccacatcacacacatatagtctgcacattggtgttggtggatatagatggagattgaattaaattattagaaatcaaacaatctgataagtataccatttgaagcagttggagtgttttctttagagccgtgacactcttcgtcgtttcttcgaacaacacataacgacttggctctacccttgccccgtctattagtgaaaccgagaccacttgtatttgttatatcagcaagagggtctaagaaaggaacacatggtcgaaattagcacacaaagaatttttgcatatggctaaataagatgcacatagctaagctaagaaactcaaacatgatgttgtacttgatggtgcagcgcccccaacaaactctttcattttagtattccccaaaatctagttccgaaaccaatcattatggaaaaactaaaagcttcagatcccatagcaaagttaagaagggagcggtgaagaaattggtcgtaccttcaattcagggaatgagattgtgagggatagaagcagctcttcgcagtgatacgtgacgaggtgtgggcagtgctaccgtctttgtggatcccgcctactttatggtggtaagtaaattcttaagatgtttcaaaacaaatttaacaattcaacatggaattaatctagcgtcaatcgcaagaatcacttcaaaatatatggatgatactggtatcaccatgagtcatgacagctgatctgattcaaaacagaaaaacaatgtgagttggaatcctatattcctatatatatctatatagttgatccacactaagtgcaattaatttgattttcctgtgatatggttgctccacgtcactaagattgctttggatcgttcgattaaaattgcacggcaggagattaggtcgtttctgattcctccgttggtggaaaacacaacggatgacatgcagctccctggcttttctttctcggtcttccattctgatcgctccactaacccctgtaaccgatgaaaataatgcaacctcctagcgccctgacagttgaacagcttcgttctcgcctccatgctaattagcgtgccacaaatcaaaggaaaccgaagcaggcagctgagaaggccaccttaataacagccctgctttaacagctacatattcagtagctccccagggacagcttgaattttggggtccatctttctacttctgtagtatagcgcgctcttcctttcaacatctgcccaatttgctcgagagcttcagtttgcttcgtcatcgacggtgttagacaataattagaactcaattaatcacacgttattatcacctcgttttgtgtgaaacacttaatctttatcttcatcttaatctttaggagattcaaacaccaccataaggttctctcactccttcctgatagcagattatttttttatcagctgattttttttgtcccccacaaggtttagtatttttttcccctaggaagactctcctcttttacgagattatgcattcttacttctcattggattttcaatacatgtattttccttaatagccaccgagtttacaatacccttgctctcaatctttctactttatttgtttatcggcaatgagaattatgttgtcttttctcagattatggtactgtggttcgagaacatttgaagaatccactctgtttcctttttatagcacaatatcagttattatattcattcaatgatgtgatttgatcaaccatgataacaatctgcaacagtactacaaaggtactccttattattcagttcagaactattaacccgcttttatgttctcatgaggtattgttacttttcttgagtatagtgtacaagtatatgtgtataaactttttatgctttttggatcagcatttccttggttaccgattcaatgcatcaatcaaaagctgcataatttatttagttcatcaaaaagtaactttgcagggataatttcatctgttcacctgaaaaaaagtgcgcagcagtacagattgaggtaaaatcaatgtttcgtaatggtttcattcgttgaatgtcgcttcattttgctaaaaaaaaacgaacatatatgatttgctctatgtttgatataaaaaaaatttatgttgcctcatttttacagtttgcagctatttgtttctgtttctagggcatttagcaatgtcacatcatctatacaccagcttgctacagcctacgttatctttggctgatgtacctaaacttaagttaactattttagaaatgtatcggtgatccgcatgtttcagcaaataaaacctgataagcacttgctgaacatctttatatttccttccaagtgttttcagttaacagttgccttagttccctatcttacatatatatatatttatcgacaacattccacagcaacacgcactactacggaaatcatctttcgtggcggtcatttttggtttttcctagcggaaattgcagccgccacaaagcaaagttcagagaaaatatcaatcttcgctagcggttatcggccgccagcgataatcaattttcgctagcggctgtattataccggccgtcagcaataatcgattttcgccggcggctgtgttataccggctgccagcgataatcgattttcgctggcggctgtcttataccggagggagtacaacgttaatttgtaaacccctaattttttagatggtatacgtacatggaatcagtgttcgatctgcatccgtcgaagtgcaagacaataattatattttgtgaatttgccatgtgtgacttatcgatattttccaggcttcttacgaggctatttcagttcaaaatgtactggagtagttattattagcttaatcatgcggatggtgccatgaggctgtacgtctgttgatgcatttttagatttggatcgatctggatgccgcagagtcgaatccagcgtctgctcttgcgtttttagatgccatttttatttcacagcagacaaggctgcactcacagttttgttagttattcaccttcagaaacccaggcatgatcattacatgccctctcactatatatatatatatatatgcacctcttacgattttgagagagaggatacaattctatattttgatatgtcattttattttgatttatcgacaaaatgagaatttggagagaacctaattcaaatctattgacggattatacacgaacacttaataatatattaaaaaataatgatttttatacatggtaggcctctaatgtggataacaactttactccatgtattgatctgtcatctttgtcatctatgacacccagttaacaagctttggcagctcagtttgaatcttggcaccctacttttttccatataatcttttaatgtggcgtaagagatgatgcagcaaattgattttatcttatnnnnnnnnnnnnnnnnnnnnnnnnncaaattgaatgatgcggcaaattgattttatctgactcaatgcaccaatttaaatgtaattctcatgtatgcagataagcaggaggcaaatcaatctagattgatatcacatgcatgaaggttaaggccttgtttgttttagcttaatattattgcaatctagattattaaatcagattactctaatctgaattataataagctgagctgcgagctgtgtgtttctctggattattggagaatctaaagggattattgaagacatctaagggcagtggatctgtagccaccgtctgaaaaagctcctccagcagagattattagattatactggattatagattatagtaatctatttgtttatttcagcttactcctgataatccagattataataattctaagctgaatcaagtaggccctaaagcatcaaagatttttcatgcaaattagagagtccaagtcccaaacgtcaatttaaattggaactgaaacggagtactagacaagcctgtggaccgggcctcccttctaattccctcgtaaaatcgtacgcacgcacactttctctcccaattcccatctgcgcgggctgctgcgaattgaagcgagctaggacatgggagggagaggacgccacacgcacgcctgcaaagcgcaaggccggccctgggcctaggccggttgtgcgaccgcctagggcccaggccggtggggggcccatcaatcacaccccctccccacaacagcccagcccagcggctgcggcagaaacccagtgtgctgaacctgcgggctacggcctgctatttcgcgcaagcgcaagcccaggagggagagggagcgctttattttccgttttttttaactactttgctatatcttactcgaaagattttttcttatctcttactcgattttctcacttgtgtattttcttgtaagttacggtgtaatttatgaaacttacattataacttttgtaagttaccgtgtaatttttaaatcttcgcatgtaagttttcaaatttgtattggatttggtttttttttcttgaagatatggtaatttagtgctcattatggtgtttcttagttgctttttgtcttttactgtgtctatcagattttaatctaaagattaaaaatatgtgtgatacgattataaaaatttttcgaaagatgcaaaggtgctccctgtttataattgcgacttctttggcgtcttcgttttctttgtttgttttttttttctttccgcaaatcacgacgtactccgcctctggccctccgcgaccacgagcgactcgctgactcccggccaccgccagtcacgcgtcgcgcgcgcggccgcgccaacgacgtacgccgcacggccgatcgacgtacgccggatcgccggactcgcctctctcacgatctcggcgtctctcctggacctctcctgacagtggacgccgacgcccggggctacaggaggagggcaaactgaggttaaagacttcttgtttgttcttgtgttatttcttcaatttttcgaagaaatttaggttagcgacttattacttatggacttaggattttctcgcttgtatgattatatgatttttcgatttttccactctaaaagttaggttatagagtatatatattagaagtaaaaaaaatagcatcaccccttaagggcctatagtgtcgagttcgtctagtgccttccaaatgtcaagaccggccctagcaaagcggaaacggttttctggttagggttcgcgccgcccccatctatctttgcatgttgctctttctaatcatcaatttcgaattcctttataattaatcaatttcgaattcctttataattaatcctgatcgagagaacattatctctttttctcgtaatgtaatgcagcagaagtttcgtgaacattatctatttttcttgttgtaatgcagcaaaaatttcgtttctccattggactagcattaattaatttttgcattccattgccatccaaacttgatgcagattccacggaattttgctattatgggtcgcaaagaggcgaccgacggcggcagatttttctacgactggcagagaggcgaccgacggatggttgttgtgacgagggccacgaagaggaggttaaaggaggaatcctgcgacccggaactgagaaagatgaggagggtggaggaactgaggaggttgaggaggctggaggaggaatccggtgacccgaggctaggagaagacctgataagccgcctcccagacgatgtcctcaggggcatcatcactctccttcctaccaaggatggcaccagcacccaggtcctctcatgacggtggcgcccgccgcccgctctggtgctccgtgcctctcaatcttgaggcttaggtcaatggcgagacaatggggaaggatgtggccgccatccatgacacgcttcgagcccacgagggccatgtccgtcgactctccctcatctggagagatggccacgaccgttgctttcctgtcgtcgaatccatccttggatcccccgagcttgaccgcctctaggaatttgaactgttctatgataatgtttgctctcaaaatcctccagttccactatctgtactccgtatgtctgctgctctatgtgttctcaggattcgttcaacgcgtgatggtgcacttcagtttcccatggagactgcttgcatgcttgatttcccacacctcaaagcgctcaccctatccaatgtcaacatcatggatagcgctctccatggtcttctttcgcgatgccctgtcttggagagcttggtgttggttgggaacaggtggtgtcgttgtctccatattagctccttgacacttcagagccttggtgtgtcagatggtttttcctcggtagaggggaagctggagaaagtcactattgtggatgccccactcctagaaaggcttattattccacgtgacaaatggcaggatgactttgttgttcgggttactcaggcaccgaaattggaggcattgggctatctaagcgatggaatttctagacttgagattgggaccatggttgtccaggtagcaacatgcacatattccataggcatttatatttctcgatttatttttttcttcatgctcctcgctcatacatttcatttgccatgtctatttcagaaactggtgcctgttagtctctccaatgtggtgcgcactgtaaagattttggccattaacaccaatttttatccgaatgttgttattgactttataaaatgctttccatgtgtggagaagctatacgtcaaggtaggaattttctctttattaaaataagtgagtaaacacccattttgttctattgtgcgcgtcttggcattggccatcttcttggatcgataggcatatcatgtttctatcaactcttaatttttttccttggcaggtgcgctattatgcgtacttcaataatgtacaacaaaatgtttcacttgagtgccttgatctacacctcaagatggtggaatttattaactatcaaggaaatgtggaagatttgaacttcattaggttctttgtgttaaatgctctagtgctagaatgtatgaagcttgtaacccgtcgtaacaaatgcgacgtgaaatggattgaagaacaacatcagaagctacagctttatagtggagcttcacggagagttacatttgatttccaagctgattatgagggagatagtttggtacacatgaagcacatcagtgatttgactacaaatgatccatttgatagatcattctgtagatgccgtgatgaggaaagatgaattcctttgaagctgttgatcagtcatatatatactttggtaagtatcaagaacatgttagtttacacgcctcaaaatccttttttgttttggcatattttgttgcaagcctaggatatttatttttccaaagaagttgaatgacatccctattctgttttttttttcattctttctgatttgctatgactgtctgttcctcacctattctacacaaaacaaaattatggtggttttgctactaattagccaactgccggttagatacatactacattaattttcacctctaatgaatacgagcaagttgtaagaaaccatgttagcaaaaaaaattgtatgttgaagaaataatgaatatttactttgaattggttgttttatggaacattaactaactccctagtcgaacggcaataagcacgattggagattctgaatatcaaatcccttatagctaggcattaacattgttatttttatatttttcattttggtgccacatggggtttcagtgagacttgagttttaagttgttaattaagctattggtccgtaagctgagacaccagtataggggtttaaaaaaagcagatgctcacttattatccaaaattccttcatgacaaggagctgccttgttctttgttcttttacaacgaagaagttttttttcccctgcatgataatggcagcagaagtgttctgtctgctttaccaccgtgattcaagaaaggaatcctctcaattatactatctatgtgtgtatatatatatatagtggtaataataagtttgctaattgtttttgtttggataaaaaaatagttttctaccattacacctgttttttttttgtttttgctatgtatatatggtacttgaaagaaaaatctgattgcagtgttctgtttgcaggtgtatgcacatattataatgctgctactagatggaaaggagtgctactgctgctgctgctgctacagagacagccgattgttcttatgaattctgttaggcccaactatctactatttttgacgtcttttggatagttcagtagagatttaatcatttaagttatgtcattcaatgcactctgtttataaattttgttttgtctttcgtctcaaatcctgtggccatgatacgactgaggtttaatttgagcggaataaccacttgatgatcggtagtgggtaaatttaagttgcttgtatgcaagtgtagtatgaatttgatgggttagcgcttcaaatgctatcagttgtaagcttgcttggcacggtgggattacgctgtggtgagtactaaattatgtgctggacaggtcaagatcccatctagagaaatgaatttggtgagtactaaatttagtactttttaagctggacaggtcaagatcccgtctagagaaatgaaatttctgcctaaaaaaatgaaagtattcaacaattcagttcaatttacaaacagtacaattttataccccgtttgtaaagaaaaaccatgtgtcttgaaaactaggagtgaaataaaaatacaattaactgcacaaccttaccaaattttcataattttggagctagtgcattgcccttcttttagtcatcttggcttttaggtttggaccggtcgatgcatgcaactcaaaaagctaaaagagccataggtctctagttcaaatcctaggtagtgcacaaaataaaagttgcaacatacttatattccatgtctgaaatcaggggagcctccgcgtaaggggtgtgttagagtagaagtgaacgatcggtgtttgagtataagtgaaatgcactctacctgagggggtgttggagcataaatgaattgctggtgtttgagtataagtgtattgtccggctccctcatagtgtggtgccagctcgaggcaacggtgagaaaaaggaacctccagcactagtggcggtgcgacttgaagaagagaaaaagggaaaaggagataagagactggatgaaagaaaaaaataataaatgaaaagaaaatattccaagtggttctataatttgtcaatcggcataagagttagtgacaatgccacacccacgtctatgtggcatgccacatcaatgtcacattagcgtctaggaggggtcgtggtaaattaggatcaaaatgactcaatttaataagttttgagatcatatatccggtattttaagagtatgggatttatataacccacatacaaattttaaaaccgatcatgcgcttcaatataaatggaggtgtaatttactatgacaataaaatcgtgctgctcctatttgcttaatttgtcagccagcttgctgcatgccagggctggcaggaatagcgagaaaattatgtatgtgttagttaccgtctaattttgacaatttgaccctttgaaaaaactaattttataaatgaaccgtccccaaaacttatttcgaaaatgaccttttttttttcagcgccaaatcatgtggcgctgaacttagacaccttagcgccacgtcagctggcgctgaatgccgtgccacggcggatgggacgctaagtcagcgtgccaacatacattcagcgccaagctatttggcgctgaggtgtctaaattcagcgccacatgatttggcgttgagcaaaatggtcagttttgaaataagttttgatggcggtttatttgtaaaaatagtttttgcaaagggtcaaattgtcaaaatttgtgttagttacctctcacaacattttacttctattggatagttgttcaatcggacagcaatctttctggcacgccattttgtcatcacaccatttttcttctattaatggatagtagtttgatcacacaacaagctccctgtcatgccatatgtgattctcattctccctatatatgtcattacaaatataaaaggtgatccatgtttccatagatatgtcgttgtctattaattcagcaatgaaatgaatgagatattgaagtggcctacatatgtcattacaaatataaaaacatgtttccttatatatgccgctatctatcgattcagcaatgaaatgaatgagatattgaagtgagccaaagttatgttcatgttatactctaaagaactgtattcacaattcaacgcgtacatggaggagaacactcacttgtatgtttttatgcatgttctcaatccaacatgctggaaaaaactcatcgaacatgtcatgttatatagttttagataaaactagatcgagatccgacgatttacggtggataacagcggggaccaatgcataattaatagaactgtagctttttttttcaaaagtgatatctgacgtggtatccctaactctccagcaatccagcaatcccacggtgtttaagtaaacaaatatttcatccatatcccaaacattctattgatacctaagtaataccacaatattatttcttcttccaaaaataccacacgcatcaccatgtttatttttgtggacaaaattgccttcactgtctcccctcgagtgaatcagctacaaaattctcagatggacagtgagattgttgtcgtcccacgccgaaggtgacaacaaatttccacacaaagaatgtactacctctcgctcgtggacgatagtcgtgacgctggcaggatgtgcatcttgctccgcacctttacatggtgcgttgtactgcccaggtgaacatcaagcacatgtgttcgtgttcagcagtgacacattaatcagttggagagcagcaagacaactcacacacatcctcgtacattcacagcaagagctgttcttggctttagggaagaggtacaacatgacaggagaacacctcgatgcacttggggttgctacgccaatccgtgctagtcggctcccacggcggcaattgggagaactgccacggcgatcgcggtggcaatggttgaatcgaccaggggcaattttgtccatagaataatatttcctagttgtcagctaatttttgtggtattcttcgaaaagatgcttctaccttttggcatgcaatgaaggtggaaaaatcttgtggtattacttggtacctgtaaaatgtttgtggtatagatgaaatttccccatagttttatcatgtgtgtgcatatgctccatctgtatattataataggtgtcatcaaatcgtcgacaataacaaaggg

SEQ ID NO: 58835 - DNA, 7830 bp, Oryza sativa
  unsure (1)..(7830): unsure at all n locations
taaaccaacaagggtgttttactatcaatgcagcatccatgcaatatcacaagatttcgatgttgcacagcggaaattgtcgcaacctctgtcacaaactggcttgttccctgatgagatgattgtgaaagttgcttcacagctataactctttcatcaggtagcttaccctgccaaggtttttacatgtgtattttgagcatagacaaatgttgctaaaacacagcacttcaatgccaaatcagataaatttataaccagctgcagttgtacataattaattatggaaataaagaaccttatacactggcccgaatccaccttcgcctagaatattttgagaactgaaattgtctgtggctagctttagctcagcataactaaaaacgtcaggtcgtccaaccaggttgtatagttctgcatgttatttttagcacagatgagaagagtaaaccagataattttgatgtttgaattatatatgtcctgatatataataccttctttctgttgtgccaatgctctccgcttctttactagtgtaaacactccaaataatgctgctaatactaaaactattgcaccaatcaatattccggaaattgcacctgctttacttttcctttttggtatgccgtttcgaacggtaggagtaaaatctgcaaaggaaaaatattatttatcggcagcgaatataacacttcctgctgttgttttagtgtggtgcttacttggagtgacgctcaatgctgagatcattggcccatagtaattatctttagtaggtatgtcaacagtgcccttgccagcccagaatagatggatctcaaggaagtttttagacacagttaccatgaaactcctattaactacggtaaaagattttccacctgctgttttccttatatcgaaatccttttgttttagagcaccctatgtaaatatcagtaatacttttagataaatattggtaagattcagtagaaaaacattatataaaatgcacaaaatttctacctggatatatatgtcaaaaactcttctccctaagcttagccaagtctgtgagtctggaaaagctaattctgcgaattggagcaaaacagtgtaatttccattctcaagtccaagtccatagtacctcagagatgatgatgacatccttgcagtttcaaacaactctgaatcaactacattttgaaaaggttgggagctatatataatattctttgcatctatggcgttccctacactactgacaccccatcttgtttgaccggtaacataatatgttgcagctccaagatttgtaggatctgcttcataaatagtgtcatctgagcctcttatggatgcattactgccacagtcaactgcgaaggaataatctgcaattaagattaaaaaaattgtagccatcattcaaattcgtaagttcatgttactgtttagttttatgaagaatgagaaatatacattctggagatccacggaaacaaggggtgtcttgttggaggcagtttattccccaaggtagcgtactgtgcacaatttgaattgaaaatttaaagttaccagcaagattttcatatagttcactcgccaaattagaactaaatgtcacaagtacctttcactggtggtatcgagtaagaagttgtttgccaccaaattcctttcaaaaaacagaatattagtatttatattttttctcagcgacacaaatatcacacttttacacttacaactgtaaattgttttgtctagcccaagaaggaatgctcccagtgagttggttgtacgaaaaatctctgtcaacattccagaattatgttatacaaaattagtgcgtactattatgaatgtagtttgtgctatactgccatgtcaattgtatttgacatacatcacttttaatgaagagcttataccatccggcaactttcctgtaaggctattgttcccaagaaacctgaattgggcacagttcaagattataaaatatactcatctgcttaatacaggctcgtatgaacaaattgatgtaaagaaagaatttcttacaaagaattgagatttcccaaattcaagatggattgaggaacttctcctgtgatattgttaaaactcaagtccctgtgccacatgactatcatattacttgaacatatggtacacaacatgaggaaatgagtaataacgtcatcagttggcaccatggcctgtaattgaaaacttacagcaattttaactgtttaaacatggaaaattctactgctccgagatcactagatatcttgcagttcctcaatattctgtaacgaggaaatacaaccttggtaacttgcaactagacaatactgtaagctttatagctaaaagcatcacatacagtgtgctcagggatgccatattactgataaatgccaacggagagaccccatttataatatctccaatccatctgctcatttgagtttttcataaattagttatcagccttgacattgtcaaccttcaagagttcatgccacaaaaagagtatacttacaatcttgttaatttggtcagattagacagactttctgggactggtccttcaaaggagtttccgtggaaagcactacaagctcattattttagaaaaaaagttagggacattcaacctttataaagtaagaaaaaaaatctctgtgtgagcattcttaataagatctctaggtatgaacatgccatgtggaccgcttactgtgatgcagatatctgcatttatattgagtgaggactgaaatgtgaaaaaatgcttttgtttaagtctgaatggagataatgtgatatacagacagtaatttatcttgcacagattcatctatctctgaacagtaagaacgaatgatatcttaacaagcttacatgtcttccaaattagtcattgtgcccaaataagcaggtattttccctttgaatacattatctgatgcactcctgcaagcagaccaaaatatcatttagcatgacaacatgacgaatataataattgaggctatgtttttgactatacaagaacttcaggttctgaagttttcagaacgatgaagggaacggaccactgaatccagaactatcaaagtacctgttattgaaagtttgaaatattatcatgtttgacaatagatatgaccattccanatttagttcttttacaagtagaaataagaagttagaaatcaatggggtatcttacaattgctgaagtttggtcaagttacccagttcttctggaagacttcctgtaaaattgtctgagctaatgcccctaaatgaaaaatgaaatatttcaggactgacaaaaaatttttgtcatcaactaatagcaaaaggggcatagttttcctgatgtgccattggacccacaatattcatcattacaatatgttcaagtatttgctgttcaatcttacttgatcatatgaagcaccacatgagcaggagttacactgacatgcctattacatcctatttagtagtagttttgatcttttttatcactccctccgtcccattataagtgcaaccataagtgtttctgtatcaaacgtttgaccgttcgtcttatttgaaaaaattatgattgtttttaaaaaaataagtcatgcataaactactattcatattttatcatctaataacaattagaatactatttataaaaatatttcaaataaaacggacggtcaaatgttgagcactaaaacccacaactgcacttattatgggacgggggaagtagaacttatgcgattgctatttcatgtattattatattagttcgtgcagtccaaatatatactccactcatttcatattatctgtcattctacttttgttgtaagtcaaacattatatttctaaccatccatttttacatatttatatagtttaacatttagattcaacatgagaaataatttcataatttatagttcgtactccctccgtaaaaaaaaatacaacttctagctaacaatttacacataagctatgctcagattcgtagtcataagttcaactctctctctatatatatgtgcgcgcacgcgcgtgaaaactgctaggaattgacagttaaagctgaaaggatgagtggtttgtagcagagggagcagtggaagattaatccacatgtgagaaaagatttcttacaatgaaagaagattggtgaggtttcctagttcctttggaagtagtccagatagtggattgaaagataatgaccttgagatgattagcaataattaaaaaaaaacaacgaccaatagatggaacatgatctagaacaaacatgtaactcatacaagtattgcattgaagtaaattttccgatgaacgacggaatgggaccagtcaagtaattacggaataagttcctgaaaagatcacaaaaataaactagaacaattagccaacacaaaaataatgatgaatacctgacaagcatttgttggtgttcacagaaagaaccatgggattgaatttatattttgtgcaaacccttgatctataaattattagtacaagactctttagtagtgccacaccctgattttgtttcaggaatttataaattatttaataaaatacttctagaatttatattaaagtgtacattaattaagaaaatgaattaaagtgggaaataaagtttcctaaataaaacattgctggatttaatttttattatattctccatgattagtttacactctctagaattttttcggatttttcagagctcaattactaattttaacaatacaaacatcaattcaatggttatttaaatataaaataaattagaaacccctccaaagttctgggtcgaattgagcccatgtctctctctccgcgctcagcgcagctagcgctaggccgctagcctaagtcaccagcccaccgcctccctcctctcactcctgccaacatgtgggatctggtcccacatgttagtgttgtccccagcatccagccagaatcacactgtctgcgttcctctccaaatccagccgcctctctagatcttttccaaaattagttgaggccgtttgttccctatctcctctttcctttccccatgaaatccccaaaaatatctaagtaaatcgtgtggaatcgagctcgaactcggacactctctatccggtagaaccctagtttttcccagcgctgccatagccgtcttaggcccggatacattatctcgtggctacaaacaggatccccctccctctcctctttccgctgccaccctcgcctgcacaaatcggagcctgtagccctagcttcgccgctagcccatagcatcagcactgctgccaccttccagtcggatcacgtcgttgctctactcgtcgccgctctacttgtcgccttcgcccactgtcaccttcgccgggtgcgcaaggaggaggcgcatttcatctgccggtcctccatcaccctatactgccagaacaccgctattgacgatgacccgagctacaccgtcatttccacctcgtcgccttcaccgtccgtcgtcgcaacgcctctcgatgagttcggctcgtcacactcaacctctcggtaccctccgttcatgctgccgtgcctgattcgccggcgatctttgggttccgagcaggtcgtcgccggtgaggtgacatcatcaccacgccattgctattgtgttatcaccaaaagttggtaaggttccttagtggatttggttgaaggacaaatttgatcaaccaatggaagtctatccagaagataccgaattcaaaaaggattgtgaagaccatggcatggcatattaattctatctgttgatttagtaactttcctttaatctttaggaagttttatctaatgtctgattaagacttgtattttttccttttatgtttagcaaacntatgtcttgtctgattaggacttgcatcaacctgaggagataaatatgtaccacagggtctttgtaaactttctccacatattaatacaattactttcggcgcattgcaaccttttgttctagcaagttcttactttgagttgggctgcattggttttgatctccaatgaggaagtaatttctatcaacttttcatgtatcgccgtggcaagaactttctcgattaagtcaggtattctttttgggttgacgcaagcattacatatccgatatattgattctatctttaactgcattgccgtttagagttgcatcgacttagttaggactttcttggttaggtccgatattctgatttagttgatatttctctaattatactattgttttagatagatttgttatatccatcacgtctgtgtagatttatcggataaataggttttttaggggcaattgcttatttgaccatgtttaaaagcataactactaatttgaccctacaattttcagtttgcttatttgaccctgttcatcaaaatcaaatgaaccgtctgaccctgttccgttaaggcgggttaacactgttaaataagaggcaaatagtcccttttgcccttgcttatttggccctcttgtatccaaacattcatacaaatggatcttttaacaaatcagaatcaatttgacaaatttaatacacagtagctggaggttgatgctgggtgccgccgccgaccaccctttgcacgccactgctccccgcgacagcgccgctgcggacaaaccgatgcctccacaagcgaattaaacggcccatcgaatgaactcgcgagggaattcttatactcttgcatgcccccttcacttgtagagaaacgtctaggcgcagcaaattaatcaagtgctctgataatcaatatctcatcaaggttatccaagtagtagccagatcaatatctcgataataatccggaacacgttcaccatggtcgtcggcgcacccaccgtggcgttcttcttgagagacctgagtaggtcgtcaacgaaacgctccatcctcctccacttctgccgcggtcggccgctgatgcgacacgggaattccgagatacctacacgcatcgcgtgatgccgcggccgctccgtcgcgcaatggcgtttgcgccgacctccctatccgtgcggcagccgccgcttccccatgcgctgccgacgctgctgctccctacctccacgcatcggcggtgctgctagccactccctcgacgcaccgccgccaccgcagatccatttctccatgtgccgcttgtaagagatgagagagacaaggtgggatggatagggttgaagtgccttgatggtattttggtcagtttaaatagtaaatagattttttttctttttctagaagaaaccctaatgatgtagtggaaagagggtcagacggagtgttcaatttaaaaaagtcaaataagcaaactaagaaaaacatagtcagattagaagttaggcttcaaaacagggtcaaataagcaattatcccattttttatcatcttcaatcttatactgtctcgtttaggtttgatttattagattgttgctaatatgtaattatattctactaagccgataagtttttatgcaacattttattagagttctagccaattagttatcttgttactacttctaagtgttgatcgtcttatactcaaacttgtataatcaatagttaaatatctctttatcaacttcaatatcataccgtctcgattaattaggtctgatctatcaagattatctttgattaggaatggtttattgacgattgatgaaaaccttatatacatcggctagcttggggctgcagga

SEQ ID NO: 58836 - DNA, 10107 bp, Oryza sativa
ccacgccctacacccgattgatacgacgagctatgtggatctctcaggccttcgtgtgcgacaaatttcacgtcaacatgttgccacgtggttccatctaaaccctagattgaatcggtttgagccgtcagatcttggttaactcttggttaactcttggtcaagatcaatctcggttgtccatctcagtgaacatgtggtcaatctctgtggacctactctacggtggactgattgctgatgacatcataatttatctttttcttctttaaaataattataaattatgtaataaatctatttaatccttttaaataggctttagttgaattaaatcttgtaaaattcattactaattcatatgaagtcgaaatgaggcagttcataattcatctaaaataaagctctaaatgtttgtttactttttatgtattgtttatttggtttttattagtcttttttctcgttttgcatgttagcttgtagtttccatcctttttatatattgtttaattgattattgtaaggcatgtcacacatgtcccaaacaatccctttgagcatgttgataaaatatttaaattcttcttttattttaaatgtgcatttaatttcgaatgtcattaggtggtgggaacctttcctttgaatagctagtttgtattgataatcctgttccttgatatcttgggatataatttgactagcttgagccatatatattggttcgactagatattagtgtaattgcttagccatgctaagaaacattagtatcattttacatgcaataactaatgattcactcatgattaatgatggttaattaatggtatgttgtgatgtttggtcatggttgattaataatatgctaactaaaacttgactaatggtaggttttgagcacatggatgtgatgatcatgctcatcacaattaaggaccggttttgtatagcatgattcatcatggagcaccacactaagaagtggtagagataggcccatgtgggtcactgcggagtctattccgggctatggaaagacgatgatccgggaacggtgaactactttgagttgagctatgcgaagagtcacaattttgcacgtggtgacatattaagcgtgggcacacgataacatggtgacatgttgtggaattgtcttgtgggtatattggtacacatctgactagagtaaaacttttcaaatagccatacatgcggttattggcaagcctagcaatgtttttttggtgattagtcacacactactcattaatcataaataaattggtcataacaatttgtttgcattttgtatggactttagatctgtgtagtcgggtttggttgtttagagatggttgggcctacgcagcataggtatgctattcagagttgattttaaattgattaattactctcaactatttactgaatgttgcttttgcaaatgaaccctactataccttcctttgtatccccatgcacctgcattttttctatgtggcttacggagtattctatttactcaccttgcaataatcatcaaatctcagttgaagaaagttttcgaaggagaagacatgtggcttatacctcagttgaactgtctgtgagagtggagctgaagctaatgttagattgtttgttacctgttgttttcttttcatttataagtaatatctaacgtaattataatattggatctgtatattcaattgtcaattttagtatctcagctaattagtagatgagtgtattatatgcacaacttagttcggaaattactagtgaatttccgaatgtgacaggtagcaagataaattaagaagagaagtcttcgataccgtacaggtccactagatgggtgagattctgtagctccgcaggtatttgaccaactacatccaaataagttaccctcctacataacaaacaagtaataattctgataagagaactatgttcaggatacatatatacagccggaggaccaaatgaatacctccgtttgggtccagcagatatgtacaatttttctttagggaagatctgtaccaaatttaggatagacttttctgattcctctatatgcagccttggagatactaattaatatcaataatctggtgtgtgtctatatatatatacacatatatatgtatgtatgtgtgtgtgtgtctatatatatatatatatatcttaatttgcatacttgcatatacgtgtatatgggctagcacacacgatgaaaccacgataaagataaagagagtgtgcgtacagtctcgtaatgtggcagagggtgttgttgttaatgtgcaatcgcacttgatgaacgggttgatgtcgcggtagttatcccaatcggttttatcagctgcgaaaccgctgcagagctcaccgctgatgttccactccggtgatgccttcttgccccatctccctagtatcgtgttcagagcagccgctgcatggttaatttattaactcaccattagtaatcatgcggatgaaagctacgcaatagtgaaatcagacttcatgaaactcacgggttgctgcgtaagttttatacagtaataatagaaataacatataatcagtaggcataacattatataatttcatctttatcgactgcagaaaaaaaactatatacaattaggatgttatttataataatttaaactagattggccatttaaaatcacaacaatagtgatgtggctaagtacatcatcttaaatataaaacaaaggtgatacggcttaataacaaaagaaaacgtgagagataatttgaacaatatacctatctcaactatcatagggataaagaaacaatttagatgatgtggcttaataagaaaagatataaatagcattaataaccactgtagaaatgaactttatataaatatataggatttctctaactctttggtttcaacgcggcaagagcggacacactatcaaagttattatcaaccacaaattagtactcctgcgatcaaagtacatggagggaaaccaaacaagagagacatgcatgcgtggaagcctgccaatggtttgaaatccaatccacaaccagcccaaaccaaagcagtaagctacacaagtccaaaccactctaattcatttgtcttctcttagaatccaaaccaatccaacccatatcatatttcaacccaaatcaacccaacccatttcatctatatggattcagttcacttttccagtccatttcaccccattccaaatcgacaccaaccacatgtcggcgacgaggtgggcgaggagcatcggcggcgagccgaggaagtcgcagcgcgactccgagcaggagcagggcgcgtgcgggcaggcgcgctggtggccggcgacgtcgtaataggcgacgtagctccagcagccgaacaggtcgttggggcacaggatcttggcggcgccgccgcacgcgtggcactgcttgccgggacgtcgccatggcagctgctgcacgccaagtgccccgccgcggactgcacgccaagaaattgccactagccgagccctcacgaatcgaatgaaagaacaacaacaagaagaagaatgtcagatggattggatgaacagctaggaaggaggcagatagggcaacggagcacggccaagtcgatccgcttttcttcttcttctccggctccggctgcagctccctcgccgcgcgccgcttccaccgccttttctcgcttcacttggccgttgggcgacaccacccacgccgccttcttggcgccgctctgctcgtcgtgctgcctgtacgccgcactgttcgcgctcaacttggccacgtggttcggcgacggcgtggacggcgagctcgtcggcgccatgcgcgccgtgcagcaggagttccctccgcttcctcccccgcgcccgcgtcttctccaccttccagaaggcggcgggcggcggcggcggaagctctccgacggcgaacctagtgcggcggccggacatccaaacgcggctgcgcggcgaggtcgaggcggccgagggcggtggtgatggagtgcctctgtgtctgagacgacatcatctgctatttggggatgaatccaattgaaatccatggactccatccattttagacccaaaaattatgactaaaaaccaatccaatccaacccaaccatccctcatccaagctgctccaatccattagttatctcaacccgtttacacccataccaagtgaatccaaattgaaaaccaatccattagacccattccaatccaacccattggcaggctacatatacgtacgcgtgcattcttaattaccttcgactggatcagtttttggtgcttgttgatcctgagcagctgcaacccgccatgagcacaaaattagcaccagccacgccagatggtggcgaatgacacctctgatgctgcaagaacgcatatctctccctctctctctctctatctaaacaacactgtgtgcatgccaaagagatgtatatctgtaggtatatatgtacgtgccactaaacattaaaaaattggtcaaatgtgtactcagcttcaacaacgaccctcgtgctttggttaatcttatccgtcatggttgataacgatatggattactctatccgtcccaaaaaactcaacttatagagtttaaatttatccaaaaaaaaaatcaacttctaccactttacctacctcctctagcatataaaatgagaagttttatctcttaaatatcatttacctacttatcaccattactacctttactactattgatgagggttatttttgtcatttttactcctcactaaatttgttttgggatgctaggaatctcactaaatttattttgggatgctaggaatcctcttttagcaagcaagtgttttggtcaaattaaagatgacattaacaagagcatgaggatgaccaactagtgtatgcccggtgagttcttaattaaagattagttatttttcatatatatctaaattcaagaaaacagcttgaaaaattctttttagtttttgcactttgcgtccttttattcagttttacttcgttaaagttttgtcccatatgagtacttgtttaatgctatcttaggttacgttcagcgacaatacacagagagaaaaattaccttctctttcaaaagcatacgcttaccgaaatactagacaatatttttttacaaaagaaattacaaaaagttgtatttttaatttttaagtttaaaataattaatattaattatcttattttgtgagtatgttttaatttttttttctttcgtcaactctcaatcataatgttaaaaaaaactctcaactagtatgttttaaagttttatggtgttagtcgtgtcaaaaacattgacttgtccacccgccgttgttttgactgcctgccgcgggaagggaaaaacttgccgtggaaatctgatgctgccacggcatcctttgcgtcaggacggcgttccccgttcttcaattttttgtcgatcagctctgttgaatcgtatgattcatatgctagctgtgtctataggatttggtgcttgcagaatgtattcttttcaccaaagtgcatatacacacacctagttgcatacatgcaatctagatagctatataaaatttttaaaattttcacaaaacgagtcctcctggtagatatgtgagcgtttgcacgattgtgttgtgtgtgcgttagacttgtactgacaaaaaaaaagaaatattaaattgataagatagatcatgaagatgtaaattactaaacaaatagatctaaacttagtctatactcactactgcagaaaaacccatagaggtgcacccttttttatttttataggtgctaaaaaaacatgaaaaaatatttggtatttttattacttccctataacgtcacacttcgcttcccacatatcacatgatttttgcaacccatattcatagacatgcttctaaagattcttaccatgctattgttttgtgattattgttatccaaatttataatgctcaactgaaaattttagcgactacaaaattgtagacgtcatctatacctacaacgttcatatatgttttgtctccatccgagatcatttagaaattttaaatattcacttatgtaaatagatctgaaacattataacacattttcggacatcagaaaaacattaaataaaaaattcatcacctacaaagttatatgtctcgtcaactacaaatttgatataaagtttatcttcatccaactttatatgaaaatgttagatagaaaatattgtgtcattattggtgccgattttagttgtaaaccaacatctatgagctcataagtactagtttttattaagaatcaacacatatatgatgcctataagtatagtttttattaagaaccaacacatatatgatgcctataagtaacggttcatgataaaaaccagtacatatgcttatagaggtgccattttattataagaatcatcgacacctatgtgttgtttataggtatgtaccagtttgttatagcctgatagaaaccgacacctatgatttgatagattattggtgctgacttttgttacaaaccaataccaataagtgattataagtaccggttcttaattttatactggaaaaaggtggagaaagcttcataggcgccagttttaggcaaaccgtcatatgtaagtccagtctttatgtgctgttttataatagtggctggataaatataaatagctagcaaactgtattgatgtgcacttattcatagttgtagcattttattattttagaatgttcaggcatatggctgtgttcgttgggtaggttgggaactcattccctccacacggaaaacggagcggtccactagcgtgtgattaattaagtattagctatttttttaaaataaatagatcaatatgattttttaaacaacattcatatagaagcttttttcaaaaaaaacacaccgtttagcagtttgaaaaatgtgcacgtggaacacaaggaagaggggttaggaaccctgaggaaataacacagcctatagaatacatgagaaagtccagagcaagtaaccagctaaactattaaaaacaattaactttactccctaatggcatttgtatgtttttttctccttaggcactaaaatttaggactatcatatatgtattacaacttatatcttaatattctcaatatttttttagatttttttatagttatttacataggttagaagcatttaagactgaatcaaatatcaagatctcaaagttaagcaaacacttctgaaaatattgaaaatattttcgaactttgataatggtgtatctatggctataaaaagtgcaacttaaaatatagagcttatataaagaagaaaaaaaaggtgaaatgtcacccgagtaccattttcaatatgctttatggagtcaaatgagtaaagaaaaggtttaggggttgatctaatgaaatagtttgagagattaaaaatttagtcttgaatgtttctatatataattaatctaaacttattattataccacaatcagtattactattttgcaaactttacgcaacttatttgttaggtgcacgcctgggtggagcacctatgctgtgatgtcacgcccataaattcacaagtaatttccaaactaatttgtgcattaaaaccctcgtccaggaatcagccgaggtacacaaactgacaatttaatatacaaattcatcaaaataactaaaacgataaatacttacataagaggcacttagtcctcaccatgaagaaaactgcagcggaaagtaaaatctagcgaagcttcagctccactcccacaggcagctcaactgggatctaagccaaaggtcttctcattctggatccttttcttcaactgaggtttgatgattattgcaagaatgagcatatgacatactcaacaagccacacagcaaatatgcaagtgcacaaggataccaaaggatggcataatatagggttcatttacgaaagcagcatttagcaaagagttgagaatttgtaaaacagtagagtaattaatcatcaatattaatcaacactgaatagcacacccatactgctcaggcccaaccaaacctgaacaaccaaccccggtcgtacagatcaaacctccaaaccaggaattatccattccaaaccataagtcaaattaattatcacattattatcattaatgagtagtgtgggactaatcacgaaaaacattgttagacccgcccataaccacgggcacggctattcgaatagttttactctggccagagatgtaccactgtacccacaagacacgattccacacatgctgccatgccccgaagtaccaccacggcactgctaagggggaaatcgtgacagtacccttcacacaacacaactcaccacagtgtactatttctggatcataatcaccccctcaataaccagaggcatggactccccagcgaccccccacggacttctcgccgcttcacagtctggcacaccataatgaatcatgctatacaaaagataaagtcgttgcccacgctggcttgtggttggcatgattaatgtctcacaacagtagctcgcgaaccggtccttaattgtcatgagcacgaccttcaaaaccatgtgctcacaacccaccattaatcatattttaattatcaattaattatcataacacgtttgaccatcgtgagctaccattaactataaccataaataataatgtagtatatatgattcatcccattaatgagctaatgtttctaagcatggctaagcaattatatatatatatagcatttagctgaaccaaaccaatatataaggttcaagctaatcaatttattatccataggaaattaaagtcatctttggccataatcaaatgggaaggctcgccacccaatgacattctaaagtaatgcataagttgaaataaaacaatagctttaaatgggttcaacatgctcaaaggattgtttgggatctgtgtgacttgccttgcaaacaagcgtcttcaattcgtcttcaggaatttctccaacgaacgaacgatcctccgaaacaacggaaaactaaacctagaacgcaaaacaaggaaagaaactaataaaaaccaaataaacagtacaattaaagttcataaataggtagagcttgaatttagatgaattatgagacttgaacgacctcattccgagttcgtatgaattagatatgaattttacaagatttaattccaattaaacctattaaagaaaagactattccaaattgattaaacaatttacaaatgacttatagctgagacaaaagattaaaacatcctccggaaatagattagatcatatttggtagatgacatatattaaaaaggaataatatgccattgaaaagaaagaacggatttatatcgattttggacggctgagattaatctcgaccgagtcgaccaagatcggatggcttggattgacacacggcagcggcacaacagcggttgcggtggcacacatacagcagcagcgcgacggcgacgtacagcggctaaacagcgacacggcggcaacaaggcagctagcgcagcggcgacgctagggcagcagctagtgacacagcaacggctacgctagggttagagcaacagcggcggtgacacgaccgagggattgaaacctaacccgaggggacacggatagaagtctcaccgaaccaaagcgaccggagagggagggtcgacgatgacgatccggcgacacacacggaaacgatgacgacgctagggccaaacaacagattagattagattagattagattaaatccctagggataaactacaccggtaaatgacatgggagagaggagagctcaccggagaagacgacggcgacgaccaagacgacgacggcgacgaccaagatgacgacggcgacgggtgacggctagcggcagcggcgagctagggcagcggcggctagggtattggagaaggcggctaaacaggaggag

SEQ ID NO: 58837 - DNA, 4819 bp, Oryza sativa
ctgcagccctaatcttaagtttcctcaatcatgcccaaagaacactttaagagactggtatttggctcctctacggcatttaggactggcgtagcctcccgcgcaagctgacatgtcactgcacccacgttgggatccggtgggatttcgcgagcacccgtcggcctgtgtgttcatgtcattgttggttgtgttgcgaaagaaacctttatttcatcaataatttgtattaggcccctactctttagtttctacgttctgaattattacgaacagtccctttacaaaatgacatattctatacgaagaagcaaaaaataacataataggactgcgctcggaaaatgggaaattaagggcttgtttgcaaaaacttttatccttatcacccctcccatgaaacttcatgatctatgatttggctattgagatctgccaagattgtccccttctttttgtagttcttgcagtatatgaagaacccagattgtccttttccttttttcggttcttgcagtatactgagtctgtttgtgttatgaaggcctgactaagtgttaggttggacctaaattacgtaatatggttggtgagtcagaacaacgtagtggccttggtgtttggcagtgttgggttgtgctaactggcatatattttttatgacatgggcttcatttacaaaaagccttatgttttttttgtcatagcagtagcctcatggttgcttgcaatggcagtagcatactagcatgaggtatttcgtcgggcctctgcttcccatggaaaagaagtggcttcattatggccttctacactattaatcaaattgaggcattgcatatagcactatagttcttaccagaactatatatctccatgcttcagttaaatagaagaacaagcctcaattcttaacagtaccatgttaattctcatgcgttggttgctcctgcttcactgattgcccacaatgctgaaggcctgaagtggatgggaaagtggtgattgagaagattgaggacagtgagtgggaagtcggttacaatgcgatgaacaacaagtatgggcactcaattgaggcaggtgttatcgacccagctaagatgagaagatgcatgctctagatggtttcttgcagagtggaggtacaatgcatggtacaaacgccacatgttgtttgacccaacattcaaatacaaatgttaggtctatcatgcatgtttttttaaaccgagccagccttggctggtgttaagcctgggcaaaaactgtacagataccacaggtggtctagagagaggaaacaaaataaagagagagaggaagaaagcatatcatagtgaaaaggcctattctcctggcatcaatgcgatcatcccttttgctccatccattttccatgtggccgattcttccatggtcttgctcagtacttgctgatgtgtggactcttccgccccgaagactgggttgttgggctcggtccaaatttccaagaaaagtatagacactttatatgcatatagagtatagccagccaaattatcactgcattttgcttaatacctgtagaacagattattagcatttgcttttcgcaattctgagatgagataatcaggtactcacccccccccccccctcccctgcttttctatggcttcatcttagccatagaaaacaattgatggcatggatttagtcaaatccaccgggtggagttgtagccaactccaggagatctggactcccacagggacataaaaaagaataatataaaacaaatattacgagatattttagaccatgtatcgtagtattcggtattcggtagttttgtaattatgtactttaccaattcaattatgcaaatgctaggactaatacaaattgtaacttagcatttgcttcaatacatattctaaagttctctccgttaattagtatttttagcacttccatcaagctgcagttcaacattgccatggtaccctcgagcagttcagtgccctcttgtcttgtctccagaagcaccggcggcgccattgtatcgcaagactattccttcgccatatatacaccaagttgctggctacaccttcgtcgtgcttcatcgtgctccctgatggcttcttcaatggcacaggggttcggaacccagcccaatgccttgccatgatggtgggttcgattatgctatcaaaatcaacatctatgtgttgttctaagtgtgggtttccgtgatggaaattagactgaatgtatgctgttggtttggatttgattcgatctgttctagaatgactcacgatttaaggccatcccaccctaaaattttacacttgaacgttcaaatacttgcatgaagtattaaatataagcttaaaaaataactaattgcacagattgcgactaatttgcgagataaatcttttaagcctaatttgctctatgatttgacaatgtgacggattaattaggcttaataagttcatctcacgaattactgttggattctgtaattaatctttttattagtatccgattaccccatgcgacaccctgtataatacccgatatgacacggtaaaactttagactctgaatctaaacaccccctagatggaaaaagatatgtttgcccttgtgctgtcaggctgctcgatctagagctgattgcagtctaagttgacggcaaaggagagagaagtgacggaaatggaagaaactttaggtgctattaaagtaaactagtaatttttagtgttataaatctaaaaacgtaaactttcgatgctatacaaccaatcttcccaaacttaaatccctcgtgaactatccaaaagacgcctaagatagtacatgttgggcctaaagaatttaaaagaacactcgggtgtctcagtagtagcaacagtcctttccacctatcaacatcaatatatccgtacacctgcaactgcaagtgcaaccctgcaatcagatttttcttcaagcacggtttctaggctgaactccatcatcagatcgcatatccaaggtggtattgatatggtactgatatgtgatgatttgcagataaattggtcttgtcgaagataaattggcctgcttatagactgcaattcaatattagggaaattcctgagatgcttcacatatacatgatccaaaatccaggttaagaaatccaggagaattaagaaaaaaaaatacaaattggatcagtaaactgaacaaatttatgaagaagacaagagacacatatgcatcgcattcatcacgactcaacactgcctaatcccatcatatcaagaagtttataattttcgttgatccagataggatttaaagcactaagccgtcaaagtcatacattagtatgaatttcagacaaaagacaatataaacagagtacattaatggcataacttaaatccctcgtgaactaaccaagagacgccaaatatagtaaacgtttgggtctaacagaattcaaaagaacactagggtgtctcagtatcagcaacagtcctttccaccttagcaacatcaatatatgcatacacctgcaactgcaagtagaacactgcaatcagatttttatttcaagtaccatacatagcaaaaataaagggggtataatggtagaaaactatgcgtatccaagcaggacaatttgcaatctaactaactgctgcatacataaatagtacaactgagaggattcatttcttaaattgcggtgttaatgcatacagaacacttctgttgcagttagtatgtggcaaggaaagctgcttcgtagtaaaagaaacacagaacaaggcagctcttagatctccttatcatggaggaatttaggataataagtgggcatatcttaaacccaacttactgaccattaccttaacaacgtaaaagtgaagtctcactaaaaccccatgtggcacaaaaaacaaaaaacataaaaacacaatgttgatgtcgggatataatagattcgatcaatactcagaatctcctttgatgcttattactgctgttggactagggagttaattaatgttccataaaaaaacgacatttaaagtaaatatccatttttttcatgagtattcatatttttcttactaacatagtttcttacaacttgttcatagccatttgaggtgaaaatgtagtacgtatcaaactggcacttgtcttagtacatgaacatgttcaacataaaaaataatattctgacagctgtaaaccagtgatgaaaaacttcgaactgaacctaaattgaaattgtgagactgcatggatgccaaaatgaggtacaaaaaacaagaataatgtagctcagagtggaatgaataacacagtatcaagaccaacatagtctagttttgtgtacaataagtgaggaagaacacatcgtcataccaaacagaaagagtaaaaatactagaatagatcaatgcaatgcaacttctttggcaaaatacatattccattcttgcaacaaaatatgccaaaataagatatttcaggcatgtaaactaaacatgcacttgatacttaccaaagtatatgactgataaacagcttcaaatgaactaatatatttcctcatcacggcatctacaaaatgatctatcaaagggatcatctgtagtcaaatcactgatgtgcttcatgtgtaccaaactatccaccccataatcagcctgaaaatcaaatgtaactcttcgtgaagctctgccataaagctgtagcttctgattttgtttttcaatccattttgcttcacatttgtcacgacgggcta

SEQ ID NO: 58838 - DNA, 1421 bp, Oryza sativa
aaatacttggacattaaaaatatttaatacaattttatctatatcaacttaatgttcaaaattttcatagattttattcacacacttactttaattattaagtaatttctaaaaattcctttttcacaacgatttataatttagcgattttcagggtgtgacatgtgatatctcgcagcacctatcataaacagttgagcaaatcggtcgatctgcattatcctttagtttgtgccacagccaacagggaaagcggtggtaaaccatttgcatgacaagtggaactgtggaccagtctatttttttcttacccaaaatttttacttcaaaaataaaaagtttgacccaagcccgtacacttgtgaaaaatggacatgtgaagtgacagatcgcttcgcttatcctaacactactggagaaaccctcaaaccgggagagaatccgagactaaatatgtgtgtgtatgtatgtacgtacatacgtacgtacgtatgcatgcatgtatgtgtgtgtttaaatacatattatatggatgtatctacacagctagtggtagctggtttgtctaaaacagctaccactctatctataatagggaccatccacctatacttcaaatacaattttctcttaaactactcatccgattttcgatccgattacaccgttgtgttcacaacaattaaatctttacaacaagatctcacatgattatattttgatgaaaaatcacaaattacttttatgatatgtctaaattacttttagatttcactaagttacttcttaaatataaaaaagtaatttacatatattatagaagtaacttagaacaaaacgaaggtaactttagcatgtcatttgaagtaaatccgttttagagataaaaacatgactctatctagaaattaaattaatcagcacaaattatggaattaactaaaaaaataataaaagtaatcacctcagagcattatgaatgtataggaagtattttaataaaatctgaaagtaaattatatatatatatatatatatatatatatatattgaatctattctacaccctctcccatgggtcaaacccaccaccccaccctcccttgggcccaaaacccctctcccacctcggtcaaagcgtcctcccgccggtcaaacccgctcaccactccttcccccacccaccactttgctgctctcgtcttgcaggaattgtgcaataaagaacggtcatcgtgcagtaacaagacaatattatcgcagtaacaacgtcaaaaagtagtcatgatggatctagtttcgttaagcgtttttttatgaacttcatgttgcaaacggattggaaatacaagatatgatgtgagagatattgctctctaatgattgagatttatctcttttttagtccttgtctcacagga

SEQ ID NO: 58839 - DNA, 543 bp, Oryza sativa
ccaccatttcggcgcggagaggagaccgcttcacccgccgatctgcgagaaaccctctccgcctcgcctcctccacctcccaatcttaacccaacctccccccttcctctcgcgtcgaccccttgctttgctcctccttcaaccttcttctttcttggagtttcttgagagagagagagagagagagagagagagagagagagagagaggggggagcggtcgcaggaggaggaggacggcggcgtctgctgcgaccgacggggagcggcgaggatgagcgcgtccaggttcataaagtgcgtcaccgtcggggacggcgccgtcggcaagacctgcatgctcatctcctacacctccaacaccttccccactgtgcgtattcttcttcttcttcttcttcttcttcctccaaacatttccttttttcttcttcttctttcttttgcttcttctttttttaattatttttgaaaaaaaatacttgtgtgctcggaggcttggagctaggattatggttcttgatctggatttgggcccaaattg

SEQ ID NO: 58840 - DNA, 19052 bp, Oryza sativa
agccgcccgcggcgagccgagtcttccctctccgctccctcgctgccgctccccgagctcgttcgcgcgcgcgccggcgtggttgccgcccgtgtcgcgtcgcgtctgcgccgcccggtcccgctgccctgccgcctgcagccgcgcagccgcttggccccgcgagccagcgcgcgtgcccgagccgcgccactccatccgccgcgcctcccgttgcaagccacgtgcgcgtgccgtggtggccgaccgcccggtcgccgccgctgtcagcctctgcacgcgcctgtcgccagtgtcgccgctccgctccaaaccgccccgccgtcatcgccgtcgtcatcgcctggccccgccactccgcgcgcaagccgccaagggacggaggcagcatccctcctccctctgccgcgtcgcccccgctcacctcctcctttttcccgaatcggcaaaggggcaagccccctttctccccctccttttcccctttttcctcctcgccggtgtcatcctccctgtcgccgctttggccgcgaccgccgagcaccagctcgcgcctttgaccgcgcaagtcggttcccaaaccgacattgccgcccatttaaaccccagcctcccctttcccttcctcttccattcgcctccgtgccattgccgccgcccccgagctctgtctcgcctctgccgtccttcgccgagcaccgggagaaccggtgcattcgaggacgcggaaggggacttcgaccacgccctcttcttcctcttccccggcccgaggccggagagattactcccgcgccgtcggcctctcgtcacagcgccccgtcccgcacggtagtgtctccctccgttcttcctcctcgctccatctcccccccccttagttttcggtggtagcacgagtagacttcccgtagctagccggcgccgccccaaccgttgccgtcgctcgccgtatgctcgccgccatcgccgctcgagctccgtagcacccgcacgtcgccagcctcgctcggcgtagctccgtccaatccgacgctagcatcgagttcccgaaaccgcgtagatgctctcaccgccgggaatcgacccctcgtggcctcgtcgccgtttccctcttccctccccgccggttgtcgccgccgcgattcgccgccgtcaagctccctccggcgaatccgagccgttggctcgtctcccctcatcacgaacaaccgcccggtgtgctcgcttttgcccgtatcgccgtggttcgttccgccgttcgccgccgccgcccgccgtccattcggggccgggtcgtcgtctacctcccgccagcccacgtggcagccacgtaggcgccacgtcggcgccagctcagccgaggtcgggacgggccgaccccggtcagtccctccccgtgcgcgcgttccaccgcgagccgtgaggctgcgcgtgggcccgccgcacctgtgtcctccgcgaactgcgtgcgtgcaccacgtccattctccaccctagcgccgcgccgcgtgctccctccgcacggtgagccgagccgctgacaagcgggtcccacccgggaccgcgcgtggtgagcccggtccaccggactctctctccttcctccgcgcgcgcgcgtcttgagccgctctgggccgccttcttgggccggccggcccgttaagctcggccgtgccgctctttctctcgggccacgccctagccgcccgagaaaagtctataatctctccctcttttcttttctttatcttttccaaaaaggatttaattaaatccttttcctttagaccaaaaatccaataatcttagaaattcaatatcttccccaccataaatccgtttgactccgttcaacttccaaaattccccaaatctcgagatctatctaatggcacgcttagaggtcattaatagggctttatttccgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatattgcttgcaaaatattatgcattgataggatcgcacttaatctgttgtcccgtctgcaaggcagattggcggacctgcctaatttgttgcatttgatccttcctttgttaattgttataccatgtccccttgtaaccacccagttgcgcctcgatattcgtgcactctgtgcgagtatcgacggtcgccttcaaacttaaaatctaaaaaacaacttgggtaaaacttgggttttacaaaagacttggaaaacccgacacctgggtcggtgcttgcaaactaaatgaatttctaaaatcgcggaccggggaacgtaccgggtgtatggttttcccgctcccgcacttaaggaccgattccttggaatttcatccgaacataagacaagtacgaccacatgggtggaatgggacacctctggctgagtaactagcttatcaggggagccatgatgccgagagacatgtggattcgccggggtggtgtcggagaggaccccctgggcttcctggcacagtatggtctgggacctaacctgttgttggtctgggacccctctcgtcggcatatggtaagcctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgacaactgcttgtgaaattactgttgtgaaaaggggttcgatgtttgaaaaatcagcagctgacgggatcagctaggcccgggtggccgtttgaaaagttgttggcccgggtggccgtttgaaaagctgttggccgggtgccaaccttgttttaagatctaaagattgatacattgcacatactccgaccggacgggacgcactgtctcaaccgtgtcgtttgagaagcactcacctagatgtttttagaaaagagttcaaataaaatcaattacgaaaacaacagcctttccttgaagcctgtattaaacacttatttcccctggcttgctgagtactcccgtactcacccttgctctatataaatacttccccccctgttgctgatgaagatgaagcggatcctgctgatgaggagttcttccaggagcaagccggttacgatgagttttagggtttcggcctagttcccaagtcgcgcctgtgttgtttggtccaagtcccggcttccgtttcccttttgtaatgcagttgtgagctcgggatctgtccgcagcccaacatgactgtactcctactctataataaagagacctctgttgctgtgatattctatcttcctgtgataccagcactgtttcctgggactggtatcgattaacaggttaatttggagcatcacgggctaattccagtcgggactagctcggggcgtgacatcaccacccgatgatctcttttgctggaagaaagccgtgcgccaccatctccttcagattgtcttccatcacatcggagggcgcccactgactctcgaagctttctctttcttccgccatgaatgtgaactagatggtttgatttagctcgagatacggctgaaaagagatggggaatcggagcggtggatgcggggagaaattttgtgaagtttttgaggatggattggagcggattgatgaaccctaacttcgtcggcgcggttctgtactgtagcacggagtggggaatggcgagagtctcggcggggaagacgaagcgacgtttggacttcggtatttttagggtatcgggagtactaatgggcctaggcctgtacagtacttcagcccaattatgttttcagcgtggcccgttgtgatcctaagggacttaggcgctttttgctttggcaatatgtgctcacaatgacacggcccgatgctgttaaaatcctttttaacgcgattcaataattctttggaattattatgatgcacatgaaaaggtgcctgacagaaaggtgttataccatttttttaagcttttttaggctacaggagctgttgggttaatttgagatgactggtttattagtagtcattctcctagcatgttatatgcttattttggctatggtaagagtcacagcctaggctgttagactcattaattaccataattttctgtcatttttggtggatcattttaagagtttcttgctcggattcctaccaaatatatctatttttgggccttttgagtgtttgtcactcggcccttcttgtattttttgtccttgatatattcaagttgagaagcagtcggctgggtatcttactaagtaccatgcgtgcttcgctataaaaccactcggtgcttgactatatgtttagttttttaactaatcacatagtcaagggctacacctaattaggtgcatctactcgatgcaccatgttttatttttgcccttcacagtttttgatttttagtactcggcaagctggagcaagttgaattgaagcactcggactactagtttttgtttcgagaaggttgtttcgtcaactgcgaaggtctcgggggctactgtggagattatggataccccatatctgcatgacagttatactttaatcggatatatggtaccaaatatagatagaatatctttatgaggactcggggtaggttctcaacttgtatgtcaagaaaatacccgggatcctagtcggctacgattgtattttatctataatcccatattccgttaggatatggactgtaccttgtattacggatcccttcccctatataaggagggtccgtgtgcttcttggggcacgattcttttttctcccaatcatacaatcaataacacactcggcggaattatccccggacaggagtagggtattacttctttaataagaaagcatgaacctgtataaaattccttgtctctaaacccatccactttcctagcttgatagccaccccttttattattgccgaaatcttgtttcgacagtgaactaaacaggcccttaatcgttctcctttgtcattctgtccagtgtctgtcactttgacaagacgaaatgtagcatttcagacagccagaactctgaactttctgttgggcaaaacaaaaagaactctgaactcgaccacttcatcatgtcataataaaccattacaattcacaatttagtagtactcaagaacaagtaaaatagagagagagtatgaaccagcaggagatagacacctcatatgttctgggcaggctgtacgctgacactagagagccaatgcgtggagcagagaaatgcagagagcagagaaatggggatgcaagacatttgccattgccattggcattggcatggagagaccaggcagaggagctgatgcagcatcatggtccatgcatgtcacctgtctctcgccctatgccacctacagatcctcctccattcactcaacagctactatgtcagccatgtagggcacaggaggcagatgctcatcttgttaacatcctcattagtgtagtgacatctcaaatgcagcttgcttgttaggactaaacagatgcttgtaaatgccatcagttgatgattgggttgagttgctgtctccctcaacagcacacagaaaaacattagcaaatgctgcatggtccattcatcaatcatcatcagaggatgcatggtccatcatgccattaagcttgcatccagggggctacaactacactaacaccttctcactttctgttgtcattgtcagaaaaccccccaagaacccagctagaaagacatagggattcctgatccagcttaggcaagcatgaatggcacacgcaaacacacatgcatatcgatcacacagaggaacaacacaacactagcttaggtacacgaacacaggacaaatctagttatctactcgtaggtaggagggtagaagaaagacagtagtaataagtactagtagttcatagatacttcctccgtcctaaaatgtaagcatttttgaggttggcacgggtattaaaaaagtagatgagaatgattgaagaaggtgtatgattggttgaaaagacaaagtaggtgaaaaagaatggttgtgattggttgagaggagaaggtaggtagaaaaatagcttcattttaggataaagtactgtgctagaaatagctatattttgggacggaggtagtactccagtagacagggagatccagccatgccatggctgtccagtatgcaagcaaattagcaagcaagggaggaagaagaggctgggcagccggtccctccctccattggtatttatgagaggcatctcctcaccaaccaaacagacacagcatctccgtgtatagtacaggggaataaataagcagcagctgatgcttgcattgcattgccatagaggcatagagcattgcattgcagctcaaaaattggtccaggatccacagtggtagcttgtcagaatatttcaagcaacgcaaaggaaggaagaaaggaggattgtagtgtaggagggatccaatgcaatgggcaatgaggcaatgaaatgcaatgcagcagcagaaaggcagggcattcatggctgggcacatattaggttggcacaaaaaacacaagccaccatggacacatttactccccttcaaccaccccacagcatacattgcagaagaacagagcaagtcaatgcagcatagtagcaaaaggacaggtaaaaaatgaacaatactagtagtaataataagatagggcaaaggttacagacaaagagtgcagagaggtaacaagtcaattcccgaaccaagacccccttctagtgtgaagaagggtcacaactggttcgctcttgacttctcctctcctcctttctcttatctcatctcctaataacaatctgcttaatgtcttcttcttcttcaaccttacacaaagtctagctcgatcttaacacaaaccacacactcaagctaccaagtcttcttcttccatcttattattacaaaaattcaaaacaaggagctaaccttcttcacatgcagttctcacttttgatgaggaaagggaggaagaacctaaagagggatggatggagtagcaagaaaccgatgcacgaccaaaatgcctgcagagctgatgtcagcaaattcatgaatcagctggttggtgcaagtgagagcttgacaagaccctttctttctttctttctttctcagcagaagtagcttcccaaaatgatcaaaatgccccccatggctttgcttgttggctggttgggggtattttcgtcattttgagagcagaaatatggcgggaagagaggagagatttgagtagctgttagtgttggcttcttgtcaaaccctcccttgcacctgatgaaccagccagaccgagagctaacagaaaaacaaactgcgatgttagcgaaataaattgggaggcattttggtgtctgatcccatgttgctccgatcccctctcctccaggtctcctttgctactgatcggacgccggctcacccccagcaccacctgctgaacttttgagtgcagctgtgatctggtgaatggcgttgcagacatggctgttgatcgcagtgacactcgagaggttgagcttggcagaaggtacggcgctggccagcacctgcatgccgacggtgaggaggcagccattgggaggcagcagctcatctgcattgttgttgttgctgctgctgtttcttggaggagtgctactggtttcgccattgccattgccagtggtggtggtggtgcttgagctgatggtgggtgcagcagcaggtgatgggctggtggcagggaagatggcgaagcccagggggaggagagggatgtaggaaggatcctcgccgctcatcgtcacctgaattgcgtccacgtccaccgtcgcgaacaccaccaggctcccaccatcagggtgggtgctgctctcctgcagcaggagctccacattctgtgacgagttgcttgcagcctggacatcagtttttatcaattggaaaaaggtcagctcttgttatatatctagtttcaatcagcagagggaaaaaagtaaagtaagcaactctcattatgaaatgagctagatctatgtgcatggtacattatgattgtaagcattacaaggtgtacgtgtagtatatgaaaaaaaggggctaatatatatatcagaaaataaaaaagaaagattcagacataaactgtccatgtaatgacagcaaattcagagatgcatgtgcacacagccccagcatacaccactaaaatctcatttaatatggcatattgagtcatgtacagttcaagtagccggtgttaatttcttgtccttggcattggtagcaaacagtgagtgcttgaaactattgaattgaacaacagttcttcaccagagagtgcagttacagcagtaactcagtagctaccattgctaccattgagctattacaatttatactacaataattaatttccctatctttttctagtttttactgtataagacataaacacacaacgtgtgcatattgactcatgttttcatgtcccttcaggactctacaggacggggggagatattcacatgctcaccattagtaatccataattctgcaactatggaagaaactagacaaacctagacaataagtactacataatattcttgatcagaatcatttaagagctagctaagtcgtcgtgattttgctctttaatcaaagctactagatattatgcaccattaagcacttcaattattatgatcatgctcttgaatcaggaaattaactactacaaggacgaaaaaacatggcatcattcaaagaggtggtaattgggtactcacgttaatgcgaagaagagagatgcaattccttggatgtgatccatttgcaatatgtgccacctcatgaagggagccgccgtttgacaaaatctcaagctgcaaaaggcaaattaacaaacatgaccacaacgaattataaggtgaacaacaacaattttcagtatggactgagtatattatatggctcttcattgtacctggcagcgctgttgttcatctgcaagaagctcaaacacctgctgatgggtaaaaggaagccagcttgtggagacagcggtgaggatgacaccgctgggctgtccgggctcagtgttcttccgagttgtaaccctgatagtgtcctgggttgaatccgagagggccgtccaagattgggttccagaagcactgatgttagcacagaaagtggtgatcatccgctgcgacagcttcatcatatttgttcttgcctcaggggtgcggatcactgtgaatcagaaacaaagggatcgagaagattatatcataaatggtcaggatggattttgtgaattgtgagaattcagaatccacacctctacacaaactgtggattctgaattctcacaatttacaaatagctagtggtaatgcgcacctccgaggtcggcgatgttacgggcgagctcactggcgaggcgctcgcactggcgctggaggatggagagccagcgcgtggccccgaaggcggcgccgctggcgacgtagtccctgaacaccggctgcagcggcttctcctccccgaccatctccatgtgctccacccacaccacctgcattgccattgtcacctccattcatgttcatgctcaaattaacacccaatgcaagcgtatgtacgtaccctggagtatccattgggcatgtcctggatgatgcagccggacggccgccgccggcacctgaccaccgaggcttggaggagcccctcctcaaacccttccgccgggaaatccacgatcgcccagctcccctcgtcggcgttgtgcacgcagtaacggaagaacaccacctcgcgcgccgccaccagaggcgacaagaactgcacctctgcttgcatctgcatgccatgtaccacgcgcatttcagtccccatccatcccaaaaacaactaatctaatcaatcagtagtaggggagtagtaatcagttagtaattaccaagaggagagttccactgccgaggtgaccagacgcagctccgtggtttatgatctggattgttcttgccttgcaaacaatcgacgggaacagctccatccatttgttctgcaaaacaatattaatcgacattaatcagatgattagaaatgaagcatcatatactagtggaaaatggcagtatcactgcactgcactgaccgcatcgaggaaggcgtccaccaagttgatgctgttcatgatgaccaccgcgttgtcacgcgtcccctccgccctcgccaccgcgccgccgtctccttgcttcgcgccgtccaccggccagctgaacatccgcgcgtgctcctccacggccatcacctccgcgccacgctgccgcacccacagcggctcgccggcgcggcacatcctggcgagctggtccgccgccgtggcggcgaggtcgaccaccagctgcttgtcctgctcctgcacgggcgccatcatggcgcccatgtacgccgccgcgccatcgtgctgcggcacgacgggtggcgggatgaggtcgccgcagcccatgaccggcgcctgctcggcgaagtgccgcgagtagacgttcatgtcgaggtcgagcggtggcatgaggaccggcggcggcgccgagatgcagctcagggccgacgtcgacagcaccggctgccgtccgccgccgccgccgtagcgggtggcgatgcaggccaagcggtcaagctgcagccaggaagcatatataggaggagtattatgtgttgggaattgggaatgaatggtaggtagggttttagggagctagcgacctcgtctttgagcctggcgttctcgatgcggagctgctgctcctcgtaggacatgtcggcgaggacggcggcgtggccgcagttggggcagacgacgttgcggatggcggcctggaggcggaagttgtcgctcttgaggttctcgttctccgcgcgcagaatcacgttgtccgccctgtcctgctgcgcctgaacatattcaacccagccaatgcatcatgaacatattgccatttgcatttgcaaatacagtagcgtatatatggaattattaatttgcatatatatagtaccttcatctgggtccggcgattctggaaccagaacttgacctggcgaggtttgaggcccagttcctggctcagcttcagccgctgcttgtcgtccggatgcgggcactccttgaacagcctgcatggatggatgcatgcacgccacttgtcagtatcacaatatcagcaaggtttaatggagacgaatcgatcgaaacggctggcaatggcattgaagaggaagaagaagatggagatgaaaaccgcacgcctacatctgctggatctggtgcgccgtgtggcggtggtagcccttctttttggcgttgccccccgcggcgccgctgggctgggcggcgtccggcggctggtcatggccgatgtgctgccgcttgtggtcgtagtcgacgtcggcgaagctgaggaggccgtccaggtgggcgctgcccgagccgccactgagctccatgtccatctcgaggtccatcccctcgtccttggccacatggaggcctgccatcaacccctcctccttctgcaccgcacgcacgtatatagctagtgtcatgaggctatgcaaagaaagaaaggaaaagagaaaagaagagattagcttacaggtattaaggtggcggcggcgttggagaagtggtggaagggcatggcggcggaggaggacatgaagccggcgagagcggggttggggatgagcggcgaggcgaaaagcgcgtcggcggaggaggcggccccggccatggcggccatggacgacaggacctggcagtccccgaacatcctgcgcatatgtccggccggcgatatcttcaataggagtagctagctagctagctagtggttccttctccggcgatccggccagcgccctcctgcctagcagtagtagaaaaaaaaatcaaagacgaaggagcatggccctagtcaatcactcacacactcctaactcccgagaagaagagaagagaagaagaagagaaagagattggaggatggagatggactactgcggagcaggagggaagaggagaggtggtggtgaaaggagacaagcggagtaaatggccggagtaaataccctgtcggttgttccgtggccttccttccttgatcacttcttctccttcttcttgatccctgcagctgccttcccccttgagatcaatcacggctggctggctggctggagaagaagacgatctctctctctttctcgcctcctcttcctcctcctctttatggttgcaatatcgatggaggtcaaggctaaggcagcgagcgagcgagcgaggaagaggagtaaccgatggctttggctggcgcttatcttgtctagtagctactgtgacgctctttgacctcctccccccttattccgccctcaccacgtcactcacgtcgccgcgcgtgctccccgctcactgacgccccggtcccaccgttgaatccgcaccagcggggcccacgaggcagcgaccctcccccgtcagggtctcgacgaagacccggtgacgacgacgacgacgccttctccgcggcagtcgcggggtggtccccacgtaaagcgcggaggaaaggggggacccacgtgtcactgggagagggtggagcggggtactgtagtggtgggaagggaagggagttaatgcggtaattaggagagcggattacagtgagactgacagagtaaatgctcgcgcggcaacagtgggtaagtcgtaacgctgcgaatccccgctctttttttccttttcttttcttttcttttttttttcccccacccaccggctgaaatacagacagagagaccaggtcaactgcatgcatgcgatgcggtcgatctcgtccgtccgatccagccacgaacagatagagagaggaagagagatctgggccgtccgtagcgaagccgcgttacggcgcgagggggtctctggagcagcatgtgtgcgagtggccatatcatatcgtgcagcaattaatttgtaagatttgtatgtacagccagccccaaccccggcacgcagctatagctgtaggtaggataggagtaaacagtaactgctccatatcatccagcatcatcgcccgtatctctctgcttaatttcacttttgctatagggcagtcacacccatgtcatgtgtgattgtgttgtgttgggtattcatatccatatatgcctttcctgccaaagatatcaccacattgatatcctttttatatccttttttgtctggctagttttaatttgtttaatttcctgctacaaaatacttacttgtatacatatcctcgctcaaaaaacaagaataccactccctatgccctcaaatatatggatttctgaaattatccgtggtgattaaggaaatatgtgaaaataaataagagatggttatgattgattgtgacaagaaaataagcgaaaaataattatttaaaagatgattctgactgagacgactgagaaggtggaaaagttgctactccttccgtctaaaaaaattgacttctgataccaattcgaacaagcatatgttcagatttatccctaaaagttgatttgttttcctagtacatatggtgtatgtttttaggatggggaagtattatacacatgctgacatgcatgccattatactccctcattccaaaaatctgagaactattttattctttggtttctccaaaaatctgagttatatttttagtcactatatgctaaatgaaattgttgatcggaaataaagaagccattctagtacttattgattgcatattcattggttttgccacatagtgagtgagttaattgcttcttgtttttgatgaaaaagaaatatatctcaaaattttggaaggagggagtatatattaaggtacgtacttttatagttttgatcataacttcaattgatgaatagcatgccacgttcgtttgtgtgaaatatatgtacagtatattatattgtacatagctagcaaaatacaagacatacaagtgcagaatcgctgaaaacaaaagagcacgttaagtgttaatttcagtgggtacaagaactggccgagactcttaatacatacatttaagagaaaactagctaattaaagcgggccatggtcctccatatgcattttgctactcctaaggatcagtaacacagttgctactcctaagctaatactactgctccctccgtttcaaaatgtttgacaccgctgactttttagtacgtgtttgatcattcgttttattccaaaaaaattaagtaattatttattctttttatatcatttgattcattgttaaatatactttcatgtacacatgtagttttacatatttcactaacttttttgaataagacgaacggtcaaacatgtgctaaaaagtcaacggtgtcaaacattttgaaacggagggagtacttcactattagtttatttttaatttactactttaatgtgtcgatcgactagctagctactagctctagatcatccatggaagaatgttctccaaggttgttgtacttgtgtgtgtgtgtttgatagcatgcatgcatggcccatcctcctccgtttttgattcatgcttcctatatcccctgcatgctggatgcatgagtatgaggagctactagaacagtttaattaatttgagtttggaccgcacatatatatcaaagaaaaccagaagatcagtctgttatagttgtgatgatgagtttctctaaactagtttgaagggagagcacatgcatgcatgcgtactggacaggtgtttggaaactgaaaaatggtatggcaagctagctagctagctgttttttcttttatttcgtgtgaagtactatatactagcatatatatattggaggccaataatgtttttctttgcttggattttttcgtggaatatgtccaatatattatctaaagaaaatgttcaatatattatccggtcatgcatgtttccctccgttttatcttgtcttttctgcttcaccatgttcctctagcagttgctagctagctagctcgatccatccagctggctggtgacgatgtaagagctgaggtcgccatgaactaacggtgtttaatggtcgatcagctcgagcttgttcgatcgatcatcgatgatgatgcatgctatataatgtttagctatatacatacatataatccaaccagttcattcagttaattgcataccgaccgatatgatatatatgctgatatatagagttcatttcgggggcagccagctagctgtgggcgggcggagtggagtggtggcaatctatatatcgagttgagctagctagcttaagctaggtgaggtcgcagtgtagcagggcagtggggtgtaccgtgtacgtagtacgtactggtgcatgctggccggccgggatcgatctatttattcatccaacacgtacacgtactgcttatctagtgcatgcgcaccatgccatattgcatgccatcgctacgactattcccaaacacgtatttactccgccccatgtgatctttgcgtccgtacgccccgacgcgtaccgtgcatgcatgttaaccacaaatatgctattgggcacacgcatgcatgcaagaaacacaagcagcgcacattctattcattttatcagattaactggctcttgtttttatccaccccatcatatactccctccgttttaaaatgtttgatattgttgactttttagcacatgtttaactgttcgtcttattttaaaaaaataaaaaatatgtaaaactacatgtgtacatgaaagtatatttaataatgaatcaaataatatgaaaagaataaataattatttaaatttttttaataagacgaatggtcaaacacgtattaaaaggtcaacggtgtcaaaaacattttgagggagtatatcacatcgtcttcgatctcccaagccgcacgactcactgcaccgctgcgcctccttcctggctcctctcccaggccataccaccacctgcatgtagatcgagctctcctcttctctcggcaaaatgccagcgaaactcctcatatctaattcactaccagagaaaataacttcggtgttagatagtaatccctcatcagtaccagaaatcaaaccgacactaaactgtagttagattcgaatcaaaagtttttgggattgtgaaagctggcgtgtatgcacactagtaccaaaatctgactcattgccgaatcagatagtgaaacgcaattgcagtgcaggtagcagaaacccgagacggagatgtatacgtggccgtgggttgtgcatgtgcgccaccttccccctcctgacgcaccactccacttacgccctgaaaagaaaaaaaaaaggaaaggaaacagaaaatgccgtcacggcctcgcctaaactgagctgggcctcgatggatcgatcgactaggccgaaatcacggtggcccagtccaaggtaataactaatagcccatcaacaaacggcccaaaacaataataatatcccaactcccaccctgaaatgtcgcgtcgcgtgccacctctacctttttctctcctctcgtgaactcgtgttcggtgttcgtcttcctcccgcaccgcacctcacgccatggccatgcctcccccgctcttcgccgccgcctcccacgcctcccttctactcccctcccccaccattcacagctccaccggatctcgccgccccttccgcctacccctccgttcctcccgccgcccgcccgtcgcagcagcagctgcctctggcgtccccgacgagtggggcgaccgctcgccctccgcgcccgagccgccctcccagcccgacccccccatcgacgacgacgagtggggccgcgacgacccctccgcctccgggaactctcgccccgtcctcgtcaccgacgagtggggcgagccgggtgtgcccgagccccaatccacctccgccgccgacccccctaccaacgacgacgagtggggtggggatccggcgccaccgccaccgccacctcctgtgccggaggaagacaacgaggaggaaaggcgggaggagctcaagcgctgcttggtggacactgtgtacggctccgacctgggcttccgggcgtcctccgaggtgaggggggaggtgctagagctcgtcacccagctcgaggccaccaatcccacgcccgagcccgtccaggccacccacctcctcgccggcaactggatcctcatgtcagtacttactattctactctctacacacgctctcctctacttcctttcttccttcttctactactacattgtcttcattggactacaataccactcaactactactagttgttattggtgaaatgtcaaatgctaagcttaacatcatttattagattttcattttcaatgaaaacgtttgctgttcctgaaatatgtcttgtgttgatgtcatcagcatctttttactagataactgatcgtctcaattgtgcatggtcatttacttgcagatatacagcgtattctgagcttctacctatcctagcagttggtgcagcaccattgttcaaagtcgatgagatatcgcaagaaattgacacaaatagcatgaccatagtcaatgcctcaactatctcaagtccattcgcttcgttttctttcagtgccactgcttcttttgatgtacagagtccatcaaggatagaggtacaaaattccttgctataaaatgaatcttgtgcttctttggattcagtaccatcatcttgtttggaatagagctgtttattcagtcatgaatataggtaatctaaaagaatttttttgaccgtttgtttgttgggaaactaaaaatgccatgctaccttgtttgatttcttccaataacctgtattaagtttactttgctagatatctctacctactaattctagtggaattcagttagcaacacaaatgttaaagtaagttttatgacttctgtttcctgccataaaagggtacactatgcatgcctgaattgacaagccgctaattttgtctttgatggtcgtacatcaactcaacgtcagagatttccgttccttttaatcaaaaaggttttctagttcatcaaccaagttactattagatgctacttataggcttgaacagtatggaatatgcagtttctattagatgctaggattgaacaatatggattatgcagtttctattagatgctacttctaggcttgaacaatatggaatagctgggggaggggccgagggggacctttcctggttaggcatagatatgattctcgctagctaaaatctgcacaactcgctagctcaaatcttgtaggatccaaaatgtgtatccatagatctgaagacacataacaaggggattatagacttgtacaaatatttctgcttgttgaacctgtatttatcaaggatttctacacaaacctcggtgcaccagaagcttgagatgtgcatagaaattattgagatttctgatcatcaactttcttgtgcaaatatgtacattgaccaaactgacatgttgatggtcattccaatgaaggtccaattcaaagagggaagctttcagccaccgaagatatcatcatcggtagacctacctgcagaggttgatatatttgggcagaagatcagcttgggcccagtccagcaggtgctgaaccctctgcagcaagcctttgcaagtattgcaggatccatttctgggc

SEQ ID NO: 58841 - DNA, 10495 bp, Oryza sativa
gatagaatatgatttggcttataaaccattgaaatctataaaaggccaaattgtatgtgattttatagttgactatcatatagatgttgcttatgagggagaggtttgcttagttgaagttataccttgggagatttattttgatggttcttcttgcaaagaaagtcaaggcataggggtagttttgttttcacctaatggcatgtgttatgaggcatcggttcgtttagaatattattgcacaaataatcaagccgaatacaatgctttattgttcggcttacaagttatgaagatggttggagctaaatatgtggaggcctttggtgattcgaaattggtggtgcaacaagtcgccggagtctacaaatgcttggacggatcactaaataggtacctcgattcatgtttagatattattgccaattttgataattttgctattagacatattgctaggcgtgataattctagagcaaatgacttggcacaacaagcatctggttataatgtgaaaaagggattatttctgatattagaagagccggtgcttgattttaaatctttgtgcgaaattggcaaaactggagactaggggcggtctgaccggcgttgcacggccggtctgatcggtgaccaggggcagtctgaccggccgtatgctgccggtctgaccggcgaccccgagcggtctgaccggccctgcgtggccggtctgaccggttttgggcagagcgctggggggcacgcttcaatcgatttggaggccgaattaattgagaattcggatatttgtgtccaggatacagaagaggattggagaattcctttgattcaatatctaaaagatctcacgcttaaggttgatcgaaaaattcggcggcaagcattcaaatatacattgcttgatggagatttgtatcgccgaaacatagatggtatcttgttgaagtgcttagatgaagatcaatctaaagtggctatgggagaggtacatgaaggaatttgtggaactcatcaatcggcccacaagatgaattggttgcttagaagagcgaggttttattagccgaggatgattgatgattgcttcaaatattatagaggatgtgaggcttgtcaacggttcggcaatgttcaattggcgcccgccgctgtgttgaaccctataatcaaaccatggccgttccgaggatgggctttggatttcattggtcaaatttatccttcgtcatcaaaggggcataggttcgtgctagttgctacggattacttcaccaagtgggccgaagccgtgcctttgaagaatatgactcatacagaggtaattgactttattttgaagcacattattcatagattcggtattccgcaaacattaactacggaccaaggtgcttcttttatgtctaaggaagtgaagagttttaccgaatcttatggcattaaattgttgagttcttctccttactacgctcaggctaatggacaagctgagtcgagtaataagacattgttaaagctagtgaaaaagaagattgaggaacacccgaagaggtcgcatgaggtgctttctgaagcattgtgggcgcataggatatataaacatggtgccactaaagtcactccttttgagttggtttatgatcaagaagccgttttaccggtagaggtaaatcttggttctcttcgttatatcaagcaagatgatttgtcaagtgaagattacaagatgttgatgggggacaaccttgatgaagtcatcgacaagcgcttgaaggcattggaagagatagagaaagagaagaagagggtggccaaggcgtacaacaagagggtgaaagcgaaattgtttcaagttggagacttggtttggaagacaattttgcctttgggtactcgatccaaggagttcggtaagtggtctcctagttgggagggtccttattgagtgtgcagcattgttcgagggaacgcatactttttggagacactacaaggggagcgttttcagtaagcaatcaacgggaaatacttgaagaaatacttcccgagcatttggcaagacgcttaggaggtactatggccggtaattgggttatcgtcctaaaaccaaaaacatgttctatgcttttagattcacgttgttcatcaaaaaggcagggggcatgtgtttacacccaaatttggcacctaggattaaaataggaaatattgccaaaatttggaagtctaccggtttcctccgaagtgggccggtctgaccgccgtgtgttgggcggtcagaccgctggttgagggccggtcagaccggcgatgtgtggtcggtctgaccggcaggtccgagtccgactctgtttcgtcgggtctcgaagtttccttgctcaggaagacatgtttcgggtttcctttggtttctaccccgagttgaacgtggaggagggcctgtagagggtaagaccaacccctatataagggacatggccggttcattgtaagaaaccaatctacaatcaatcaatcgaatcgtttttcatattgcttttagttttctcttagtttgtccatctttgtcggtttgcgccgtaaaccgtccgctgccgctgcgagagtgcgacatctctttgcaggtttgtcctgaaaaccttccgttttgcccacgagacgagtagctatctagaaatcggctccgctaggcggtttagttatcaaaactcatctaggtttagctctttgctagatcaaggtggttggtgactctaggatcaccacaaagcttaaagtgctgcgatcgtgcttatcaacttgttaaaaaagttgccaacacacttcttaccaccggacacaagacaccgcaaaaagaggcagcgcaaccagccaccgcacctctccccccctccgcgcgccgaccatgtcgtcgtcgcaagctcgccgcccgcgtttcccgaggggaccggcggccgccctcctgcgttaccagttcaagacagtgaggccaccgacgaaggacatcgtggagctcctgcccgagggagggtctcgcaccgtcccaaggagcgtgctgcacggaagcgcgcttgcggacgagaacaagttcaagtccctgagcaagatggagccggcgatcgtggcggccgcacaggaggatggcgatctggcggcggcggcggcggccgaggcggcgccggcgccggcggacgaggagtaggagaagcctgacggcgatgtggatctagctatcgtcaagttttttcatgtttcttagtatcttagttccatcggatcgagtaactgtactatgtttccatgttctggtatatctgtatgatgcatggaccagttatcgaaagatctttggcgctactgccttgttccaagcaaattaattctctatgcgtcatgaattgtgttcttggtgccgtctttgcataattaatttgtattcgttcgtggtcgccgcctttgcttgctcatccaatgtcatcgtcatcgacgtgtcctcgccgttgccggtgcgcgtgctcgccgtggaattggagccgtgtacatatcccaactgaattagcaggactagttaacccgtgcccttttcttgtcgatgtttccacaagtatttttttggataagttatataatttttttataaagtactacgaacagaacactttcttttgcaattaaaaaaatgcaaaaatatatgcagaattcaccactagtggtacattatctttttaactccaattacattcttatcttttaaattccatacgttgctttgcgccttgcatgttgcatgcgaaggagtacgtaccactggacggggcaggtcgatggcaggagagcggtgcaccaaatagaccaggaccatgatagttgcaagtgaaacgggcatggtggcccacatgtcgatcgtttaaccgcgtagaccgtgtccacgttgggatccaccagcagcagcaccggggggaccactagactcccagagcttcgtgtgatgtgaggcaacacaacgcggacaaaagcccaggtagactcattccaccagtgcatgatatcataggcaaaggagacctcacatatcagtagcacggtccacgaagagcagggcgtagggaggggagccgcggagcggcctctgacacgaccgggaatcccgggagaaaagcaatgcggtagggtgctaagggcggttagatggagatcgaacggccacggcgtggtagacaaccaaagccggctggtatcgcgggcgccagtgcgaaatgggtagtatttgaaattttcttttctttttcacaagtaacttttttcttcgtcctcctttcttattttttttgtaaatttgctcagacacaaaattccgatcctacgaaacaatattaagtcataggccaactgaatctaaacaaaacagaaggaacttaccttgatatatacgaaacgagagttgttcgagtttgctatcgacattatcgctttctataatataccgacgactttaacaattgtcctataatacaccattgggctataccttcttttcaaaaattcccaaaatactcttatgtacatacaaggttaacaattaatttatctaatttgaagtttcaaaaaaatatgaaaacttttgtgtggactccttacacaacatagaattttgtatagaagttttcaagttgtttatatttctattttttataaacaaaaatataacttatttgttaaatgctatatttttttgaaacttctgatgaaataaatcaattgttaatcttgtactccctcatctccaagatttgatttttttagggacgaagagagtatgtttctaagcatattttaggtatttttgagaagaaggtccagcccaatggcgtattgcacaataattgataaagtcgccggtatattatagaaagagacaatatcgatggcaaatcattgaactcgaacaaactcagtggtatagaatagattctctcatacgaaaagcagacaggtcacaaatattcataaccaacgacaccttaaaagaatactaatataacataagctaaaaccattgaaaaaagagtgcacagcaacaacatggtcaaaggcgatagtagagcaacggtgacggggaggtttgattctcgagacttgttatatctatccagaatttcttttctcttcttcaactcgaagtgtgatcttgtcaatgcttctttgagtggcatgtcgtacagacgactatgaactacaacatcacatatttttgtctgcggtgatatgtagaagagtccgcatttcaagcgacggtccttgtaccgtctgagcttgttgttgataacatctatcagatgatttataacatgtagctgcttcccgaaagctatccacctgaccaatcctaatttttgaagcttgcaatagtaatccaccattattatcttttgcacttgtagtattgcttcgcgtcccaatgacgttgtcttaaccatggtgcgatgctcactacaagcccatgtaccttgctcgtccctagcgcatagtctatacttcttttttctaatcttaaaccccttctttctttgtcctttcctgaagaaaaaaaaaacctggcgagtaagaggagaattaaacttcctaaaacataaacatgaaaaagctaaactggcgagtctaaacatgaaaagctaaattatggctacataaagaagaaagacgaatctaattgcaaattatgtaggaggaaaacatagatggatttgtaatttagctttgcatatgcacgtgtagcgacgactgacaaatacaattatactcagatgtcattgtgtgtttttattctcaaacatatttgcaaataatatttgcatatttgcgtggtcgtttggggattgaaagtctattgatacatacttgatgtgactgccgcaagttagattcttgtccattggctttgctttgagatgcaaacctgtgaatcccctgtcgatcgcggatgtcttttgttttttgatggctcgatcgtgaactgaacagtatatactagtagtatatatatcgtagtagatcatgacatcatgtatgtgtcctggttggtatccagaagctctttttgtcgtctgacattaaggtactacaaccgttcagttgtggggaacaaggggattcacagattaaactcgcttagttaaagataatctatctccaatctaccatatctttactattataaaaattaaaaatatttttattaaattttgtcacgtaatccgtgtttgagttggttttcgaagatggttcggccccttttgacgtttcgtccgtttctcgtcacgctggttccgtccgattaaattcatatcgatcaatctttttttttctttccaacgtcagcgttcgagtctgcatcggttgcgagcgaacgagaaaccgtgtagcttccggtatttttgaagcgagcgccgtcgttgtcagttcaactcctaaaaccatctcccctccgccaccgtcgcatcggcgccttgtctagtcgccgtcttcgtgctgcccgggagcagtaacaacagactgttggcccaaggaaattgggctaagctttcgctcggaaccccctaccgccgtggttcgtcgcctaatccgaaaccaccatctaaacatcagcggcacatggcttccgccacacccgaccgacgtccctccgccggccatcttccagtcctgccaacgacaagactgccaccacaccacaccgacgtcctgccatcggccgacttcattgaaccaccatccttgagagctggctcaggacccctccgttccaccacccgctgccctcctcaccagatctgaccgaaggagaacctgggactgggtggcattgcttcggcaacctgagcttctcccgctgacaagctaccacctcaatccagcctacaaacttcccgcaaagaaaaggaggagcaccaggaaggtcgagggtgccgaccaacaacgaaaaagatgacccaccaccgctagctcctgttgcactaccatctgggcctgcaccgacaccggaaacgctaccgctccggctctagcgccggcgccccctttgtccggcttccttgatccacctagccgcgccgcgccgcccacctagccgcagaaggcaccgtgacagcttcccagctgcccggccgctgaggcctggccacgccatctcgcgcctgcaccaggcctcgccgttgctagtcggaggaggcgtagggcggctgctcgtgctgggggcggaaaccgtaggtgggctacggaaggcttgtcggcggagtagtgtggggcatcgtaggaggtggagggagcggagcaagggtagccggactcgtcggagggtcggagcgggcggccatggggcggcaacgccgccgggcaggccacacccctgagccgccgcgcacctcgttcacatccacctccgcgtccagggcggccgcacaccttgctgccacgcaccaccgagccgccaccgccacccctagatggttgataatgtcacaacgtgtctttacaaatcactagctccatttttacctcctgtccactgtccacttcattctttcagtggagaaagatagcttcagatctccgtgattgctgtattttggaaccgagggagtgatgaccagagtttacattaccgtttccaacatgagaaccgttttcgataaaatgggccacgaagtatactcttgatctgggtctaaatttctatagtatcaccctcttaaagaccagtttaccattgttgacgagcccaacaaggcatatattaaccatcgaaagtagcccaattaagaaattgcggaaaaaataggcccagtccaattagcccattctatataatccccagccgcccacttcttccgcccttcacgcatctagggtttcgccgccgcctcttcgtccccgccgcgacgatggtacgctcctcgatctcgcgcccttctctcgtggaatccatgccggccggccgacgtttcgctgatgtgatcgcttgcttgtttcgtttcgccgcagccgtcccacaagaccttccgcatcaagaagaagctggcgaagaagatgcgccagaaccgccccatcccctactggatccgcatgcggaccgacaacaccatcaggtgatttgatttgcttgctcccctccttcttgctaagtcttttgctcctcccgcgttcgattcggcttaggcatatctgctgagatgtcgtggtttggtttgtgttgttcaggtataacgcgaagcgcaggcactggcgccgcaccaagcttgggttctgagcaggaggtggcaccggctgctgcctgcggattttgttttatggatgtttcagtgtttatgcaagcttaggatgtgattccatgatgctttttattaaggttttctgaaatgttaagggtagtagtactctggtttactgaggataccatgctatgctgtgctgagtaaaagaaccattctaatatatctgccttgttgaagttatttctcaggcttattctgtttcatttttaaatttgttattgcatagctggagaggtgaattgttctcaatatcgttgggagtatgattgctctattgttattctattgggctgttgttagagtagagtaggcacatcctaccaaaagctttccgtcacaaaatatagcaacctaggattggattagatgcggggtttgtctatatttgttggactaggacgtgtctaatccagttataggttggtatattttaggatggagtgggatccttatgcaggtcaagctgttggtataattcttctgtgtgtatggagtttatgtggattacgtggttttgcaatggtccttataggaaaacaaactaatgctgtgcatctaccattggtacaattctatgcaattgaagctaatgcaacttattttctgactgtaataatgttgcaaattgtgattgtctacgaattggcaaccatctttctcagatagttactagatctctttattgaacaatggcctcattgggactgcttgaaatatattattcccctgattatctacttgatcatagggataaattaaatatttttagaaacaaaatgaacaaatagtttagaacatgagggctacacaatgcagtagaaagtgtttgagaaagcatatttttagaagtgtggagcaaacactccacggccatatctgctggagtgtacatttttggtcgtacaacagtagtggaaccctttttttttttttgctgtgttctacttctatccatgttaaactgaaagtagtcaattcatgtgcttgttaataccaacatgagttctgtatcaatcatagaagactttggttatgtttgggctttatatttccatgctgtaatgcttgtgttctgctgtgaactatggtcatttgaccgagatatgcactaagggatcgtttatgcttgtttcattggtgtgctattctacatgagaatacatggatataatacatggcgaatcctcgccaactcgcgagcttcgtttgaacggcgagcttagggattctgatcccgcaattaaaaaaaataaaaataaaaaacaaagagagggagaaaagcttcggcctgaaaaggccgtggcctggtaacctgagttgggccctctcagcccatgggttgctgacgggaccggcccatataaggccacctatttcagccatcggcccatcatcatccatccaaagggcccaacaatggcaaaaaaaaaaaacacgtcggcagtgtagttttgtgaaattttaggaccataatatctaccacgtgccaaaatacatgtggttttgtatagcttgaacctaggatttattgaaattcaccttcctttttttaagggaaaactttgagcacccgcctcccccaggccgggcccacttatatctgatatctttcataggtcatagactgccctcacaggccaacacatgtcttttctgcacactttgtcctcactcgtgtgcacccgggaagaatttcccggtcggtcacccatcccaaattgctccaggccaagcacgcttaaccctggagttctttggagattggattccggaaaaaatgttgcaacttgttgatatgagtattctattaatcctattaagccctaggccgggatgttacaccctcaccccctcaagagagatcgacgcccccgtcgatcaaccctaggccagaaacgtcctctcttggccacgttcatgtgtccagtgccagcgcatgtgccatgctgtgtaaccactcccggtctacaccagccatgcgcaccatgcctgcgcaactgcgacacacacgctcgtgaaaccgcgagagtcggctctgataccattttgtaacgtcccgcctcccccaggccaggccctaggccgggatgttacaccctcaccccctcaagagagatcgacgcccccgtcgatcaacctaagtcaggaacgttctgttt

SEQ ID NO: 58842 - DNA, 26767 bp, Oryza sativa
aacctccttcatcagtaccagggttgcaagcatcgcctgttccaccaccgccgccacctccacctcttccaatgattccagggatgaaaacaccacccaccccaccgccacctcctccagcagctccagggcagcaagcaccagctgttccaccgccacctccacctccacctcctccaatggttccagggatgcaaacgcggcccattccaccaccacctcctccatctcaaactaactctttggtttcttcatttccatccacaagtaaaagaattccaccgccaccccctcctccatctcaaactagctcattggtttcttcattgccatcctcaaggaaaggaaatgatgtggcagcccctcgtcccccacctcccccaccactgtattccaggtcatctcatgtcacttctgcaccatcagcaccacctgcacccccattgcctcctccgaagctagttggggccagcaaaccttcacaagagcaaatgataacctggccaccaccacctccaccaggcccacctcctaagaattcctcgaactctttgccaagtaagggtaatgttgtcagttcatctcctcccccacctcctacattctcatttggcgcaaaggaccgtagcacagcccggtccagaagtcctagaagtttgcggcccaaccagtcatctaagagacaccattgaagccgttgcactgggtgaaagtgtcaagagctacacagggaagcttatgggctgaaacacagaagtctgatgaagcatcaaggtattccaaacattttatgccattattttccaggtaaatgctaatggtagcactataacatgttagtccatttatgtcttcaccagaaccccagagatagatatttcggaacttgaaagtcttttctcggtagccatgccaaacatggaggagaaacgggcacgccaacgtccttctgttgcagcgaaacaagaaaaagttcttttggtacttatacttcacattccttactgcaaatattcacaagcagtgagaaaattcaagtgaaaagtaaacaagattaaccttttcttctgcagattgaccttcagcgctcaaagaattgtgaaattatgctgagaaacattaagatgccattaccagatctgatggtaacgaactaaacaattttgttgaagggatatggctcttgaaaagtaaaagtaatctggcatagttgatgcatacccttgctgatagactagaatagctaatcttactaatgccacttcctaaacctggtttgggttatattagttacctattgttgcaactgttactgagcataaagtatttggcagctgtactgaactagtggtttctgttgataatagtggttccttttttttcagaactcagtgcttgcacttgacgattccattgttgatggtgatcaagtagattatctaataaagttctgtccaactaaggaagaaatggaactactcaaagtatatatctactcagcagattgctctttgaaatatcattggactcttgaaattcttactgcgtctgttccagtggaattttttctgtattctgctaattgattaaggtttttcctcctactttttcaggggtttacaggcaacaaagagaacctagggaaatgtgaacaggtcactaataatcttttctacttgatcttttgttggtgatgagctttgttttttcggtaactatgtaaataataatgaatttcatagttcatcccaagatatacacaatcttagtgggagatcatacaaccaactatctcacccagtcatgtttggatgtttcttggaagttatgtagtggagtagctaataagatgatcatttttttcagcattttcccggtgccatgttatgtatatatagcttgtttattgcttagcctgtaccagcagttatactattaattttttgcttaatctcatgcatgaacacaaaggcttgatctgacttgcttctgtaattgtagttcttcttggaaatgatgaaagtcccaagagtggagtcaaaactgagaatcttatcctttaagattaagtttcttacacaggtcagcagaatatttgcatcattttttccccagtgaacttgtgtaactgttctgatagataagtagagtttaatttttttgccgagtaattctgtgcattctttcaggttgcagatctgaaaaacagcttgaatactatcaattctgttgctgaagaggtacactgttatataatatgacctcaagtcctcaaccttttcccgtttgacgagtttaaacatgctgttatataatgttatttggacaggttaggaactctgttaagcttaagcgagtgatgcaaacaattctttcgttgggaaatgcattaaaccaaggaactgcaaggggtgagtaattaagtatgttctaagattgatatgtttacgatatgatttttgcaaattgatcttccaacatgaagaaatacagtgcacatggtttctcttttttttaaaaaaaaaaatcttgttctattttttccaataaatcatttttttcatatcatagaaaatgttggttaaaacaaaattcgagcatttaacaattgtcacgggtgaagatgtagctaggatttatggacaggaagaagaccttacaactgcaattcctgcgctcttatttcaaaacagcatgttcaatttcaccatagctattatgtcctgaaccatcatctctcttaaccacatgaaattgatagcgaactgttgattatatccttcatatttttctcacaaacacctgtttttcagggtcggctgttggatttagattggatagccttcttaaactcattgatattcgggcacgtaataataggatgactctcatgcattatttatgcaaggtatggcatttaatttcagtaatcccatcgttttttgtgttttgaagtgtcactgaaccacatagttatgaaagcattgctcgttttgcgggaatttactggtgcatagcaatagaagttccacatactaaatttcttatgagttagacctagagaagggatctatcaagggtatgtctaaatagtatcattgtgattgtattattgatggttgttcattacagtaggaagagaaagattatctaaaactaaaagctccctttttccatttagaaacagtacattgaccaactgcatacagtggtttctcattaaaaatttgcattcagctgtgagcaggacagcagtgactgtattgcccttttttttcatcttccctttattcccatgtttcaaatatcatatcagtctttctcaaaaaaagggaacaagagcatatgacgaaagtagatatgaatctgcgtctgtaagtttggactggttgcttttataaccagtatatttgcattgatattttgtcatgaagttgatacttttgtggcaagctcagataagtatgcactttcatgaactctttctcaaagtttattgcgctcgcaggttctttctgacaagcttcctgaagttcttgattttaacaaggacctcacatatttagaacctgcatcaaaggtaacttagatatattaattaacgctagatccacgttggctttgttttgcttgcttatagtgtggtggtgaatcacagattcaattgaaagagttggcggaagaaatgcaagcgataacaaagggactggaaaaggttgagcaggaattgacaacatctgaaaaggatggtccagggtctgagatattttacaaggtcggttgcctgagattttattgttagtcatatgagcagaaatttctcatttattttcgctgattacaatcgagaaaatggtgcatggtatttggttctccaacttcccccattgattctctgttgcctccttgtggatgtagttgttggaactggaaattataaatataatttcatgtttctcaaagtattcttcttatgtaaaactcatcatcaaagattccgagttacactacaatagggatagtgacaaaatgtgaaaagtaaaaggtgatcagagacctttgccatactaaagggaatgaacatgaatcaacaatttagtccttactgctccatttgtattattagattatggaaaccataacacttgattgcagttttgcagttttgtacttcatcagtacataggctttatagatactccctccgttccaaaatataagtatttctagggttcaaaatgtgtgcctcaatataagcattttatgggacactgattccatggaaatccatacatttttagccaatcaggtgcttaggagacgaatctaagcgattcaaaaatcaaaatttgaccactgaggtgactgaaagggaatcttttcccttaaccttggtatttgctaaaaaaacctagaaatgcttatattttggaattgagggagtatattctattaatagtttgcaaattgtcataaaaggatggataagaacaaacatgacgacacccataactgaaacagttagtcatttagttgactatcattgcacaatgttttgctgttagtatattattaactgtaatactaatactcaaaagagctttcgtttcagaaattgaaggaatttcttgctgatgctcaagctgaaggaagatcgttagcttttctttacagtactgcggtatgcaaagactataaatagtttcattaccttgctgcatacgtcttctaacatgtatttgtactaagtttttgttattttattttcaggggaaaagtgcagattctctagcacattattttggtgaagatccagtgcggtgtccatttgaacaaggtattttatttttatatataaggcttaattaatattcctaactactctacaaaatgtacaaatcaaagataagtgggtctgatacaaaagggaatgggaaacgtgtatttatatgcaaggcatgtgacgaaaggtgctatgataattgagttagtcatcatgtttcagacagagggcactgcattcctctttccatggtatgacctgtcacaattggataacttaggagtaattgagtattgccatttttggggttgtacaatcaaactaagaaggggcatacaattctgggggtccctggtggttttaccagaatcatccaaattgctgctgttctttgtgtgctttgttccttagtgaacttgtattgccatgatagatactagaattgttgcatccaccaaatcttcagattaataccagttagcttttggatatctgcagcagctatatgatttcctgacctttttatgtggacagttgtctctactttgctaagcttcgtgaaaacgttcgagcgtgcccatgccgagaacctcagacagatggagctggagaagaaaagggcccagatggaagcagaaaaggagaaagtgaaagcagcagctcacaaggaggatttgctggagccatgaattttggtctgatgagttggcaaagtatgcattgtcgttgatttcttgccgtttcatattgcggccttagcttcatgaccaaggacagtacggcagaaaattttgtagcggtttattcgaagcttctaaccatgtgaaattggaggtgaagaaaattagcacatatgacaggtacatcaatggaagttactccctatatgcttggactactattggttcttacagttttgccctgcagacagagggagaaagacaaatataagctcactatgtagtgctaatatgacagtttacttagcagatagactatacagcaatacagatacagcttcactggttcagtggttcttactgtacataggaaagtgcagctatgcaactcaccggttccctggtgctgaacaaattttgcaatgtttgtgcccgcaaaatatgtacatttgtagagatgcttttgtgcattacgatgtataacactgtaagtagaacaaataaaacaatatttttccaaatggaatgtgtggccatttgatcattcattcatctggctggagctgtggaacaggcagcttgtatcttgttttttcctccttgtctggaaggatagacaaatgctctgaaccttatcagttatgttgtcaggtgctatgaatcgatcataatccatcaaactgtgaatcacatgcttggtcggtactccctcctatttttaatgttcgacactgttaacttttgaattttaatcattcatcttatttattttttatgcaactataaaataaaaatataagtcatgcttaaaacatatttaataatagttatatatcattttaagagtaaattgtactttgtaccaggtagagtatatacaccttgtttgacttttcacccggtagagtaaaccttgttttatttcgcactaggtttaacacatattttcactttgtatcagagaatatcgaaatatgagtaaaacatatgaaacttcttaaatttaaactatgtttgacaacattgcttttagatattataaaatttcattattttttatggtttgatgatagtgtcaagtgaaatttatttcaagacaatgtagtgcaaagtgaaggtatatgttaaacctggtataaagtgaaacatggtgcgttttacctggtgcaaatacaatttactattttttaatagggaaaattgtaaaaccaccacagaagtctgaagtttgacattccacaccataagtcattttgttgcaaatgcccgcccactactcggttttgttgcaaaccacatcataagtcattttgttgcaaatgcccaccctctactcagttttgttgcaaaccaccacagtgcacacatgcataaccgaatcaatatgttttcataaattgtgagccgtcaatatgttttttttacataaaattaatacttataagagtatagttttaacactctttatgagattcgatatatagaatagctaatgggagctttaaaattgttgcactgagttttgctatatgccaaaaaaaagaaagaaatcaatgaaatatataagaataaatctaatgtaaatactatgacaagattgacctccgtaacctatggtggttctacatcagcgttaactgacttatttggttaagcatgtgtgcaatggggtggttttaccaataaaactaagtaggatgggtatttacaataaaatgtcttatggagtggaatatcaaacttcaagagatttttggggtgatttttgtaatttcccctttttagtaagacaaatagttaaacataactgtgtatatgcataaaactcatgagcactaggatttaaaccctgctagatgaagccatgcgcccactactctatcaccgtgatgctactaacatacgaatctcaaaggaaaaaaaaagaacaactactccatgtaaccttagaaacacatgttatttttccataaattcttatgttatgtgcaacttgcaaggagttataagctctcgtagctaacaaaatcaatgtgcgacttctaggggcaaagctagagtatatgaaggcgtgccaaggaaccagtaaagaaaatttttagttataactcatctattttcaatgtaaacttagacgttttcattagcttaaactcgatccaaagtaaaaaaaaaattaacggaaatgctaaacttctgttgacagaaaatagaacctcaaatcttgtaaattttggatcactggatgtgcttcatgattcatgctcttcttctccaactctggcgtccacctcttcttctcctgcgccagcgaacccaaaatccggcagagggccgacgaattagggtcctgcggtggggtgggggtgggagggagggaggggagggggaagagggggagttcaccggctttagagggatggctgtgggaggcagcagcccgacggtgggcggcggatcgagcgggcggcgaggcagcggcggcggcgccgtagctgctgggtcgggagcgggcggcgggggcaaaacggaaagagtggtaggaggaggcggctggtggtggcgccccgccggcgacagggaagacaacagacagctcgccgctgccggcttgaggcaaaggagaggagagggagggggagggtgaaggggccggcccggaggcctcgccgacgccgttgacacctttcggccagccggcgaggccgggcggtggcgtgctcaggcggcggtggcggtggcggtggcggaggcggggcggaagcgctgaggagcggcggcgtgaggaatcgggagaggagagaggatttttatggtttggttgcctgcacgaatcttaaagcaatcgggtggtctaaaatttgcaagatttgtaagggggtttcctgtcaaatgatctatagacaatcccataaattaaacaagagatattttcattcattttgttctaattatgtccttagtgactttcaagagggattaagctcatctaacttacttttctctaacttgtgtcactgacatgtggaccatatatctattggactcacatattagtgcatcaaagtcaggggaacctcttccctctcgagagtcccctttcttctcgcggctcagttcttcagtttgttctttgagcttggtccctccccgaatcgatcaccggatttccacactttcccgtaaaaccgaaccccaatcgataaattcaaacaaactctcatcatcctagagctctactctagttttcctttttttttaaaaaaaaaatactacggagtagagctctacgccaccgtacactacggtctcctcctcatccccgaaacccaagctactatcctcttatcgccaactgacaatgacaagagggcccctagccccctactcctccgggcaccacatgtcagtgggcgtaacagaaaacaagtgttgacctcggggtgcgtggagtttttcccggagtcgtatcctttcgggtgacgcatacaagggcggttcggatcggacggctagtatatatccacctccgcctccgcgtccatggccaccgccgcatccacctccgccgccgccgtcgccgccgcatcgcgcctcctcgtccgccgcgcgccgccgcgcctgctgcgccggttaccccgcgcggcgctcgccgcctctcgcccgtcgccgccgtcgtcgtcgtcgtacggtgcagcagccgtcgccctcggccggcagccgctcggccaccgcgctaggatgggacacaccgccgccgccgccgccgccgcgggccccgcgctcgggctcaccaagcccaacgccgtcgagccgccgcaggtgcgtgttcgggatggggttcgggttcaatttcaggttcagtcgcttgcttggtgcttaggattgttgcagattcctgaactccccatctgtgtggtaaaatgaagctgctatatttggttgacttgatcacgactcgttatcgaatctctcgagctgctagatcgagatcgaactagtgatctcctacgcaaactacgtttgcatctttgtttagatttgccgatgttgcaagtgagctcagtctcaatctgtgcactactgtttttttttcaggtttcatttgctgctaaagacgtcgaattctccgaatggaagggagacatcctcgcaatcgcagtgacagagaatgatctggtcaaaggatcagactccaaattcgagaatgcggtgttgaagaagctcgacggccagctcggcggcctcctgtcggaggcatcggcggaggaggatttcaccggcaaagccgggcaatcagtggtgctccgcctcccggggcagggtttcaagagggtgggtctgatcggccttgggcagaacgccccctccaccacaacggcttgcaagggcatcggcgaatccgtcgcgtcagttgccaagtctgctcaagctagcagcgcggctattgtttttgcttcagtgggtgggatccaggaagattttaagctgactgctgcggcagcaattgcttcaggtagtgtgatcttgatgctcctttcatggaattgttgtgatcttgtgggatgcattggcttgatgctgaattttatctgtatctggattgcaggaactgtgcttgggctgcacgaggacagcagatacaagtcggagtcgaagaaggtgcatcttaaacaagtagatcttatcggatttggttctggtccagaggttgaccagaaacttaagtatgccaatgatctctcctcgggtgtgatattcgggaaagaacttgtgaactcacctgcaaatgttcttactcctggtatatttcttttgttaaacgccaaacagtggatctcctccatagatgccattctgatgttttcttatttcactactcactcatctcctttatccagctgtgcttgccgaggaggcatcaaacattgcttctacatacagtgatgtattcactgcgacaatattagatgtggagaaatgtaaagagttaaagatgggctcctacttgggagttgctgcagcttctgcgaatcctccccacttcatccacttgtgctacaaaccacctggtgggaatgccaagagaaagctggccattgttgggaagggtctaacttttgacaggtttgtgaaacatatgcatattttgtgaactattgcagtaacatacatcattgtgtaacataaatatgccatcttttatatggataattgttggttcttacaattgattaaccgatttttttgcagtggtggctacaacattaagactggaccaggctgcagtattgagctgatgaagtttgacatgggaggctctgcagcagtttttggtgcagcaaaagctttgggccaaatcaagccccctggagtagaggttcattttattgttgctgcttgtgaaaacatgattagtggcacaggcatgagacctggtgacattgtgactgcttctaacgggaagactattgaggtatgtttgttgtgatacaatgcgtatgattgtagaagactaggaatcatgattcattaacataaatcagtgatagtgtgaaaaaatgcgtttgcttatgtattcatctgtatttatttttcttcaggtaaataacactgatgcggagggaaggcttacacttgctgatgctttggtgtacgcttgtaatcaaggtgttgacaaggtaatgacttttatggtgtcatgttctgtccatatgattaccaatctgattttttttaatgctttgatgatttctctataaattaaaccttagtgcaagatattttattggcattgttggttttagttataatgctgatactcagctcatcaccctagcatagttgtatgctatttatttctaggccctttttatggaaatgtgatttatcttatggcctgatgtccctcacgaatctagtttgaggtactgacttatctttaaatgtcaaatgtagattattgatctggcaacacttactggtgcatgtgtcgttgcacttgggcctagcattgctggtaagattaaccaatcacatatcacttgcaatcttctccattaagtgaatagattagtgtgttcctttgattgctgcttgcttaaatgaatattttgtgcaggaattttcacgccaagtgatgaactagctaaggaagttgctgcggcatctgagatatcaggagagaagttctggagaatgccactcgaggaaagctactgggagtcgatgaagtctggtgttgctgacatggttaacaccggtggccggcagggtggttctattactgctgcactcttcctgaaacaggtaaatttaccactttattatgaatgaaattcaagcaaaacacacagccacatgctctaggtaggcacatttgaataaagttgtaagcagtgacatgctaatggagcctcatgcttgtatttgcagtttgtggatgagaaggtgcagtggatgcacattgacatggccgggccagtgtggaacgacaagaagcgggcggccaccggattcggcgtctccaccctggttgagtgggttctcaagaactcatcttaaatcatttattcccttgcattctcatccccctgaggatgagatgacacgaggatttcggaggagtttggtggtggcaaagcggccagctagggccaatgatatacaaaagtttagtgggcaatttagaataagaaaactggtcatcgtcgtttccttttcagttggggtgtcgaattgtttggtgaaatcatcatcatcatcatcatcacattcacaagatgttttggccaggacaagtctgttcgtgccgtgtagctctctcccttttctcttttgtcaaatgtggaataacgctcttccttttgatttgtgccccgggataatctgagtcataaatatttcgacaatagcctgaatcgtaacgtttccgctgtgctagtgactgaacaggggaactttctgactgagaaatcgcgatgcttctgtcgagagcacagccatttctgtgtgtgtattgctatgatgtgtctacgtcaggagtgtaaggtgaacacgtatctgatgcctacttgttcatgttggccactgcggatgccaccacacaagtgtgtgtatacaaatgcagaggcgaacgactgcacgtcactggaggataggatactttcccagcgaggcccaaattcatagaaattttcgaaagattttattcctatagaatatttttttaaagccctttctatcgaagaaatgaatcctatcaaatcttatgaaattcctatgaaaagttttggagaaaatttggcatgaggtagaatctcatgggaagttttctttgaatctttatctttctttttttttcctgcggtccaatcaaataatcatttatgtgtttttacgttttttttctatttctctgtttttcctataccccgttctcttaattgacaattttaacggtgcccgtaaaactaaactgtcattatatttgtagtatactatttacaatattatatattactaaaaaaatatccatgtgttgcaacgggtaattgctattttaattttatcattgttatacggtttagctagggtaaaattcactgtgggaactcgcttggatatttttttagaaaatcatgagcttcaattaagagtatgtatttcatctcaagttagcatgcaagtttttcaaaagatctcttatacaactccttttatacttccaaaaggaaacaagcttaaaattccaactcaaatacagatatgtatttaaaaaatgaaagaacttaattaaaaaccgactctaatatggatgacgtaccaaaataccataaaaacatcttcaatttttataatagtagagatatgatgcggtgtgtagtcatttgatggacaaagaagcttctagaatatactaaaataatttatttcaattaatcaaatcaattttctatatatctcaatcaaccacaaccttccaccatccggagccattgtttctcttattcgcggaataaacgaaacggcatatttggaaactaaaattaatttgtgaataaaacttttatatacatattcttagcaatctagaagcaaaggctgaaaactaaacttcgatgaaaaaacctcaaaaccagctccaaatttatggttgaaaattcaaaatttggctgataagcataagtataagcgaaaagatgaggctagaggatttcactattttttttttattttctgaagaatatctagacatgattacattttagaaggggggaagtatatggttactattgcagggtaagataaactttgactcccatgcaatgtcaaagtcctatctcctaaaatataataacttaatactggataggatcgaaagaaagacgtctactatgaatctggatatgacacaaagaaaaaaatcttgaaaatactagtatagaaaaattggagggagtacctttttttttctctttttcacgcggcctcatttgtatggagcccaatatactagtattcgtcggcggaaaattagttgggccgggccgggccggaatctttccttcctttcttgagctgcaagaagaagaggaggaggaggccggccattagaagcggaggacacgcgcacggcggtcgccccgcaaacaaaaactcgccgcggttttacagccaacgaaggcgcagcaaagcaaacgcggcggcgcagcgctcgccgtcgccggacttcctccccccccccgctccgattccgtccaggcaagtgcttccctctccctccctcctctctctctctctctcttcggtggaagcggcgcggctcggtgtacgctcgcgtcgcgcctcctcctttcccctcctcctagtcgcgccgtggatcgcgccgccgggatgggggttttgatctctatgcggtaagaccattcggtggccgattaggatccaaccatgcctaactgtgatgattccggtggttgtttcggttacctgtgcagatgcgaagattttgttacctttaggattcagtgaaggtgcttgtaatgttaaatccgtaaatgtagtagcattatggactatctatgatgaagggattaagaattttcttgctattagttttcatgaaaataatggatttttcccccacacattatgtggtttgattgtgctatttatcttaagcaaacagcaaaattagaccttttgttgattattactacgcatgtcatagtgcaatcttattagtacttgagttcagcaatactgttccggaacatcctttttttttaaaaaaaatgcagagcatctaaaagtggagtgtaaaataaggacaaactgatcttttttttaataaaaacacatgtgccgagagaagcacatctcttactagctctacaactagtgctcagattgttctgcacatcagtagcatagcaggcattaattagtgctgaaattttactcttgggatgtttaggctttccttgatcttctgtttcatagctttgaaatgtttcttaccgcagtgtttagttcagatagatagctatattttcttattccgaaaagaaaaataaagataggtagctagctatacttttggaccgggggagtaatagatttacaagactatcagttgattcatagagagattgattatttgatatgttccctttgcccttttgcctcctcatttcattgtgcagatactgagtgaaaacctgctgctaagatgggtagcacagaacacccaattcctgcgcagtcacctgcttgcccaactgtgagcgaaggggggtcggctgctccagctcctgctactgattcaaagccaaagaagaagatatgctgtgcgtgccctgatacgaagaggctgagagacgagtgcatcgtcgagcatggggaatctgcgtgcaccaagtggatcgaagctcacaagcggtgcctccgagctgagggttttaatgtctgaattttctctagtcatctaaaggtattacatttacttttatagaagaagtgatagaatatccggtttgagacttgagatgcaaattggatccaagagattagctgccctgtttttgcatgttatcgaagtgatagaatatccggtttgtgaattgagatgcaaattgaatccagagattagctgccctgtttttgcatgttatccctgtatgtcagggaacttattttcatgataaataaaggtacttccgttactggtgacactatacatggctatattcagcaaattacttcatggctcccttttgcgttgaattgcgtacatgatatattctttttcgatgagataattgctcagggttccttcagagcacaggaattttataggattttcacaggaaatagttcagttcctctaaaattccagcgaaattcctccaatccaaatggaaccttagtggtaaacagagcggaaggcttcaagtttattagctccttgttgcgatgcccatggtttccatggcacaaccatccttattctcttattatccttttcccaacaccaatcaatcacactcctcacctatcaactacactgcacctctaccaagcatcttttacagatttctagactttgtagctagacatcagttgttggcaggaaaccatcaggattttggcaatggctcccctgccaagaacgactgaaacatcctgaatgctctccttggctgaaacagtggcacctcatgcccagcacctctcactgacgcaaatgtgagcccttcatacacctcagaccatcctccaacctgcacacacagatgcaccatttgcagatgaagttacagactttaaagtgacaagatttctgcttaaactgcatctgacaaacagcaatggagattgttcactacctgtccagctgagtaccaagggtaccagcggatcttcgtcttcagtccaagatggctaagcgcaaacctcgttgcagtaaccggaacgactgaatccgtgtcgccactgcattttcatcaagtgacaaatagctcatgatctctgaagaactagttccatgctgaaccaaaaggataaattcaccaattccaggtcctccagctcacctgaacacccatatcctcagcccggccttcatcagcaacttgtaagtcggcagcatggagaactctgaatctcgccacgtcttgatgagcacatcactgtcaaatccaacccaaatgcattgttaaactctcccaattccaacctcagtgatgccaagaaatatcaagaaaaaaaaatgtcagctgatgcatcaacctgcaggctgtccatctgtaaggaatcccagtgatgttggcatgcatggccttctgaacatccggccggttgtagtacttctcggcgtatgtctccgtgcaggggtcgtagccgaacgaccggcgccgtaggaaggtgtccttgaacctcagcacggcggccttgccgcggcggcggccggtggcgttggcggcggcggcggcggcgcaggacggcgtgtagatgctgtactggtcgatgtcgccgaactcgtggttcatggcgtagctcatggcgcggttgcagagcctggagacgttggcgctggtgaagttgcacgacgacatgatggccttgtaggtggtgtccgagatcatggcgtgcgtccaccagtaggtcaccgtgccgatgttgtcgtagtagttgtcagtcaccccattgcccacctggtaaaatcaggatcaccatcactcacacggttaatttcagtctgaaactcgtgttctgatatactagaacatatggattggttttgtttgagttcacttggttattttcagcctgaaactctgtgtgagagatcatagaacatatgggttaagttttgagttcagggtctgcttgtgtttgatggtacttacaaggatcatcgcatggttgtttttagtctgaaactcttgccagaggtgcaatctatggttacagttttcagttgagaatttgttcgtgcttgatttaaaggactgtctactttagtttaataatactcacaaggatccccttgaggttgatgaaaggatatggtgaggccttgttgaactcaacgatcttccttgccaactggggaacgtaatgtcctagaatttgtgcaaattttgttgatggacagtagtcagatgatgcagagataatagtttcagagatggtgatgcaaacatcgccagtttacacattaccagcatagctttctccagcaatgtagaaatcccggtgccgatactgtgggaagcgggacatccaactgatcaagaactgcaacgcatcttgagctgcatcacatcacatcacattcagaagaacatcaagggaacattcagcagtttgccattttatgatgcagtgttaagacagatttggtcagtaaatttcagattacatacctgtcctctcatcaccagatgtcttgagatcagaggtggtgttggagtatgaaaagccaactccggcaggtgattccaggaacaggaggtttgcctctgcagtaacaaagtgttcatcagtcagtgacaggcattgcatcattaggcatgatgagtttctgagcttagtcttagtacctctgttccatgagtacttgttcagatagagccctgtcccgtttgtcttaatcctaaatgggccaatctcttcagatgctccatacgcaatcgatgagcatccaggacctgggaaattatcagcaaatattactggagttaaataaggatgtttctacagctacagtaactttaaaagataattagcaatccaatccaaagtgattagaacatcagactatcagagagatactagtagtaaaacagtaagcactactgctatcttcatgttacagttgctatttacatgacatgcagctccaatgagcatggatatacttgagaagctccaaatctcccaaaacaagcaagtcctaaggaaaaagaggagatagatctgataatccaatcaagaggtccatccttctcgcagaggcgtgctctgcaactccagaaccccattcccaatgaataactagtcaaagagaacaagccatggtgccagaggaacccactgcccttgcatctctctctctctctctctctctctctctctctctctcatctgaacttttattttatcttctctactccaaatcctttgtttatgtacaagaatgaagtccaaaggcaagaaaaggcatctgcaattctgcacgcaagcacaacttcacaagcaattcaagcagctgtggttgtttcgatctcgcaatgacaaatcgacaatgcagaggtcgtcggccattcagccacgctgcagcaaatgtgagttgttgtggggtaaaaggttactgtttggtttgtaccttgtggctttatccagagggaaggaagcagtggtctctgcatgtgtgtgatgatgaccagagagatgaggagcaaatggaataataataattgatcataataaggccgagtgagttgcaaacagggagaaaataacaaaatcaaagatgactagtagtagcctttgtagtttttcttagcttcagctttttatttggctttttctcccttctcttggcataagccgatctagctgattgcattgtgtaactataactcttttcttctaatatactgacgtgcaatctttttgcgcgtttggaaaaaaaactagtatagtagccttaaattggtgctgcagcttttgtgccactcattcactagcaaacatggtgtggtagtatggatccgcagagtgcagagtactactacagtgcagacagaggcttcatcatttcttggcccctcttggcttggcttggctacacattttacagtgcttggctacagattttattacagtgtttggcttggctacagatttactactaatacttcacatgagatgatgtgggatgtggctaagattgcgccgatctccaaggacgacgggatcattcatcagagcgcgccattccagctgcagctgcagcagatgctcgcggccggccggccggccttcagaagaattctgaatcagcagcagatgagctctgcatcatcgcggcgcggggcgaggtgtgagagctgtcgccttgccgctgtacgctgctcgattcacaggctcacagtctcaggtgtgtgtgtgtgcagcggcagctagcgctgattgcagatgttcagagactgttctttcctcctaggaatgagagatggagagagataacaggagtactcctatgctgtaaagcttggaatcgatttttgaattagagtggattaatgcaggctaagcaaggctggattagtggttagcaatgaagtgattagaagggcctaagctgaacagttttctagtatctccttagactccttacactgaataatcatgccatggcaacatggctggctgtaaagattaaagaatgaccagaactacacagctcagtgtaaaagggaaaaaaaaacagtacaccgtgcaggacaagagaagagatttggtggccaaggaataaatgtcaaaagtccaaaagccaggattacaattcgtcagcttgaacaaggaacaaacacacatgacaacatatgcctctctcacacagttgtagtcaactagtggctggctgatgataatatcccacagatcaagctcataaccacacttaccaggaataaactgcaaatgatccggcataagactcgacagttttgggcaagtatacaggttcagagtttcagtcagtgtgtttacttatgcttaattgcccctatgtaggagtactagcgagggcttgtttatccttacctatggagaaaagaaccatgcatgagtttcgaagcattgttcttgtctggctctctctctctcacacacactcaagtctcacacataaatacatgtaattctatttatgctgtgtttaaattcagggtaaaattttttgccgtatcacatcgcatatacgaacacacatttaaaatattaaacgtagtctaataacaaaataaattatagaatcggtcagtaaaccacgagacgattttattaagcctaattaatctgttattagtaaatatttactgtagcatcacattgtctaatcatggagcaattaggcttaaaagattcgtctcacaaattagtcgcgatttatacaattaattatttttttgcctatatttaatacttcgtgtgcaggtgttcgaacgctaaatgtgatagggtgaaaaattttgatatgggatctaaacagtaccttacacaatgtgacaaggaaaaacgcaaagggtttagaggttgcatgtcgtgttgcccggaccagtgcacggctgctgctgccgcctgcacggcgccggctgcccgcggtctcccctgcatttactctctacttcctcgtgatgctaatgtttgttcagccaggcattggtcatgtcttttgcacacacacatttactctcctgtattctctgcatttactatcactgtgccatcgctgtgctctgccttcaaaacagctagctatagtaacactaccaattgctcgatcaaaacactcgtgtgtccattagaggatcgaacacacacacacacacacacgcacaatgtcctttacaaagacaacaagatcatctatcagagctactagctaagctagcaggaagaaagaacacaaatgtatgtacagtaacttgcattttggtttggagcgaagctttgagaggaactcagaaaaagagaatgtggctttccgttagagaggcgtgtgatgacaagaagtttgaacctaggagtgcgtgtcaaaagctctggaaagttgcttgtagctctcgatccttttaaactccagaaaagctagtgcttagatagctaaatgctcatgaaaagactccaggaatggatgtgttgtgttctcggtttggtcaaacacgagtacacgaccaccgatccatctacttctgtacctttggacttaattgagcacagtagttaggaccaatcaagaaccccattattgccagcgtgtgcaaaattaacgaacacgaatgcaaaatgtactatactaaatacaactactcgtacatggatcgaatcaatttaaggacgttgtgaaatttattcatgcagaaagaggtcgaagagaattcagaaatgtgcagtgtagaacagtatacttaacttaccgccgttgagccagaggacgaggggcttggtggcggcggcggcggcggcggcggcctcggtgagccagtagaagagcgcccgcccgctcgcctcgctcaccgccacgtacccggcgtactgcgcgaacgccaccggtggctgccccggcagcgcctccacccggtcccgctccgcctcgcacccgccgccgttcacgccgacggcgaccgccagccacgccaccacaacgctcgccaccgccgctacaatccgccctcgcgtcgccattcgcgacgacgaaagctaagctaagctccgatcggaatgtcgcaatgcagcagcacaaacacaacgcagcgacgaggtagctagctagctagctatgcggcgttggatcgggcgagagcgagatgagctcgctctggggaagcatttaagctggcatgcagctcgggctgagccgaggagggagaagagagcaaactaccaccaccattgcctggggcgatggatgctgcagtgagctgcctacggcgccattaatacagcagctgctactgctactgcagggcttggaggtctggatgggggaggagaggaggaagaggaggagggcatgcagtggctgcgggctcggggtggagagatggccaaggccataaatgcaaagtagctcaagctctacggcatgcggcagtgcccagtgcagcagccactgcactgtgctaacctctcctctcctcatcggattgagatcctcttcatcacttattaaattcactctcttcctcacgccaccgtatgatgtggattttttttattttttagaccttttgttttttaaattttaaaaataaatcttttaaaaaacggaaccttttggccacgccaaccacggtggcttggtagagcgcgtgtcgtgacagagttatttggcaacgccagctacatctggcgtgacagaattatttggtcaaacaggctagcgtggctaaaagattcagatttaaaaatattttttcaaaaggtctactttaaaatttttaaaaaaacgtgtaaaacaccaagtacttcacaaaagttatggtaacggttattaattaatatactctgtattataatataacaatatagtgtcaatttaacaccatcaaatattatgaatctgaaattagataggttgtgttaaatcgatagtattttgggtggatataacacatggatgtttcttgggctttttaccaaaagctgggtcattattaatataatgatctttgctctaaaagggaaaaatggattgcagcataagttataaatttttcaaagaaaataaataagaagttatgcaacttatttgtaaaatggttttttaagggaaaacagtatgagaccgtgcattttcattaaatatagcgggataaaaatgtagcctttagggggcaagaaaagggaaaagaactctataaactatatattgtgaggcaaaaggtcacgtaagctctaaaatgttctttttgactcatggggtaagttgatactacatgtatcaagattaacaagatgcagtagcatttctttctagccatgccttagtggttctgaaaacggctgccccacatacaccacctttgcttgttgtttcgtcaagtggccaaaaaagaccattttgcctaaatgggttacagccaaaagaatcatttcgccccacaggttataggagtgtctagctagtactgttaaaaaatatttttgggaatatcaaaggctataaaaaagtttaggtattcaccagatatgtgcaagataacaaacaaaaactactgtagctaagtaggtgattggcatggggacagcagacgcacgtaaatctagtcaaaacaagatcgcaagcaacgacgttgacaaaggcaaatttttctaagctagaaaatgctgcaggatgagatgagctagatcgatcgccttggtaatgagcaagaaatggagtcaagattcagctagctaagccataagatacctgtaacaactggctatacatacatggatcggagcattcttttttctctcatcatgcaattaaatcatgtcgtcatctagcagtggacaagaattttctacacctagatatcatggcacccatcatttacatgtgactcaaagtctatacacaagcatgtaagtttatttttatctacaactagaaaaacaataatagtaaaatcaaatagtggatagtatcgtacatcgcagataaaatttgttttttttaattttttttcttcatgtgtatatcaaatttaaagttgcatgtttgtaaatgtttgtatagtgtcttatatatattatcacagtctatcttattaaattttataaaaattttatgtaactatttaaattacatgcatacacctctataatagtgtagaaaatacttccccatctagcggtgtgatgatctgatgaaacccatatacgtggaggtcgcaatgagcaagaaccaattgatcgcatgcatgccatcccgtctcagctatcgtcgcgctcaaacaacctagctagcttttgttcgtcgtccttgcagctggacactgcctggacatcaacaagcagctatatatagcttaggttcacatgcaagatagcgtaaccggatggcaatgagtcaatgacaaccagactgatcaactcgaatcttcctattctgttgccgcaaattaaatccttaatttgtctccattcattcccaggtaaaaacagtgtcattagcctagttaccttggtcctaattaaatactgccccctccattctaaaatataagggatttataatagtactaaaatatactacatctatccaaactactttatattttgatacggagggagtatctcgctttttcacggagtccgatcagttttggttggctttacgaaccttgaacatatgtattaaggtggtgtttgaatctcctgaagataaagattaagtatttcacacaaaattagatgataataacgtgtgattaattgagttttaattattgtaaacttgaaaaatgaattaatctaatattttagaacagctttcatatagaaagttttcacacgaaacacaccgtttagcagtttaaaaaacgtgacatgaatattcaaaacttaatccacttttttaagtggaaacaaacggagcctaaatgaagaaacattatgattggataaaaagttatataagtagagaaattaaatgagataagattatgattagtctgagaaaaaaatattactaatagtggataagttattatatattttaggataaatcttaagtactacttatattttggacggagggaatagtgggtaatttcttttttttttctaactctacatatctagatttctataaagaaataaaattgtatcactgcattattctgaattctgaatgagaccttacctagtcagagacagactctgcacacaaattcttcacttgacaagctacagggagcatgcatgcagatggatgggcaaattaataatcgcgccacgatggctgaaaacaactgatatattttgcgtcacagctcaaatcgatctgatgacgtttttgacaatttgacccggttaaattaaagaaatctctgcaggctggctgccgcgatgagggcccaaactgtacccataattttacctgtactcgtgatcaactccctcgtatactctgtctccttgagagaagcagcagataagaatgatgctgcttctgccgcccgtcttgtctcttacagcagagtactaatgtggtgatgattcctcctgagaaaagcttgataattggatctatgcatgcatttgcactgtcattaacggactaacagtttcttgcatggaactactcactcacctactgctctgattagagctgagctttgtcagatggtgtactggtaggagtattgtgtttgattgattaagggcgcctagaaagagagggtctccccttccaagaaccaagacgccacactgcacacttttatttacattgaactgtactacacggctgtagttaactgaccaccacccctaggtagatcctgcttgctcagtcactcacactgtgccaagaattgcctatgtttgttctgttccctgatgaacaatgccattgcactgtagtatgtatgtgtgcctactgcctcactgtttttctgtagaattcagagagagaaagaacagcaaaacagtgacattaatttttctccatggccttgttgtcttgaccatttggctgattcgttcttggatacctgcgttcttggacgcattgtgcaatttgcttagtgccaagctaagctaccaaagagtagtacattagtacaaagctcaagttggattagcacttccagtaggctcatacacaaattaagacaagcaagccagcatctcaggtatagtagaaccctagctagtacataaaatgagaagctttgtgctaaggcgatattaggtgtcgaatgcttcgaagtagctagcactccaatgcgagctgttgcatggaattgatggcgatcgagtactactactgactagtgaagtgaaggcgacctgtgatgagttgaggaaaggagtagggacctgcaggtaggttatctctgaactttttggatagctgaagctttgaggctttttgcttgtacagggccaaggtcagtgatgaagaggcttccatttctagtagtaggagtagtgtaggagtatagtactagaattgcagatttgatccgtcgatatggcaatgtttggcacgggaattcaatgccaattcattgctctgttttcttctgaaaaaaatcaatgcaagaatttcagtagtagttcacttctcaccgacatatgcatgcatggaccatcaaattcaatatctgtgcatgcattgtgtgcacagagagaaccatctgcttgttgatcttatcactaacaaggggccccgggagatttgtgctggttgatggggcccatgtagcagtgaaaacactgaaacagtgtacaattctgtagagtaaacagcactagccactagagactgttctactttgatctgaagctg

SEQ ID NO: 58843 - DNA, 5916 bp, Oryza sativa
tgtctatatcgaagtgtgatgtgtcagaatagtttgtttaaagaaatcatttgtcagaatgttgtggcatcctactggatggttctttagatgagaccaattttaatacgaaaaggaaagggaaatcattttggtaacagtaaataaatgctggacatgatttttatgaacttcccctatccctagatagggggaacactaaaatgaagatggaatgaatggttttaccatattggtagtaagaggtgcacttaatctgattctttggtatttcagaacggaggtcagcctaataaccatgaagcactgagcaatgagtggctggaaatgggtcaatgccccctggcaaagtcgtacagggcattaagtggtgtcgtgcccctcgtcgcaaagatgatgacacccccggctggtatgaaactgagatgcccacctgcagtagttgccgcccgtgcagcactatcacgcacagcctttgccaaggggcttcgtcctcagcccctaccgacgaaaatactggtgatggcgttgcttggtatggcagcaaacgttccccttggcatctggagggagcacacggagaaattctcagtgcagtggtttgccgcagtccatgcggcggcacctttcataggcatgctcaggaagtctgtgctgatgccaaagacagccatggcgcttaccatagctgcctcaatattgggtcagacaataggtacgagagctgagcgtatcagattgaagagggcagcaaaggttgctgctggtagccagggtgatgctagcaccagaatgagcctgaaaaccgggagatacactgatgatgtccagttctgggatccgcttgccctcagagttgagagtaccataggaacaggaactccggttcttgttccaactttccattgatgatgttgccttgggtttgtttcttcggtcgattattgttgtattcattgtgttgtgccttagtctttatactaaatattacgttggatgcttctcccatgaatctggggtccaaatttcagtgtacaataaattgcacgtgtacatttccgaaaacaagtgttactagtgcgctaagaaatacgcttagagctgagaactaagatgatgtccttgaattcgaccgatttgcatctgcaactggctgatcttgcagtcgttgtacaacttttcttacaagagctattcggatggcgtgaaaactgaaggaactttgtgcgtgcgtgtgtgtatagagtactagagtttatttggtcaattaagcaccggggcgtagctacagcctacatgagctgccacgcactttggtcaaattgcccagtacacaaaccacctcatcaatccatccacattcgcacaccaaacgcatgcaatttcaacgacaaacacaaccaataagtctaactgcgtgctcaacaatcgtaatatggcactagttggttaacatgtgacaggaaaaatcaactagtgctaggactaggagcatcgtctttgattgcaagcagcccccttgccgtgcgaaatgcaaacgacaggcaggcaggctcattacctagtatatctcatcatctgggacatcaggtgtaaggaacttctgtggatccttgtacagttcctcgtagttgtatttcggcttcaccctctccgggacaggctcaagtgggatgatactgtctccgtcgattacactgtcgatgagcccgtaatcaacagcctcaagaggacccatatatctgtctctatcaatgtctttctcaacctgctccggagtgcgtcctgtgaaacctgatataagccggatgacattcctcttgttagtcaatatctccttggcctggacctcgacatccaaggcctgcccacttgcgcctccaacgggctgatggatcattatcctggtgttgggcatggcgaatcgcttgccctttgtgccaccaccaaggattatagaagcagtggaaccagctatgcccaatccaatagtggaaacatctgccctcacgagctgcattacatcatagatggccattgttgcgctgagagagaagcaggaatcagtcagaaaacacaaagatatttgcatcaacagatttaccagactgccaagaacccaagagctatttaacgtaatgacctgcctacagctacttgctcttggttgatgaactagtatctcctacttgtattgcaatacataatcaatcttgtaccagtgctattaaggtacattgcaaacaaaacaaagagaaggcattcctacactaacttaataaacaaaaaaaaaggcaatatcctgcaagggaaacataaaattaagcatcactctgaacaggacgtgcatcatttataaaatgccaaaaacatcattaccaactccgaactgcggcaagatctttttacagaaaggaaggaagcaaggtttacattcacataatattgcctcatcagcccatctctttctttcttgtggtgtgtgggatagcctctatcggatcaaatagtgttgttgatttagaatctactccctccgtcccaaaatataagagattttgtgtgcatgtgacacatcctaagactatgaatctggacagtcacgtccaccaaaaatcccttatattttaggacgaggggagcaaatacactatcaattcaaaacaaatggttggttgatccataagattcatagcaggagctctgatattcattataactggaacctggaaggactgtttatttacaaagggaaaaaagaaaaggatatagtctgattgatgttattcatcatatagtaagtagctcaagacttgtcttttacccacaatttgcgttatcagaaaataactaccctataagtagcatacttgtatgattcctaatgcgcttaattaatttcgtgctccaaggttaaagcaattcaaagcaaaaggagaaataaatttaggatgcgcgacctgagtgatcccccaggggagttgacgaagaggcggatgtcagagttggggtcgacggcgtcgaggaggaggagctggctgacgactgcgtcggcgaggaagtcctctatctcgttgccgaggaagacgatgcgctcccggaggaggaggcccatgacgtcacccccggctccggctccgggcgagtcggacgactcagctcggacgccggcctcccacagaggagtagagggggcggaagccgcgcgaggggggttgagactggtgagcctgagggggcgcggtggcgcgacaacgcgcaggcgtcgctgctgcgtggggcggagagcggccgccgccaccgccaccgccgccgccgcggagagggaggcagtggcactcgcactcgcagccgacatcgctcgcaattatctctatcctgccctcggctaacctacttcttggttgggttgcccttgtctcttgccctttctctttgtctcttgacgggggtttggggtggattttcttataaattactatatattacattcgtcctataatataaaaaaagttttatagttgaatacgtttattaaaaaaaactagtaatatatccatgctaaacactacaatataattatatttgttttaataattcttaaaattttatgttagtaaaaatatttttatatggtttgtgcacgtgaacttaaaatcaatttatgccgtacatcaaatcaaatatatttcacgtaaatttgaatttgtttccttgcacaatattcacgctgttttttattcctcaactgtcgatcttcaccattaattttacctgtgaatatttttgcaaaataaaacggagaacgattcatatctcacttttatactccctcgggattaaccaaaaaaatccccttccgagacgttcccatgtccgaagggcctgagacacgatgcatcgaattaccccctggttaattggtaaacgaatgtactagtggaaagaaggaaaaaaaggcagcagcagagttagaggtcgaggtgaatggtcttccctccgtttgcctgccaccttcggagtttttttttcttttgagaaaaggagacaaaaacaccatcgagtactcaagctggtaatcagttatacttactgctagttcagtaagaaacacagttagtatcacgctcatacagttctgtccacatcccagcttgccatacgagaacaaaggatatataacaaaacgtagagggtgccatcaaattgcattctcgcgtcctacattagtctagtcagcttcttcctcttcctccatgtcatttgcacttattagatgcccaagtgaaactttggcttttttcagttccggtgacctcagtgcagcagcaatgccatcgcttttcctcttctcgccaaaccccgcttcatcttcgtcttttgtagcctcacccgaggacttgtcatcgtcaggcttctcagcaatcgttgacacagaatcatccttcttctccgatggaagctcacctcccttcttcaatgactgctcacattctttcaggaaatcacgaacatcatccttctctgcaacatgtagagccgtctgacccccttttgtctttgcggcgatgtctgcacctttcttgactaaatacttcacaagctccaggtgggagttctgcgaagcaaagtgcaacgcagtgaagcctttcctgttctttgctttcacagaggcaccagatgccagcagctcacggacaacctctacatggcctttctgagaggcaaaatggatcgcagcggtgtcatccatagctgcagctccaacatcagctttgtgcttgcaaaggcacttcacaagctcaacatgccagcccatgctgccaaatggagtctaaatgaacaaagaaacaccacatcaaggagataaccaaaaccgagaaaattgatagagcttgagcaagcttatcatatctcataatatgatacactcataaggcagaagcacaagtgataatactgatgcagcagtaatggattctgctcaagaaaatcaacataaacacaagtgatgcagtcagttgtttctagttgttgaaaaagcaagtgacagatgaaacaaaatggcctagtaaccccccctgtagagatagtggaatagatgcctcacacccaatgtggggaggtgatctctcatatatagctgagttacaatcaatgctagtgagatacacaagaccaaaggtctaggagataaacagcctatagactaataaataattctaatacccccaaatcagaagaaaacttgaggaacaaccatgtagtagtagcctagtaggaggaaagtatgaaaagtatgaatggagagatagacagcacaacagctgtaaattaacgcaagcttaaactatcttacacacaggagaaaaaatgttggacaccagaccaggtgaaacaatgtgtggccgaggagaattgaacactgcctgatggagtggcatgacaacaaccacagtgctatgtgcaattctttacatttggagtaaattgcagattggtccagcttttattaccaaagtgtcactttgggctacctctaattcaatcttttcacttaaagccaactattgttaccaattctttgcaatttgggctagtggcccacctgtcaataggcttatgagcttttctgtttctccttcttccttcttccttctctctttcggtttcttcttctccaggtcgagcaacaacagagagggagagggatagggcgtcggtgctccggaggaaggggaatgatggcgttggcggcggagtgtgttcccgagtaacgcgcaaccgaggagggtggtggaaagcaaagggagtgagggagatggccggaacggcgcagaaatagctcagctccggccggcatggatggtggcggtggctaaaggggaggggaaataggaaaaataggttcacctc

SEQ ID NO: 58844 - DNA, 2312 bp, Oryza sativa
cacgcagctttgcatgccttcctgcgacaattgagcgaggcagagttctctccctttcctttaccaagctaggtatcggacggagctcaacgtacgagaataatattggtggtggattgagagcgagctcaagaatgatcgatggctgtgtgggagctcgatagatgatggtgcttaattcccagttgacgtacggttggatctatatatagcaccgaccaagcgtgaggaggagctacagcctacaggccagggacacagcaggctgccacacatgagctcgccggtgatggccacaaagctaaggagagggagagacagaaagagaaaaaaagatgaaatccagatcgaggggtattttgatcggctcgcgcgctaagaaaaagaaatgcaaaaattcatttaatgatcaagaagaaacggtgttgtaacgtgttgacgcccttcttataataatgaagttttaacgaaacccggcctatctgtgagatggcgtttcagcaaacctcacttttaacaatatatatatagcagaatataccaattattttctcctttcatttcgattaggattgcaggtgaattaattggtgatcgaatgcaatatctcgatcatacggatggacggttgctgtgtgcgctagctagctgtgcacagaccacagtacaggcaggcgggcagatactagacagacaggcaattttggttatggttttccgccgatcgaatcaaattaaaccaccttatataatttcctcgtttaatttcatgtgcaatagtatactagtaggccgatcgactgaatatattcaacggagtgagtacttatttcatttataaagtgaggaagaaattaaaagaaggagaggtactccagcggccagcgagcaactgtatctccggtgctgcacgcacgcacgacactgtttaattaatgcacctccctcgcaaccgaaatgcgagtgcatccttgaacgatcgcctggcctgtttaatttgctccatcactgaatggcacaccaacagcttgatatagccaggaaagttgacttactgctgtctgctggtgaggtgggatcatccatgacttatctgatcacacacgattttcttttagaaaaggaagaacatcgtgataatatttgagaaaatgaagagctagctaggaaacatccagttggagggtgaggaacctgatcaaattgtgcatgggcattactccagcatcgtcagtctaccaggcacagtgccgtctaggggcaacaaagcacgggcttcgattcactgattcggaaaacatggacgccagggaaatacaaattctgcacgtggttggtcattcaaaatatggtttagacttgggatcggctcgcaaccagagaatgacaaaatgtcactaaccttctttgctgtagagaagtcaaaatgactctccacctcttggccaattgcatatacacgaaaagaaaagaatatgaaacccggtaaccacttggatggcctatcatcagctcgatcttgagctttgggaagcaacccaaaaagggcaagactaatgagagacactagtaaacatgacaagtgtttcaaaatggggattgcgcactttaatcctcgtcgtcgtttgggtgatctgaaatgagaggaagcgatgaatcttagcacaaggagaccatgacagccaacctctttgataaaattaagaaagaagctaggacgtacttgggctctggcatgagcaaagtgatttcgggagttcttaccaaacagtgtatatgacttataaggtgcttttccccttttcacatccttaagggttgtattttctcccaatatatatttaatgaaagagcacaatcttatgctaattaattataatctaggaaaagaaagagctaggaaagaggtcacatgttttgttatcctaatgagcaaaaaaacacatccttttgttaaagctagtatgtccatgggcgatcctagatgcatgatacgtacatactcgtagagtcaaggagtagcaatgaactggtggctacagaagaggagatttacaattggttgaatggcgatggaatggtggatgtgcagatgcgtcgtccatatatgcatgatcacgtggaagtggagactggccagtgggtaatttaagtgtatacgtggccaccttaattacatggtggcttaagctccaggtggcccgactgatgctgatgggcacaaaattaagtgtataagcttttactccagttgatgataagtaattattaagagtaagaaatagttaattaaacatttaaagaagcagtta

SEQ ID NO: 58845 - DNA, 60314 bp, Oryza sativa
aagagaagagaagagaagagtgagagagagagagaggagggagggagagtgacgtggcatcctgacacgtgggctcacgctgattcagccgccacgtaggataaaaccggtgtcaaaaccaccgaaggacctattgtgaccggttttgattagttaagggacgctgaatatctggttttgcggttgggggacgagtttataactcaatgacaagttgagggaccttcggtgtactttttcctaagggaaatgtcacgactcacgagcagcaagcaaagcaggaaggccgagaataactgggctgcgtgggccatgcggtggcattttacgggcccatcctccttccccccgcgggtgggaacaaattggcacggccgcgcccaatttcatttccccccatttcaattcatttcctccgggcaccacccgctcccttcccttccaccgcacacttcccgttgcggcgccgatcgccaacctctccggcagcctcgctcgccggaatggacccctccgccgccgcccactggtgggatggatctggggggagaggtggaggacgacgccagtgcaggggccgctcctaaccctggtggaatcgccgggggaaaggagggagatctcgacgcggaagattcgggaggagggagcggagcagacgacgccgccgccgccgtttcccatggcgccaccagcaccgactcgatcgtgctcccgccggagccgacgagcggccacctggcgagcctcctgcgggcgaggaagctgatcctcgtcgtggacttggaccacacgctcgtcaactccaccgcggattacgatatctccggcacggagtacgtcaacgggttggcggagctcgtcacagatgatccggggaggggcctgttcatattggatcatgccagctggttctcggcgttcatcaccaagctcaggccgttcgtccatggcttcctgcgagaagcgagcgccatgttcgagatgcacgtgtgtacaccctcggggacagggactacgcggcggcggtcgccaagctgctcgaccccgacggcgtctacttcggcgaacggatcatatcgagggacgagtcgccgcagccagacaggaagagcctcgacgtcgtcttcgggtcggcgccggcatcggcggcggagcgcgccgcggtggtcatcctcgacgacacggcggaggtctgggaggggaacagcgacaacctgatcgagatggagagataccactacttcgcgtcgagctgccgggacttcgggtcgccgtgggagtgcacgcactccctgtcggagcggggcgtggacgagagcgagcgcgccgcggcactgcgcgtcctgcggcgagtccacgcgggcttcttcgccggcggcggcggcagcttcgtcgcggacgtcagggaggtgatcaggcggacgcggcgcgaggtgctgctcgggtgcacggtggcgttcacccgggcgatcgccagcgacgaccaccactccgtgtggaggagaaccgagcagctcggcgccacctgcgccgacgacgtcggcccggaggtcacccacgtcgtcgccacgaacccgacgacgttcaaggcggtgtgggcgcaggtgttcggcaagttgctcgtcaacccagagtggatcaacgccgcgcatttccggtggagcaagcccaaggaggaacacttccccgtccgttggtaaaccggatcgaagttgagattgtcagttacctcgccaccagcattttccagtgttgcacgtactggtatgccaatttcattgcatcgagcagtatcgtttgacagaaaaccccccttacaaatcttgcaaattttgaaccatccgattgctttaagattcatgcaggcaaccaaactctaaaaatcctctcgcctctctctctcccgattcatcacgcgccgccgctcctccgccctagcgcgccgccgcccggcctcgccggctggccgaatggtgtcaacggcgctcgcgaggcccccccgaccggccccctccctctccctctcctctcctttgcctcaagccggtggcgacgagctgtccgtcgtcttccccgtcgccggcggcggggcgccaccaccggccgcctcctccccactctttccgctttgcccccgccgccgtcctccagccccgcggcttcagcggcgccgccgccgcccgcctgatccgccgggctgccgcctcccacggccatccctctaaagccggcgaactcccccttcttccccctccccctcccccccacccccaccccaccctgggaccctaattcgtcagccctctaccggagtttgggtttgccggcgccggagaagaagaggtggtcgccggagttggagaagaaaagcacgaatcgtgaagcacatctagtgatccaaaatttgcaagatttgaggtaggattttctgtcgacagagctttagcaattccgtaaaactaaactttgtggaagtatctatatattgtcattctttgagactcttatcttagcgacatgcatgcatgcatctagaaaaagtggttgtgccttatattatggaatggagggagtatatactttggtggaacaggaaactatagctaatgatgtattttgtaaggtgcaataacctaagttttgtattggaaataacgggatttatgtctacatatatacatatggcacacaacaccatacatctcatctagtttctttaattatcagcactgagctcctttattagtgggcttgctggaggctagagcccaagcagttaggctgaggaagtgaggatggtgctcgctggctagtctgatatgtatacgggggctaaggacatgatatgtgctccctccgttttacaatataacactttttagcattgcctatgtacatatagatgttaataaatttaaacacatacatatgtctaaatttattaacatctaaatgaatgtggacaatgctacaaaatcttacattgtgaaacggaggaagtatatgcgatgcgtcggctacatcagagtttcatctcgttgagtctgggttttgatcttgcaccttatctaacgttttaaaactttgaccttttggtttctgcaaacaaattaaagacttatgggccttagcctataggtttagacaatgtaggccaagttattgaattgcctacaagtatgaaagtaccaaattacctataagtgcaaaaggctcgttctgtctacaatctaaccttgtcggtggtgtaattatgggcaattagtgtcacccatcgaactgctattggtcggtcaagtgggccatgaatgtgtcatttttttctttccagctaaactcacataatcgtatatatcatgcctctagataggggccacgtaatcatggtaactcaccgtaccatggtaccgaggaggtaccaatgataattttaggtatcacaaatattttattgttgcattatagagatagtgatatagtaagagtatgatgatatatccatggcacccactacttagaatgtattctctatacctatctatacctatctagttcatccccacttagtgtaattgctaccatttaccatttatatgtattctcatgcttccatatcacataaattgatttggacctgcgttagcgaaaaaaaaaagattcaaaccattaattagatcagagcagtgtggtcagatcgatactaaacatcatggtcatgactagacatagctaaaattagaggtagtaaccacttccactataaaacttgctcttagcaagctgtctgtaaggcttttcgggccatatcgtaagaggtttgtagagtatgaagtcaattaaaatggtttggctaaattttggtggagtaaggaatatgttcatgtccttatatattttcacactagacaatgtatgaaacatgggaatttcgctatcgtcacgtcatgatacaataacatctcttgtaaatatatgtccttttattttttggggaaacatgttggcattgcctcagatgttcaggtttggttggcaagagaagagacaagagggtgaagaagccgacatgtgggttccacgctgactcagtcaggttgaccactatcaagttgtcatgtgagccaaaaccggaaactatactgccctagaaccagtggcggagctaggtttggaggaggagggggctcagccttcttcttcctcctccagccccctctctccccccattttcttcttcctctccctcttttccctcctctcctccctcacatttccatggagtccagcagggtaggggggctcgagccccctccaccgctgcctaggatctcaggtacaccaatacacaattcaaacacgtcaaagacgaagggcttaaagtgaacttattccctcaacgcacgcacaacactgaattaagtgtggcgaaaacaacgggaaatcggcccatttcctatatcctggcccaatatcaatccatttttctagggaaaaagtgcgccgaaggtccctcaacttgtcatcgggatacaaaaacgtcctcgaaccgcaaaaccggatatacagggtcccttaactatataaaaccgatcacctgagatcctttggtggttttgaccccggtttttgtctacacggcggctgagtcggtgtgggacccacgtggaccccacatgtcagcgtgccacatcaccacccattacttcccctttcttttttctcttccttttgttacttctctttgccgtgagggagtagcacacggaacaggcagcagcgagccgggttgaccggcggtcgacgcaggtggcctacgagcgcgcggcggccggcgaagcggagaagagcggaggcgcggagtggcggtggcggcaggcgggcgagcgtggtggccggcgtcctcctcctcctccaccgccgcatcgacggtgtgtgccctgtttctctcggtggtcgtcggcgtcgccatggtagtcgtcggagtctgttagcaacccgatgcaccaagcaaatagcaacaatatctaaaccaatttgaggtgaaattgagcaagtagctgagtattacaagcttctagaaggttctatagagggagacaggaagggtgtagtggctggtaggaaggagtagtgagggagagagatcgacaaggttcctgcccaaacctggtcgccgctgccgccgtggccgaagccgccgattgccagttctgttctatttcccctcctctcctgtaagctgctgttgcccttgtattgtttcagcttgggcttgcttgggcttcttggcaacgggttgcctagcggcccatgtgtagcccagccgagaccctgacaatcccttcttcttgaaattcggcttgtccccaagtcgatgaagaaaacctcctggatcgaatgatgtttgaagttcctcttgtaaaacttgatgctcaagtacagcaaccataccaatctgtgtaggagcatcagataaccaggcgttgcatagcatgatcaaccatgcatatatcccagtcattaccaccatatgattgtcccttcttggattgaattcaagtaaaccggccatggagaatctggatagtactgcactaaatgtattccactccaccaccagtataacctcatgtatctcctctgatgcatgtactaatcttagcccactagaaagaaactgaggattgatagacaattcggtgagcacttgccatgcaactgtagctatcagttttgtatactgtagagagtatgtgtgtcgctcaataatctgatccactaaatgtgtttcagccacctgattaagcaagaaaggcaattgatttccatactttattccatagttatcggtgttctgttggctatacatgcattcttcaccttggatgacatttgcattagttggcaacaagcaatctaaagtattagccaagatgagcccttgagcaccactactgtgtaaagccagatctgggattttcttgagtgcatcactgtagatatcatccaagttttcttcaccttggaacttccatgcataaggtttcagataatcatttagctttgccggctggaacgaggccttcatcacctcccgcaccgccaccggctgcgcgcggtcgacgagcatggagaggagcagtgacaggttctgcttcagcgtgcggagcgccgggcggatgcgggcgtcagcgacaccgccgacatagagcccatcgtagaacgagtggtgcgagtcgaggaagatgaggcggtacgcggcgacctcggcgacgtgtccgaccgcggattgcgccgcggcgcgcgcgcggtcgaagtgggagcacggcgcgaggaggcgggcggtggcggcggacgacgacgacgagcacctgccgcgggagaagaaggagagcgacttgtcgagcgcgtggacgtggctgaggatgaagtggagcgtgttgagccggacgtagaggcgctacgtgccgcggctggtcgacgggcgcgggttctggccgccggacgccatgccgccctggccttggtggtgcccgtgggcgcgcgggctcgacacgggcacctggcacggcgtcgccaccttcttccacagcctgatgattatcgagtcctggttgcacctcgtcagcggcggcagcgacgggcacgcaccgtgtccttccattatcccagctacccgcgttctcacaatggaggcaccgtggagttcatgtctctcggccggagcaagaacgccatcgtcggcatcgaagaatggctacactacttattcatccaatcacagaatctccaatatgatatagtactactatttactagtataggaatgaatattcagggttagtcgtacactcataccataaactactacttgcatgctccatggctatcacaattgtatgacaaaatgaagatccactttcttgtctctcatgctcgtcctcaactgaaacaagacctccaaaaagcttcaggatcaaccaaaccattacatacacaacatacagactataaaccttcacaatcatcgatcacaggctataaacaatgacgaatcaagcaataaaaaggagatttttttaaaaaaatatcatattttcacggtgtctggtgtcgctagcggcgaagaacggcggcctgtacgtcatggagatgtatccccggggagacggccatgtcaccttcgaggtgctcgcctacggccgccacagccagccgccgcccgcctacgtcggcagcagcggctgggccagatgcagcatccaactcgaggactggcactggcgcgccctcccgcagcctccctacgtgcagtacccgggctacgaacgcgacgaggcgccgccgtgaaacacccttattacaatatcacggcgaccgcggtggtcggcgactcacgtctctggatatcgacggagggcgtccgcacgtccgcctttgacacggtgcgagatacctagagcaagcagggcgagtgggcgctgctgttcaggggcaacgccgagcacgtcgcggagcacgacctctggttcggcctctcgcgccacggcgacaagctgtgcgccctgcggcagcacccaccaccctttgaccgcttgacgcggagctccccgccggcctcctcccctccccacccgccggtggtctgcagagagagagagagagagagagaggaggaagggagagaagatgggaaataaagggtggtgacatggcacactgacatgtggggtcccacgctgattcagccgtcacgtagaccaaaatcgggatcaaaaccaccgaatgatctcgggtgaccggttttatataattaagagataccgtatatctgtttttacggttcgaggacgtttttatatccgatgacaagttgagggaccttcagtgtactttttcctttttctagtgcacatgaaaaggacaatttcaaaattgagattttgcgagcaggggcgatctgtggccgtccattcgttgtggacgttaaatcgaccccgtcgatttgtgatagaggttacgccgcatctgcgcgacccgctaccacccacacatcttcccgtctcaaaacaaaaagaaacaaaagaaaaaaaaaatccccatttctctaaaaatctagaggcttcttctcttctcctctctctcgttccccttcgtttcgattcgtctcgcccaaatcttcaaatccaaatccgcagcggaggcggccggggcgcggcggccagatcctggaagagaatccattccgggaggggaatccgcgcatgccaatgtcggatcccacggcggcggtcatccccaagccggggggcatcggcgtcggcggcggaggcggcgacgacgaggagccggtggagatccgggaggtgtgggcggacaacctcgaggaggagttcgcgctgatccgcgacgtcgtcgacgagttccccttcgtcgccatggacacggagttccctggcatcgtgtgccgccccgtcggcgccttccgctccccggccgactacaactacgccacgctcaaggccaacgtcgacatgctccacctcatccagctcggcctcaccttctccagcccgcgcggcgagctccccgcgctcggcccaggccgccgccgatgcgtatggcagtttaatttccgcgagttcgacgacgcccgcgacatcttcgcctctgactccattgagctcctgcgccgtagcggcatcgacttccgccgcaactccgagcgcggcgttgacgctcgccggttcgcggagctgctcatgtcctctggcgtcgtgcttaacgattctgtatattgggtcaccttccacgcgggctacgacttcgggtacctgcttaagatcctcacatgcagcagcctaccggacacgcaagccggcttctttaagctcatgaagatatatttccccaccgtgtatgacatcaagcacctcatgaagttctgcaatagcctgcacggtgggctgaacaagctcgccgagctccttgacgtggagcgcgtcggagagtcccaccaggccggttcagatagcttggtcacttcatgcgcgttctggaagctcaaggattcgttcttcgctggctctaccgagaaatatgctggagtgctgtatgggctcaatgcggagaatgttgtcagtgcgcattgatggatggtactcctctttgaattttagctttgtgaatggattgatttaggacagaaaatgtgacaaatgatcaagatgatgttatgtaggtcaagtttgtctcactccatttgggtttaatgtgatcctagtgttcttcagttattcgcgatgaaatagtgaactgtatttatgttaagttgttctgtccgctttcattttctcctacctggtttagttagataggaaagaaaaatcacctttaaggattaggagatggtaaaatgaatatattttgttgctgttttgtcattgatatgtatagcatggaagctggttgtttccaaagagtggggtgcgggtacatcaaagtgctcaaacatgtaacttgataacattacaatacaatacacagagcgcgacctctcttcacatgggtattttagatgctgttattttaatttcccagaataattagttactctaatatgtatccttctagagaataacacaatgcaatattgagaataagggcatctctctatttcgactttgtgctgcagtttttggtaatctgaggtaatgctatctggtctacattggaagcctggaaacatttacggttttcagccaaagttttctactatttgttcatcaattcaattatccagtaagcctactgcctagcgaatagttctgggcttctggccaatgttcactaggcaaaacctctgtactccatggagtaaaactacagtgaaatcctgcaaatatgcaaattctgcagatttgctaacaaaatattagatacgcatctagctatatgtgtctcttgatccagcaattaagtcacaatgatgcacagagcatgaatactagcagtttactttttccataataggttgtgggttacagtaacaaatatgcatgtcttgagacagtgatgctgatactatttcccttgccttcctgcaacacttggattgaatttctacttatccaacttatattctagatacaacattgatccatttacattctttgtgaaaaacttatcataactagatgagctttgaccacaagttacatcattccctgcaatttaatagcatcagattatttcattgctggatgtaccggaccactcttttttgctttgcaactagaatattagttcctttggcactaacatgtcctcaaatgttgcatgtggagatgaaatctagggcatttaattaagttactaacgagtttatttacaggttctgttggaacccaatttagagaagaatctagttagctacatcttctcgttttattaagactcaacttggacactaccttaatcccggttgattgccattgtccagtttatttaaattcatgtatataatcggtccttcttaagttcggacattgttggagagctattctgaataaaggtaatggtggctaacaagaaacaaggtaaggattgttagaaactggagaagtttgggtgccaaaaagcttcaaaagtattgaaattgtctaatgtttcatattttgcaggtaaacctgataatactttcctagtgtatcattttttaacgggatgcatttctggtgttaaaatgtggtactcgtcatgccaacttgtgcatgggttcaatttgaagactgagaagccttgtgcacgcatgaactttcttcatcacagattgatggcagcagcagcctatctcaattccccaaatctccagggatgagatcaaaccatctgcattgcacaagcttcctcccatggataatgcaaatgtgtaatgcttatgcaattgtaatgtgtagtgttaaacagttgtggtcatttttgtgagatctgaatactgattccataaatcggggctggccagaaacaagtgcttattgcatccagagaacatgttttcagtttgcctcacaatttcactaaaaatatcagtacagatttgttaacctccaaaaagggaacacagaaggcgagctaatatgcaagtttacatcatgcaaagaaatggcctgaagtttacattagaaagaattaacatttttcctgtcaagtctctattgacaatgaaaatcttaagcaggcaggagtcgttctatcatccctggcttaccgtcaagatctttttctcaaaacaccgtaattggatcaaaagttcaaaacagttgccatcttaagtaatgcagcgcagtgcactgttcaccctctaatctgcaggttcttagtgtaattctgcgttttttggctgcaaccacaaagacagtcgggtgagttatatttgccgtgtgtgctcataagcagcaactgttcatagcctacccatttacttttcacgtgatgtctatcttgctggcacgtatgatcaattggtccatttcttcgtccatatctatttgatctcctgctatcatctgaggaatattttgtggcacaatgtcagcattaatatatgccccaagcaatgacttgtacaggggcaagcttgtcaagttgaacttttgaagaacctttatgaatctatctgcatcctccacactgccttgctcctcgaaatactttgcaatggcctccaacagctcaagtggaggtctccagtggcaagtcttcaacagagataagcccttcttcatggcattgacagctttatccatctgcttactctgaacaaatccctccatcagtatctcccaagtcttgtaattcggatgcgcacctttctctagcatgtggagatgaagcctctcagccttttcgatccatccattcctcacataagcaccaaggagaacatttgaaacccgcacatcgtgcttcttgctttctgcttcccagcttccaaaggtccactcggcccgaccaatgtcgccaacttttatcaagcataccatagcagacatgtagtttgcagcagggattctacctggaacaattttactagcctcccacagcctaataaccccatctctgtcattcagggctgcataacatgtcataatgaaagagtaccctaaacgccctgttgatgacaactttgtttcagccgttctaaggcaagcaagagctttactgctctgtccatacttcttgaagatgttagctaatgtacagtatgtgctccaaccaacctcaaccatgtcatcattcagcatctccttgaatgctgattgtactgaggctaagccagagacctcagcacatgcattcatccaaatgttgtaggacagaacatttcttggaatgttgttccgtttcatcagataaattacactaaggaccttctcatactggcacgttgcaacatatagtttcataatttcattgaaagaatgaggatcgacaggcagtccatatctctgcagctcagccatgaaggtttcagctttctgcacatttctttctgtaacatagcaatggagaagcgggaatgacgcggccttcttggaagcagcagtacttagttttctgtagtactcctcagcttgagaagtaccatgaacttttgcaatcaaatccagtctaaccatatgatctgagggcgatagtctaaaatcattgtgcgagtccatccatgataaaatctgcagcataataaaattccgtttaggtagtgccccttgcatcgccactgcgcgatatagattggaacagcaataaacattcagctgagctgtgcaagtgtgtcaataaatcatataacaaagagtgaaacaatgttcactttgcagcataacattataaggaattattaagaagtttgaatcaaattgttgcaaaggtgaaaaagactcctatgtcctatctgtatcagatttttctcggttcaaattcgttcatcaggtagagctgtttggagtgtgctcacctccagggcttgctcgtagcggcgcgcgcggcgaagccggacgacgtcacggcggagctccggcggcgagacgcggccgcgctcccgagcccatctctcgacggcggcggccgcggcggcgcgcccgctcttcctcgggatccggaggaggcaccgcgacagtaggtcgccgccgtcgccgtcctcgcgagcagtcgccggaggagcggaggaggaggaggaggagcagcagaagggtctagggtttgggcgggaggcgccgacgaggagggcgagaaggcgcgagcggcgcacgacggcggccatgggcccaaacaatccatgggcttgcttgctttaagaaagtttaccttcttctcaatccctttttttaaaaaaaaaattagtaaatttcagaaaactgcaactatagtcataaaactgtagtgtgctgcaacattagtgatctatttcagtttgctgtaataataacgtggaaaattatcacaaaattacaacttttacgtgatatgcgtagaagttacagtttcgtgataatttatcacgctattgttctagcaaactggtagttttgtgactataattgcagttttttaaaatttactcaaaaagaaatgaagtgatagcataaatttgtatctcaattatagtggatgaaaatttagacatgtttttaaaaggctaactcatacgtgagacctaaccggattctacaacttcagtttcgctcccaattattttagataatagattaaaccggcctctgcatccaaacatatatgcacagccaagaagctccccaaatatatgtcctaaaatgtaaatccagccgcgccacggctgtctgtgccaaaccaggacgaggaagaagaaactgacagtaagctcaggtttatacaagccatcaatgtctctctttctaggtcgagttggcaacccatctcgtcctccagattactactacaatacatatattgacatagatacacaggcctagactagattacatcacaaactaacactgctagctagtacacagcatacaatggggggacatgtacacagatgcagacgagagatctgtcatatgcaagctccaagggagtagaaatcgccgcaccccaggtcgtcgctgaaggtaacatcatccttctcctgcatggaaatcgagtgtcagatagcgaaacagcgccgtcaacaagatgactattgcttctgatggtcttatcatcagcgaaaatggttcaataagtttgctggtatgtgtcacttttgtgtaatcttaatatggatgtcatggtaaaaaaaattaggtgaaggaaaaaatccttaccactttgactatggaattgagaaggccgtcgaagctgcagctgctagagctaagttcgctctgaagtttcgggatgctcaaatcggaggcgttcttcggcatcgccatatctcccgaaacgaggaaatctgtcttcatttgtgggataactgttgaaccacttgaggttgcttgcccaatcattctggcaccaatattgctactgttactactgctattgttccatctttggctcatagcatgatgagccccaatgttgcttgccaattgagagctcggtacagaactccatacgaacttgagatcaaacagactgtctgcagtcctatcatcgaacttctgtttcaaaccgtttccacctccaaaattcaagtacttttgctctgtatctggaggtaaaagcatcgcgccaccaaaagagctagctccaccttttgtgtctcttgctaccataaggtcatttgaagagcgagcaggtgcacacgatgaagatgtaccacccaatttgtttgcacaggtattgttaaacgaaccatggattagcaacccgttggcggaaaatcctgataaaggaatagtactctgctgggatacacgagattcaagcagaccagatgaaactccaacggcgccttcaatatgttctgaacttacagaggaagttcgaattgatggctgactgacaattttggcttgtgtgcactcggctagttcttgaggcagcaaaggactgcttgtgacactttggagtgtgccagacataccattagataggccattcccagaaaggatggtggacagatcatcggtttcttcatggatccacttctgttgcatttgggtctgcccaagcgatgttgccaaaccttgtcccaagtttcctttctggtttcctggtaagctaaggtggtacttatttgcatcattaatggaatggctcaatgtatggcttccgctcatagtctgaatcgattttgaagcaggtaccccctgagttccaagagctgctggattgtttctaggactgtttaacaatccatgtggagtaaaagatgatagagctgcggaagaggtaaaagcttgataaccctgtagtccttcaaatccacccatgtgcagaaaggggtctctacctcccaaagcagcaacgatgctaacttgttgcgacgccacagcgcttagccgtttgagatagagcctgtacttctgcgtggtacacaaagcttgagattagactctgcaaacaagttgtagtgtttatctgtgaacaatttgcttttagtgtctcagcatgagtcacagaatagcaccggaacttgtttttggttcaccatatatgtggttgctaaatctgctagaaggtttagagaagtgctgaaaaatgtacggccttttcctcaacttaaaggccactcatttaattgttacagaatctgctcttggaagcagaggggcaaagtacacaagactcaagttagaataggccttaaatgtgtaatagctctgtgttgataaaggatgccacagtgactttctatcagccatatttaatacagtattgtaaaacagtcagcgcacaattcattggtattgaagaacttctgaattcggttaatatttcttcagggccttagtaaagttgaaagatggtctatcttaagctatagtttcctctgaacagtaaaaacttgtagtgcaattaattacaatagctgctagctgtggtacagatttgttctattcaaattacatcattaccagtacatgctaataaatagaagatagtgaaatgagttccttgcctgtaggtgacttgcaacattttcccttgtgagtttctcaacattcatgagctcaagtatcctttttggcacagcctctgcataaatagaaaaaaattataatctcatcttttcacttatgcttatgcttattagccaaaaattgaattttcaaccttaaatttggagttgattttggggtttttttcatcgtagtttattttttagcctttgcttttagatcgttaagaacacgtatataaaagttttattcacaaattatttttcatttgcaaatatgtcgtttagttttttcctccaatatgccaaacgatggggccgtttctctctctctctctccaaaaaggaaaagattagggtgtaacatgagtcaccataaaaaaattgtgaacagcaaaatggaggcagtggtgagaacatactgtcaattccaagctggttgacagcagcgacaaatttccggtgtagttcaactgaccaaacaactctcggcttctttggagccgagggatcatcaatatcttgagtattgacctcaccctcatcctcctcttcactacagtactccttcctcttcttgctgggcctcccactttgatcaggtgatccacatgtaacatggccatgcacatggtctgaatccgcatttggtggcttgttgcactcttcatagaaatcgagattagcacggtcgcgagtactgaatttcctcctgataacatgctgccagatattcctgagctcttcgattcgaacaggttttaggagatagtcgcaggcaccatgggttatccccttcaatacagttttggtctctccattcacagataacactgcaaggaaattactaattggttaacatcaacatttccccctacccgtcatagaaggaaataagtacagtacagtgctcaggatttgctgaataaactgaaattgaattgatgctctgcagatacaagaaaaatcttcactcacagtggctattactatcaagaacagttgaactggattattggatagctctgagaagggataagattcatgacttactgatgacagggaggtccatttcaagccccacaagctcaagaagcttaaagccgtccatgtctggcatatggacgtcgctgataactagatcaaacatgtccctgttttcccgcagcattttcagcgcgatagcagcctgatttgttgtcgtcactggaaaaacaaaacaaaaattactctttcaagtgaatagctgttgaagatacaggaaggcatctgcgacaacaacaattcaccctaaacccccccccccaaaaaaaaaaaaaattgcagcatgcatttcttttatcaacaatgacaccataaatccagatcatgtaaacaatttacaactagacatctctgtagctgcatgcagcatatatagtatacgataacttcatgaaatattttattgaataaacataaagcattaggcaaaattctgaagaacatacatatagacatctaacaataaaatttgtaagaattgatattgctgttccaagacaaaaaaaaaaaccaagactgaactgcaaaaagaaaagaagaagtatttaccatgatactggcagcgcagcagcagggtctcgagcaccttgagacacaccgggtcgtcgtcgacggcgaggacacgcataccgacggggaactggtccctcctcctcgccgccggcaccacacccttcctctcctccgccgccctcatggcaacaaaaaacctcccaatccaattcacagcacaaaacccaagaacagcaagaaacctcccaatcgatgaagcaaatcaagaacaaaaaccaaccaccttataaccaaagttgcaggatgctgggaagcagatgtgggcaggggaagattgggattcagcttcaaggcaggcctcccaatccccagcaagaaagcaaaggcaaagagcccaaaggtacaaaaccaacaacctactactactgctcctgctgctgctgctgctccccaactagaacaggaaaagagaaagggagaagcaaaatggaaagaaagaagctggtggtggatttggacagggagaggagagagctggagagagtgggcatggagcttcaggaccaaacccaccaccatctccaccaccccatcattattgaggcaaagaggtgggaaagcaaaagggagggagttggagaagaaagcagagttctctctctctctctctctctctctgcagccaaaaaaataaactaaaaaaatgggaggaaaaaagcagagacactgactgttccagatggccaagcaagcaagcaaccaacctcagcttcagctcacacacatgtgaactactcctagctcagcagcagcagccaccacaactcccagcaagaaaacaagaggagattggagcaagaacagcaagaacatctcaagggagaagaagatgagggagagaatgtaagtagactgtccatctgtctgaattttaaggggtcaaaaatggtggagggcaacagaaattggggcccatttcatccacaagctccaaccgatcgctacagacgaaacgccatccctctgtagtctgtagtatgtactaccccgcaccggcgaaattcttgcgtctgtaaattttgtattgtatctcatgtatcaattggacggggcaaaaaataattttccatgaacatgttaaattggtactagtagtaatgtttttttttctgaggccttaaattagtagaaaatgggcattccatatgacaattccgtatctcatttttaactttttttaaaaaaaatatcattatttttttgagaatttttttggaacaaattttctgattaaaatgatccaaacttttaagagttgtggaaacggatgagacacatctcgatcacacaagtgaatatagcattgcaagctagtagtatcaacttgccacgcacaaatgaatagtatcgcacagtgactgtactcctacattgagggccttttgatttggagaaaaaaaaatataagagtaggagtttaggatgattccaaccctataagaaaatttcctaggaaaccctttaaaataaaggattgaatcatattgtatgctttaaaattcctatagaatgaataatcctagaaagattttgtgaagaaaatttagcaagagtttcaacctcttagaaattttcctttgaatctatccctttataagattattgtgtttttcctgtgattcaatgaaatggttattcttgtgtttctcctatattttataatcctctgttttgtacatgcaattgttattagaattatacgttttttttctatttcttcccttttttttcattggcccctacggagtaccaccaaacagtataataccatatacatatttactgcttgtataaaaatactgtagtaattatagagaagcgtacacgaacagaagacatatgcttgccttaacaactttagattcttcacacggtataccactactgcagctgggccccaaattataatcatccaatggagcaaacaaagacgacctgatctctggatctacaagtagttaatggtaaaacaccattaaccccaaagtaaaactccccttaaatgcgtgcctttaattgacgccatttactaacgcttttaataaccatccattaaagctttggatgattgattggaagggggcaccactccctcgcacacgaacgagattacgagatgaagattgtcacgaaaatgcccgaccgaccgagcgtgcttttttgtacggtctcattttctaaaacatgatataaacgaagacgctcataaacacacatcatatccttattagcatctttaaaatcctaatttaattactccctctatccaaaaatataatgtacaatcatgttttttcatgcctcataatataaaacatatgcgtatatatattaactagcacctcgatcctctaaatttggtttgttttaaaccatcgagctcttcaattatattgcttgtatgcatgaatgcgatccaaccaatgagaatgattaagggccagtttgttttgaggcctaaattaggcttgccaatttttttggcaaccttaacaataattgtgtatgtttggattgaagccaaattttgacatgcctatataacataggccattttaatagccaaattagtttaatttggcttcaatccaaacacatgttggccttaccaaaaattggcatgccaaaacttgtcaaaattgccaaattttggtaaggccaacattggtcacaaaccaaactgaccctaattttttttcttaatctttatgttacgagtggtgagcatttttttttatagatggagtagcatctttgaaagactggactaatataacttaggattgataaagtaacacgtgtatattgtcacacattgaaaaataataattagacgtaaatacaagcatctatatcaagtccaggacttgaactcatgtgaatcggtttctaatcaattgagttatgctcacttcaccatacgatattattctaaccctatataaaataataattctaaatcatttcaatcttgtattaccatctccactaaataattagaatgacaaaaacaatcgatcatcggttaaagtgatagtagttttagatattgtttccgaccgttttcacccctagcggcgcacacacaaatcacctctatttcccgtgctcgcgcgcgcgcgcgcgcacggtgggggcggccacacggggggtcgtgggggtgtcgatgcggtggtttttcgcgcgcagccagccccctttgtcgtctcgtctgccacccacgtccccatggcgctgctgctgctgctgctccttgctgcaacctgcaactctgcaaggccaacaagacaagcggaggcagcagtagcaggagggcatatgcctcgtttcccggactctccttccatctcatcccttggttgacccatgggtttgaccatctcaaccgttgattgatcccacatttttttaagcaaaaggtatagtcaatgagtactccctccatcctaaaatatattccatatctcaaaatatgaagaattttaaatagataggacattttctagtactatgaatctggacagactctctgtacaaatttatttaactatcaaatgttccatctgtttaaaatctcttatattttaggatggagaaaaagtaaatagtattgaataagaagaagagagtataaataaacaataattatgtgcgttaaaaaggaggttgtatacaataaacaatagttaattagtatttaataattgaacggttaaacatttaaagacactaaggcaaagatggtactacactaagcttagtatttgcaaatggattaattatgtggactaataagtgtttacactcatatactgccaggacatgagagaggagactgtaatttgtaaatagctgcatgtgtgggtttcttgtcattttgttcatctttctcgtgaagttttttgcgtgaaaaggggaaaactggacgtgccggtataaagtgagccagtactacaattcactgcctatatatgccacgtactcgatccaacctgctacgttgaaaacttttgcgtccatgactcactgcacgttgcttccggcgatgaactatcaagcgtcatatgcattcacgtaagctatatatatatatattattcccttctcctaaaatataaaatattttatataaatgtaatatatttaggatcataaatctgatttgactttctgttaagatttatagtcacacacccacctatttttttttcatattttagtacggatggagtatatgtattggcccacatcaatttaagtcagataatgcatcaggtgtttgcatgcttaattacgaccgttaattgtgacagcggggcatacatggctaccttcaatacgggtcaacatttactgttcacttctttttaaagcccgtttgaatgcgagaaattgtatgtgttcacttcacgtggaagtatgaaataaaatatactaggatacctcctctccggaacgcaaaacgatatttgcattaacatgtgattaattgaatattagctattttttaaaaaaaattgattaatatgattttttaagcaactttcgtatagaaacttttttttaaaaaacgtaccgtttaatagtttgaaaaacgtgcgcacggaaaaccatgatagggagttgggaactcccaacaaagaacgcaccctaattaagtactcttttatattcatcaccatataaagtactttcataaactatacacgaatttctattagtcaatgataaaaaaaattaactggcttaacaccaagtaatttaaacggaagtaatatatatgttttaacttttattaaaggtgactttttatactaatttaagaacgtgttcaacctataacctatacatatatgtatcgttagcaaactcctttttttatgccatacatgacttgtgtgtcgcataaacatccgcgagcacccaatagtacgatgataacactaaattaatattctccccgcttcaaaatttagcaatctatgaactaaattcatagtgttaggttggatctaatctcatacataaattgttatattttgagacgagtaataattaacatatttaaagtactcatctcacacttttcccccgcatgatgcaacgtttaccgacagtttatagcttccaacaaacaaatgagaagatggttgcatttaatttaattagcttgtgtgattggtgagtggtgaccaaacattatgtcatcgatcgatcccatgcatgcatccacgcccaattttttcatatacaccctccgtccctaaatatttaacgtcgttgacttttttatgatatgtttggccgttcgtcttattcaaaagatttaagtaattattaattctttttctatcatttgattaactgttaaattcacttttatgtatatatatatttcacaaaagtttttgaataagacgaatggtcaaatatacttaaaaaaaatcaacggtgtcaaatatttaaggatgaatggagtatatttttctccgatccatggagcacgcgtatagaagttcacaaaacatatggtaactaaaaaaatattcacagcatttttttctgcagggaaatattcacatcattttcacaggccacgtaagaaaagaataatattcgtcgtatgaagtcattataatcttcctttatggatatctagaaggcatatgcatgcatgcattctgcgatattaatatatatatgtaaccggcgctgccggccacgtggttaattagacagttaattagttgatgatgccaggtggtgtttaattactgtggaaaacttctactagacgtctgaatatcttgttgccctgatgataattagtatactgataaatggttttaattaactaggcatcttagtcagcttcacttaagtgcagatcttaaggtagctaggcccagtcatagttccaaactttttttttcaaacttacaacttttccataacataaaaacttttctatacacacataaacttctaacttttccattacatcgttacaatttcaatcaaactttcaattttaaccaaacttttaattttgacgtgaactaaacacagctctagtggggttttttttcttccaaatagctaaatgattgaataatgtatgtgatcactattcgagagcacaaacgaatggattaaacattatgaagttaaagaatagatctaaactagttttgtcgaaattcacatataaaagttttttttctcaaaaatcgtatagtttgggtgcacgtaaaacatgtggcatatattaatcgatcgattaatccttccttagaaaaatgttcaagggtcttccgactagttccacaaggtggtggctagactatctgggttcggagcctcaccccttttaattatttgatattaggttatttcctaatatttgccttttttttattaattcttcctttaaaaaaaagagtaggttgatttaatgctaattgcattgccatgtttatttttttttctttttgtgtggatgacgtcgcacgcgaacacgattcgaaccgaagtccatttttcctgcgcgtgtacatagtatatacgtacgcgtgtagtggacggttgcttttcatctgctttcttcagagaagctctatgtttattatgatacgcatgcacgtcgctcttatatatgtttctataatattatgcgatgattctcaatcatgcatgtttcaatattacctaaccatttcaaaattgaacgcgatctcaattatttaactacatatacgcatgcatgtgtgtatatatatacagtacgtacaccaccggctgcatgccggccaatgatcgatatgatctggacctgcttttgctagcttaatttactcgtatttataattttttttgactgaattatttataattgtttgtaaacactgctccctccattccaaattgatggtacaccaagaccaagaaaagctaataactctctcatattatatttactctagcaacaaacttgatgcatgcatcatccacactattttctagccaatagaaaatcaagatattgcatgtgggttataaatacttgtgtggatgcatgcatcaatgcccatttactccaatgcaccaataacgaatagacttaatgaataaacacaaatatatagatcatttaagaataaccttaaaaaaattatatgcagatcaattttgaatgaagggagtagtatacatgcctcttactacatatttttggatcgatcacttgagaatttatggatggagggcacaagctgcattcacgtacgacaaatgcgatctacacccaatctttgcgcgtaaatttctgatcgatctgcatttaattcactctccatcgaaagttcatttaagagctagctaggggccgaccatcgatccatcccagaagtaattactactctagttattgatctgggcccttcatgcaaggtcgaacccatcaacatgcacgtaatataagctgtgtttagttccacgctaaaattaaaagtttaaagaaattagaacaatacgatggaaaatttgtaaatttgtgtgtaggaaagtttgatatgacggaaaagttgaaagtttgaagaaaaaagttaaaatctaaacatggccatactctacatctaaaaataacacataagattaagtggtgagatgaaaaagagaaatgaggaaaaatatatgtatcacctttaatcatgtaaggggcaatcttcacacaactaaaaaaaagaaaaaaaagtgaattggacaaacaaataaaataaaattattggggttagtgtgctacagtacagaggtaatataaagatgatgtattgtatataccaccttttatagataaaattgaaggtgtcaactacctttgctataaaacttgttcctatattactcgtttaattataattagcatttaactgcgacgctaaaacgcacgcttgcatgcatggtacaatattggtactgcaggagtatatatatgtacgacgcgcatgctacctgcagtatgtacatgtccctcgtctgtgcgttgcacgcaccgttttagaacgcaaggtaatattggtttaactttgatcgatcatatataaacataattaaaaatataaatttcaggtatctgaagaaaaatggatgtatatatagtctaccataacgagagatttcttcatagtattacacttatgtaatttctaaaatttatatcgaagggctagatagtcaaatttttatccccgcaaaaaaaaaggatagtcaaatttatagagtataatgttaacttagaaaagtcacacacggcttgtttatgctaccagaggaaatagctgtataattaattaattaattaattaagcccgacttacgtacgtactctttctataaaagaaacttaattgcaagctattggtcaacaaattagtggtaagggtaggggccgggtgagcagaaaaaaaactgaaccgaaaagaccgagaccgagaaattcgatcctagacagtcaaagaccgatttttttcgatcaatttggttagtctcctcgggtaactgaataaactgaaaagactgaattaaaaaaatgtttaaatgcaacataaaatccactaagttcaataggactagactctaattttttcacatccctacttcttctaagcatgcaacctaacaagagtctttattcatatgtgcttacaatttctttttttgatttttgtgttggcatttttcactatttttttgcatatataaaaatgttgttgaatttcggtcaggaccgagaccgagaccgaatttgtcagtcctgacatttttgcgttgaaattcggtcttcacattccaaagaccgaaatgaccaaaagaccaagactgaaattttcggtcaggttgtatgcccacccctacgtaagggtaagtgcgcccctcacaaatacacataaacacatataccctacatcttaaattatatggtgcaattaacaccaatataaagaccaagaaagaattattatcacctttcgtttggataactccaataaatacaatgcatacacccaatgggattagagattttgagagggtggatgattttgaaaaagaaataattaaagaggagagagatgtgctagtttattgcatcatgcgtgctttatattatgaaacattgaaaaatatggttgtgtcttatattttgggatggagaaagtaagaaaagtaatattgcaaattggtagttaagggatactgagagcaagtactataaggatatatgtgttggtctaaaagtgtcgcataagataagtacttgatgagatctactccagaagaaaagtgatgagagagactatgagctagtcactagttatacaagaggcaatctacatatataatctccaaagaagagcacacaacgaatgtgagatagtgtgaaagtgaacataaggctgtcatgggttggcctaataatgttgattattttcatacagcttattaataaaaacttatttatgagcatcacttttatatatgtcatagcgactttaaaggcaatgcataaaaataaacttttcttttgagatggaaataataaatctcaatagcatcaaaatcaatttcaaaattaaattttacaattcaattttggtaacgatttataagctgtatgataaaagataggtatagtatatgacatggctaaaattaaggtagcacattcactataaaacttgctctcttaatttaggaacacaacttcttccattcccagatcgatcaaggatcaatatataagttgggacaaagttgcaaggctaattaaagtctttttagggtggaatagtaattttgaattttgatttggtggttgttttagttccaccaccagcttgtcataaactatatattccatgctgctagctagctagatttggcctagatcgatagctagcacttgcaaatttattaggtttggagctttgggatcctacgctgatcatagagagatcgatcacttatatataggcactcgctgtcgtgatagatcacatagtcctaacacatgagatcctgtaagattatggagtatcacacaggtcatgccaagttgtagaatcaattaattaacggcggccgtggcgtctgaagaaagaacagctagcagtggtaaaaaaaaaaaagaaatcaaagatatgtgcctgccatgtcatttatcacatgctacgtacaacgtgttggcacatacagtaactgatgagcaattcaagctatgcattagggtgcatttctttttagctaacgattacatgttatcacggacatgtttttttaaaaaagtttataataaacacggtactttttcaatggaatatgagcaatgctagcgcaataaatgaccacacatcaatctagccggaaaaaaaaataaagggtaaatagctaaagtggtcctccaagttttaattatctgaggctcagtttagtccttgacattttaatctatccatattagtccttcaagttttcgttttagttcaaaattatccttgaacttacttagaagccacatggctaaacataaccaacaactctcttgataaatgacacttatactcccctcattcacatatataagagaaaaaattgcatgcaatgatttttttatagataatgcatagtaatttatgtaaaacgaaaataaattatgtacttgcaggtgtatacgatagccattgtttaagtttcatgtgcatatgttgaaataatgggaaatacatctgcaatattgtttatttattttgattttcccttttctaatgtatagttgcatacaaattaagggcaaaacggacattttgcaatggaaatattgactacaaatatccatatggcatattaagtgggcccaaggatgattttaagccaaaacaaatacttagaggacctatgtggataaaataaaacctgaaggaccaaattgtgccttcggtgaaatttgcgggactaaattagctattcacccaaaaataaatgacaaagttacttctagtcaatgtattagtaaattactaatttacccttaataacaaacggatcatatcatttctatcgatagtataatactactagtagaaagcaccggagcatcactcaatattgaattcattcattcatgccatcaaataattgttatgaacaacgcaatttcacaaatcatccatagacactttagagtttagaacgcatcatatccttaggccagattaaccaaaagaacatcaataagcaggactatatatagcaagtactttctgagacgaatattattggtgatcccgggtacccgggtacgtacaaatcagggtgcatgaacgacatagcaaaggcaggactaacaaaaacggaaggcatatatatatatatatatatatatatatatatatatatatatatatgcatgcagcagtgtgcattcagatcggaagtggtatataatgtggttgtacgtagggtaagaattaagcgtgcgtggcaataacatcatagctttgtcggcaattgttcgtctcttctcctcacatggaaatcttgagagcagagatcgaatcgatcgtcgaagaacgtacggtcctcaaccaattaataagcacatatatatcgtcttgagatatcgatcgagctggcgactgactagctagtaaaattgtttgaatttttctagacaaactgtattaagtttgatcaagtttataataaaatttagcaacatctaaaatattaaataagtctcattaaatctaacattgaatatattttgacaatatatttattttgtgttgaaaatactactgtaattttattaaatcaaatattttttattagaaaaaagaaaaggtctaacgactttaaaggaaaggaagtactgtatattgttgtacgcatgctagcaagcaaatgcaaggggcagtctggcagtgcatatatgatagcgtaatgatgatttgttcctgcggctccctccgagcactggtgaccagtttaggttatgtttagttcacataaaaattagaaattcgattgaaattgaaacgatgtgacagaaaagttggaagtttgtgtgtatagaaaagtttcgatgggatgaaaaagttagaagttttaaaaaaaagttagaaactaaacaggccttaggagtacatgttggtcaggaggacgcattctgcatttctgcggcaaaatcaatcgtattttccgtcgtggtgacacgtcgcggctcgccggggccgggctacgagcgtgaggtccccgcccgttgcagactcagcccagcccggcacgtacttccaacttgcctcgccgtgcgcggagaagaatagtgggccggcccaacttgtcggtgcaccactgcacctgcacgttcgtgggtatcgcgttacggcccatactgctctcgggctgcctgtctacaatacatgggccaacatcgtcataccagtccacttctgacggtatgagcttttgccgtttctccttgcttcttgcatttcgatgacgacaacgtactctcttcgtctcctactttaatcatttgtcttgcttaaaatactaggcacaaatatatttaaaataagacggacaatcaaaaacttatggttgcacttaaaataggacggagggagtaaatgctgcttgaaacaatgttaaatctagaaagagtcgctcaaaggcatatggtacctgagtttctgcaatcaattcgaattaatcgattcccttcttttgcatttgcacatctgcagctaatagtacaaactgaataataataagtaagaaaacagaaccccagagggctcgtaaactgaactacagaacattgctactacatatctcctgcttccactaagctcccctcgattcagctcacggctaacactttctcatcgcatctccatttctccatccaagctgctacccacaagtatacatctgttctccaatctgatgaaactcacactgaccattcttgtgcagcatcagaattcagaacacactccttttccttcacataagctgtctcccttccctgtcagattcttcgtcttcttcttcttcctccatacgatcatggagcaacgacagctattgcacggttagtagattgtgacaagtgacaacggctaaaaacgatggaatcagctgctctccagtttcatctcttgccgaatctcaagcacttgttgtgttttacttcggtcatgttattgttcgaggacgacggcgccaactggggcgctttggctgtcttatccttggagagcttctccatcgcgttgatgaacttcctcagatgcctgatgtattcagggtacgtctccaggttgcagtggccgccacctttcacccataagggctcgtacttctccttcgcgagctcccatagccgcttgccgtgggagaaatcgacgatgtcgtctgctgtgccctgccattgtcattcagcaggtaagttctgagttctgatcacaccaaccggggaaaaaaaaaacagttgagagcagcaatgaactatctcagaacttaataaagtcttagcatgttttctgttgaactgtaactagtaattggacatgagatatatactgaaaagtaaatttgaagatgatttcagacttgaatatcaatgaaaagctaaggaggctttgaatcagaaatgaaaagggtacaagctactcacatgtataaccagcactggacagtcaacctgctttattttgtcgatgttctgcagacatgttagcagtaaccagattaggatggtaaatgacagtcgttttagaagcaaactgaaatcatggtccagagttccagacataccttgaagatatcaaaccaaagtgttacttttaccggatatagaacccgaatgcctgaaagtatagcactgtgaaggacaacccctcttaatttttccaagcgcgaggctaaatgcaatgttggtccacttccaactgattgtccatacaagattagatcctctggttcaatcccgtacaccttcgttaaacagtcataaacagcctctatgtcacagtatgtgttgtattctgatggcttttgaagcagaaaacatgataagaaaaggaacaaaattaggtatgtcttccacaaggcgaacaattacctagcttaattacttattgtaagttcgtagaaaggaaaacatttactatcgttcgttctgatcatcagaaagaattcgttaatcaacaaaaccatgtgccacatatgggaacaactgaacaagcacacatgccactttatgagctagtactacttaaccaagttcttcaagtagggatcgataatcaatcacctagaagttggggttgatggtcccttggtataacaactttgacaaaaggatgactaacagaacaaagttgccatcatggtcgagaatagcagaaagcatgtgtgactttttccgatattcataatgaaagtaaaattgaaaaaggctaaacagccatttgccaaagtcctattccagatgaggccaagaaagacagaatggctaataataattgctttgagaaaagctgcccatatacctatagaagaacaggatgttgattatgaaaaaagcaagggaaacaatccaatccaaagattgtcgcttgagtcattgatgaaaatatggcataaacatacaggagacatcatgatcacaaaaaagtttaggtgacaatctattcaaagaagacaagtttactgcaaattaacctaagaatcaagtttgagctcttaaaatcactgaggaattcagaatcttactttgcctgtagaggccccatatcctgaataatcatagctgcagaacgaaaccaagtaaaaagttcagtcacatgtaacacacaatattggtcatgtccatcaaaggaaaattgtcatgatattaatttgacacaattgtccatgttttatatatttattgatggaaataaatttcaaatcccatgaggatcaaatagcaacttttccagtaggggaaattctttcgttcttaaagttaaaaggcaggcatcaactggatccccaaaaggtgaaatagataccatttgaatgtgaagttcgacaggactccatccgaaataatttatagcagaattattcatgatacatttttactctatccacacagcaagactatatgcaaattatcaatccacgatccaaatgccacaaacagttataacagtattataagaataagatgccaagcactattctcttacaaaaatgatgctctgtaatccttgtatattttaagagaactgcaacaaacaatgccgtaaaatttttttaccccagttccccaatctagagaaatgccacaattctaacaaatgactagaatcgctgaaactgaattcgaaagcaatagcagcagatcacacacagcagcatgcatctgcattggagcagaatctgacagtataaagtacaatgaatcatccaaaaaaaagtacagtcttaacctcgtcggatggcaacctggcaagaactaaaatctaaaacggagggaagaaacgatctgtttttcaactcttccataattgtggtcaggccatcaggatatccaagaaactaaatctaaacataaaagcagaagtcaaagcatttattcaggaaaggagtggtcgtcatttaatcaaacgagcagttcgttcctaacattgaaggtgaagcttaatcaggtgcgaattcaacccctcaaagaaggtttaacaagaacaatggaaagaaaaaagcaaaatcttttgcattgcaggtcaattaacaattctgaacgccatgacattactgttcaacacagttggctcaccaactaaaaaaagatcgaatcaaatcctctttcaaattaaagcgaggaaaaaaaaacataacgaagtgcccgccaaatcggagcttgcaaaacggagtatttacaaaattgatcctaaatcataagactaattgaaagtttgatactgattaggcatgaagagtagagccatagagcgcagcatatctagcaggcaagaacacaacaaatgcaaaggcatataatgaaatgcaaatgcaaatgcaggttcagaagttggaagtggaagcaagaaaagaacaaggcgagcaatggaggagaggagaggagagagggtgacctcatgatgttgacgcggaggtgggcgcggagctcgaggaagaggccgagcatctggccgaggtcggcggcgttgccgtgggagtagagcagcgtgaggcgcgcggaggggtggcgccagaaggcggcgacgacgcgcgtccctcccttggtcggcagcgcgtgcacctccacgccggcgtccgccgacacccccgtcatcctcaccacccctcctccgccgccgccctcctccgccaccagctcgtacgtgggtggctccggcgggaagaaggccagcctcgccgccaccgacgacgtcacgttccccattagctccccctccccgcccgcctatctcgctccgcaacgtgaggccgccttctcctcctcctcctccttttcttgatttcttccctcgtcaagaaaaagaggtgaggtggtggtgtgtgttgcttttctcgggctccttacctaagcttgcttttcctcctctctctcgcgcgcgcgcaatgactctggtggattcgggtagcagttgcagtcggggggttggtttctttggttggttgcgcggcgggggcgtagcgtaggcgtacgtacgcttgtcgatcgatcggcgacgacgacgacaggttgacgaccaccacgtcgcgtgtgtgcgcgcttccgtcttcgtttagtactactcccacacgttttttataaaaaaaacagtctaatactaaacatatcttaataagttgtgttttcctgaaaaaagttggaggtttggagaaagttgggagttaaaaaaaaagttagaagtttactccctctgtccaaaaaaaagacaaaccctaggtttctatgtccaacgtttgactgttcgtcttatttgaaaaaattatgaaaaaaattaaaaagacaagtcacacataaaatattaatcatgttttatcatctaataacaatgaaaatactaattataaaaaaaaattcatataagatgtttttgggacggagggagtatgtgtgtataaaagttatatgggttactgtagcacttatgactaattatggactaattaggctcaaaaagatccgtctcgcgatttacatgcaaactgtgtaattaatttttctttttatctatatttaatacttcatacatatgtccaaagacttgatgtgatatttttggaaaagttttttgtaactgaactggcccttagcaatgttttagtagccacgcacgaaaaattgtgagacgtctcggatactcacccaaggaggcaacaggacggagtattattacaccatccgttccaaaataaatttatttataaatttgtgtgtctaacgtttgattacctgtcatatttaaatcttttttataatttggcatttttattgttattatgtgataaaatatatataatcctttatgcgtgacttaattttttaatttttttaaatgagatagacggtcaaacgttagacataaaacctacaaataaactaatttttggacgaagggtgtactattatagatttaaaaatttattttttaaaaaatgagttttatatagattattttaaaagaaaatgtattgtttaatagtttacaaaacgtgctcccggtaaacaagtgggtagtaaaatcgaaactcactttcaaactcagtgttagatttacatttagcactggcattaaacaccaaaagtagctaaattggttggttagtgttgttttttatgtgaaattctcgaggattttggtgttagcttatgcgtttaaaaatgatcgtgcaaataactatcggctcatccgaatagcagcagtacggtcgctcgcacggatcggatgcattacctgaccaatcaacagtacagatattagggaaaggaagacgttgtacctgcatataggtgactcaataactgatgttcagttagctataataaatgcgtggaagagccaaagagggtaagctgaggcttgtttagagcaagtttaataatacagtggttcaaattatctatagctaatctaatagtctattcagataatagctaactataaaaatatactacaccgttaatacacgattctacccctcatacacacgtaacgtcttagagtttttgttacaattagttataaatctacaggccgatttattctctcttttcttttttcttttcgatatatgattatagctagtttatagccttttattgtaccgctcttaggtggtcaagattcggtcaaaagcagcggcagagcaaagaaaggatgatggagaagaactcgcagcggtgactggtcgatcagacggcgaagatagactgatgcatgcctctccctgcagctgtatacagtatgcttccgtccattctaaaatataataacttttatcccttagtatttatcctaaaatataataacaactctccaccaatattctcttcccaaccaatcacaatcattcatcatttatttttttccacctacctctactaatcatcaatcacaaacctccaccactcacttctacctactttcttaataatcgtgtccaactctaaaacttattatattcttggacggaggggtagcagactataaatcagctaaatacatatcgagaagataaaaaaaagagagaagaacaacgtggcaacagatttataacgaggtctattgagatatgttgtactagaatatgttctatcccatcttaggttgtgtttttgggacgaaaaaagtatatatttatagataattattgtataaattagttattaaattgagtatagatgatttaaagttagttggctataccattgggtgagactgcgagttgagcgagtgaggcactgtttccctggccccacattggctgtcttcatccgacagctgccagccctcgaagtcctcactgatctctctctatacttcttccagcatttctgcttgatcatcatcagcagctgcattgcctggcctactagtagtagtattgctattgctcaattgttatcgagactgttagagactgtttaatctgacgaaaggatagatatatttcgcttaatctgatgattaatcatgtgctgcacactctatgctatggagtagtagtactcgctgggcagaacattctccttgcgcgtcttttgaagcctctgccgctggaatgattggatggaaaagaaagaaaattatgcgtgcacaatgagagccgaggcagccatcggctgtctcgcccatggacaagaaaaggtcactagtggccattgcgttgcaatgacacgaatcaacgaacagctttgagtccaatccaaaaacacatttagttttggtacgaatcaacaaacgcttcgtcgctatgcatccatccatgcaacacactgctgttcctatggccatactccatccgtccaaaaaaaagacccgatccatttcaactagtgtcacaatcaattatttcatttctattggagcattggcctagtagcctcctcctcttttgttactacaagaatgtccctttacttccatagaaaaggttaattaagttttcttttcttttctatcgctgactataattagcacatactccttctgttttaaaataaaccaacttatacatatgattttggataaatcaactatgaatctaaatatccgtatgtaaaagttgattttttttactagagtatctctttcttttaacaatcaagataaacgccacacaacagctagcatggactcatatgaagaaggtgaagatggttaattagaggtagaaaagatcaagcacaagggtaacacaataaaccaactgctccaaatctctctttttgtccctgaccagattagtgaattgccttttgtcaacagtgacgttagctggatctgatcatgaatactctctccccaactgtactgttgataaatatgggaattgggcaatgtggtcaagcaaagggaccatcagttcatcattctcttttgcatttctttatcaggtgggacccacacccaaagctccaccccgggaccacatgcagctcttcctttcatgagggctgatgcggtcaaagggtgaaagggggacggtcaacgggagattaccactacctggatgcatgtgggcataatgatagtagtactagtaattaagagttaattatccatatgcacatatagcagctaagcttagcctcaaaccttggagtgcgaaacactgtaaccaaatccattggaacgtgaccggcacatgcaatgagtgcctaaattagaaaggagcacggcttggaaaagttagtgctcacatcattgtatatttgtaccaacagattgtgtaaatacaaagcgtacaatatcataaaagccacatgaaaataaaagagatgatctagatatacgaaattgattgttcctttccccccaaaaaaaaaaagaaattgattgttccttaccaagggtatttgttagagataaaactttatagtggagtataatcttgtagcaactcatatggaccattaagatcaaaatatggagactcagattatatgacagtccttataactgcatttgatgtaaatcgagagatgtactgtggtagttcctgttatttataacagtcttttctagcttgttccttgtagattttttttcctaataatatactccctccgtttctaaatatttgacaccgttgactttttagcacatcaccgttcgtcttattcaaaaacttttatgaaatatgtaaaactatatgtatacatataagtatatttaacaataaatcaaatgataggaaaaaaataattacttaaattttttaataagacgaacggtcaaacatatttaaaaaagtcaactgggtaaatatttagaaacagatagagtattaaagtacaaagcttttatgcactcaaaaaaaataaccacacttgatctcaatattgagcgagggtcctcccagtactgcagaggatctggatttctcaatatcgagagtcaaatattcgcattcgtatgggccatagagctgagacttgagagaaggaaaacgtgtggaggaaaagtccgaaaatcccatgcttgtgtcctgctatctcgactgggagcacaagcagagacgacgcgaaggctgacatgtgaagtacttctactaggagtactactcgcacaggtctgggcggcaagcaaccgaggcaggaggagccgtacgagtcagcagtcatcatcagccagcgtggcgtcgcattggattcgcttccttcttctgctcccttctcctgccccaaaacgtcgcaacgaataacgatgcccctcggatctgcctgcacccgagtactcctgtgtactctatccattccaaaataaaagaaaaacatgtccaggcactcgatattccagatagcatcatcttatcttagatttgattattttaaaacggtgagagtagtccagtactgctgctgctgctaattggatttttatctgaatatggaagacatattcagatttgttattctaaatatcatcacatcttgttttaggttatcctaagttaatttattttgagacggagagagtagcccagactgtccggtactgctaccgctgctgctaatgttgatttttatctgggagcaaatgaggtctcgttgagttctaggaataaacaacaattcatttgctactttgcttagcttaaacagcaggtcatgcggctcacgcccggtcgaggatatgcgtggcaattcttgctttgtattggtagaaatcatcatcatcttatgtacatcggtgaggattacatgtaccgtgtctaatgtcatgtgcaacagtgtaagcctaattaagcagaggttaatatgtacatggggacgccatctcttaccagatggacggagcagaggagaggcgggctacttccacaccttgacggcgccgtctctgcttcccgagatgagcctgtggctcgacaagttcacggaggccagcgcgaggatcgcgtctcggtggcaccccgcggaatccgcggcggccatggcgagctgcgtcttgtgggttagcctcgacgccgtcgtgggctgtctgcatatttcctgcacacagaagcaagcaagcaaacacactctaatcaggttcaagatttgcagatggggaagaatgtggcacaaaccaataatcatgaagagagatttgacattgatcaatcgaaagttaaaactgaaagatacagcacagaacagcatagatgtagcagaaaaattcatattttacgactagttacctgcacaacttgtacacaagagctggatcttatatcgtacgtctcgtcgtttccagctcctttcaccgagggaccggctatacagaagctttgctcaggccttcaaaaacatcaaaggaaaacgctagttttatatgacaggcacctcaggagattttttttttgcaaaatcagtagtagtatggtacaaatactgaacctggcctgatcccagtagcgtatcttcaagtccgttcctccggtcaataggtcccctcctggcaaaggaagcaaagagcggatgcctggaaggcgtggaggcgggtcacataattcttcaattcggtaattataattcgctggccgggtctcatctctggtatttggatgtattgatggtgcctttggtacaacagcttcattctcagtacttgctgttctaaatatctgcatagttcatcaaatttacagggcatgagtagagtcgtcaagtgactgcacttgatagattagaggtgttcacttcatttttctcaaaaaaaacactgactcttatagaagactaactaattacaaatgtgagtaaacaaggtattttatcaactgtgacagctcaggaaacaccaagcagaaagccatatgttacctggtgacggcttccattctcagcatcccatagggtaacttcattgcagcctgcagcaacaaaaaccacaggtctcccggaagaagaaattgaattcggtggtggtataaacaagcacaatttctctataggggttgctggcaaatatttccatgagttaacgggaagcaaaaacctattatcccacaacgtaagaacgcctcttgaagacccagagatgaaccaattcccgcactggcccactacaagtgccgatacatagccctcctctggtgaagatctaaatgaccaagactcagcattggtccttgtatcccatttatgtatgccacaatgttcagtgctgaaaagaatggttgggctaaaactctctgtggaacagttcacaacactgagaattgcaccttctttcaaatctttcctttttacatcaacaatgccagaatacctttcgatgacactccctacaccacgtgcgcagtcaacagaaaacaagtgcaatgttccatcactagcaccaacaataacttggggagtaccatgaagcattgtcgtacatagagctcggctactaccgaggctatatgttaacctagatctgaaggcaatgtccttttccaattttcttgtatcccatatcttgacacttgagtcatctgaagctgttacgaaaaaggtattgtcggttgatacagcaatatcattgacagataagcgatgctcctgaagatgtgccaccagaactccacggggtttccaacttgtctccagagacaatgctggtctggtgaacgatcctgaattatcagagttggaaatgatatcacctggtatagacgagctgctattcattgagtcactgatgctcccatctcggtgcatgttactgaaatgattttctctagtacgtatgcctggaactgaacttgataaactcccatgccggtcagatcccaaatttgcatgtagtgctgtcccttgcatggagtataatggtattcctttaggtacgccatcataaaaggaactagatccatgtactgcagagcttatatatgctgaactagcagaagaaaaatctttaatgttcaaagacacatcattggacatcttaggtcctctcaaccttgaatcatcttcaatcatgattgatgaaccactttgtaccatggcaggataccttcctccatgcactgtcaattcttttttaccatcacccttcagtaaaatgtctcctgcatcatggacatcctctaaagcttggtacaagactaattttgagaccggaggcttaatacatgaaagaagagcagtttctgatgacaatgatggtggctccctgtgtaaaaaatgcttaagatgtggaaaaaggtatacaaaggtgtctacaggccctatgctctcactgcaagcaacaacaaatcttacagcggaccgtttaacccattggactggatgacacagcaagggaagagcctttccaaataggccaacaatcgcccttttcctcaaataaccacttttgcacatcatagtcaagcagtcaagtactttcacaagcacaacctccatttcatcacttagtgcctgttcaagatagggcaagagatactcctcgacacttctggaaccaataaaatagcacacaacaacaatctgaccaaaataaactgcacggagctgctcatcacggtcatttagaaatgctggaagtatgggaagaagaaagtcgttagtttgtctatgtccgaagaagtaacacaggtaacctatatcttgcagaagagctctgcggacattacgtgtctgtttctgtcccattaccaactcttgcactatttcataaatagattttctgagtcgtgcaagttgaccattaatgctatcttgctgcctctttactggtgattctacagactgtgatctgggagctaccattgattcatctagaggcctagcatcctctatactccgagaacgaagcaggaatctgtaggctgtcaaggccaacttataaatgttgctggcatagcaaaccctaacactctcctctgtatcatctgggagcaaagagagcattggaaggatgtactctgggaatatctttgcatcactgataggaaagtcttgaataagacaaagaacatcagatagagtttccaaagcagcacagcggactatggcagctggatctgaaagcatcgcaataacatatggaataaccagctgtaagcgactatcatcatctatgtatgtagaacaaatcttcagaagtatgagactagcccttctaagctctggctttttgacacttcgtatgcatgagcaaagtaatgaggcaagcaaaaccatgccttcacagctcaccttgtactctgtttgttggaaaatgtcaaaattataggtatctgattgagcatcataactagacactaacgcaagtaggttactctttgagatcttctgcaaatgtgatacacaattgttctggcccatcaaaccactttcagttcttccagcttgacaaacctgctgcaaggactgaataccatttgcatgggaaacattgggagtaacagaccggtctctgtcttgtgtgatctttgtacttgtacggtcgtccttctccagttccttgaggaggaaattgagatctccaacaatatgcttatgctgtgcaggactgtttatcttaactacaggtacacttttggcatattcttttggtgaatttacagtttgccctccgatgcccattttcccagacagttcattatgcacaggcacagtagcagatccttgaattttctcgagtgttgagccacttatcattatatcatgcatcttttcaaaatattcttgagtcttctcgacctgtcaaaaggcatgtatgtttggatatccatggtcaagaataacaaagtagaagtttaacatagatgtaattgatccttaccctagcatctgagtgaagcggaacaatatctgagaaaaatttgcggagaaatttcgaaaaataaaccgggaatacaacagattcatatttttgcaagtagtttttgcatgatagcctttctttcgggtctaactgaatcatgtgaagtaccatgtcacggataccagtatcttgtatctgcaagcacaaatggataatgagccatttttctttatgcattatctaatgttccactccatgacccaggaagatattacaatgttgcaagataagaacagaatagccaagagactacattgctttgtatgtgttttttcacctcctgactattaggcaagaaaactgatggaataaaggacaaggcataactaatagctggaccaataaccagaattatttgtgcaacacaaaaggaacaaggaacaataccagaaaccttttcaagggtatgaatagggtcgtactgaccacgccgataagctagaagttgtgaaagctcaaaaagtggctgaccttctaggaaaagttcagcaagaacacacctgtaaagaagacaagccatttaccatttggagaataaggaaacgaaaaatacagcctcagtaaacaagtctaacatagcaaagtaccacataaaagttggagctattaaagaaaaaagattaattttcttaaccaagggtcctaccgtcctagcaaacaatcatgcaccgatttccttttgggatgtgcaaatattttaatgtagacagcaaaacatactgagggtaggtctctcaattataccgtcagttcgttttacttctaactgagcattcctcaatgcgatcaagtgaatttgtaccaaccatgcagcctcaaattgatcaaaattatgttccaaaaagacaatcaaaattattttcaaacgctaacccagcctaaatgttaaatttcgtatttcagttaagggcgtgtctcaaatgacaagataccaagtggagaaaaaaacacattggtaacaatggcatatattgacaacaaagaacactttgtgcattgtctatcagcaattatcagatttcatgggacaggaaaaatatgatatatgatttccctctttgtcaagtgagatgccaaatgataacacatccaatgaaattaaattataaaactggcatgttcaagcaaaaggcaactgtgaccaaactattagtataagggattgaaaggtcctatactcgtgaccaaatcgataaagatttataagaagaaaattacccaagagagaatatatccatagatcgttgcaaaggtgcatctgctgcgacttgggtttccgcaccatgctcatagaatctctggaaacattgagttaggtttattcaaaagagttgtaggtaatcaaagatatagcattaagacatccaacagtgcattgcaaaaatgcaaagactgactataaatcataatgtgttttcatattcccaaccaggatgactacatatgttattacatctttggtaataatgaaagaatccaaatctcctagaaaatagcaatagtttatttgtgaaatgatcaagtgaatgtagttttcaacccatatggagatggcaatatactttcaaaaatcaactgcatgtaaacccaatcattgtaaataaaatggaaaaaccattgacgaactgccctgacactatacatgttactctagactaacaaattagtacataattgtattaacaggtttcgaatttgtgcatctgcagtactgcaactacaattttccccgtaattcaatcataatcctttagctcaaacaagagttccccatgtagatttcattttgttgatcgtaaatcagagaaagcaattgccaaaactttaaacagaagtctgcgttatctgcagctcctaaaggaattctttttaaaaatgaatgcactaaaatatagtagcaccaaaagctgaaacatcacaatggtgagagaagggtgtaactaaagatcctaacagcagccagtctaaacatcacttattgagtagttgtttaaatgaataacaatttgcaggaacaagcaatatacagaagaccataacaatattagtgataagggtgaaaactatgcctatgagaacaaataaattgggatatcatcgacaaaagagcataacactttcaaatataattcagattaaagaactaacctcaggtgctaggtagcatcttcgccttccaccagtatcaaagaagaacgaaaaatcagatggatcatcatccgggatgtaagttggtttgaaagatgcaaagtccgcaagatatagccaattccaggaggtaacaagaacattctcacattttatgtcacctaacaagaaaactcagtgtaaacatcaatagacaaaaaaaaaatactgctgatgcacagtaaacccttctcaccatgacaaatccccttactatggctctgctccacagcatggattaactgcacaaccaaatgagctatgttggtaaccatatctggaatggaaagagaataatgactcttacatgttccactagttttaagtgcgtgactcatagctatacaatttctaacagtcaccataggatctgatcattaactctgtaaatgcaaatgattatccagtaacaaccataaaaaggatggctcacctgaaaagcaagccatttcttctcaattttactgaggaaaggccgtgtgcttagtcgatcatgcaggttgctgtagaaatactgcctaaggagatacgctgccttatccgtttgcaaccaaacctgaagacatgggatgtcatgtcagcatatgttacccaaaaataataggagggcatatatttacaatagacgtagataactatgttcacatcctgatggatgcaacaaccgctaaatttcactatttcatacaactatctagtgtgaaaatattacgagggcatgagcatattcctaactccattagaatttaatcaaccatagaaatcgatatcatactctagaaacccctaatggtatggcttgaaaagccctaatgacagtttaccaaaggaaacaaccttttactgcctgatctgaaatttccacctaaaccccacacagagtaaatacgcattatttttctgaatgaaaactacagtctaatccaccaaatacccttatgcaacataacaatgcgctaaagtcccacgaccgattgcgctagttcgtaaagcacgggcaaaattcgatggataccacagcacgcaatcctcacctggaagggccagacgtgggatccctccaacccctcgaaggcgttcctaatccgctccagcctccgctcatgctcctgccaaaaccagcacccacagatctcaaaacgcgatttccaaaccccaaatcgagggggggacgggggcagagtgaagggcgcgcgagccgcgaagcctgccgaattttcttaccttgaggtcgaggggctcgccggcgcgcttgaagtagaccttgacgaggagcagcccctcgtcgtgcttgcagcggacggacttgaggaagcggccgcggctgacgacctcgacgagcacgaggttgtacgtggacgggaggtcgtggaggtagtactccgtcgccgacgcctgcgtcgtcttggcgatcttgttccccatcctcctccggcgccgccgccgctcgccgccgggctcctcgcgctcgctctgctgtgcttagtttttgggtttcgatttcgagggaggtgtgcggcgtcgttgcgtttgcgtggtgcgtctgcgatcggaacccggtgcgagtgccaccgcgtcacggagcggggacggagaaccaaacaagcaaacccaatactaatccgaattgcacgcacgcaacagaatgcagttcgagcacaacacgattaacaatatatggctgtgtttagattctaatttttttttcaagcttctaattttttttatcacgttaaatattcaaacatatatatgaagcattaaatgtggacaaaaaaaatatcaattacacagtttgcatgtagattgtaaaacgaatctttttagcctaattacgccatgattagacatacgtgctacagtaactaatgatggattaattaggctcaaaagattcgtctcgtagtttacagtcgaaatctgtaatttgttttgttattgatctacgtttaatacttcaaatgtgtgttcgtatatgttaaaaaaaaattggctcgaacgaaacacgacctatgtctaagttatatatccctcatttcatatcgtataagtagaccaaacttggttaagtttaactaaacttatagaaaaaattagcaacatttaaaattatcaaatttagcaacagaatagagttcgagcacagcacgattaacattaatatgtcaaagttatatacaagtataatgtaattgtaatatatttatttatatttgaaaaattgttaagagaagatttgtagacaaatttatagtaaaaccaaaaaaatctgaacaaactatcaagcttcttttttccctttttttcacggttaagttattgttgatgttttatattaaaaaaagaaaatgtccacttcaccaactaacctaaactaccaaggcaacgagaacagggaaaccaagcacgacactcaaccaacgccattcaccacaggaacaagcagctagaaaaaaaagagactctcgcacactgaagacatgatgttatcattatcacaccatcaccctcgtgatcgggtgactccaccttcgttgggaaacatcagtgtaagggtaacaacctagcctgcatcaaatcatagcttaaataggctcatgttatcgttaccacacgtcatgccccgctgatgctatagctccaacttcacaactaccaaactcactgatgtactgttgagccagtctaacgtacattacagatgataagctttgaagccccacacaagagcgaaaacacaatcggtgaagtctaacttatgaaaaatgactaaagaaaaaggagtgagttgatcaaacggtgttcatactatacaacatagtatgtcagtagatattaggccttgtttggatcatctggtctattaaatagctctccggaatcttgctatttaggagtattaaatgtagattactgacaaagctaattccataacccctaggctattttgcgaaacaaatctaacgaggtatattaattcatgatcgcggatgatactgtagcatcactgtagcaaatcatggattaatataccttgttagattcgcctcgcaaaataccccaggggttatggaataggttttgtcagtaatcgacgtttaatacttctaaataacaagattccggagagctatttaatagcccggaggatccaaacaggatatgagaaagaatcttcacttctattcaaacattctgagattttattggttagtcaacaggatcacaataaaggacgcctgtgaagagcaactgaaatgattatttactctgtttagcattataagccgttttgtgttttgaataatacatgcatgcatccttgtatgtgtttttttagacgcaaaaggtagagagactctaccttattaccattgcattaatggtggtcattaagtaacaaagccggtggctggcaagagattataaggggggaacaaagaggaaggataaagaaaaaagaaagatagaaaaaaaaaggaagggtgaagaagaagaagaagaagaataaaacgatacacaaaaataaaagaaaacctagctaagtttgtctgcccaagtgttgatgttctcgcgaaggctgggctttaggcgatgaacccacaactggagactttctcttatttgaagcaggatgtacgtaacgcttgattcagttagcttgaagatcagctagttgtgtgccttccaaagaccgtgcgaacaagctgcaaagcacgcaggccatcccagtttctggtgttctggcaaggtatccaggattgattccacgaaatcttgtatgttagagctgcgcacggctggctcatagaggttgagcttcttccagacttctcctgctaatttgcaatgaagaatgatgtgatttgctgtttcaatagctgggcaagagatacattagtggagaaaccatctcacaatagtcccagttctattaaaaactgggactaaaaaacgatttttaatcccggttaaaaaatttttgatcgactaaagatgatttttagtcccggtttatcccatgtcagatgtatggcagggggtcgaggatctttagtcccggttgatactaccaacactttagatcgatctttagtgccggttggagttatcaaccggaagtaaatatttctctcccacatctgatcggttaagtcccagacagatatttagataagattagaacatcccctctcttcctcttctcagatccaatcctcttcctcctctccttcctcttctcctcctcctcccctctcctctctcccatcagccggcccttcctcctcctcccctctactccctcttccatcagccgggcgggcggcggcgacgcgaccgcgaagagggaggaggcggcgggcaggaggccggcggcggcgggtggcggcggcgggcaggcggccgggccccggctcatttgcttttttttatataatttgtatttcactggatgtatatttttttttagattttatgattcattgcattgcatggatctgagatgtataatttgtataatctgtgatgtatttaatttgtgtgtagtcttttaggatttgtgatgtatttgatctgtgtataagtaacttaatatttggaatgttgatttggggatgtgcatcccattcaattcgggagaaaatatatggattaacactagccattagcaaatcaacagtaaaataaaaaaaaaaggatctcgaggaactgtcgattcacctcaccaaccggaactaaagattccccctctttagtcccggttggtaacctctttactcccggttggtgttaccaaccgggactaaagagattcgtagtctcggttgaaaaaccgggattacaaagggttctaaatcgggagtaaagagtatttctccaccagtgatacagtgtgggttggaatcccatttttccttgtatgtgtttcacacgtgtctaaatttatactcctgtgtgttagggaatctagataggtaatggatcataaggtaaaacgtaaaacggagggagtaatacatactcttattgtgaaacagagtaaattagttttcttcctcgtacactccgagaggtgaggcaagcatggatacataaaaggcatattcgtcatttttgcgtaaccttacagtcctgctcatggtcatgttgcagcacgataggtagtttggtacatgatcttcctgagatgtaaataacttgtaatgtacggagtaaataacttgcatatcatatgtaccattacaactcatgtctgtaaaaacatcctcaggtgagtcaggtcctgccgatcgatgctccagtagctcactttgccttcaaagcaacagaaagtgcgctctctgataataataagttgatgataccccatgcgttgctgcgggatatttgaataactttagtaaaaatataaatttataaactttgaacatgttgcattagcgttgttttttttgaaaaaaagaaaaaatgatatattgtgtaatcataataaaagaaaagctaaacaacaaaatagttatgaatccaattaatccataaatcaccaagaacaaaaaaaaatgatggtctatgatgatgtcgttcatgatttactccttgatcgatgaacaaaataggcaagacgtagctgaggagacccatactttatgaattatggttgatcatcacataaaagaactctataacaaatagttcaaatgaaaaaaaaaagctatcatcaaggtaattcacatataattttaggggatcaccaagtgaatagaatcagctacagtgtaaaatataaagacataacaaactacaataacatgatttttgatcaacagtgctacatacctgcaccaaaattatgccaaataatccaaaaggcttcacacagtgacagtcattagcaatgcagttgctggccggacatgagctgcatagtggcaaacctgcaatagtggcaattgagacaaaacaccaatctaatatctgtaaagcacggctatgtgcgaggcaaaggctggtattttattctattatatctaaaaatatatctgtaaagcaaccaacaatgaaaaatataaccaatgcaatacagtgtgtgttgacagaggaagatacctgctgccgtgcatgtgacagagtcattatctaacctgaagaaacaaaacaggacatgccaatactattccctttacgctagtgttatatatacaacatggcttctcgatcgacagtttccttgataattgtgtggatcagtggataacatcgctcgattttatagacatgaagcagcagaaattgaaggcttgataggaaatgtatagttagcaattgaaaaaaaaacagacgggaattcatgtaatcctccatggaataaacctgcaaagaaagtgaagtaatccaaagaagagattgaaaggagtgactttccactggcacaaatagtgctccaagggagagataaaaaaatagagagaaagaaaaggatgaaggtattaggaccattaaaaagtaaaaacatggatgaaggtattacaaactattcgaaaaatggcccaatttgcatcatatagattataaagagagacttacatatttagctggactgaggatgaacctacaataatggatatcatggcatggaaagaaacaacctcctccagtcctcgtagtcatccaggaagcagcagcatcaaccttcatacccacttctcttcttgaatcataattagcagaacaactcgcgtacgtgtcgttatataaaagaagatgagaagggaggagacgttccaataatgcaagcggtggttattggaaggtgaagattaaaaggcagaagtggggcagccagcgacccttcgctccctaccgcgggaggggctggactgggccgatcgagtactatagaactgagcagggcaggaaggacggcaaaaacaatctgatctgttaaagcagagcgatccaatggacgggaatagacagtgacgtggcaaagcgagagagcaggaaaatagatttagtggggatgacttgtataggtatataggatactcaattaaaccttcttatacttcacgcctataaaggtaaaaggtagaaaatatgctttaacgcctcaatttttgggacattagaatctattttagtaaaaaccttgattttaaaattttagatctttgtaagaatgtaagtgccaaaatctcagttaaaatttcgaaacaattacccctatccaaattcaaatccatgaattcggatttcttttccaggttcattttacaattcctccgaatcccaagtccttaaatatctacacacaaaaaaaaactctcccctaaactcctagatcaaatttaaaactttgatttgaagctctccattgaaatgccctctctttcttttcctcaaattcataccaatattcaagtctcttccaaaaatatccaagtattggtatttcagcccttctataaaatatttagaatttcatgagaacaaaatataaaattttgaatcaaatccccgtttcaaatctttcaattatccttcaaacaattcttggaaaaatctcaacattcactattcattcgggccgctcttttccttttctcccggaccggcccgctctctctctctctctctgtgtgtgtgtgtcttaactgggccaataataatttgctgggcccgtagttagtttgcccactgggatggatggtcaagatgtggccgtttcgaacggactgatatgatgatttcttcaccctcaagaagtattcctatactgtatagggggtcgtatactaccgtataactactagatgttgctatatagttactcctcctctcacccatctccccactcgatacacactttgtttacatctaaatttggcacctaagattaaaataggaaatattgccaaaatttggaagtctaccggttcctccgaagtgggccggtctgaccgccgtatgttgggcggtcagaccgccggttgagggccggtcagaccggcggtgtgtggccagtctgaccggcaggtccgagtccgactctgtttcgtcgggtctcgaagtttccttgctcaggaagacatgtttcgggtttcctttggtttctaccccgagttggacgtggaggagggcctatagagggcaagaccaacccctatataagggacatggccggttcattgtaagaaaccaatctacaatcaatcaatcgaatcgttttttatattgcttttagttttctcttagtttgtccatctttatcggtttgcaccgtaaaccgtccgtcgccgctgcgagagtgcgacatctctttgtcggtttgtcctgaaaaccttccgtttttcccacgagacgggtagctatctagaaatcggctccgctagccggtttagttatcaaaacccatctaggtttagctctttgctagatcgaggtggttggcgactctaggatcaccgcaaggtttaagatgctgcgatcgtgcttgtcaacttgtcaaaaaagttgccaacacgatttttggcgactccgctggggaggagatccgttcatcgtcaactcaacttcgatttcgccatgacgaagccgccatccaagacggaggtggagccatctaatgtgatgccagtcacattggatgacttcgaaggagaagatcgcaaagctatggaggaatacatcaatgagctcacacgggaggcgttgatgagagcaactactaggactcgtcaaggcatgatcatcaagcccgggccacgtcccaagctcactcccgacgtggtaagtaatgacgaggtatcacaatctatccaacaacaaattgcatctacaatagattcatctatggctaattttaaagatagattagatgtaatgtttaaggataaagttgatggttttttaaggagtaggctcgattcttttatggatgattacacattaaaggataaagcctataccactgttgatcaacctcctatagatccaatgggtagtaaaaccgacggaacggcgttcacggtcggtccgaccgggcctgacggccggtcagaccgcaacatagccgtcgatctgaccgtccagacggccggtcagaccgggtattaccccggcggtcagaccctgggccagtcagaccggcacaatcgtcccaattcaggctatagatccaatgactaatgctagttatttgtatcactttaaaacatttgatcctcctgtatctactgccaccactaatcctcaagttcccccacatattcctaatgcttataatgatgtttctagaggctatcctcccgatactatgcaaggccaatataatcatattgcgccacaaacacatcctattaggccaccaaacccaccgccaaatccacaagggcctaataacatggaggatatgattagtgatattatgaggaatagattcgggattgaaactaggaatcatgctagagcttacaaaaagccatatcctgattattatgataatgtgtcgtttcctcgaaattatagagttcccgaatttgccaagtttagtggtgaggatggtaagaccacatgggagcatgtaggtcaatttttagtgcaatgtagtgaggctaatagtgatacttttaaattgcgcttgttttctttatctttatccggtaatgcttttacatggtttacttctttaccggcaaattctattcatacttgggctcaattagaagaacaatttcatgattatttctatactggggaaactgagcttaggttatgtgacttgacatcggttaagcaaaagtataatgaatatgtcattgattatattaagagatttagagatgttagaaaccgatgttatactttgaatataactgatagagatttggccggtcttgcttttaatggtttagttgctcctcttagaaaaaaactagacggccaacaatttcttgatgttagtcaactcatgcaaagggctctggctcaagaaagccgggctaaggataataaaaaatttgctagaccatttgacaaaaagcctaatgttaatgtagttgattaccctgaggctagtgatagtgaggaggagggtgatcatgatatttatgttgccgaatggtcgtggaataataaaaataagccttttgtttgctctaacttaatgccgactcctcgcaaagatcggcaaagtgaggttaagtatagttttgacgtggccaagtgtgataagatttttgattaccttttgcaagaaaaacaaattagattacctaaaggccatgtcataccatcgcaagaagagttgaagcgtcgagcatattgtaaatggcatgattctcattctcactctactaatgattgcaatgtgtttcgacgacaggttcaatcggccatagatgaaggacgattgaagttcaccgatggctccaagatgaagcttgatcatgatccttttccggtgaatacaattaatttcaatgataagaaggtgttgattcggccggagcaagccgaatctactaagggaaaggaagtggtcattggtgaaccaagatcaaagatgatggtgccaaagaagccggaggttggtgtttggaaggagaataagagtggagcttcaacttataaggctcctaggaagaccaaagtgacctttgatatgcttttggagaaatatgagaggcaaggtggtgagaaaattcgcaacaaagggaagagaccaagatcacctcctagggaacgatttggtcattcaccaagacggtcgcattcaccttcatatcatcatccacaagacatgtcatggggtccctatccgatgccgccgccgggttattcttatccctacttcatgccatggggggcaacgccgccaatgtaccatcatatgcctccaatgcaattcaaccaagggtggggaggaccaaggaggacaattcatgagcgtttgtcttcgccaaacaatagccggttctatggtaagaatcgggctaatgaagaaaagagggaaggaaagcgcgttaaggtggaagagaggacttcggaagtaattactatcaaagtgggtcccatgatgtgcctatacattctgtagatggagttggaaagtccccaagcaaaaaatccgaagccggtaccagctcctcgcagacggtcggtctgaccaggccctctggccggtctgaccgcggccatgttgccggtctgaccgggccatcaggccggtctgaccgtcgacccgatagtggtccgaccgacgcctcaggctggtctgaccgtgtgccacacgtcggtctgaccggcgcgactggccggtctaaccggtggtctacggccggtctgaccgggctccagcgccggtttgatgagaggattgtaaagagcgatgtgagggcttcatcattttcaagcaaagtcaatagaggacattatttacctcctggaacagagccgaatcctaggtggatgcctaaggatttgacggctactcaaaagagaaggttgcaacgtcttcggacccaagaactaagggagaaaaaggccgaagatcaaagggataaaaggttcaatgagttgcgaccaccaccgatatggaggcctaaatccatagagaaggcaaaaccgattgatgtacaggagaaggaagaacaatcggttgataaaagtgatttatctccaaaagaagacatgtatataaatatggtatatatgttgcctatggagttttgtgctatggatgaagccgaggttgctcaattctcattaggtcctaaagatacggtttttgagaagctcgatgaatcaaaccatcatatgaagcctctctacctcaaaggccatgtggatgggaagccggtctctaggatgctagtggatggaggtgctgctgtgaacttgatgccgtactcgttattcaagaagttggggtgcgaggatgatgagttgaagaagactaacatgattctcaatggcttcaacggtgaaccaacggaggcgaggggtatcttttcggcggagctcaccgtgggaaacaagacgctaccaaccgctttcttcattgtcaatgtgcaaggtaactacaatgttattttgggccgttgttggattcatgccaattgttgtgtgccttctaccttgcatcaatgtttaattcaatgggacggcgatgatgttgaaattgttcaagcggatacatcggccgaggttgcaatggccgatgctacttttgagtggcgtcatgggaatatccaatgcttatcggggagggatctttctagctatgattttattagtatctctgatggcaaatttgtacctatctctgtaaagccggctagtgtagcacggctaagccatataaatttgtataacgagtaaagaggctaatttagagtggttacaaaaaagggtgcaagaatatcggtctacaaagaacgatattggagaaaccgttgaagattttgatgaagtggagaagcttggacaagggtttacatcggccgatccattggaagaagtagacataggtgatggaactaaaccaaggccgacttttgtaaacaaaaacataagagccgattataaggttaagataatcaagctacttaaagagtatgttgattgctttgcatgggagtaccatgagatgccgggtcttagccgtaagctcgttgagaatcggcttccaattaaaccggtttttagccttataaacaaccacctcgtcgttttaatcttttactatatgaccgagtcaaagaggagattgatcagttgttgaaggtggggtttattaggccatgtcgttatgcggaatgggtttctagcatagtcccagtggagaagaaggggagtggtaagattcgagtttgcatagattttagagatttaaataaagccactcccaaatatgagtatcctatgcctatagccgacatgatgattaatgatgcctcgggtcataaagtgattagctttttagatggtaatgccggctacaatcaaatctttatggcggaggaggatatgtacaagacggcttttaggtgcccgggatttgttggtttgtttgagtgggttgtcatgacttttgggttgaagaatgccagtgcaacatatcaaagggcaatgaatttgatctttcatgatttgttaggtattatcttagagatctatattgatgatattgttgtcaaatcggatggtatggaatgacacatagcagatttgaggttagcttttgagaggatgcgccggtatagtttaaagatgaacccacttaaatgtgcttttggtgtgtcggcggggaagttcttaggattcatggtgcatgagagaggagttgagattgatcctaagaagatagaaaaaattcatgatttcaaagtgctgacatgcaagaaggaggttcaaaagttgctgggtaagtgaattatttgaggaggtttatttctaacatagtgggtaaaatcgatgcttttgttcctatacttcgcttaaaaaaggaagccgattttacctggggggcaaaacaacaagaggcgtttgaagagttgaagagatatttgtctactccacccattgtgcgagcgcctaaagccggaaagccttttcggttatatattgcctccgaagacaaagtcattggtgccgttttgacgcaagaggaagatggcaaggaatatatcattacatatttgagtcgccgtcttttggatgccgaaacgaggtatgtctttatagaaaggctttgtttatgcttatactatgcttgtaccaaattgaggcattatttgttatctagtacatgcatagttacttgtcaagccgatgttattaaacacatgttggaaaggccaattctaagtgggagaattggcaagtgggcatatgctttgatagaatatgatttggcttataaaccattgaaatctataaaaggccaaattgtatgtgattttatagtagaccatcatatagatgttgcttatgagggagaggtttgcttagttgaagttataccttgggagatttattttgatggttcttcttgcaaagaaggtcaaggcataggggtagttttgttttcacctaatggcatgtgttatgaggcatcggttcgtttagaatattattgcacaaataatcaagccgaatacaatgctttattgttcggcttacaagttatggagatggttggagctaaatatgtggaggcctttggtgattcggaattg

SEQ ID NO: 58846 - DNA, 12111 bp, Oryza sativa
ttaacaaatgattggtgcttgagcttgacacacttcgtatctaggcaggtgtacagtcgaatgacctttacctttttccttcaaccatgtaattacataaaacattctatcaaaagaaccccattccgtatcctctaaaagaacaggtccagatctttaaagacgagcgacttctccttatcgctcctctgatcctctcttctgactaaattgcagataactgtaccttgaggtcttgacttctagagttctacttctactgttattaccatgctactgccaaaactcaaggggaaccaaacatgaaaatacatacagacggcagacaacatagcaacatttgcatcaaaggcaaggccgcaagtccgcaagcttctgcccaaatcaaccaaccccgtttgaggaatgtttttctgtagctctggattatctttcatcatgaatcctgcatttttgtaaagaataggccaattagaccccaagtaaagacacaaatgcatgatattaaaatgtctactgacatgataaaaatgactattcatcatgtattcatgttaaagataggatattccttgaaaatatgttaacgctacacacaacatctgttaggtaactttctttttttttgcatattaattaactattaaaaaggaacatagtgttgccatgttcatgtctggaaatttaagcatagggttccaaaaaggaaacaatttggaaatgggctaaacgtacatatcctcttaacagtgatgcttagcaatggaatcagcggttcagcagtagtagttcccgaatagagattaaatgaaatcacaaaaacaataatatatgactcgaaattcactgcaagcattagcttttaccactagacccttgttgatgtaggtatttattttttctcatttgctaaacattaatttgcatggcatattaccctttgacagtgccgatataacattttatcacagtgacctcagcatgacacaagtccctcaggaaggtgccaaggtgacagcagggagtcagggaggcatattcaacagacctgaaatacacagtggtactgtaaaataaagaaatgaaccaaataagaaaaacctttaaccataacatgcctgagctttgtgctttaccagatttcatgttaagactgtatcctgcatacttttgaaaacctcacgtacagatgaaggatctatatcacatctaacaccctcacctccatacagcacaaagagatactctcttgatgacattggagggggcaaaaggtcagacagctccactagatcttgtttaggtggtaaaggaatatccctttggttcaatgaataatacacatcggccataagaagccagacaaggtcagaatcaatagaagcaattcccgtcaatgcccttatagcagcttctcgcaggccgatcaaaccactataggcaattcccaccacaagtccacaaaccttctttagtacacttcccagagcaatagcacttcgtttgttggaagatatttcagcgagcatgtccagcactgcaatctgaatcttttggctggatatctcagccataggctcctcggatgtaagtgaggtattcctatatggtaaaataatagctttctcatccatcagtgccattctttttcgttggaagggagataaggttagcaacctccaaataacagatccatccttatgaaaccggcgtacaaaaaaatcgcctccagatatctgaatgactttacttaacacctctgtgcattttctgacaacagactgcaaataccataataatgtaagctataaggataacatacagaaggaaccaacaaggcaaaaatagatcaaaagcatgcatacaaagtaaacaacaagaaaatgaaaactccctattttagcatattcctgatacatgttttccaaaaaaaattgtatagggcccacttcatgcacactgtttttagactagtcagtccaaaagcattttattttatgacagaagaaccaattaaaccctcaacgatggcaacaagtgtacgagtgataagaagaatcagtatatgacaaagttataaggttgcaacttcaggtggtgtttggggcgtattgtatacctaaatactcagcaacatgtattgcatccatctgattattgatcaataaagatgatcaagaacatggaaaaaggtctggcagcactatgttctgttctgaaaatgctgaatatagttgtaatctgtttacttcggaatttcttatgcaaacttgtatctcacagagatgcaaatatattgaggcattggattatggatcaactccccatggcaagtcatcaaacaagatctagaaatgcctaggtgtcatttaagaggtgaagttactgaatgaggacaggccccaaaataacaattacttcctatgtttcacattataagatgttttgggttttgaataaattcatgcatgggttcatgtatgtaccttcatatatgtgtctaaattcatataaatgttagtgaatctagacgagggatagagatgccaaaatgtcttataatgtggaatggcgggagtagtaacatactaacatgtcacgggataatggaagtattggtaaagtatttgagtttgatcacacaaaagtacctggattcacaagcaactataggacccttctaatccaacaaagtaaacagtgaaaagaaaattacgaacttaaaaagaaactatggtacagtcaactccaactcccaaagtccaatgtctgattatggtaacaaatattgaatttgtgtgaaattataatggcatatttccaaatacatgaataccagtggcatatttcaaaactagaaattttttaatggtatgtatccaattaaccctttgttaaaaggaaaaggcaggagttttgatgttctctatattgatcgtgttatggtttcagatgctctacagatcaagagccctcaatattcatttcgtgcaagtgagacatgaaacaccaacaccaatgaatgaatgtaagcatctgtttaaataaaaaaaagagagaaaagaaagctaacaatctttttgttgcaaaccaatgattaacagcatgcaagaaattgtaccactgagattttgttcccaagacaaataaccaagtatggccatagcttgttcacagctgggagtagtctattctcatcaacatcttctgcagcatccatgtcatcatgaagttcatccactgataataattgaattgtctcctcaataactgctttgcatcgactttcacacttataggcttcctcaaccttggctatagacataatagcattctggacaaaggaatttttttttaatgtaacttcgtctatcataggctcatagcgaacttcatgccaggatgaatgaaaagaactcaagcaattattccttataattagcattaaagtgttagcataaatgcagcataccttttccttttatttactaccaaatgacaacagaaatggagatataagggctatgggcatgttcgttttgatgccaaatttaaccataccaaattttggcaatgctctgtggcattgccaacttttgctaagctagaggtgtgtgaaggtatgtttgttttgatgccttaacaatttttggtgtcctgttaggtaactttcttgaatcaccaaattttggtatggaaagtcatttgggacgtttggattgtcacgtcgccaaattttggtaaggatgaaaacagtacaaaataaaaaaaatgctccctatttcaccagaattagaagaaattttcttcctagttgaaatactttagagcttgacatttcttgtgagaaataatggaagataggtcaagatatcataatatcattttttgaaaaaagaagtatttggaacgccatgaaaagatgaccaaaaactattgttagacgaagttgtaggagaattatattgacattgcaagtaaaatatcttatgaaatggaaccaaaaccttgtctacattagcaggggaacaatacctctacaatgtcaagggccacaagacaagctgcttcttttgttgaagatagaagtggagtggaagctactacacaagagccaacaagagatcctactattctcctgtatcttctcatctcatttagtttgcaaagtagatcctcccaatattctaatcccataaaatcaggctgagcatcaacatccattctttctgatgcaatcgcaaagagaggttatgagatagggactacacgaataaaatattgcatagagaagtcagaacaggagatgcatgcaatatttacttccataattattatattgctacctaatgtagaagatattgtaattaattattaaacttatcaagctattaccaggcattgcacaggtatccctctcttctctatcaaactttggattgcttcaccttccgatctaaccttcataaagaatgattccacctcatctggcaaactaacagattcatgtcgagatgccttagcaacctcagaaacagcctagagaaacccaaaaaagaaaggggaaaactggctctgttagacgggtaatttaagtaaagcgtaaacaaaatatgaccccaataaagttatccttggtgtaaaagatcaacttagcaatctaagaaatgagagttaaaatgatcagaccagcgagaaattcaaatccccttaaagtagaacaatagacagatacaacatgttatcacttatcaaaactttattttttagtaccttcagaaatggaacagttaaatgcgggtgatcatgcctaccaagaacctccagctctgaagaaacagcacgcatctgcaagaataaaaatgtattgacacagacattacaaaaaaggcacctgcttcaagtgcaaaaggacatcaaaatttgttccgattaaaggataacatttgcccctttctaccccatactaattacatcctcttagccatatattttaaagtgctctgtaaaaataagtgtttccacttttcagagcaaataagggccaaccaatttgactggttcagcaattagaacaacagatgttgggcacttctcttacaacaagactgtttttttaaaaaaggaatatacaaagaatggattaaatggatatttctgattctgagattcatagccaccctaatcatcataccggttcttccaggaatggtaaaatgtcacgagaagcaccaatataacacagcatagaagcaagaatatcagggacgtggggattgagatccaaatggtgcaactgtctgcaaagagagtcaacaatgtagtcggcatttgccacaacaaattgaccaacctgtacagggaggaagaaaaaacataaatgcaaagtccagaagataaggaaaaaaaaacttgcaagaaataaggccatgtattaccgaacagtaacctccagcagcagcgagtgctcttaagacagcatctgaagcaattcttatctgtacacttgagctgataagttttcgaagcagaagataaagtgaagagtgcataaatccactacttgcaaaatcttggccaagcacaacaccaaatactccaattccttcaatcattacctgataaaaaagatcaaaaattgagcttgagcaaacaagacagtccagaacagaacaagcaaaaggagaacttttgaaagaccaactggcaaattgtaagtgcatattacttggtgcaatgcagcagtatcacgaaagaaatacaagggaatattcaactctgttagggatagttcagagtccggttctgttggaagatcccaaacttctggtgccatatattcatgcagaatacttccgatacaatgaataatgtggtttttcgtgcccatttgctcactgatcttccaaatatttctgttagtgcctccattattctggccaaaagcagttaactgatcattttgaccaggtgctcctatcatctgtgctgagttcttgttgaatatttgtaaacatatactgagggaacgatcagatagaccatatatgagctcattgagcatgcaaacagcagagcttgcctggcgtagtgtttgcccagcatcacttttcatgtaccacctctgcccaccactccgcagctcagtgctcaacctcctgaactgatcaagtaggatatcaacaaagagagacagtgatgcactggtttcttcgcctagtatcatcaaaagcaaccaaaacataagattcaagtaccatacgtggcaccactggatacaaaatgcaagactgagattaaccctaaatgataatgttggcaggcatacaacatagtcgagaaagtacctgaaactgccgatagaccaacaagcctaacaattccagcaagagcaaaataaagcttctgactattcacgtgaacaaaccatggaggtacatggggtaactcatagtcaactgaactatgtgttgtatttggcaaaccattatcatggataacagatattttggtggctgttgatgcaggcatggcatgctgaaaaccatagttttcatctttaggataggcaccactttttaactcagcaacagaaaatagatatccaacagacagtggctttgaaacaattagcttgtccatggaaccagaaaattgtgaactttgactgatacataaacccaaacagtcaaataaacgagctgcaacaacctgaaagtggaacaggataaagttaaaagcaaaagaatcattgatccaacaaaagggatgtagataacttacaggagaacggtgaagataatttgccaaaaactgagggcctgcataataagttagagctagtagtcttctagcatgcgaaatagcagtggtctcctcactaccaagtaccatttgtggtaacttttcaacaaacctgttttacatgtcaaatggttgagaactttacccaaactatcacttgtgttgttaacacagagtaaaatagaacgaacctggtaaaaatatcagaaacatcatcttctgttagaactctctcaccctcaatgaaaagataatcaagagagtcttgcgcagcctcagacacagatgctgcatcatcacatgccagaatacataagcattcctgcaaccatctttgagaagttaaaaataaacatatagcataattctaggcacaacacctcaacaagtgataaaatatcatatgtgtacttaccacaagcaacatcttgcttttccttagtgtatagctgcagctggacaaaaggactcttataccattaaccaccgacctccttactttctcagatgaatgaatagaaagctgcaaaaaaaaatagctctaatattcacttttgatggtccaaataaccactcaaacactaaataaaaataacagagaagaaaaatactggcatacatgtggaaatgtcgcagagagtaatttatcaacattattagctgtttcctcaagccatttttttgtccgtttaacatgcagttctcttctatcagcagaggttttactgccatcagcgttcacatcttctgtagcttcaccactgccgatctgcttagataaagttttggccggtaattggcgaagcatctgcaatacatgttcactagaactattgccaccagaacaaagagccacattctcaacgctggaaatatcaagttcactcaaattctccttgtcatttaggactacgatcaaggcctcggtcaatccaagaacagcttgttcaatgctcaaagcactcccagcagcaccacttatcatattcttagatgtgtaaagaacctttccaagacgactgacaagtccaggaaggaaaaaggcaagtgcatccgcagaacctacctaaacaagaagagtaagtttactgaattgtttgtacaatgggaaaacaaaataatagcctcggaaggagtcatgccccagagaaaactaaaacctctgtaacatgcttttacacagaggtatcatgccctaaagaaagataatggatatactaagaaaaacagtgaggctgattcttgctatgaatcagaggaaactgggtatctatcatctctgaaggttggtgtatctaacatcagttcaatatattttattctctctttttttaaaaaaaaaaagagtaaaacaactagccttgtcatcctctcaaaaagaacaaaaaaaaagcctggtcattatgccaatgcaacagctaaacagatactgctggttttttttagccttcatcttttcatggctttacagttctgcaggagaaatgacagcaaagaaaaatgctaatcgacattatgattaagcatttcctgaacaacacaagtgtcttggctagtgacccatccatgtgttgcttgcaaaaaacttctcaccttgccaataagaacacgcagtgtaatcagtgattcttttctaacatctgcactgccacggtgaccccttgatgcctcaagttctgatgactgaaagtgaaaggtgtcatatcaaccaaaaagacaataaaagaaaagaaaaatcaagtgaatcagaagataaaagtaaatgaatgatgtacctggagaagtagtgaaagccagtgccccacagcagctgaagcgttttgggactggaggaacgcaagcaagcactcttctggttgtgccgagtattttggggtaactatagtgccaacttccaaacttgtaaaagatagggctgtagacaatgcagttgcttgtttgcaagaacaagagcggtccaagcatgggtgtagctgcagaatcatggctctgaagcatcttatgatgccttggcggaattcctctgaagcctccgaaggtgaaagcattgccccgaaagttaacttctttagcaatgcaaccatctagtaaggcaaacaaaaagaaactcatgtcaaatatgtgatgagactcattaagattaggatccaggatttcagaaaagttctgcctgccatgagctacacagcacacaggaaattatggtttcatactgtcctcagttgttcgagatcaattgtcagataaaataatacacagattggttaacaagttattactaatgcagctaatgtgtacaggttctagttggagatgatagaatattaaactagagaatcatcaggtatacggaagcagagaaaaaaaaatgaagcacctgattgaccgaggtgaggcggcatttggtaaggagcacctctaggcacgcaagaccgccttcggcgatggcatcaaagatgtggagctcccctgacgcattggcttccttcctgcattgcaccgcagcatccaggagcagcaccaatggaaacacggtgtaattaggcacccaacacagctccaaacaagccatacattagcacaaccaaccaaataaacaaaaaccaacacgcgcagacacttggggcgggggagaggagaggagaggagtgggtactcgaagcagagctgcaaggccggggcgggggcggagcggaggaaggaggccatggcgcggagggaggaagccgcggcggacttggaggccggggtgcgggtgcggatgaggtcgagaagggtgacggtgtggggcttgagctgagcaaagatggcggctagggtttcgtcggaggccgccgcggccgcagcagcagcagcctccatctccatctcggaggtggcgacggcgaggaagcttggctgcgggaggtagcgcaaggactacagtcgagttgctgctgctgcgttggtgcgactgcgagtcgacaactcgagagacctcctcaggtttcgtttcgttcctctggagaagacgacacccacaggccaaaggccaggaagcgtacttcgactttacgtgtacatgtatggcaaacggtattgtgatttccgcatctaggcctcgttggcatgggcttctaccccgggccatctacgtgtacggacggaataatagtaaggaataagttcacttttgatcctcaactcataatattggtgtaaccaaggctccatcgtgtccagttttaactgacaagacaagttagcgtatgacccatgtagcctccgtgtgttagtgactaatcttcttccttctctctaccattctcccctcttttgcctatctctctctatggatagtatattttgttgttaattattatgtcgattatggaaagattagtgataattaaaatatttttttgttaattaaaaatttactgttctcatctcattctctctcatccagccgactaaacaaattagttgttttcctatctagccaatgattaagagataacgtttggatgatttttgtggtaaatttgtacaaagacaacagtgtatagtagaggtagatcctgccgagtcctaaccaatacactccagtagtaaggtagaaagaaaaacatacagatggcaggtgacaattaacaagaaggtactactccagtacaattgtacggctgtgatctttagggcctgtttagttggaaaaaaaaacctacataccacatcggatatacggatatatggacgcacatttgaagtattaaacgttgtctaataacaaaaattgcagattccaccaggaaactgcgagacgaatttattaagcttaattaatccgtcattagcaaatatttactatagcaccacattgtcgaatcatggcgcaattatgcttaaaagattcgtctcgcaatttcctgacgaactgtgtaattgattttttctacatttaatactccatgcatatgtccacacatttgatatgacagcgtgggaaatgttatttgggaactaaataggcacttagtctactactttcccaacttcatatccctcgttttttcattatatgcatgcttcccaaattgttaaacgacgtgtttttaagaaaatgtagaaaaattgctttaaaaatcatattattctattcatgaattttttagctaatacttatttagacatacgctgaaccgtcatttcgtattgcgtgcaatggaggaagtgttcacaacttcatccggctcagccgtatcaagccagcactacatacatatggtgcaggaactctgtgtttagatctatgggcgtaaagtttagatatacggacatatatttgaagtattaaacattgtctaataacaaaacaaattacagattctgccaggaaactgcgagacgaatttattaagcttaattaatccgtcattagtaagtgtttactatagcaccacattgtcgaaacatggtgcaattatgcttaaaagattcgtcttgcaatttacacacaatctatataattgttttttattttatttatatttaatactatatacatgtatccaaatattcgatgtgacatggtgtaaaattttaccagggatctaaacaggcccctactccaccaaaagagcacaaacatggtaacactaacaccccccgtgctgttctacagctgtaacaaacacatacttcctccgtttcacaatataagactttctagcattacccacattcatgtctagatttattaacatctaaataaatatgggtaatgctagaataaatgaatgtagacaatgctaaaaagtcagtacattataaaacggagggagtaataaaaccaggaatttacacttggcgcgtacaaaacggggaaagccatgctggcaaattcattccttccttgcatacacccacagccaaaaggagttacatgtaaatcttatccccttgggagtatttttttcccccttacaaactggtcccctgcagcaaatgcaaaaggccacccagtccaggagtccaggcaggcaaggcagaggcacacacacctcacctatccccttcccttccgccgccgccgccgccgccgccgccaccacgcaatgcagcgcctctccgtgggatcggcaggcggcaagccccgcctcctcgagggcggcgcggcggcgggggaggaggaggaggaggaggagaaggccgggaaggcggggcgggcggcgccggacaggtccatccacatcatccccgtgctcacgctcctctgcttcctcgtcctcttccttctctcccacgacccggcttcctcctccctcg

SEQ ID NO: 58847 - DNA, 1518 bp, Oryza sativa
gggtgtagaatagttattctaagggaggggtgtataatagagctactcgtatatgtatgtatgtatgtacatatatgtatacatatatatacatacatgtatacatatatacatacatacatatatacatacacacacacacacacacacacacacacacacacacatatatatatatatatatatatatatatatatatatatatatatatatagagagagagagagagaaaaactattctacacctgggtatagattagctattctataccccctcctctcccaagggccaaacccacctcccacctcagtcaaaggtcggttaaaagcatcccagttagtcaaaccacggtcaaaccacctgctaactcctcccaccacccacctcttctcagctttgtctcgcggaacgatgcagtaacgcgacggtcaacgtgcagtaacactacgtcttatgcatagtaacagcgctcaaatattgttaaaatatagtcatgatggatctagttttgataagcgtttttttctagcatcatggtgcaaacgattttaaaaaatagtacatcatgtgagagataatgttcttcaaatgttggcttttctagaatttgactctccacaagtagtaatgctataacattacttgttactattgtcagttgcacgttactacaatcccatcgcatcgttactttaagagtgcagtaaaaattataagtttttgcagtaactgtgttttactacattttttcgatagtgttactgcataaacatatggtaacgtgtacctgcctttgtagtaacattccacttttgtgtagtaacaaatatatttagcatgtgagacattaacccatatatccttcacatgcagtaacactatagcatcctgtgaaaacggttttaaaaataatacatatcttgtgagatattgctttttaaatattggtattttgaactttaacactccatatgcagtaatagaatatgtaatttgcagtaacatgggtatatacatgcagtaacatggttttaccaaatgtataaaattgttcaaaacacttgtacatcaatcagacctcactcaaagccacctacaaactttacctatagcccacctattcgatcttcatctcgtaaaactgacgtagtaaaattacgattatcgtgcagtaacataactacttggaagtggtaacatgcacctattatgtagtaacacttctacttttgtgcagtaacaaatatatggctagcatgtgaggctttaacccatatatttttgttttgattcctggtctactacaattttactacgacgttactacaaaagtgcagtaacgtcctatgtgttctacagtaacgtcacgtgttactatacttttacaacaatgttactactggagcatagtaacatgttatgagtttcggtagtgaaagatattagaattaataatcatattactttctcataaaattcttaaaacaaatagcatcattagatgaattggttagaa

SEQ ID NO: 58848 - DNA, 637 bp, Oryza sativa
cgagatgtcgactagaggggggtgaataggcgatttaaaactaaatgacaccaaatcaaaactaacctaagttgctaggcttggtgagggtcaactctaactaagcaactaagttatgttttgcaaatctagggtgatagaggctcaattatatctctacgaaagtaaatcacactcctatgtcaatgtttagcaatcctagggtgatatgatctcaagtttgtctctagaaaagtaaattgcacaaaggtaaatgcgacaatcaaatgagacaaggagacaagagatttttcatcgaggttcggaaactcgctggtttcctactccccgttgaggcgagcccaactccaccactcaaccacgaagcctccgcacgccctcttcgtcaaggggtgggcaaggcgggagccagcccacggagaggactacccaagcctcgatcactagggtagttctttcttctctccgaaggtggtgaactccaaaccactcacaaaccggcaccgggcctcctccacaattatcacgcccggaatttctatccaaaattccaaacgcttacatgtgtgggaaccctcgtccaggaatcagccgaggcacacaataacaaattgataatagagtacaaatattactc

SEQ ID NO: 58849 - DNA, 813 bp, Oryza sativa
aaaacctttttcaatttaaattattttttaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaaaaattccatttaaacaacaatttatatattttgaattttcagggtgtgacaaacctacccccttaaacagaatctcgtcctcgagattcggaagaactggcgaacagatgcggatgagttgacttcaattcatcttctcgttcccaagttgattcttcttccgagtgattactccattgaactttgcaaaaacggataactcgattcctggttcttctctcatctatttccaagatacggattggtttcttgtcgcgaccgggaaaattgccttttcccgaacgccagtgtattaatccccgtcccaggaaaagccggggtacaccatacaaacatgatataaaagacacatctttattatatcgataatatttacattattacaaaggcgcttcaggcctgacaaacaaaaataaacagcagcggactagcgggcctacggctccatcttcacaggcgctcaactggggtataagccaggactccacctaagacatcttctctgaagcttctcttactgaaggggggagaaagatagagcaagaatgagtacaaccacagtactcagcaagtcacaccggcagatgcacgattaatgcaatgggggtac

SEQ ID NO: 58850 - DNA, 15034 bp, Oryza sativa
caagatgctaataggccagtagcaattgatgcaacttaataaaagcttccttctatgtaaaagaaagaaattgatgcaactcatgttacattttactttagtctgaatcaatatatctgaaattttgaacagaacatactccctcatttcaattgtccaccaaatgcaactcaaactcgaaatgcttggcatgctggcaaacaaattatgttttattaagttagtaactgttgaagtattcttgtagacattatacaatttaggagcaaggaagtttgcagtgatcaatgtgccattactcgggtgctgcccatatttgagaagtcagaacccgaccggagagtgcttcgaaccgctaaaccagttggccaagagactgaacggcgaaatccgggacctgttccgtgacctcagctccgaaatgcagggaatgaagtactccattgccagctcctatgaacttatctccagcctaattgaaaatccacaagctgctggtaagttacctcagtttaagcaaagagtaatatgacctggaactcacacctcaaacattgtcacagttctacttagcatgaattgaattgtaaccgtctacttttcagctatatctgagatctcacagacttgctgattgatttcagggtttgtagaggtgaagagtgcatgctgtggtggtggtggcaagttcaacgccgaggaagcctgtacccccagctccagctgctgcgctgaccgtagcagatatctcttctgggatctcctccaccctacccaggccacctccaagattgtaggccttgccttctatgacggggcagcacggtttgtcagtcccataaccttcaagcagctggccgacgcatagcatttcggcatcagaactagaacttaggattcactagaccaagacaatgcttgtatcaatctacagcatggcaaagatgctgaactatccaaagaccaaactatctgaaaaacctacataagagaggtgcttctcttatgctttaccctttgagaactgcagaaatggtgacagaacctgtcctagttttctcatgagtgtaagtaaaaatggttgctggttgtccccattaggtgattgatctgtgctctcctcatccaccggagagctccagtcagtggccagccattgcttcaccctgtcgcgcttggcgacaagccggcctttgttcctcatggacagcctcagggggctccccatcctgctcagaacctcctgagccagctccctcaccttgggctcacctctgacatcgctgtgcttgccaatgccacacaccactgacacctccaatggcaatgcgcggcgcgccttcatcgcatccacccactgcaaaatcaaaacataggctgcaattgtgctgaatccatggaggttcagcttcacctccgactccgaccaatccatcgccttgtcgagcaccgaagaggatgtcaggagctcctgcaccagctcagcttctgctggccattgagatgcagacctgagcttcttgaccaactcagccgttgacaatggcagtgattcccccaattcttgagccatcgaagctactgttgggcatgagttgagcacaaagttgaaggccttcgtcgtcggcgcaatccgcagcttcctcatcctcctcagccatgccagcatcctggaatggtcacggcaggaggtgtagcacgagagcacgatgttcgccgcgccggtgccgaggcggatgccggcgtcggacatggacgagatcaccctctccatctcggccatggatcccgccttgccgtagcacttcgccaccaatccgaactggaacgcctccggctggtgcccccgagacgccatctccctcagcgccgcctccgcctcgccggcgaggcccatcaggcacagagattttatcatcgccgtgtaggtcttcttcccggacagcggcggcgaggctcgcagctgggagtagaaatccatcgcccggtctcgcatcccgcgggaggagaaggccgccatgaggtcgcagtagaagagggacacctcctcggaggaggaggaggtggagtggaggcgcgagatggagtcggagatgagggatcttgattcctccgcgctgccattgctctcgagcagcgcggcgacggcggcggcgtggatggagctccacttgaaccaccgcgcctgggtgaccacctcgtagaactgcagcgagaaatcaaatcccaccccaaattcgtgacgcgaaatcggcaagaaatcacaagaataatttgggacgcgctcacgcacgccgcacgcgcaccgggatggcgaaggggtcggagtccatgagcaggcgggagagcgcggcgagggcggcgcgctccgacttggaggcgacgtagctgcggatgacgcgctccgccgcgccgggcgtcaccgtgcgctccagctccgacatgagccgccgctcgctccgccagctcgagccacctcccgccgccgcccgccgcagggacgccaccgccacgttcaccctcctccggcccctccccccggccgccggcgatggcgccggggtcgagagcgacgccgccaccgccaccgccatggctggctgctgcgctgctcgcgagcgacgcggttggcgcgtcacaagatgagacgtcttatcaccaacgggtacacatcgcaaggccggcccagtaaaacaattcagcccaaataggcccaccacatttggattagcgacccaactggacccaccagtcaagcaagcttcatgcatggctgatggggcccagttcgttagcaactgatgcagttcttgtcacgtttgactttattctgaaccaaaagtttatctgaaaaatgtgagctcattatgtataccctcattttgaaattgtgaacaaatcatacaccctataccctcattttgaaattgtgaacaaatcatacatcctcattttaatccacgagatgcaaaagatgcagtcgtgcaactcaaaactgatcactatgatgatggaatgccaaaaatttccaaacatgtttttagcaagggaacaattatttgcatgtattactgtgctcgaatttaatgattaatcgtgaagttttcagtttttcggcagaagatcaccaacttttgtgtaacacgctccactttcaacaagatgtcaaaactaactggtagaatataatgcagatatttttttaaaaaatataatgtatagaaatctggcctctacgtccacaagccacatccaaaggttatacgaatatttagattttaagtctcgtaacgaaacgcagataaccttggaaaatataggcatacactacaagattttcatctacaacataggaggagaaaatcggaattcagacatgaacaagaaaacaggatcaatttgtacaactcttttcagcacattcctttttctatacttgttctcattaatgcaacaaaactagaacaagaaaaacaacagcaaaagaaaccaaaaagctgaaaaaaaaactaaataagcaaaaaaaacaaagctgcaacaacgtaagaaatactttttttttaatcactgtacaccacaatgcgcttccctcttgttgtgggatgctacaattgaatgatgcaccaacattgtataagctactttcagtggtttctcttcaatgctgaaagaaatcctgcctttgatttctggcgaccctcggtatcagctctcacctgtttttttaaatcaggatattaaaacaaaatttaatatatatttttctggagcatgatattgaacatgaaacaaactaaaatttcattgagcaaatagtttctgtttttgtaaaagaacaaaatcttgagaatttttaagaaatgcatgataaattgatgagtcgaggtgcattagaactgacctctttggggagtctctgaagaatctccagtatctgggagaagtcaggcctttcagcaggatctctatgccagcatttctgaagcagctcagacagcttggggtgcgtatctttcggaattgttggtctaaggccctgcagaaaatgatcaaaatacacatgagtgaaccttaattttgtgtagaattgttgtaaataactagcagctctctgctacatatgtacaagttaaaatgctgtcttgcaactcttttagataccaaaggcaatctcctatcttaggccttttatccaaaaaaaaggccatactttatgaaatcaagcaggtataccgtatatatgcatgtatatgaggatatagataaatatgccaataaatttccatgaaatttctaggtatgtacagtgtctctaaaggacctatattctcttgaaaatacttgtcttttcaaactactcctacttggcaatcacggcaactatttcatttacaatcaaggttcataatcattttcatatgcaattcatagcactttctgctaatggtaagaatctatgatgttaagcagatattatatgtgaccctacaattgagggagctacaatgacgtgacttgacggaagtttgttctacttcatctcattcccatgagcatggtaacctgaaaacctaacttgcacctctaatcaggtgagtgattagtaggatggacacaaagggaggcaatcgcatattaaaagaatggtttcttgaaagaacaaggatgccatcattttttaaagactgcttctcgaaactactgtatccttagagcatcacacatgtcccccacttgaactaaagaaatccagcacccacaggacatagctatacaatgggtttcatcaacattttaaatttttgagctaaatactacggataccacgcatgtaactacagaatttaagcagggatgcttgcttaccttctgaacaacacctatggctgcttgtagtggtgttaggtactcatagggtatctgagaaattgaatagttaggtgagtttagttttatatgtaattaatataagttggacaaagaaagaaagaaattgactttttcctggagcaatttgtagttaccttgccagttagcagctcccatagaacaataccaaagctaaaaacatctgctttatgatcatagggcttatgttcaatgacctgtagttacaatagaatacaaatgttagaataaacaaaaatgctgttgttattcttatggaatgagcgtatgtataacaggcacctcaggtgccatccaacgataagttccagtctctgcagtcatcactccggattgatctttgacacgtgcaacaccaaaatctgcaacctttacgacctgaaaaatatgatcgctctcatttagaagttcaatgacaggagcaaatatcactctgcacactctgtaaatcatatagcattatggatgagattatggatgagaaaaaactagccttgttttcatccataagaagattcgctgtcttgagatcacggtgaattatgttgttctgatgcagatagttcattcctttagagatatctgtcgccactctcagtatttcggatagcttgaaagaattgttctttttatgaaggtaatcatgcagactacctcctgacatgaaatctaagaaaatgaatgcaaattagagtgtgtcaaacactacagaagtttgtctacaaagattataagttaaaccgttgtaatatacctgttacaatatataagttgggctgtcttgtacaggcaccgataaactgtacaacatttctatggcggacctttctgcaagcatgtagattttgtaagaaacaatttggtacagtcaataaagtcaatatgcatatgatttgccaaatgctaaacaccagaaaatgctcgataaatgggagaagcaataaaaaaatattaagttaacctcataatgtagacttcctgtgcaaaatcacggtacatatctgcactaatgcgttcaggtctcactactttaatagctacatcctgactgcagtatgatccacggaacctgagaaagcaaagcatcaaatggcactcaatccccagttgtgtaaaattatattgttttcacttcccgacaaagataatggaacttacagatcgccatttgatccagaagcaaccttggttccaaacttgagaagcttgagatctatctcccaaacatgcgtcccatctgttggtatttccacactggtagatggcatactctctccacctgacggaccttccaatgattgtgacgatgagtttgatgttggccaagcttgtgtctgtacacgaaaccaaaataaaactaaaacaaatgttttttatctgaggaattcaatagaccttacaagatttttatgagtgcaatgaacaaggcaagtactggttaggaaaataatgttctgcattcctttttcaggtccaggtaccatattttcaggcaacaattaataccacgagaatgagttttttttttcgttgaacttcatagaagaaagtgaggggaagcttatacctcaatgtcatgaaacttctccagcaacttttcttttagctgctcagtaccctgcagtgtgcatcaaaagagcaaattatcaacacgaaaagtgaagtatgttactgaactaactgaactactgaagcgtttagctctaaagaccaattgcaataaggacaagacaaactaacacagtaacactattatgctgggtgcgtaccccaaggtgccaaccagtgacaacaaatacatccaatgagtaaccatcacttgttgaaaatgcatgcgcttcttggatgtcaagaccaagctcactaagcaagcaagtcagctgcaagtgtatgaaaggcaaagtgtaagaatcaaaacaattgctgacataagtcctgtataaaattgccttgaagttcacattaaacagatttgtaatgtttttttaatctttttttctaaataaatatgtccatttatttttactaatgattttcctaactagctacttgtcagcttttgaatttccttcgctttgttaagattgtattgaaagaagtatgcctacctgactaaggacctttggcttatcagttgttgcaaaagttatctcatgcattggcctgcaagattcagaatatagcgagaattaatcaactagaatgagaatatatagaatccaagtattaatcaactatttgcataatcctaatgaaaatgcccataaatacttcctccgtttcacaatgtaagtcattctagcatttcccacatcatgtctagattcattaacatcaatatgaatgtgggaaatactagaatgacttacattgtgaaacggagggaataaaggcttaagttggaaaaatgaactactcccaccaattatgagtacttttgacaatttcataatccactcactacatgatcaaaccagcgcataacaaagaagctcatgcgtggcatcggctttttgtgaaatgtcttgtacatctaaacaagtatgcaaatgcaatattgccagagaaagtaccatattcggaaaggaaattctgcatatcatggttttgcagctaactgttagtaacaactaatccactgatgctatcatttgttaaaaaataggccacagaggcatgcattcttcacaaggtaaaatatgcgattttctggttgtaacacaatataccatgttaattaattgatatagagaagtatcaaaaacagtttttaaaagggaatcgcaacatgccgacatgccaaccttgtaaggtagtagtacaagactacaagctagtgctaagcacgctatgattgtacagaatggcacatgaaccaaaagaaccaaagacaaatacagtgggctcctctgaaacacgggattgagaaaacaaaggaataggaaaaacacagaatttcgataggaattcaaacgcaaaatagaggattgtaaaacacaggaaaaattcaaaaattgaatgagagagatagactcatagaaaactttccatgaggttggacctcatgttaaaaatcctccaaaacttgtatggaatagagcattccttaagaatttcataggattcaacagttttcaatcatttgtttcaaagggccagataggaaaaaaaacctataggatttgaatcttacaaaaatcctatgtttttcattcaaatcaaaggggccctaaactcaaaataaagcgaggtacacgtgaactgaaaaggggaattatctacctggaaatgagatgaacactgctatcttcatcattgttactgctccttagattagcctcactcgcctcgagcgcaagtgcctctaagttggagcaagaaccaaaggcaggagggggatgaaccctgaaacgatttgtgtagtcaccattactccattagcgtgcataaaagacaagaacagccaaggagacacatgcatgaaagtaaacgaacttcatgtgcatatagatagatagatagatagatcatgcatacatttgtcttgccaagtggttggtatgaaccggctccatcccaagctcagaacaatcatccatatcaccatcaagaatcctagaaacctagatcaagcagaaaacaaagtttggtaagccaaggaattaaaatgtctcttcagtttgatgcaacatctaagctctactcttcagtttgatctaatgaacaacatgagacagcacaaatcaaattccccgagcaacaccacaggagagaaataaaaatctaatggaaattaagcagtacgcgaaatcgaccgacatgcaggcagccatggatggatctctctcacctggacgacgcgcaccgacaaggcgggccgccggtccggatcgcgcgcctcctccagcaaccggtggtgcgtcaccacgtcctccgccctatccgcgtgcacatccagcgcgtacctgcacgcccgccatggccatgagggaagtcggggagggggagggagggggagagagagggcaggagaagagatctcaccgggcggggaggcggtggaagtgggcccagagcgcgtcctcgtaggccggcgagatctcgacgggggcggcggcgccgaggccccggaggcgggcgagtacctcgctgtacacctcgaggcggcgcccgctcttgtccgcgcgccgtccccccgcgccgacctccgccgctggctgcggggacgacggcggcggcggcggggacgacggcggcggcggcggcgactcctccacggccatcgattactctcgaagcaaagcgagcgcgcgcggcggcgtggtgcacgagacgagagaggagagccgtgccgctactgctgctgggtctgcatggggtggtggtggcgcgcacgtgagacgtgacaatggcggcgagaaagtccacaactttatagacacaaacaagcggaggcgctcgccgtagagaagaagaaaaagatgagaagagagacaggtttttgtctaggttctggattgacttcttctcccctattggctggagtaataatagtaccattgtaccctcaacgtctcaaaataaatcatctcttactaatacacaacaaatctagatatatatccatattcattgtattcacattttaatacgaggttgatttatttttgaaacgaagggagtaatacaatgatccaaacaaaataattcaagattaatggtctgtttcgtactagcttcaattccacttattctaaagttcaagtccagctaaataatttcggctccatccagaatagaagtggagctagttaaactccaaatccagctcttggaattaaattttgaaaaacagattctaagtataatactaagaagttaaaaaaatcacaatttttattaggtattaaactccttccgtgtttagcttatttggaagtgaagtttaaaatagtattaggcttgaaatttaagtaaatttatgtttttattaaaaacattgaaaaaaacaagttgtattttaattggggattgaatattattggggataaggctgcagaaaatgggggtgatgaatctggaggatttggatgaccataataaaatatgaggacattaatccaaaaccgagtcaaaaatgtgatgtggagaatggagaacggttacacacaagccatgcaatgaccagtgaatcagtccaaaaaccattgctttctcctcgacctgtgtgcatgcgcagtactacaactccaaggtcaaagcagacattgcacgtggtttatttgctacgtccacacgtacggtgtgtatgaacccggaataaaaacattgctttcacaaaataaaaagaaaagttactaccatatggttgaactaagcaacaattgaagcatcattttaaaaggatgcaactctgagcgagactcaaaatcaacttcaaactgtgtaacgagaccatgggcgggaattgtatatatgtgtaccgctggcttctcaccaaaaagctctagtattaaatttataggtggtacctttaatatttctatattgatatgtttatatgtgtctatatataaatagagcgtacaaaatatgacaaaattggagcttactcggcgaaacttgcgggcattgatgaggcaatgtactaacctaactaagctagttaggttcattatatctcatatttgggctgggttcaatggttcatccagcctagacactcaaaaagtgggcaagataaacaaagatacaatattgcaatttgaagcactagtagtaccagtgagcaccatatcatagcaggatagtataattaaatcaagaagatattgtaaattatttggttagtattttctataccatgatggtcctatatgatactgctaactagtactgtatgactatactgttaattggagctctttgagcatgtaacaatggtagcaagtagaaagtagctagctagtcactgaaacgtacttgtacgtacgtaattcaagaatgatagataagctaatcaagtactgatgagataacattgtccttatttatttgtttgaggcgattttctactaaccaattttttgataaatacagacacagcgtttgtggtaagttctgaaaaacttcgcatatatacacaccggagggaacaaaagtaaaaggaaacttcgataaatcgtttttctttaatttggatagtatgagtgatttgaatttgaaggcatcaattttctgacggtatagcgtgggatctttttcagggtacgtattttgaattgaatggaatttagcttggaaattacccactctaaaaaaaacttggaattaaaagagtggtgccttgcttttgcctatgacctcgttctcttaaactatatatatgcagttcacctttcgaggcggagctggatatgcccatgtcgatcctccgcatcgcacagttactccatgcacgaaccaatttttggtttggctaatcacgccacgtgtactccaccatttctcaaaaagaccgtgttttagcatgtgtaaaggaatatgcgattgagttttaattatcttcttcgcccattgatataattagtaaaaaatactactccctttggtattatttgtttgacgttgatcatcgtatatacacaacttcaatcagtaattttcactactccattcgcccctttaagataatcgattttaattatttactgctccttactctaccaactctcatctcgtaccaactctcgtctcatactggtcgctagcttctatccaatctctaactaaaaggtcgtcgggcatatccatagtattgtaccccagaacgtgaaacgtaagcaagtggacatttatcaccttatctccgaaaaaaagatagattacatcgctggctcgagcttgagtcttcgcatcggtccaatggtgaggattcacttgatatataaaatccatcataaaaccatgttggcatatttctagcgaaaccttattcaatttgacacatggctcgagacaagcagcctgatgtttttagaatatgcttggggattaaacccaacaatcatacgatgattgatctccacgtctaatataagcatatatagttgtggttaacttaattaatcagagaggaggaatgatatttatatcaagtgctgaacgagatcaggactccagcccggcacctagcaagtactcctacgtagtacgacacatggatcgatatccatttatactagtggatcagtagtttacaattgactcgcaaaagcaagctaagcatcgagttaacatcggctagctattccagtgacagtgatttggtcctaaccaagtggctgctgaattattgaccgtttgcaacttaaattaattgttgtttttatcactactacttgatctccgactctccgtttgagaacatatacgtgttaagcagttcaaaattaaaactgaaaaagtcatgaacagcggcagaccagagatatatatagatcgagaaaatatatatagtaaatgcacgatgtgtaacctgcatttttgtcatttagttaagcaataattaagcattcattatccaattaaaaagcaataagcattgtatattcagagttgcaggcgaagtcacgcaacaaccgatgatcgatatcgattcctggcgtcgcatgcgtgagtacttgtgcctgtcggcatcagacaaattaagcaatcgattcattaattaaacatatgtgtgtggagtagctataaccttgcagagaatcagatcgaataagttaaggtaaacgataaagataacataagaaaatatatcaatagtagtaattaagtctgcattttgtttttgctgggaaagtctgcaataattagtagtaaaaaaatagtgttggatccaatcgttttgcagaatcaagtgcaggtttgacctgaaaatgcattgcagcatcagagtgagagatgcgtcaaattaaacgagcagtggcgactactggacgggctcgactggccgcgtcacaactacaggatatgcatgcagctggacacgtagcttcatcgaccgacacgtaggcatgcagagatacgcgatgtctgacgaaattacgtttataaaatttactactccctctattatatattataaatcgtttaacttttacatagtcaaacttggttaagtttaattaaatttataaaaaaatttagcaacatataaaatatcaattagtttcactatatctaatatttaatatattttaataatatgtttgttttgtattgaaaatactagttaaatttgaatagatttaactaggaaaaaaagaaaactacttgtaatatgaaacggatgaagtagttgatttggctgtgacttattgacataagatcgaagatgcattctttttattattattgaaacagagcagcagatagatgcttctcgggattttcagaacgtgtcatgaagataggaataccagaatttatacactactcctatcatgtgccttaggatagtacaggcgtactataatatattgagttattcaccatcaattcattcagttttaaacccctttaaaaatcatccatccaatcgtggcatttttaaataatgttttgtttttgaaatttctttgcatgcatataaaataaaaagggataataataacaatactaactatcatcatttgtgccactccaagaaagaaggaatgataggaaggagaaaaaaaaagaaaggaaaaggagagatgaggaagagaatgttcagcaatttggcccatatattaccgatgggccttccaaatacgtataacgtggcccatcaacctggttcgaattacgtatgcagcccagcaacatgcgtccggatacaacacacacaaacacatgctatgtttggcctaaaggtctaaaaaagttataacaaaataataaatataaaatgtattcatatcctaggtagagtttaaatatttttatttaatttgtagaaattaaatttaatgttgtatgtttgtggagtgatatacggataccttgttaaatgttaataaaatttttaaaaattttgatagctatttgggtaccttgaaagaaatgaggtaacatccactcgaggaaaaggaccatattctaataattatggataaatttaaacgcttatcatttttatatttgtttacctatggagtaaaatacttgtattctgattctacacaggcctgatcaacgatgtgcttattatgctttatgctacttgtaacttgctaatgaagcgcgattacactcgtgactcgtccctgatgccgcctgtcgcacgctcttctcaagccaagaatcgcattccttccttgcatacatagcatcatttcatttgcgttttcatgcatgcccccgtggggcccaccttagtagactgcgggcccaccggtcagcctcctcttgtgcattaattcagcaatcctcccgccatgcatgtgccctacgctttcacaccgttaatggttagcttagctagcccccgaagcggccgagctccggtcatcatgtcttggtccggcgagctgtcgccgccggcggcggcgtcggggactcgcctcctccacggcgacctcgacctcaccatccacgaggcgcgcggcctccccaacatggacttcctctccaccctcctccgccgcctctgcctctgcctccggccgccggcgagacggcccagccccggccagagccgcggctctgtcccggccgacgaagacggccgccgccagccgcacggccaccacctcctcccgacgtccgacccgtacgccgccgtcgtcgtcgccggcaacacgctcgcccgcacccacgtcgtccgcgactccgaggacccagagtggtccacccatgtcctgctccacctcgcccaccacgccaccggcgtcgccttccacgtcaaggacgccgaccccttcggctccgacctcatcggcgtcgccatcctccccgccgccgacgtcctcgccgcggccgccgcgcccatcgtcaggagggagctccccctgtaccgccccgacggccgcgggaggccgaagcccagctccgccatcgtcatcaccgcctcgggggtgcagga

SEQ ID NO: 58851 - DNA, 14227 bp, Oryza sativa
ccttaaacggaatctcgtcctcgagattcagaagaactggcgaagagatgaggatgagctgacttcaattcatcttctcgctcccaagtggcttcttcttctgaatgattgctccactgaaccttgcagaaccgtataacacgattcctggtattcctctcgcttacttccaagattctgactggcttctcaacataagttaaatcttcttgaagctctatacgatcaggatctgcttcctccgtaggtacacgtaaacatttcttcaactgagacacgtggaacacgtcatgtattcccgccattgacggaggcaattccaactgataagctacctcacctcttcgactcacaatcttaaaaggtcccacgaaacgcggtgccaatttctcttggtctggaaacgatgaacacctcgtaacggcgtaacccgaaggtatacataatctccttcttcgaaagccaaatctctgcgacgattgtcggcatagctcttctgacgtgactgagcaacgcgcaacctttcttggataatcttcactttttcttctgcctctcgcaatatgtccgtcccaaaaacttgacgttcaccggtttgatcccaaaggagcggcgtacggcactttcggccatataatgcttcatacggagccatttgcatactagcttgataactgttgttatatgagaattccgcgtacggcaaattcttatcccaacttccaccaaaatctagaacacaggctctcaacatatcttctaaaatttggtttactctttccgtctgaccatctgtttgcgggtgataagcggtactgaaattcaaacgggtacccatctctacttgtaatttctgccaaaacttcgaagtaaactagctacctctatctgacactatcttcttaggaacgccatgcaaacataccactctggccatgtataactctgcaagcttattccccgtgtaggttgttttgaccggtatgaagtgagcgacttttgtcaacctatcaaccactacccaaatagaatcatgtcctgccgacgttctgggtaggccggttataaaatccattcctatttcttcccacttccactctggaatcttcaacggttgtaacagaccggctggcttctgatgttctgccttgacccgctgacatacatcacatagagccacatattctgctatctcacgtcgcatactggcccaccagaattgttgctttaggtcttggtacatcttagtgcttccagggtgaatggaatacaaagtttcatgagcttctttcatgatggtatccttcaactccttattttctgggacgcaaattctttctcccaaccacacagtaccttgctcatcttctacataaccgatggcttttcctcttctcatgttcttctttatttcttggatatcaggatcattcacttgagcctcttaacttgatcaaacagagtaggtttagcttccaaagcggccacaaaaccattgctgactattcccaagttcaacttttcaaattcttggcataactcccaaggtaaacgtcgaccttctgacatattacagtagcttttcctgctaagagcatcggctacaacatttgctttccccgggtgatagtagatttccatatcataatctttaatcaactctaaccatcttcgctgacgcatgttcaaatcaggttgagtgaaaatgtacttcaaacttttatgatccgtatacacctctgtacggttaccgaaaagataatgacgccaaatcttcaatgcatgcaccacagctgccaactctaggtcatgcgttgggtagttattctcatgaggacgtaattgcctagatgcataggcaaccacctttccttcttgcatcaacacacaacccaaaccgagtcgagatgcatcacaatacacttggaaacctttcctcgaatcaggcaaaattaacaccagcgcagtcgctagccttttcttcagttcttggaaactttgttcacaatcctctgtccacttgtacttcacttccttctgaagcagacgagtcattggtctggcgatctttgaaaagttctcaataaacctgcggtaataccccgcaagtccaaggaaactacgaatttctgaaaccgtcttgggttgcttccaacttaacactgactccacattgcttggatctactgccactcctccagacgagatgacatgaccaagaaacttcacttcggacaaccaaaattcacatttactgaacttggcataaagctgatgttcacgtagtttctctaaagctagacgaagatgctcttcatgttcttccttcgtcttggagtaaataagaatgtcatcaataaacaccacgactaacttatccagatattccataaacaccttgttcatcagattcatgaaaaaggctggggcattagtgagtccaaatgacataacggtacattcgaacaaaccataccgagttgtgaaggcggtctttggtatatcttcctcacggattcgaagttgatgatatccagaacggagatctatcttggagaaaactgtagcaccttccaattgatcaaataggtcatcaattctgggtagaggatacttattcttgatagtaacctcattcaacgctcgataatccacgcacattctctgagtatgatctttcttctccacaaagatgactggtgctccccatggcgaagtactgggtctgatgtatcctttctgaagcaaatcttccacctgtctcttcacctcaactaactcattagctgccattctgtatggtctcttatggatagggttggttccaggtaccaagtctatccgaaactctatctctctcttaggtggcatgcctggcaaatcctcgggaaacacgtctgggtagtcttgtactatggggatctcttgtagagcaacttggtttaagatcacaccatgagatttaggagaggacataaagaaagaaactgtttccccattgctactggttaaagtcaccttacggttggcacaatctataactcctctgtgacaagataaccaatccatccctaagataacatctagatctttggattctagcaagataagcgaggatgggaaaggaacttcttctatttctatagtagcggaaggacaatactgtgtcgaaaatacttgattgcctggggtattaactagtaaaggtctctcgagactaataacttccatcccatgattgctcgtaaaacttttagacaaaaaggaatgtgtagcaccggaatcaaaaagcacagttgcgggtatagagttaacagggaacgtacccaaaaccacatctggtgcattctgagcttctgctgctgcaacatgattaacacgtgcctttggtgctggaacattggagttgttcggggctggagcgttcttcacgcgccgaggcttaggacacttatcagcataatgtcctggatcaccgcaattgaagcatatcactggcttgcttccctgttccttcctgacaggctggttctgagctgaagttgctgcaggacgagcaaccacgttgcggttgtcattgccacgattactagtattgttgttgtagaactggcgttggggacggacaactgatgaagatcctccttgagggtacgatggaacttgaggtccagtaacgagacgcggcctctggttactgccctgttgtgccttgaattgggcagccctgcgcttcttctgctccatccggttatacttgtcttcctgacgaatcgccttgtccaccaactgctggaaatcccggaaatccgtagacatcaaagcataagacaactcatcattcagtccctccaagaatttctcctgacgctcttcatcggtgcgaacatcttccggagcataacgagctaaacggttgaaatcatggaggtactcggtgaccgatcgagatccctggttgagtgccctaaattctctcttctttagagctacaacacccgacggtatgtgtgtcttcctgaaagcggccgtgaattcctgccacgtaataggctctccttcagccctgccttggcgaaaatgatcccaccattcagcagcaggaccatgcagttgatgcgaagcaaaagaaactttctcctgctcagtacactggatcaaatccaacttcttctccaccgcatgcagccaatctcctgcttctactggattggtggtgctggaaaaggtagggggtctcacgcgtaagaaatctgccagcttgttttggggaggtgggggtggattctggttctgattgtttgcctgctgattctgtgcctgctgcactaacagattgatcagttgtgtttgttgggccagaatctgagctagcgtgggatctcctccattgttagtagctccacttccacttccacttccacttccggtgcgcgtgttcaccatctgacgataagcagagactcatgctgttacatcccaccaatgatgtaagcaacaactaaaacccacacactcacaagcaaacttaaacaagcaatctaacacagcgatctacggcaacgatctaactaagcgactaaacccgccttgtgtcggaacgaagcgatggatcttcttcctctggagtagctggctctctttcttcagggtcttcctcctcttcctcatcacttatgatgtcgatgacaggttcagcacgatcgggcacagcttcacccatcacgcgaatcttcgaagctaactggagacgaggtggcggacaggttctttttctttgagtgaggcgatgcttgggtgttggcggcggcgtttctcctttaagttcagctaattccttttgtagacggtacaccttgctctccaacttgcaaatcttgcctcgattccagttttccctgtcatgagctgctttgtctcgctccacacttactgcatccatagcactaagcatatgcaccgcatgcatcagagtggcactctcttcaccgtcaggacaggtataggttccatagtcttgaccatgaggcttgtgaggatgatactggaaagctgatgaatccaactcttcttcaaagcgttgacgcaactctccaatggccaccaaagctgcctcttgacaagcatggctgtacgatcttcctccagcttcgaacttaaaagacggaaggtcatcactatcactagccaacgtcacacgaacacgacacttctcctcgtcggggtcatgggaaatttggcgatactcgggagcaacttcatagcctacctcaaaagccatcaacctcagctccctgacgaaccctaacaccttgatcaaatttctcggtgaatggggtggcatctaaagaaacatagaagggaagaattaatgcatatttttaagttagctgcaccaactagacttaactgatttagaccaaaaaggaagaaaataaaagaaaagacacatacaaagctactttatatatttttctttttgaatttaacttttgaacagagacaaatcagtttgaacaagtgaataaaataaaaccaaaatacttaagacctactataagcacggtacaatgtcaccattaaaagggatgagtagtactagtgccaacatgattaaatcgataccataatagatgtacagtgccgaccaatccataagatttagtaaagagaaaaagaaacattttgagaagaacaactttttgctttttaaaagaaaagaaattgaattaaatgaattttgtgcataaccttgcatgtgctgccaacttatttaatttgtaagagaatagagaagagcagttctatttttttttcaaaaatattttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaatgacaatttgataatagagtacaaataaataactatttaatactcgcaaataacaaaagattacagaggtagatagttcctctcaaaaaataacattctacgcagcggaaaaaaaactataacaaactacggaacagctatggcgactccactccacaggcatcttaaccaagaacaagctcaatcctccagatcatcaccttcactgagatactcctcttctgatgaatgaatattgcaagaatgagcatatgacatactcaacaagtcacacagcaaatatgcaagtgcacaggataacgaaggatggcataatatagctcatttgcagaaacagcatttaataaatatttaagagaatgataaaaacagttgaataattaatcagtattaaataaacaccatacaacacacccatgttgcataggcccaaccacatttgaacaaccaaccccagttgaacaaattaaacctccaaaccaggaattatccattccaaaccaggagtcaaattaattaccacattataaccattaatgagtagtgtgagactaatcacgaaaaacattgctcaactcacccataaccgcgggtacggctattcgaatagtttaaactctgatcagaggtgtaccactgtacccacaagacacaaccccacatcatgtcaccatgtgcctcaataccaccacggtacctcggaaaggagttgtgataataccccttgcacaacataacccattacagcgcacctttcctggatcataatcacccccttataaacaaggcatggactccccagcgacccccgtggacttctcgccacttctcagtctggcgcactataatgaatcacgctatacaaaagataaagccgttgcccacgctggcttgtggctggcacgataaatgtttcacaacagtagctcgcgaaccggtccttaattgtcatgagcacaaccatcaaaaccatatgctcacaacccaccttaaccaggttttaattatcaattaattaacatcacacgatttaccatcgtgagctaccatttaatataatcatcattattaataataatataacatagtttataattaatccctttagttagctaatgtttctaagcatggctaagcaaacctatatatagcatttagctgaaccaaaccaatatataaggttcatgctagtcaaattataacccctaggaaaataaagtcatcttcggccaataattaactgggaaaggttcaccacccgatgacattcgaaaacaatgcatagttgaaataaaataatagctttaaacgggttcaacatgctcaaagggttgtttgggatctgtgtgacttgccttgagcttccgcaaacgcttcggaaccttcctcaacggaaacgctctcctccggaacgtcggaaactaaagcaattaaacaaaaatcaacaaaacagtacaaaaacaagcataaacagtacatgtggatatttttaacatgtagatcttgattttagaaaaatttagcaacttgaaccacctgaaacggatctacggttatttagttatgattttccaaagttttaatctattagaaaattggaaaaaaagaaaaaagaaggagatgatgacgtcagcatgacgtcaccccacggcagccggctagggtttgcgagctcgccggagatagagaccttggccggggatttggagggcatgtacacgtagaggacgacgaggcgaacccaacggtactcaccacaacgacaaacgacgaacgatgatggccggcgacgaagaggacggcggcggcggctcggcttgacggcgacggcggagctccggtggtcggcggcgaagggggacgggcggccgaggttcccctcaccacggcgcacctaacggcggcgacggcaagcggcggcgacggcggaggcggcgcggcggcgcggctggagaaggccgacggcggcggcgagctaaagcaacgcggcggcggcgctacggtgcacgggagaggacgagagaggggcaaacgaaagagggcgacgatgtggtcctatatatagcattggattgaagagatcgaactccaaacgagaggaatcgactcgggaaaaatccaaactcggttttagggataaactcgaaaacgagtttgattcgaacaagatactcaacggattgctccgtttcttgaggggaaagatagaggagaacgagaggaacaaaacccctcaaaaacccggaagaatcggggtcggattggagcggaatcggaggcggaaaagggcggctcgggctcggcttcggccggctggaggtaggagatggatccgacatgtgggccccacatgtcggtctcccgagaggagggcacgggcggctcggctgggccggcttgggccgcgcgggagagagagagtgttgggccgaattcggcccaacggcttaaaggaggggatttttgaactttttaaaataaaaacaatttgtgaaatgttgtttcaattattaaaaatacttcccttgctcaaataattcccagaaaaatctagaaaatagaggagcaagcatagtatttaataaaattttatctagctcatttttatgttgaaaattttcctagaaaattagggtttagtttgtaggcttttaaaaataatttctaaaaattccaattaaacatcagtttatatatttaggatttttagggcgtgacatcacgcccggaatttctatccaaaattccaaacgcttacatgtgtgttaaaccctcgtccaggaatcaaccgaggcacacaataacaaattgataatagagtacaaatgaacaactatagaatattcgcaaataataaaatattacagaggtagatagttcctctcaaagaatatccttctacgcagcgaaaaaaaataaatctataacaaactacggaacagctatggcgactccactccacaggcaacttaaccagaacaagcctaatcctccagatcatcaccttcactgagatactcctcttctgatgattgaatattgcaagaatgagcatatgacatactcaacaagtcacacagcaaatatgcaagtgcacaggataacaaaggatgacataatatagctcatttgcagaaacagcattaaataaatatttaagagaatagtaaaacagttgtataattaatcaatattaaataacaccatacaacacacccgtgttgcataggcccaacctcatatgaacaaccaaccccggttgtacaaatctaacctccataccaggaacgtaccattccaaccaggagtcaaattgattatcacaattaccattaatgaataacatgggactaatcacgaaaaacattgctcaactcacccattaccgcgggtacggctattcgaatagattaaactctgatcagaggtgtaccactgtacccacaagacacaatcccacaacatgttaccatgcgccttagtaccaccacgatacctcggaaaggaactgtgacaataccccttgcataacacaactcaccacagtgcaccgtacctggatcataatcaccccctctacaaccagaggcatggactccccagcgacccccacggacttctcgccgcttctcagtctggcaccccataatgaatcatgctatacaaaaggtaaagccgttgcccacgctggcttgtggttggcacggtaaaagtttcacaacagtagctcgcgaaccggtccttaattgtcatgagcacaaccatcaataccatatgctcacaacccaccttaaccaggttttaattatcaattaattaacctcacacgatcaaccatcgtgagctaccattaatgtaaccataattaaaataataatgtaacatagtttataattaatccctttagttagctattgtttctaagcacggctaagcaaacttacatatagcatttagctgaaccaatccaacatataaggttcatgctaatcaaattataacccataggaaaataagatcatcttcggccgttaattaattgggaaggttcaccacccgatgacattcgaaaacaatgcatagttaaaataaaataatagctttaaacgggttcaacatgctcaaagagttgtttgggatctgtgtgacttgccttgggcttccgcaaacgcttcggagccttccttaacggaaacgctctcctccggaacgtcggaaactaaagcaattaaacaaaaatcaacaaaacagtacaaaaacaagcataaacagtacatgtggatatttttaacatgtagaccttgattttagaaaaatttagcaacttgaaccacctgaaacggatctacggttatttagttatgattttccgaagatttaatctattaaaagaaattggaaaaaaggagatgatgacgtcagcatgatgtcatcaatggcggccggctcgagttggtgacctcgccggagctagagtggtcggccgggattttggagggcatccacacgtagagaacgacgagacgaacgcaacggtactcaccaatgcgtccaacgacgaccgatggtggccggcgacgagaggaggcggcgcggcggctcggtcgacggcggcgacgggtctccggcgaccggcgacagcggggagagggcggccgaggttcctcacctccgtgcgcacctaacggcggcgagaggaagcggcggcgacggcgaaatcgaaggcgcggcgcggctggagatcaccggtggcgacggcgagacaaggcggcgtcggcggtgagctacggggcacgggagaggacgggaaaaggggcaaacgaaagaggggaactagggggtcctatttatagccttggattgaagagatcggactccaaacgagaggaatcgaaaccggaaaatcttcgggttagtttggagagataaaatcaaaacgagtttgattcggacaagatactcaacgatttgctccgatttttgcgggtaaagatagaggaggatacggggattaaaacccctctaatatccggactcggggtggccggattggggcggatttgagggcgcaaggtggcggctcgggctcgtcatgcacggctcggccggctgctagaggaaggggaaggatccgacatgtggggcccacatgtcggtctcccgagaggagggggcggcggcgacgggttggaccggttttgggccggctcggccgcgggagaggggaaggatgttgggccaaaaacggcccaatggctttagggaggggtttcagaactttttaattaaatataatttgtgaaatgttgtttcatttattaaaaatacttcccttgctcaaataattcccagaaaattctagaaaatagaggaacaagcaaagtatttaataaaattttatctagctcaattttacgttgaaaattttcctagacaattagggtttagcttgtaggcttttaattttaatttctaaaaatgatttaaacaatgtatttttaatttaggcgatttttagggcgtgacacaatccaagctgccatgatgtggtcgcagccaatctttgacccatccatagcggcccagcaagtaccaccagttggagccgggcaatcgaatgccgtggcccaactccacgcacaagccgcgatttcgcccttcgccacaccgtacccgcagcaaggtgcggtaaacagggcgggaggcgaaaaggggctgccgctgagtgggggaatcaagactcgtccaatcccaccccagttgaagttcccacctgtcccgcgttattcgggcgaaactgacccgaaggagttcctctccatctacgagtcaacgatcgaagcgactcatggtgatgaaaataccaaggcgaaggtaatacatctcgctctagacggtatcgcccgttcttggtatttcaatttaccagccaatagcatttactcatgggagcaattgcgcgatgtttttgtccttaactttcgaggcacctatgaggagccgaagacgcaacaacaccttcttggcattcgccaaaggccgggggagtcgataagggagtacatgcgtcgcttctcgcaagcctggtgccaagttcaagacataaccgaggcgtcggttataaacgccacttcggccggtctgcttgagggcgaactaacaagaaaaatcgccaacaaggagccgcagacgctcgagcaccacttcgcatcattgacgggttcgcaaggggcgaggaggattctaagcgacgacaagctatacaagttgagtacgataaagcctccgtcgccgctgctcaagctcaagcacaagttcaaattgccgaaccacctcccctctctgttcgccagtctcagccggcgatccagggacagccgccaaggcaaagccaagcccccatgacttggagaaagttcagaacagatcgggcgggcaaggctgtgatggctgtcgaagaagtgcaagccctccgcaaggagttcgacgcccagcaagcaagcaaccatcagcagccagcccgcagaaggtccgaaaagacctctactgcgcctttcacggacgctcttcgcacaccacggaacaatgccgaaacattaggcaacgtggcaacgcgcaagacccaaggccgcagcaaggaacaactgtcgaaacaccccgtgaagcagttcaggagcaaatacccccagccgaacaacgccaatatacacaacaaaggataatccaagtgattacaagagctgacccgccaagccagttgtcgaaacggcagaggaagatgcagatccgtacggtccacatcatcacttcggcaggtgagggggcgccacagtacgtgaaccagctgatccctttcgggccagaagacgccgaaggagtcctgttcccgcatcaagatccactagtaatctcagctgagatagccggttttgaagtccgacgaatcctggtcgatggagggagttcggctgacgtgatcttcgccgaagcatatgctaagatgggcttgccaacccaagctcttgcaccggcaccaacgtcgctccgggggttcggcggagaggcagtgcaagttcttggccaagcacttttgctgatagctttcggctcgggagaaaacaggcgcgaagagcaaataccgttcgacgtcgtcgacatcccatacaactacaacgctatcttcggccgtgcaaccctgaacaagttcgaagccatttcccaccacaattatctcaagctcaagatgcctggcccaacaggagtgatagtagtcaaggggcttcagccttcggccgcttcaaaacgcgatctagccataatcaacagagcagtgcacaatgttgaggccgaaccgcatgagcggcccaagcacacgccgaagcccacccctcacggcaagataacaatagtgcagattgatgatgccgacccacaaagctcgtatcactggggggcgacatgggcgaagaagaagttgagagcatcctagaggtactcaaaaagaacatcgatatcttcgcctggagccctgatgaggtggggggcgtcccggcggatctcatcatgcatcacttagcagtcaagccgaatattaagccaagaaagcaaaagttgcgcaagatgtctgtcgatcgccaagaagcggcgaagaccgaagtacaaaaattactccgagcgggggttattcaagagattgaccatccggagtggttggctaatccagtgctggtgcggaagtcaaatggcaaatggcgcatgtgtgtcgatttcacagacctgaacaaggcatgtccgaaagacgatttccccttgccgcgaatcgaccagctcgtggatgcgagctcatgagtttcctggatgcatattccagttaccaccagatccacatgaacccgctcgacatccccaaaacatccttcatcactccattcggcacattttgtcaccttaggatgcctttcggcttaaggaacgcaggagcaaccttcgccaggctggtgtacaaggtccttggcaagcagttggggcgaaacgtggaagcttacgtcgacgacatcgtcgtaaaaagccgcaaggctttcgaccatgtgttcgacctgcaagagacgttcgacagcttgcgcgcggcaggcataaagctgaatccggagaagtgcgtattcggcgtccgcgcaggcaagttgttgggtttccttgtttccgaaaggggcatcgaggcgaatcccgagaaaatcgatgccatccagcaaatga

SEQ ID NO: 58852 - DNA, 2170 bp, Oryza sativa
tagtttgttatagatttattttttttcgctgcgtagaaggatattctttgagaggaactatctacctctgtaatattttattatttgcgaatattctatagttgttcatttgtactctattatcaatttgttatgtgtgcctcggttgttcctggacgagggtttaacacacatgtaagcgtttggaattttggatagaaattccgggcgtgacagattggtacttggtttgttccgaagcctggggttggcacttgctgccgaacggttggcacctgagcagtgttgccgaagtcgaactgctgtcattgactccacggcgaaggtcccgagcctggctgaattggtggcaacccattgggcgctccttgacttgtattccctaccgggtgagccgatggggttgtgcttgaaatgtagtggggttggttgagttgctaaaggaaagcttggagttgcgcctgcagagccgaagcccattccaccactggttgtggcgcttggccaggtggttgatgctgcccggcgaagtacaccggcggctgtgcggctagtggcggagagggctaggtcaccacttgcggccggacttgaggtggggcatagcctgccgaatactgaaggattggagccgacgtggccttggtcggccttgtcgcctcgtatgcttgttgttgttcttgcatttggcgaagcatgtcttggagccgtgtcatattctgccgcatggcttccatgtcggcttcggcttgcgcttcggggtccaggctgatttgggcctatacaacggcgagcgcagttggtgccgccggctgtgatggggcggcttgaggcaccaccagttggtttgtcgaaaggatctctgccctggtctggagtgcccttgccgccgcagccgccttcgccacgtcggccttgttcggcacttgcactgaggttgcggaggccgaagacggttgtgatggcgcgggggccgaaggcggctgtgatggcgcttgtccttctccatcttcggccacagacgccgaaggctctgctccttcctcggcggccatgtccggtccggcgtcgctctccttccgcctgacaaccttctccttcacgaccctcttcgtggcattcgctctcagtggtttcgctcggagtccccacggtcggcgccagctgttgtcgaaacaacaactgtatacgtcgaaggacgtggttactcaacagtggttgggaaaatgaagtgtactaaatttttaatttcacttgggatcccccgttacatagccctagggggctatttatagccctattgcaggctctttctactaggatctaggttgtacaggggaatttatataattacccttatgaaagggacatttacaggggtacataatgttatagggtctcatgggcccctaatgggccgtctagcgatcgccggcccttaggcttgatgggctggaaaggcttccttggcccttgcgggggcgaacttgctatggcgaagtcgtcttccttcggcagatagtcttcgccttgcacccttcgcccgagacgccccttgcagctgctcatctcttttaaagcgatgtgacaacacattttttcagccatttattcccccctctgatgagttcactgcaaccatacgcaacaaatgagagcacatttttacaaatgagtaaaaagttacaaatgatgttcgtaagtatataaaaatttttaaagttggacataattattaagaaagtaggtaggattaaatgtggagaggatatgattggtgaaaaaagtaaatggtaaagggttgtgattggttgggaaaataatgtaggtggagaaattattatattttaaaataaattcctaagagtttaatgttgctatattttggaaatgatatttttagtgtcatgcctagtcacacaataaggaccacaatttggcttttcgaacatttttttttaaaaattgttttcttaaatcctccactctcaaaatccataatcttattgggtatatacattgtatttattacgatgatctaaactagaatgtgataataattttatttttctctttaagcagttattgtgtcttatgttttagaatggcgagagtaaattataaattaaaagtacataccaccaaaatgtaaagaattttactcatgtaa

SEQ ID NO: 58853 - DNA, 564 bp, Oryza sativa
aaaaccaccgagtcctcgcggacagcgtgccaaacgcttcgcctcacccttactgacatgggcacgaaagtgcggggtgtcccctccgagatgcatcagccttcgacttctccgaatggacccaacaggctggtggttcggtttccgactgcgccaccgcatacggcgattgctgtgcacgcgtatgagcggcctttaccatgggcctcctgcagcagttcggctgcgagcacatcgccgagttccccaagtacgcgaagggggattgggaaatcagtgcgcaagacatttcgcccgcgcttcgtgcatggcgaaaacaattttggcagaaggacggccgctccgccgctaaggcgcgccttttggcgcagctggcgaaagcagaggcggcggacctttgtgaagatgaaggcatggcggccggagggggtggaggcgatgcccgggaccacccagaggtgtgaggctctccgcccttctcttaaattttcatagttttcttttggtgttcgctagatgtggcgaaccattgcatatcagagctggtgggctttgtaggtattg

SEQ ID NO: 58854 - DNA, 14741 bp, Oryza sativa
  unsure (1)..(14741): unsure at all n locations
agagaaaggtgctctcacagctggtacagtagttcatcaccttatattattagctacacgtaaaacgagaaacatgattagcattttaattaggtattaattattaaaaaaattaaaaatgattttatttgattttttaaagcatattttggcccggtctagttctcaaaattttttgttttggggtgtcatatcggatatacggacacacatttaaagtattaaacgtagtctaataacaaaacatattacagattccgccaagaaactgcgagatgaattttttaaacgtaattaatccgtcattagtaagtgtttacttagcaccacattatcaaatcatggtgcaattatgcttaaaagatctgtctcgcaatttctgtcagaactatgtaattggtttttttcacatttaatactctatgcatgtgtccaaacattcgatgtgatagatgaaaagtttttgttttgtgaactaaataaagtttttatatagaaaatttttgcacgaatattagtttgaaaaaacgtactgatggaaacgagaaatagctaagctgaaccagctgtttagaacacggccctaatgtctttatttgattgatcatctggcatcaatcaatcggctcagtcgctaacaacaaaatactaatactccctactccctgtgtaccataaaaaagaaatctaaaattaggatatgacagattcttagttttaaaatgtattatatttgtattagattggttttcagacagatggagcacatctcaataaaaccaatttaaaattggatttaacataattctatattggttttttgttaggacagagataaatttagaattgaatttaattagtttttattgggacggagcacatctcaataaaaccaatttaaaattggatttaacataattctatattggttttttgttaggacagagataaatttagaattgaatttaattagtttttattgggacggaagaagtagagcgctgcaccctcctcaaatctcaatgatcagtatagtagcagagagatagagagagagccaaaacacacgggttacaaaactccaagcgccaaaaagaaaaagaaaaaagaatgtagtagtaggctgtagctggcctgcactgcacgcctggagtcgtgcagccagaaaggcaaggctgcacacttgctgccgctctcgcctccccatactcagtacagtagctaggaagaaggcaagggaagggcatggcgacgctgccggacctgggtgtgtccgccttcatcaacatcttgggcgccttcgtcttcctcctcatcttcgccgccctccgcctccagcccatcaacgaccgcgtctacttccccaagctctacctcactggccagcgacgccaccaccctcaccctcatggcttcgtcaacctcgacctctgctcctacctccgcttcctcgcctgggtccccggcgccctccgcatgtcccagcccgacctcatccaccacgccggcctcgactccgccgtctacctccgaatctacacgctcgggttggttcgctccctcntacacctcccttccttttcttttttactacactacttctactggtattccagattaattaagcaccaccgtatacgtagttgcatttgctttccctgcactgcacattattatgggcatccctcccttcctagtgcaactcttgttgatttgtgtctagtatgtgctcttgcttgcctgtgtctcctaccaaagtcgtcctgctcatacagtactactatggacttcaattatggttgtttccagctgcatggagtatgcgataggaattactcttcttgcttcttttttttgtgtaaagaaaatccttgcttgctacactactgtagtcctttttattttctctgccgctaattaaggagctctttcctgaatactttcgctcatttccgattccatccacaattgattgattggacctcacaaattgaggaggagtgctgcttgccaagaatattactatattgcttgtatgtgtttggtgatgacgacattgtggccgtgatggatcccgcggtaattagttactggactagttaatactccttcgttgaaaacggtgtcggcggataggataatcttaacttgatgtgcaccgcaattcctggccttgtttcatggaggaagagccatagcctgtatattttgtttggggcctagcctacacgactggtactcctatgaattcataatgcagttctaaattaaaatatacacatatatttctaatgtttggcgtgttgctcatgttcttgaatcatgctcgcccactacctttggaaaattgccgtccaacttttgtttgtctccaacgattcctcaatccgtgtgatggtggggactgctcttttacaactggagatgcttttcttgccactttggaacttgcatgaaatttactcaaaaagttttacctatacaggatgtactagtcatattttgatacttgtactcttgtcattctcttatttatagtactgtacagaacaaagtatatataactccaccatcacgtggggggaaactaactaactaacttgtgctagaagtttgaggatttttcagccatagttcctcaggcagcgccttggaccttttctttttccctttccccactttcctgtgagcaaaagttttgagtttgtgccatgagacaaatgatcaaattttatttaaccagtttctatgttttgcacactaacccttttgttttgtttctttggcagcctcaagatatttttgcccatcatgactgtcgccttgctggttcttattccagttaatgtctctggtggcacgttacttaatttacgaaaagaaattgtctttagtgatattgataagctttccatatcaaatgtcaaccctggatccaacaggtttgtccacaagtatcttaatcatgaactcttagcagtgttaattattctttggcagagctcgtataattgttgatgactgctgtacttgaactctacattgctctggctttatgctttcatttgtagcattgcttgaaattgtctgaccatgtcctctgcatttcacttcaggttctttatccatctattaatggcatatgtgttcactttttggacttgctttatgctatacaaagagtatagcaatgtggcatttatgagattgcacttcctggcttctcagaagcgttgtgctgatcagttcactgtaagtgcaaataactaggcaatgctatatttagttctactacaatttatgtatcacaaccaagctccactaaattttttgtaaaggaatagaagagcagttgaacaaatatttggatttaatgtctatagtgttgtcttgctgactggggcatactccttttattgtgatataactcaatgggataccatttaatattgagatccatagttatactatatcacttactaatatattttggcatggcaggtgattgttagaaacatacctcatgtttcaagccattcaacatctgaaacagtggatgaattcttccgtaggaatcatccagaccactatcttggtcagcaggtacctaatcctcaccattgcttatgcctcatcatggatttaaactggaatgatgtttaaagctctacttgatttctgaccgatattcaatttacaaaccatggttattgatgaatatactgaccgcaaaactaacctcaatctggatgttcaggctgtttataacgcaaacaggtatgctaaacttgtgaagaaaaaagagaggcttcaaaactggttggattactaccagctgaagtttgaaaggcatcctggaaaaagaccaattggaagggtattttataaacgttgatcctgtcctttcgtttgcatcaataccaagttcttggacaactcgttctgaattcatgttccccccaagaaatgtttcaagcttgtgaatatttttggttctgcagacagggtgccttggtttctgcggtagagaagtggatcaaatcgactattaccgtgctagaatcagcgagcttgataagaaggtagagctagaacccacagtgtcgtgtttcttaccattcacaggcactcagcataactttgcaggctgttgcatgtatgtttgtatgcatgagtgaggctcttgttcagttttaacttttaacacaagctgtttgttattgtgatctttttagcttgcatctgagcgtcaaagagttctcaatgacccaaaagctgttatgccagttgcttttgtgacatttgactcgagatggggagctgctgtatgtgcacagacacaacagtcaaagaatcctacccaatggctaactgattgggctcctgaaccgcgggatgtatattggcagaatcttgccattccatttttctctctcagtatccgcaagttcctgatatccattgcagtttttgctctggtgttcttctacatgatacctatagcttttgtgcaatcacttgccaatcttgagggtattgaaaaagttgcacctttcctaaggcctgtgatagacacgtaagttagctcccattatatctgtcgaggttctgtaaattgcgccccttttgctattcactcatcatatggcttgctgtataacttgcagaccagtggtgaaatccttcctgcagggtttccttccgggtttggctttgaagatttttctgtatatcctcccaacggttttgatgattatgtcaaaggttgaaggttatgtgtctttatcatctctggaaaggagggctgcttcaaaatattactacttcatgctggtgaatgtatttcttggaagcataatcgctggcacagcttttgaacagctaaatgcatttttccatcagccaccttcacagtaaatttcttcgagcaacctctcttttgtcacatatgctactgtttccttgtcctcaattaactaatgcgatcatggcatatacgagtaaatatactgatatgatccttccttccaatttctgcagaataccaaggaccattggagtagctataccaatgaaagctacattttttatgacatacataatggttgacgggtgggctggcatcgcgaacgagattcttcgagtgaagccgctggtgatataccacctgaagaacatgtttattgtgaagacggagcgggacagggagagggcaatggatccgggcagcattgggcttgcagagaacctcccatcactgcagctgtattttcttcttgggcttgtgtatgctgtggtcacccccattctcctccctttcattatcatcttctttgccttcgctttcctcgtgtacagacaccaggtgagtctgtctgtcggtcatgcctgctgctttggctttggctttggctttgaaagtgatggttgttttggtttggctattcagttaggcgctaaaatgtgttttttttttgtttagatcatcaacgtgtacaaccaagaatacgagagtgctgctgcgttttggcctcaggtgcactctcgcataatagcgagcttgctgatctcgcatgtaactctgtttgggctgatgagcaccatgaaggctgcctactccaccccgctgcttatctttctgccactcctcaccatatggttccacaagtactgcaagagccgtttcgagcctgctttccgcaagtaccctctagaggtgcgtgcatctctcattactctctttgtgaaatcaagaataatttgttcaagtatatgcaacaatgacatctaattaacgagggaataacctgtggtgttggcaggaagcgatggagaaggacaatctggagcgcacgtcggagccaaacctgaacctcaaatcgtacctgcagaacgcttacctgcaccccattttccacatgtttgagcagcagcagcagcaggagcaggagcagcaacgggaggagaaggtagaggtgcgaatcgacaaggcgcagcaacatcatcatcggcaggtagaggaggaagaggaggagagcaagagcagccaggctacaacacactactaccaccatcaccatgagcagaccacaacgacgacacaccaccattaccatcagcatgagcatatgagccactaccacatgggcccctccgacacagctgactcaccctcgccgccgcactttgtctaccattatggcgtcgacccttgataatcgcccagatagtctcttagcttctgaatcactagattgtttgttcttttgttttttccttttgtcaattgggggtgatatttttattcctctaattaacgaccgactggctgctgataattatttaatgatctgttgtaaatgcgaatatgtgagttgattgagtgtgtatatgcacgtaaatcggaaaaattccaatttgactccctcgaatataggccaggtatgcctgatccgtatccctcagcctgtaaaactaggtataatatcgtttccttgttgatgacaccaaaatgactaaggagagagagagtggggtagagaaggaagaagaaagagaatgtggggaggatgatatatgggctctttcatattttttttaattttctcaaatgattgggttgccatatagacaccatgtcagcaaataccaccaacaatactatctgggagtcattttgcaccgattttaatagttggagttattgtacctgattttatacttgagagatacaaatcacatccaatctatatttcaaattgagctttttccatgtaagttctctttgtttctttttaggaataagtcaatttgccgtccctcatttttccgtcgaatttaatcggcatccctaaaacctaatattagaaatctcaaacccaaaccgttcaaaatcaagtcccatgatagtatggatggttgttttagttgtcatggcatcctagtcacaaaaagaaaattaaaaaggcatgtgaggcccacatgtaatcggacctcaacctttcctgacctatcctcttttcccactcactccacctctcccttctcttccctaggagttcgccaatggtgagaggggcagtggccgatgagcttgttcgcgagggcttcggtgatctgcctgccaggctgaagcggtttagaaccgacagaagaggtagctagagttgtaggtcaaggcggcaaatcaccttggcctcgaactcttcagccgctgacggcatccttacagcacccacggcggacattgagctatgcctcccaaacaacgtcctctagatcatggtggccgaagagcgcggagtagtcaagggcaccgcgcggagaagcaaagtttggatggagctcgatcaagttgaggaagctaggcggggtcgatgggctagtcaaaacgtcgtggcctcaagatcaagcgcccacatgtgttgtggaggtctcccacttttttttggcacataaatgcctaattagaacgagtggacaggtcaatttgcaatgtcagggaaaccaaccatttatactgctgaaggaacccggttttataagttgttggttctaataaggtataggtattgcgatttagggatatcaattaaaatcgagtggacttattccttgtttctattgggctagaatgggctgtgaaatggcggattggggccgcaggaaatattagtccataggaggagataagatgatgccaaaaccaaacacgcaacttataatttgaaaagcgcagagagtcagtcacaggctcacagcgcaggagcctcacgctcgtcttccttttttgcgtgaacctcctcctctgtctcctctcctccctgcgatttctttttttcctatctctctctctcgatctctgaagtctcaactgaaagcagccgccgccgccgccgccgaccttaatttccgattccttccacccgccgcctcaagaaaccgcaatgcagcccgacgccgccgccaccgcccaccccagcttgagcttctactccgccgccacgggcctctacagcagcctccaccctcccctacccctcccctccgacccctctctctccctcgtcccccacctcttctcccatctccccctccaccaccattccctcctcgtcgatgcccccaccgccgccaccctctcctgcgccgacttccgccgcctcgtctcctccctcgccgccggcctccgccgccgcctccacatcgccaggggatccctcgtcctgctcctcctccccaactctctcaccttccccgttgccttcctcgccgtcctcgccaccggcgccgtcgccaccaccatgaacccctccagcgcccccgccgagatcgccgcgcgcctgcgggacaccgccccctccctcgtgctcgcctccacccacaacgccgctaagcttccgcctctcgccgccccgctcgtcctcgtgcccgacaccttccagcagcaacatgatgatgatcagttcgacttcttcttccacgcgctgctcgagaccgaccccgaaacgccggtggagatgggggtgggggtggggcaggacgacgccgccgccgtcctctactcgtcggggacgagcgggcggagcaagggcgtggtggtgacgcaccgcaacctgatcgcaatggtggagctgttcgtgcggttcgaggcgtcgcagtacacgcggcctgctcgtgacaatgtctacctggcggcattgcccatgttccacgtctacggcctctccctcttcgccgtgggcctcctctcgctcggctgcacggttgtcgtgatgaggaggttcaacgtcgacgacgccgtcaaggccatccgcaagtacaaggtgacgcacctgccgctcgtgccgcccatcatgtcggcactgctcagggccaacccgcccttggaattggattccttgctgcaggtctccagcggcgctgctcccctcaaccacaccctcattcaccacttccttcacgccttcccccacgttgatttcattcaggtccctccactccttcccctctctctctctctatatatatatatatatatatatatatatatatatatatatatatatatatatgcattattaattgcttctgtcccatgtttctcagttagcgtatcaattaaaaatgtggctgctaatgaatattttgtctttatctactgcatgtactacattttactcagctgttagggaatagtatatatgtggaatgggctctgaaatctccaatatatcttcatgcaatgtttgcacaggggtatggcatgactgaatctactgccgtaggaactcgcggcttcaatacatgcaagcacaagaagtatgcctcagtaggtcttttagcccccaacatgcatgctaaaattgttcatctggaaagtggttcttgtctgcctccaggctcttatggggagttatggctccatggcccggctataatgaaaggtaccgtgtcaaaaaaaatttactttattcaaaattctactatttttgcagtctgatacaaaagatttgataattatttcaaaagttaattaacaagcctaattattcacatatgctggtatgatctggctgcttggaatcttatatgaaaactacgcttttctactgactctagtttcttctgtactctctgccatcttgtttagctcctttagataatgtggttattcttgttgactgaagataacatggtcattcttttttagataaaaacgtggggtggtcattttttttttccactgcagataacagaatcattctgattttaaccttgtgtacttgctctgccgaacactaatcgttgcagtgctaaacactaaactctttttaaatacggtactgcattaggactcccatgggttgccatgcttagccaaaaaagaaagattcccaatgcatgctgctctcgaggaatagatttagctgccttcactaagtattgttcctgagatcagttaggcaaggttcctgagatccatggggaatggggatttagtttagcttccatactttagtctgtaacatcatatcccgctttaggtttgaatcatggtatgctgtacttgttacctctttgtatttgggttgtcagaattttgcttcgtcacaggttacttgaatgatgatgatgatgctttcactagaaaggatggctggttgaggactggtgatattgcttactttgattcagatgggtatttgttcatagtgggtcgcttgaaagacacaatcaagtacaaaggatttcaggtatggcctcctgtagcaggccttggaagttggaatacaatatcgttgttcttgtttcaaggaatttcaggtatcatgcaaggaagtctttggttgtaacaaattggtgtatttttcttgccttcagatagctccagctgacttggaagctgttctgatccggcaccctgaaattattgatgttgctgtgacatcgtaagatttttatttctaaacagcgtgatattatagctgttttatctgttatcatgtccttcaacgtgtttctttgattctctcgttactttttttttttgacattgattctctcgttacttagtgatgaagatgaagaagctggagagatacctgtagcttttgtggtgagaaaatctggaagcactctttcttgtacgcatgtcatggagtatgtggccaagcaggtaagaacaagaaggtcctacacaacacaacactcaccatattttcttgcttgggaacattacaagataataataacagcaagtgcacagagtgcattcttgttagctagagtatcaaattccagtaaaaatggatcactacaagctttatgcccacctgtgcaaataaatatggcagatattagttagtctcaagtcgtgttggtcagtgtgctcctctgcatccagcccacctgttttgaaaacagagatgtggttgttgtcagttgagcccccgtgtgtaccgatgggaatgtgtaactgatatgagcctgtctgtcagttggtttggccgcagccatagaagacattgtccatccagaagctggttgttctttgaccctgcccatccaaattaacaatatgtctttttttttcctgaagtaataatccttgggctgatgctgtctagtagagtgcttaccaagtagtgtgatgttgtatactgttatggtgggtgcaggtggcgtcgtataagagagtgaggaaggtaatattcgtggaggcgatacctaagtcagctgctggcaaggttctgaggaggcttctcaaggactctcttgttgatgcttccagtggcagatccaggctatgatcagagaagaagcaacatttacgcattcaatcaaagattcattttggccgtcaagttaggccaggcctcctcccgtttgttaaaacgaaaaagcaaaaggtccgggcaggccttcgttccaaagattttttttatttagaaaaacaaagaaacaaacgaggtcagtccaggctggcttgtccagcagcatgcctgttaatttccctgtagaagagtagatcctgaccagaagtggtcaatttttatgtattgttacttgtagtcgctcatgggtaggaatatgcttaagagcatatgctcttggaatactggtgggattgatgaaggtgtcaatgatataatactatggttgcaaacatatatatgtaatactattaacttgggccttgttatcgatcatctggtattttgttttctgatggatggtaggatgcgtttaaatcgatctctgtgtatctatctgctcaacaaactccagcgaactaacgaaccaactaaccaagggcaggcatcctaccaggcccctggattctaactattttgttttcggtaaacaaggcaaaagaaagagattgtaataggaggtttgtttgcttttttttttttgtttctagtcgcatcgcggcggcgtcgtggcgaggctgtgggtgcgtgtcctccgctgcatattattatgccaccgcggacgcggataaatgatggatttgctttctttctttgttaaaagataaaaaaactgaagaaacacatctctctccaagagtctgctgattcaacctcgccctcgcgcgtataatggagatgatacactcgcatcgcatcgtatcgtatcgcatatataagttgtcatgtgagtgtgtgtgtgcgtgtgtttaatttaccttaataataataataataataataataataaaatgaataaaaaagaaataaaggagacgaagaaggcgtgtttgaagcagtgattcgattcgagtagaacatgagacgggtggcggattatgcatatgttgggagtaagtaattgatgatgtgtaaaatattaaagagagagatactaacagtgcgtagtgtagaaattacgcgtgacccacctggagtcggagtcggagtcttgttccctttttattgagaggatcccctccctcgtgtcgacacgatcgtccaaaatagggaagagggagggggttcttcttctcctcgatccggttgaggactttgaggtagagagaggcagaggcgacgaggaaggatctgatctatcgatggcgcgcgtttcgcattccagaaagcggactagggctccctccaactccaactccaagcccacttcacaaacccaaccgccgccgccggagctcaccgaccgccctgtccgcgtctacgccgacggcatcttcgatctcttccacttcggccatgcccgcgccctcgagcaggccaagttgctgtcagtttctctctcttctcttctttacattacattacatggatccccccgatcgatttctcttggatctgggcctctatgttagaatagatcgagagatctgttcaattccaattcctgattgctcatggcgatcgcaggttccccaacacgtacctgctagtgggctgctgcaacgacgagctcaccaaccgctacaagggcaagaccgtcatgacccaggatgagcgatacgagtcccttcgccactgcaagtccgtctccttccttccttcttcaccttaccacatacgtacatggattttcatcaactgctcttactggattctagtattacatatcaatatatatgcaacaactgcatttgcattggattggactagactccttaatcaacacgtagagaacagaatttggattaacaagcacacaaggaagccaccaacgtttctatttccctttcctagccacaatattatgctcgcggcttgagtctcccttctgttgtgctctttgcaaactacatttctggattaacttatttcaaggggcctcttaatctctaatttagtgctgtaaatttaggttccataattacttctcaccttgctcctctcagctactttcatagctccactgatcctggatatttttttacatcagtcaatttttttccttccctcttgtgttgtgctgatatcaagcttcattattgtctgccttcttagatgggttgatgaggtcattcctgatgctccatgggtcctcacgcaagagttcattgacaaacatcagattgactatgttgctcatgatgcactgccgtaagtttcagcagcacaccaactattatcgaattcccattttttgtccctttaatactgtgctctttcagcttaactgaccggagttccttttttttttgccacagttatgccgatactagtggagctgctaatgatgtctatgaatttgtaagtcagagtagctatatttgctactagtaactacagatatttctcttgcattgctccttactgatggctgtcttcatgtacttaggttaaaaagattggcaaattcaaggaaacgaaacggacagacggtgtatccacatcagacctcataatgaggatattgaaggactacaatcagtatgtcatgaggaatttagcacgtggatacacaaggaaagatttaggcgtaagctatgttaaggttagtctcatctctgtgttggtttaccttcatcttcttgcagacaaattcagatgcatttttattatttgcatggttttgctgcttttgcaagtaatgacatgcttgtttatgggttcttactatcattctatcaggaaaagcaactccaggtcaacatgaagataaataaactgcgagagactgtaaaggcgcatcaagaaaaggtaaaccatgcatgtgactctaagatatttctgctgtgtcacatggaaggacagggagttccccttgtgtttacgactttacagatatcctgacccgctgggtaaattatttggtgcagttgcaaacggtggcgaagacagctggaataaatcatgaagaatggttggccaatgcagatcgctgggttgctggtttcttggagaagtttgaggaacactgccacaacatggtaagtttatacatgaaacttgagacaaggttgccgagaattcgtcgacagccagattgagggtaaaatgcaaaattatttggacgtggtacccaacactgattcctcgttggtatggtcaggaaactgccatcaaggggcgtatccaggagaaattgaggaggcaaacaagcagagggataattgggggtctaatgcagcaaccggtggcagcgtaataagttgtagaggagagatgacgttgagttggagtaagctgccctggggtcaccacggacgagaaatnnnnnnnnnnnnnnnnnnnnnntgggcgcaaaatttctct

SEQ ID NO: 58855 - DNA, 8238 bp, Oryza sativa
ctctctctctctcttttctctcgtaagcccgctgataggtgggccactagcccaaattgcaaaggattggtaacaatagctggctttaagtgaaaagattgagttagaggtagcccaaagtgataatttggtaataaaagctggatcaatatgcaatttactcttacatttgagacaaagatagttttaactgtgtagtggggctgcttttaggaagtttaagctatggcaaggaaaaacaaattccacaaaaatgaacctgatattagtctaacataaatcatggggatacattacagcaggccttgcaagttgcaacggcagttgatgggctgccaaataaaaagtactagtactagtatactggcgataagttgtaaggatcaagcgcatgatgaatcagcagagtagatacacagagtatgatgaatcagcagagcagatagacggagttatgaattattcgcagcaacaacagcaagtaataatacacagagtggtgtatagcttccatcccaaagacctaggtttcgctaaaattaactcaggcgacagaggggaaaataagtactccgtgcgctaggtcggaggaagggaagggaagggaagggaatcttcttcttacggggtgcgagagaggcgatctctggaattgagggcgagagggttggcctcgcacagagactccgccgccgccaaatctcccgaccgcgcggccttgtgcagatgcaagtcatcctcctcgcctcctccgcggcctcggcctccacggccacgaccgccgccgccgccgccgccgccgccgtgacgcctccccatctctacgctgcagccgctccggatcagagaggaagaaggatgggaattggatcgaacaaatgatgggctgctgctctgcctcaattgctgcccaggctggcggcccattaagacagggaatcttaacctttatccttatctatatatctcgtgtctatctctatctttaatattataaaaattagaaatatttttgtcaaaattttaatatgccatccgtctttgaattgaattttaattttatcatcagactcttatatatcctcccatatccggccttcatcaccacgtagtgggcactgtgagtccaactttatcgttgcaaccatgtatataacatctcctccatctttaaaaaccggtgcaaatcgccttctttaatggattggaaagcggtttatactgatatgacaggttgacttggtccaaacatactgatgtgacagcccagtcatcaaaagggttaaaaatagaagtgggtccctaatctaagtggcaaaggataaaataaaaaaatatgggcccacttgttagtcccacttttcctattcttcttcctctcttctatctctctctctctttctcagccgccgccgcaaatgctgcacacacgccaagaatgaatcggctgcgcacggcagctgtgctgaggccggcgcggacatcccatatgtgaagggtgcagccatggacggcagcgagccatggtgttagtgcttgccctttttcagttgcctatgtgcaggtctgcacgagaggcccaacagagtcgccagcggcgagaaggaggagtgggccgtggcgtatgtgcggttgtcgttgtcgtcggacgccatctcctactcctccagcatctccacggacatgccgctctatgagccccccgaggtaaaccacatccttctcgatctctgcactgccatgggttgatgcgacgagatgaccggaattcatgcgcgtcgctcgtgcgcgtgtgtgtgcaggtgtcgttcgacgagtacctcctcgactgcgcgcgcatgttccacgccatgttccccgacgagagcaggagccagcgccccagcgacgtaagcaaaccaaaaaccaaaaccactcccgaagtcctgttcgctctgctccggcaacgacgctaaagcttagctgatcctgtgtatgcgtgcaggaggagtggagagtctagatgctgtcgctgcatgtgtttgtttgtttgtctatttgggcacgtagacgaagtgggagctacgtgggctggagcgcggctacgcatcggcgagcttcgaccttggcatccgcgggtcgctctacaccgatagaagagtgcgcgactaagactgatgggagaaaagagtgcgcggccggccggtgaccctttcccccgcacgcgtcacgacctgcgacccctcctaggcgcgtcggttggccactccgcccccacgtgctgctgtaaggtgagagaagaggtagaggaaagagagaggtggagaggtaaggaagaatatagatggaggaggttgctgacaggtgggaggtggggcacacaagctgattcagtcaacggggtcaaaactgccacgtcgacgaaaccacctttctaaccgctgaaagaggcgatttgcactggtttttaaagatgggggagtcgctatacccggttttatgattgagggaagttatttaactagagcaagagttgagggaagcagtatggacttattctacttagaaaagagccacatatagcccccagcccaactaactaatccctagctcggtagctcccgaccccggcggccgccggcgctcctgtctccggcaggtagcaggccgcaggtggaagcgcgcggcgctggcggcggtgagcaggcaagcagcggagtacgggacggcgtgtccgcgcgacttcgcgagcgcgagcagcagcagcagcaggccagcagtcagcagaggccagcgcgagcaggagggagctgagcaggttgcagacaggcggcccgcggccggccgccggcgccagcgacgccacgggaggtcgggtgcgtgcatactgcctgcagtctgcagcagaccagcagcaggccggcggctgcaacctgccaatctgcaaaacaactaaacaaggtatgcttatcacttatcagtttatgcaaatatgcaattgtgattacctaagtggaaatttggaatggctcaatccattagcaatttagcacagtttcatcttgtgaagttgtgatgtatttctcattatttctctatttctatatgaaacttctttagaatacaacataatactatggtattataatattgtatgagacatgatgtgtttatgccgacgtttccctcaatttttcattcctggattcacccctgcttttcaagatgcattcatttggccatttaggcccagatagtctaagttaaatcaacagaacatggctcagatcagttacaggccaagttttcactacccaataaacaaggccagtttaacttacatagccattttactacagatcttcatagcatactatgtcacatacaataaaattactaaattcttggacttcctcatcagtttcccatttttaagttttaacaatgcaaaagtgccttactgtcatgcggtgagtctccttgattcaatatacgcatcacatacttgataggtgtatactggcagcaaaacttttagctatttactccaagagctgatgataaaccaacaatggtcatggaattttagctctcttcttcagattcttccacttatcctactccaaccacagcacgtagatcgatgcggtggcactaccttctatgtgtgttaggctcccatctttttgccaaatatggaaaatacgtcatatggcgtattagcaaaataataataatttgtaggtaaaacatatatatatatatatatatatatatatatatatatatatatatatatatatatatatatatatatatatatatgttcttagcgacttaaacgacaatcttcgacgaaaaaaaacttcaaaaccaagttttaaaatttaaattttggcatcggttgatgctgaatagagtaaacgatgggcgcgagggagagatggctgcgccgccgccgtgcacggatgggaggcggccatggtgtgattcgaaccggattctagcaggaggaagacgaaatgggccgatacgaaatttcggcaataataaaagggggtggctatcaagctaggaaagtggatgggtttggagacaaggaattttatacaggttcatgccttcttattcaagaagtaataccctactcctgtccggggatgattccgccgagtgtgttattgattgtatgattgggagaaaaagaatcgtcccgagaggaacccggacccctccttatataggggaaggggtccgtattacaaagtacagtccatatcctaacggaatatgggattacagataaaatacaatcgtaaccgactaggatcccgggtattttcttgacatacaagtttagaatctaacccaagtcctcataaagatattctatctatatttggtaccatatatccaactggaatataacctccatgtagatatggggtaaccataatctccacagtggcccccgagaccttcgcagttgaccaaaataatctccaaaaaacaataatccaagtgcttcaattcaacttgctccggcttgccgagtgctaaaagactgtgaagggcgaaaataaaacatggtgcatcgagtagatgcacctaattaggtgtagccctcgactatgtgattagttgaaaaactaaacatatagtcaagaaccgagtgattttatatcgaagcatgcatggtactcaataaaatacccagccgactgcttctcacttgaatatatcaaggataaaaaatatgaaaagggccgaatgataaacactcaaaaggtctaaaaatagatatatttggtaggaatccgagtaagaaactcttaaaatgatcctaggccataacccttaccataatcaaaataagcatataacatgctaggagaatgactactaataaaccagtcatctcaaattaacccaacagcttttgcagcctaaaaaagcttacaaaaatggtataacacctctctgtcgggcaccttttcatgtgcatcataataattccaaagaattattaaatcgcgttaaaaagaattttaacagcatcgggccgcatcattgtgagcacatattgccaaagcaaaaagcgcctaagtccctagggatcacaacgggccacgctgaaaacataattgggctgaagtactgtacaggcccaggcccattagtactcccgataccctaaaaataccgaagtccaaacgtcgtttcgtcttccccgccgagactctcgccattccccactccatgctacagtacagaaccgcgccgacgaagctagggttcatcaatctgctccaacccaccctcaaaaacttcacaaaatttctccccgcgtccaccgctccgattccccattcctctccagccatatctcggaccaaatttaaccatccagttcacattcatggcggaagaaagagaaagcttcgagagtcagtgggcgccctccgatgtgacagaagataatctgaaggagatggtggcgcacggcgttctcccagcgaaggagattatcgggtggcgaccggcgtccggcgaagcattcccgaccccggacacacacgaaatcatggtatttgctcatttcttctatggcggattttctcttccaaccttaagattcttccgggggattctgaacttctacaggattagcttgcatcacttgaatccaaactccatagtgcatattgccaatttcatccatgcctgcgaagcttttctgggcattaggcctcatttcgccttgttccgccgcatcttcttcctcaagccccagccaaacaaaagcaaaccatgcgtcgttgcgggagctggtttccaactcagaggaaccttgagccaaaaatatttctccatgcccttcaaaacctcaaacaaaggctggcatgcaaactggttctatgttcagaatcctgagcccgcagtccccgagtactgctgtcttcctccggtttaccaggatacatggaactcattgcctatgggagatgaagctgctcaagcagtagaactgatggagaggatgataaagctgaaagaatagggccttcaaggagaacagatcacccggcactttaccaagtgtcggttagctccaatcaaagaaagatctcgcacagccttcgaatttgacggcaagcatgacccaaaccgtgaagatccggattctcttgacttcaaggtcatgaaggaaaggatgtataagatcttctcaaacgccatcgttgtcagctactcacacttgctgccagtcgtaccgttcaatgcattcaatcctcctccaccggtgcgtattcatatacttcaacctttctcaaaatatgatcttgttttcttgttgaatcatttaacaatgaaggatattacacccaggaatttgctttgatgaagtcggatcccccaatcgctcaacgccgatctccccgccaccaaactgggcaagggagcggaagaccaagaattcggtatgaaactcaaccaagtgcttctgatccagtcggccagtcagattctcgaaagaggaagctggttctaagtgacgacgaagccgatgataccaccaggaggcctgtagaccgagagacgaccaagaaactaccaaaacaggctactccaaggaagaaaacatccagtcgtcctgtgccaaagatcaggaagtcttctaggtgcaactcatataacgatctctcttgtattgatgcgcacccattgcggcaataatactgataatcaaatttgcaggaaaccatctgatatagacccgtctgggaaagactctgacccaactaacatggacacaagtttttccaaagaaaccgggccaacagcagagaatcgtccgagtgacaaacaaccggcaaccgataatgtagaacccagcaacgagcccccgactgggaaccagtcgactgaagctgaagtcggtgctaaccaggagcccccgactggaaaccagtcggatgcagggccaagccaaaagattcccgaggttgaagctcaaacgaacagtcctctcgggaaggatgctgacaatgaatcagaaaccaggtctcctgtgaagacaccaaagtctactcgtccccgaccgggaatcatcacaggtagacacgctatctgaaatcgttttgatccaacagactttatttggctgcttcatcttcattcatggatacactagggccaataattggtgatgaagaagaaatcctccggatacaagcagctgaggattcactccctccgattctggtcaagtggtgggatgacaacatgcagcctcaagggatcgtgataaataagcaaaaagaggacgaggagctatgtctactgaagaaggcactaggtcaggcaacccgcattgtaaatgtaagccctctggtacctgatctcaaccatcttgtttgccatttaattcatgcgctaattaaactgttttgtagaggatttgtaacaccctgaaaattctcccaacgaaatcaaaacaccaaaaatacagattttcaaaaactttttaagtaataaattgcatcatgccgattttattcgcctatttcattggattttgatctcggaatttattaatcgcgaataatgaataactaactaggaataaaccttaaaaatcaagctggctaaataaataattaaaatataaattaaaataaagattaggtgggattggaaataaataaaatattatcgcgaccatattagcaataattaaattttagtacgatggaatgagaattaaccctaattaaaaattcaaataaattatataaacaaaatatgagtgatattaaattagggtgaatttttagttagtataaaacaaatatggagtaaacttcatttatgcaaaagttagaatttataggactatatttaaatagaaaatgggctaaaatcgggataaataggaaaagttactgttcattgcgtcataggtgttcgatcgtggtccccctggccccgcccccttccctgccgcgtgcgccgcgtcgcccgcccgtcgcgcgcgccgccgccgctgccgcgccgtcaccgtcgcgtcgccgtcggcctcgcgccttgtgccgccgcgcgcccgtcccctcgcgcctgcgccccgccgcgcggccgtcccctcgccgtcaccctgcgccgctgccgcgccgcccattccatcgcgccgagccctatgccgccgcgcgcgtcgcgtcgccccgcctgtcacgccgctcgctcgccacctgccgcgtc

SEQ ID NO: 58856 - DNA, 16833 bp, Oryza sativa
caacgacgcgacggtcagatcgatttatagcagagcagtagttacgttgatcgatcagtttgagagtttgctagcgctagatagagctatagtatagggctcgaagatgacgacgagctcatggagcggcctgcttgtgatatcctgtatgttattgatgagctgggcggcggcggcggtggacatgtcgccggtgcggttcgacgccgcctacatgccgctcttcggaggggacaacctcgttccctcgcctcacgcccgcaccgtcctcctcaaactcgaccgcttcaccggtaatttgtttatttatgaatactaattaatttgatttattgctagctagcatgtatagaatcaatcgatcagtccatcgatcaattagagataaatatatatgccgcaggttctggattcgtgtccaagtcggcgtaccaccatggattcttcagtgcttccatcaagcttcctcatgactacaccgccggcgtcgtcgtcgccttctacgtatgtcttataccaaccttcttcaattttctaaattatgatatcgctatctccaagttaattcatacgtaccgtacgtatgtggatcgatcgatcgattaattgatcagtgctaactaaaagttaatgatcaattaatttgtttgtgcccaaactaatttgtgcttcaatctagctcataaccaatttaatttgtgtggagtacgtacgttgtaacgattatgaatttggacggtggagctacgtaccctcgctggtatcttgttgacaatttaatttctttttgcaacttcgatcgatcttttgcgagcgagcatggtgttatcttgttgacgacgtccacctgcaaaagatcgacgtacgtagcagccgtgcactcatctcatcttaattaattggtccgttaagttggtacgtgttaagttagttggttcataaattctaagcaattgtgtgggtttgaaatttggatggcgatgacaaaggcaaaaggcaatatgtatatcaatagagaaaggtcgacagatgggtggtggatattaataaacctatagctagttatcttatactctgtccggacataattaattgacattttcaaacaactatagtatatttttttagaattacatagcaacaacgcggagactatagtatataatttacaaagaaaataagcctgcaaaacatttgtctgaaacgcaaagttataaagctgagcctactaattaacatattttttaatgtgaattttgagttgataattatcacgtattttctctaccccataaaacactactcaaatgatgtcggattagattattttaagatagagggagtgcatactacacgcatatagctgaggtacctatttgtttgttattgtcgcgctcgattagtaggtgagtgcgcattgcacgcgcgcacatatgcatatatgccgccacacccagcatatccatccattatactcattggccatattatgcatatggagtatatacatcgggcaatgcaatagggtatagtagctagcccatgcccggcctccatcaatcaaaaatcgccgcccaatcttcttttcttctcgatgggtggaggagattgattattcaccctcaatggtaggcgacatgtacctgtcacaccttttcctttttccccctcttcaattttatagccaaaaagcaaacaaatatatactagaatacatgtatatactagtatacataccacacaaatatatcttgtacgcataacaaataaatatcaccaaatttttttcaaaaaatatacttccaataatattatacatatgtataaagtatacatatgtgtttgtatttatttgtataacggatttatactcttaaaaatagctgatttttactttaaaaaaatttctaaattttcgatgatatttattatgtcagttggtattacatccgtccaaaatatagcaatctagactggaatgagatgttttagggcattgtagaactacaaatataaggcatgtctagacgttttaggatggagggagtatgtataatgtgtatactcagattttgtgtctttagtgagggattttttttttcaaaagtgacggctgtatgctacacctattctacgtgtgcgtgtttgctagtacgtactactgtacgtatttccttgggttgattttagagaccagtaaaaacatcacaaattaatttatgtttgaatacaatgcatgcagctgtccaatggcgacgtgttcccggggcagcacgacgagctggacttcgagctgttgggcaaccggcgaggccacgcatggcacgtccagaccaacatgtacggcaacggcagcaccgggcgcggccgcgaggagcgctacctcctccccttcgaccccaccgccgccccgcactcgtacgccatcgcctggacccccgccgccgtcatcttctacatcgacgccatccccatccgcgagctcgttcgctgctcctccggcgactaccccgccaagcccatgtccgtctacgccaccatctgggacggctccgcctgggccaccgacggcggcaggcacaaggtcgactacgcctacgcgcccttcaccgccgtcttctccgacctcgtcgtcaccggtggtactgacgacgaccactgcgccgccatgggcctgatgacgtcggaggtggccgtgatgacgccggcgaagcgcggctccatgcggcggttccggtcgcggcacctgacgtacagcgcgtgctacgacacggtgcgctacaacggcaccggcgtcgtcttcccggagtgcgacgagtcggagcaagacaacttccacgcatggggcgagtccaagcgtgtcatcaacagcagatccagttccagcgccacatacgccactggttcaggcgtgcgcatcgactaatttatttactagtactgtgtaatctcaatcatgcattattccaccagttgatcctgcttctagatgatcgatgatgagtttgtacgtacgtgcacactgacacattttccagttcatatatatactcgtatttccttcggtcgttcgattcgattcgattcaattatttggtgattttgctatcaaccgggtgtaccctatgatcttttatatctcaatttttaaaagggttgcatgcatgttaattcctatactataaaagataataataatgataggtgacatctttgccaccagcttaccaccaccaactttttaacttgttttacaaattagttattgatgacattttttgatattttatttggattccagtgaatagactgggcatttacccatagcaaaggcatgtgcgttttactagtgttttgcgctttggttattctaggatcgacggcgcgttttgcgcaccctaacatacagttaattaattattccaactagtgtagtggctagcattttttttagaaaatgtaaaataataattatatttagtgtttttgaaatatagtagatatttttttagataataaatatagtagatataatttcacactttatcgtgaacacaaaaaaatattaaaaatgatagtataattatgtttagaatggattaattgtaatgtaaagcttaaagaataaaatagatactcctacttgtatgtccccacaatttcagttatccatgtttaacacaactatttactcagctcacgtgtttcattaacaaatggatgataaaatagttaaacgctaaatgtaagggtggcaaatagttatatgcggccttggtgtcagcccgtagagactagcaggccagggttgaggttgaaggcgtacatgtgctagatggactgggccgtagtacgtatgtgggcctagttgcaacggctagtaggtggcgtgtagacggagacgggaggcgaggcgagcggcgccgcggaacgggacaacggtcatattaccgaccgttgtactccaccacccacgaacgaacgaacggctacgcacttgcgtttaaactttaaagcagcagcagcagcagccgccgcctccgtccgtccgtccgtctctctctctctctcttcttctcttgtcagtctcgcgcctcctcctcctcctcatacgcagcagcaagcagccaagcatggagacgcccctctccagcaggaggatcacccgctccatggccaaggcctccgccgccgcccccgacgccacgtccacggcccacccgccgcgccccgccctgcacgacatcaccaacgactcccccatcgtcggcctcgcctcctcgggcctccgcacgccggcctccaccgccgccaaggcccgccccaccagggcctcccgccgcacccccggatccggcgaggcactcctccgcggccaggtcaagacgctcctccagaaggtccaccacgacgcctcctcctcctcctcctgcgccgcagccgctcctccctcccccaacatcctccgcatccacgcgcccatcggtctcgccaggtcgcccgcccacctcctcgcccccacgccggccaacacgccgcacctcaccgccgccgcccctcacgccttcaccatgacggtgccatgcgtcctcgaggaggagttgctttccaagctgcaggtaaacattaacctaattttgcccccccccccccccattcctcctcccttgcttgcttcccaatatggtttcctttgcttctgttccaccaatcaatcatgcgtgcaatcattttcttcaaataatccaatccaatccaatctatatgtgtgtgtgttttgttatgcgcgaaattgctgttctagctgtaggacatccaacattaggcgaattctgttcgattaaccatgcgtcgcagcaatcattttctaggataacatttcgtttcttcacttgctgcccattccaaatatattagacccaaggattcagaagatggtactgtatttgcttattgctgcgcttacattacctgtaacacgacctctgcattacgtaatgcagatttgacaaggacatttgtcaggtgttgtacatgaaattcaatttgtctatatcttcagtctggtattgattctacactgggtgctattctgttggattgttctaagatagtaatgtttggtttcctggcttgctgcattcaaaatagattggacaaaaggatccagaagatgcttatcgctcttcttacatgacctgtaacaccaactctgcacaaggacatttgtcatgtgtttgcagtacatacagtagtacatgcataaacttacttgcccaaatgtttgtgtttgtgtttgtgaagctatccatgtgtagttattgttgcaattggtcttgagctgatttggtccctctgtctgtggtgcaggtcattgcagatgccctgccgccacctccagctcaggcggaggagaaccaccttggagagtgcaaccgtgcactggtgttcgacgactcccccgggaaatcggacctgtccaatgctgcctcggtgctctcgtcgtcgtccctctcgttccaggacagcagcagcaccgacagatcaccggacgacgacagctcatcggcttggtcaatccaggtcaatgccagctccgagaagggcgacgaggacacgttcactgatcaagacccagaggaggaggaggaggagtggctaacagaagatgatgatgatgatgagtgctttgatgatctgtgtgaggggatgagcaagatgtctgtgtttgacgatgaggaggaggaggacaagaaggctgggctgcctgcgtttcaggggaagcacaccaggttcatctacgacagcgacggcgagatggagagggaggacgtggcgcatgtgccggtggagaactgcaccatggttctgaggggcctgccggtgccggaggggaagcatctccgcttccacgaggtggaggaggatgaggaatagaatgacattgctaccagtgatacacttcgcatccaagcaacaaaaacaacattgctactatagtagcttcttctttttcttttcatctggacagacacattgattcagtctactgcaatataatgccttctgtgtttcgcttcatgtttcagttcttctgaatgccttttgaatgttacaactgaataatgcaatgcaatgcaaatatgcaatgttccattacccttcgttcagttgcatgtttatgtgaaagcatcaattacccttcgtttttcgaaagaaggagaagaagttcagacaaggtctgaacttcaattcctgttagctgcctggcatattactatttgcagagcaatttctttcttggcccaattggaccattcctgatactggaatgtggaaactatccgaaggaagaagaaatcattaaatcaacgaagcaatacagggagatggagattaaaagattttccctccatttaatattacaaatcgttttaacttatctttaagtcaaaattctttaagactaaatttatcaaaaacatagtgacattttcaacacaaaataagcatactatctaaatgccccctccgttttaggttatagatgtcaaactgctttaaatttgattaagtttagagacaaatatagtaatatttacactaccaaattagtttttattaaattaataattaaatatatttttataatagatttatcttggatcgaaaatattactattttttatacaaacttggttaaacttgaaacaatttgattttttgaccaaagtcaaaacattttataacctgaaacggatggatggatgtagcgcccgttccgtcgtggcgcctagcgggaaaattatctcctaaaaaccctaatttcgaaatttgtttcttcgcttgttgtctagtgtccgtgccatctcaagatctcaatccccgatctatcgtcgagttcaattccgaatccaaatccttccaaatcaaattcctccgcaaaagtccattttgcctcccccaaggtcgatgggtcgaatcccgctcggcccatctctcccccggccccctctctcccgggcgctcttgctgtctatggtttctgtacaatctctaccaccacttggtgctatccaaattatctgtgaaccgccactacatgtcataaaagataaaacatgagcaacccaatgtaacaaggaggtgaagtacatgcgtttgcgttaagaagaaacaaattcagatctatgacggattaatggtgaatgcagaataattccttgaatagtcttgactgcactgcaactaggtgctaaatttgacacattataaaactagcatgtgtattatattttctattactaagtactaactatatatgttctattatacatggttaaacaatcaagtcaaaaaggcctaatatttataagtaaaaaggatgaaaactaacatgttactataagggaagaataccgtaaaagtaaagccatttccttcagactacgagtatttgccctcctcttcatatcaactagctcaggaaaatcattcatatgcttttttgagtacacacaaatgaggtttctgcagggagaaaattcctttatgaaattaatatttccaggcaatagaaacactagaaacagaaaagacaactcagccatatgagcttctggggtggattaaaaaaccttcccatactaaatggcttgcagagaggatctgtaacaaccctatcaccagcaacataaacctacaaaagatggcatattagtgataatgtgattagtcaatagcatatgacgattcacatgtaaattatccaagtatgtccaaattactgtcgtactatgttttcgctgatccatgggttgcttctttcaagcagcaaagcaatgattgctggatctgcttctgtctgatggttagacatcagaacaacattatggccctacaataacaaacaatttcagaaaatgcataagaatctttagtaaacaattaaaagaattattcgacagctctaaagcatgacagaagtatgttaggataattactacaaacacctaagtacctagcgtcgggtgcttccagcaatgacagaaggtcagaagcaacttacacaaaaatcatccggtgtgagggacgtcatgtgctgacatacactggaaacacttttatcactaaagcataagaattggcacatgatgtttgttctcatcattctcttctatcagacatctctaaataactatgaaaccaaaaaatcaaacattgatgtgaggtagatcatatctagttgaagctttcttatggccgtctcttgctgttgatgcttatatatcaaaacccttggaaggaggggaacctctgttagtatgtatcatgatattactatcaacgacgctgggaggattacctctcctgttcatctaaaaaatgaagggtcgattccagagaggtctttggagggtgctatctatcctagttcttttaaccctagatatgtgattcatgggttattggtttgttctgtttactaaaccatggcagcttgcactcaccaagatgttgaagaggattgattatcaaagaagatgtttgatcagaaataaatacagaaaatagatagtacaatggagtttagatgaactaacctgttggagcttctgttccatgtcttggaaaatggatatattaccaacatatgaatttctgggcatatgaaataaaaagttagcatgataaggaagacatacctataagctatacagataaattataacacatgtgaatgttgcaagtttgacggcatgccacggtaataagcaaaaccaaaatgtgttaatagatatcacttttcttgttgaaggtatatctatgactaagccattagttaaaaaaactagctacttatggagaggatgggaacaacaatgtcttcaaggactgggaaagcaggtaatatcttatgctttgattaaagaatattgccttcacctatacagggtatctatatcctcactgcacccatcaaaacaatacggtcatgtcgcgcgacatgacagaaatatctgccatctatgtgaaatgtgattaaagcatttgtgctacaaagtgtggaaatatactaaataccatgaatgggcaaaaaaaggggaagattgaaagggtcctcgatacctataggggaagagatttgcattacctatagtctacaaggggcctaatgtagttctgaccaaacatgtaatagtcgaatggttccctgacagctttgtgataaggcggaaaggtaaacggattctgcaaaaggaggaggcagcttggtataaaagggggcataaaagaaaaatgtcagaggaaatcaggaagataatgacaggaggtagaacctctacatcgagcagaacacaatcgaacagggccaccatgtttgaaagcacgatgtcgtgtgcatttggatccctgctctgcataacctgataaggcagagtatccccgtggccatatgagccgatgatctaattgcaattgcagcagatagaaaagaagaaatgttaccgcgtccttgtagttgtagtatagctcttctagattggcagcgacatctgcaggcagcttccctttctccacttcctttctgatatgcaaaatgagctctgcacatgacaggaatcgagaagtgagcagagcacctcgtggtttcatctcatctagattctagagcatctaaaggtagagtgattttctaggtccaatatatccaaggcacaactaatataaggataataataatcgagcaattcaccaaccaaccatgtccatgcatcgaggattccaatgcgacccccatactaagtagcaatgcgaatgcgaatgcgaatggagtttgtgagattgggaaatggaggggagagaaccttgctcgttgcgcgcgtcgaggaggggagaggggcccaccacctcggaggcgaggacggcgcccttggccggcacccgcggccctcgggccgccggcctccaggcggccttggcttcgaggcggagggcgccgcggcgggagcagcagagcctcgccggcgcgggcaggatggcggtccacgccggcgacggcgaggaggcgagcggcggcgcctgcatagaagaagcttctagaaacctaatccgaaagggggttgttaccctagtggggactgggttgggagtggtcgccggagcgcttcgggatttgtgccaaacccaccctccatctccatctccatctccatctccagcccaattatttctttttctattttctcttgtatatattttcacttccgttgtatcattgcctattgtccccctacgatatcaaaaacgaactgtatcatacgatttgttttcgtagttcttttattagatacggaaacgaatacaaattaccttgaatacaaataagatcgaacacaaatacagaaacaaatatttatcagaacacgaaaccacagacaaataccataatatattttaagctcattttatacacaaagtttgatcataaactaaacatgtacaatattattggtataaatacatgtctaactggtattacaacacataatacatatagtatattttataaaaaaatatttaaaagtttaaataaaattattagtgtggactaatgttaaaagactagaactagagctagaacgaaatggggtatgtttttatgccttcagcgaatatccaaatattattgtgcaccggatatctgtattattatttatagaaaaagtgctcgtgcgttgcaatgggaaaaaaactaatgttatgataatgattatagttattttataattccatgggagttatatgagatagttctaaacataaacaatgaattaaatctatacctaaccctaaattcattcctcttctctcccaccgagagcgatggcggcggcacatttccccacctgtgcagcgaaataatatgatatagttcgatttaatttttattaaattaaccatgattaataacactctttgaaatttgttgttggaattttcggaacttaattgctaattttgacaatacaaacatcatttcagcatttatttaaataaaaatcccaatttctctatgggccattttcagtcgatttactatctcagcccgcaaatcaagtctaatttgcctcccccaactcctcctctgattgcgttgtagacacttgatggcagggccatcaagtgtgtgcagcccggcgatggaggcggcccgaagcggaggtgatctgagccattcgatttgatagatggcttggatcgcctgcgcaccattgaagatgcatgtgcattggaaaccctaaccctcacgttcccccgttctcgatcctgatcctttctcccagcaatgagcgagcggcggtggcggcggcactctctcattccgcgtgcgacagcagcggcggcggtgcccttcccccatcgcgagcgacggcgtcggtttcccctaggaggatccgatggcgttggtggctgcaagtggcggcggcgctgccctcccctaccgcgagtgacagcgtcagcttcccccgggtggattcggcggcgatggtgacttcccacggacggattcagcggcgtcggcggcttcccacggggttgagataagatttgtgcgctttttattatttttcatgttccttttctctttctttggattgtccaattggatttcaatcggatttacggatgaaaaaaattcacggacaacggaagcaaattgaatcggacttttttttgcccgatttttttcaccctgtttttcacgtacggaatcggattcgatttgttttttttattgtgtcgcattttttttaccgcatcacatataatttgattcgatttcgtttcgcccttttttcacggacggacaatggaaacacttctaattttttaagtagtagagatagagatacctatcgaaaactatgataccatattcatattcatatttgagaaaagaatatttgtatctgtatccgtatctagactatccaaaaattatacgcacagaatggtatccatatttgtttttcaccagagcggctgaaaactatatgcttcgttttcactggaccggctgaaaactatccgcttcgttttttctcctagttatctccacttatctactatattcattctgattttcctgataaaacactcttgagtttatggtaaatgcagaaagtttaagtttatatacacaaggtaattgaaacatgtacttaaaaaaatacagtatatttttaatggttgaaggaacaactatgaggaatattttagtactctcgttatcttggtcgcttgggacatttggaaatatagaaccgattgtgctttttcaatattgcaactcctagtgtagcggttgtcactcaagatgtggttaatgaaggtgcactttgatgcttgactagagcatcatagctctaggagaagttggctctagctgtgtgtttagatccaaagtttttcttcaaacttctaactttttcatcacattaaaactttcatacacacataaacttcaaaaatttccatcacatcatttcaatttcaaccaaacttttaattttggcgtgaactaaacacaaactctatagcccttttgtgtcgtagggtgtttgtttgcagttgtattttcttgttatattttttgttgcaagacatgttggtgttaggggaagggggtttctaattccgcaccctttgttattttctatcttgcttaatatataaaatgatgtgtgtatcttatacatgttaaaaaaaatataaacgagcagtaaaatcatgtctccagctatctgaataaaaaacgatattccctcaaatatttgtagaaggaaggatttaaatccaggtaggcttgcacatcaccaccagatccaaggagtcccctcttatccggtacacatatagacctaaattaatcaaaaagcctactaaataagcattgttaaattttgataaaagcatatacgtaaataatgtaagttgctacttctattttatattataagacgctttcattttctttatttgaccaagttcataaaaaatataaacgttttcaataataaacaaacatcgtatcaaaatatattcaatgtttggtttaactaaactaatttggggttataaaaatgattatatttctctataaatttgattaaaattttaaaaaaatgacaaatcgatttatatttagaacggatcggaggggccgggtatgcgaaattggtaaacggtacatcgacaaggcatgttttccatggtcgatggcaagctagagcctagaggtcatggtgattgtaacggagactgtaacggtgattctcatgttataagccattcacaccaatttctagctagtttcctatgcaagatatattgaatcaaacgactaaaaatcatgcactgcaggttagaactgacttgacaattacaaatgaattgccataccgcaagtcattcgctatcaaggatttaagctcaccatatagtcaatcataatgacttgaaaggtcccattcacaaagtcattatgtaaactatactcatttgatagtaacctttttttaaaaaaaaaatcagagacattctagaatctaatatacaaccaagataaaaaataaagcagccagccaactttttttgagaatttgttgttgatttttccccctcagccgcggagtttaggaggaggaaaatcagctacaaagtgctcttctagactttgaaagacgatacgtattggatctatcagtaaaaaaagtggaaacatgtgtttttgaaactccatcaggtcaggtgcaaatatatactacatcaggtattatatagcgtgagtgtttaggcactaataaaaaactaatcagttagtaaaccgcgagacgaatttattaaacctaattaatccatcattagcaagtgtttattgtagcaccacattgtcaaatcatacaacagttaaacttaggccctgtttttttcagcttaagattattataatctagattattgagtcagattactataagctagattgttataatctgtagtagaataagctgttagttgtttctttcctagattattagagcctagattattgggtttgcaagtctaaatagggagtggggtggcatgatgggtaatttttcacccaataatctagaaaaagctcacctaaatgagcttatcaaattatagcaagctgggtttcatactataataagctacttcaataagttgtctgtttctttcagcttactcctaataatctggattataataatcccaagctgaaagaaatagggccttaaaagattcgtctcttaaattagtcgcaatctgtgtaattaattatttttagtctatatttaatacttgatacatatgttaaacgtttggtgtgatagggtaaaattttttttggttgagatctattcagggcctaactgttcaaaaattttcacaatttgaccatttgcaaaaactatttttacaaatgaaccgtccgcaaaacttatttcaaaaataacccttttgttcagcgccaaatcatgtggcgctgagcttagacacctcaacgccaaatagcgtggcgctgaatatgcgttggcatgctgacttagtctcccatccgcgatggcacgacattcagcgccggttgacatggcactgaggtatctaagttcagcgccgagtgatttggcgctgacaaaaaaaaaaggtcatttttaaaataagttttgacggcggttcatttataaaaatggtttttgcaagggtcaaattgtgaaatttttagctaactgttggtatataaacataaagactagaaagcgtcttcaaaggaagttactccgtggccacgtcaccggtaatctaataatgcacgcaaaagaaacaaaaactaagaagtctgaactagtagcagaatactagatggacggctggcgttggagcagagaccgttgactacagatgtgaaccgtcggatggtggctgcctccctcacgacgtccccatttttgcttacgcggcaagaaagaagggaaggcaacttggcatccaaggaagatgcgcgccaaacgctcaccgccagcgtggccccgcgtgcgggtgggcccacatgtcggtgagcggggtgtagggcgtgagcggtaggcgaagtaggaggatgggacacgacaaaggcgtggacctcgcggcccaataattccaccgccgcacgcctctctcccttcctcccctccttccttcctccccgcctcccgctcgttgccttcgccgccgcctcacgccgccgtgatttgagttaggtttttttttttttttgctctgaccagacttgccggcgaaggaaccaccggcgggcaccgcctctcctcggcaatcgttgccggggataaagtggggtcgttaagggagcggtaggtttgggggtttgggattatagatcgaggaagatgaagcaatccatatcgtctatcatctttgtatctactcacgctgctgctgctaactataggtaattattatccatcgatcgattcgtcaccctaatcctcccttcatctggatctgctttttttgtttattgtttttagcaaattttttcgtctccctttccaatttattttattttgtgccagccgatttaggtagatttaagattccctacctgtatacttccttcccaatttattttattttttattttgtccagccgatttaggtagatttaaaattccccacctatatacttgtacgattgatttgctataaacttaatttttctacttatcatatatgaattcgcgttagactcctcttaaatcactattttagtcaaggggttgcccctgtctatgcttgtcagttttcgatgttaaagttaactgaataattctatgaagttccgatgaattttgtgtcatgctgtatataactttggtaatttccgcaacatgctagtttcattcaaaactgggaatgaacagccccacatgctagttcgtcgccacacaatcacgctgaaggaaattttcttgttggtgtttgtcttgtatttttttttctccaataatctattcctactgcctaaagtaccacacaaactacgtttatgctagtaacagtggctattgttttgagcgactttggcatgcagtctgtcgtattgatgatttaaaatattgtgtttttgaagtgttctctaatatctggctttcattttcaggatcatttcgcttctgcctctttctgacccgactctttttggtttttgcctcgtcgataatgaacttgagtacactcagaagcttgcctattagcttagtgtaaatagtaggcttgttggagtttagtttgttagaaattattagtctctggttcatttcagctagcaaccatggctgcgatgaacgaaaaggtattggataaatgtggaagaaacataagtagcctcaagagaaagcgggacaacccagctgcacgttgcgctgatgccggcaacacctctaaattgcataagcatcccgccgataactctgttgttaggttttatgttgatgaaggtcacaaggcaaagatcaagtgccatttcaaaatgcagattatacagagttatcagaatttcatgactagtgctttacctaagcgaattctgcttcgtcaaggtggtgaatggaaagactttccaaagcaaattgtcaagcttgcccacagtgattttaggactaagaagacaatcacagaaggtgaacaccagacccatctttttttgctggattttgtgcacatgacattcatagactcaaa

SEQ ID NO: 58857 - DNA, 43983 bp, Oryza sativa
tgtaagtttatttgttaaaaagtactttacagacttcaatgcagaataacacactggaagttggtaaggatgttgcaaaggacactgataatgtggcaaatgccgaggagcaggtattgaaccaccccttggccgagcaggtaaaatctgagaagcaaatatatcctggaatttctacaacattgatttgctctgaagacacaacacagttgatagataaggatacaggcagtggcaaattaaataaaaagatgaattgcaagtcaaagaggcaagtgaagtatcctgctgttcgcatgttttttgggcccaaacaactgttactggcatcagtaaaactgcacaagaaaaggaaacacaagagatccaaaaaacaccatgcactttctgtgcacattgaaagcatcatcactgatcagcagacatcaacatcagaaactgttttctcaaagatcatatcacataaatcccgtggacagaaacgttcttgtgccagtgcaagttctgaggatggcactcagctgttcaacaagaaacagcatatcgaaggaaccaccaacagtgttcccatggacaacaacgatacaaaacttgctagcgctgacagcaacgatgcaaaacttgctagcgccgagctaccaagctcatgtacaaactctctggtgaaccagactgattcaagaaacaatgtaaatgcaaatgagagaggcccctggcattttaatctcctcacaaggggtttaagagaaattactggttaacatctcttcgcaagaaatttctcattttccatcctgctgtcaacactagaaatttataactcattgttttgtttttgcagtgccacgttgggatgacactgagattaaaaatacgaaggaaacagagatactacatccaaggactagaagcatcggctatgtgctagatgaatggtaagcctgttaactgcagttaaatttctttctgatggtgatgttggatgtctcaattctcttgatgctgaaattcggaaaatcctccacccataccaaatctttgctaaacttctgagtaatatacgaacaactggcaggaacataacactggttcctaggtccgacttgaactaattttagaatcctactagaatatgcaaccagcagcagattcttctttgctgtgactaagatctgagatgaatataaagccctcttctttttttgtatatatctcggttttcctcttgcctgtttgttatccttgaaactgtcttattcggaagataaacatgatccttaacaagatgcacctaatcgttgtgtcagggacgaggagtatgatcgcggcaagagaaagaagatcaggaaaccaaagcatggcttcagtgggccgaaccctttccaggagacggccaacatcagatcacggcagaggatgagactacagtctgaccagaccaaatctgggaaccagcctctcaggatataattgatatactggagcagcaacctgttgttgtatccttcagttttggaacagtaactacttctctagtagaactattatcctccccatgttttttttttcagttatgtgtagtgtcatcagagagtaagatttaggcctcatggctcagtcatttgtctgattgattagccgaggaacgaagcggactcttgtttgttgtcccatttctgtcgagcttatcatgccaatttttttttacgtcaatgcattcacacgtgttattcatcccggtccattcgcacaataaccgagcaattaaaagtcgtgatttctgatctgtgacttgtattctgcatcaacaaaattcagtaaaaactgcaaactttgccaaaccggtctgtgtagccattgtgaggctcagtaagcacgccatcacgaccgtcagatcgtgagcgaacggtgttgattgccaatttccggacttcccctgaaaacgcgggactcgcacccaaaatgcccaatattacgtacgtgtaatagttagcccgaaaatgattggaagaataatttgcgatccaatttattgcggtgaagagggtgaggcgcaccgagttaaggtggctcacgcgttcgctgtgatgacggttttactggcgcgaccgaccggaccggacccaacgcgcgcacccaactaccaaacgccggcgatctcttgcaggcaatccattatccatgcgaggctgcatctaccgcatcagtttggtcatcgatcttcagaaagatgtacaagtctgattcaatgcatatcaaaccagcaaagttaaaataagcttgacattcagaattccagatatacatactccaaatatctgaatgccgcatgcatctattgttaacctatgctagctgcaaattaagggtctatttagatcccctgctaaaattttataccccgtcacatcgaatatatagtattaaatataaacgaaaaaaataactaattatacagattgcgtgtaaattgtgagacgaatcttttaaacctaattgcgctatgatttgataatgtggtgctacagtaaacatttgctaatgacggattaattaggcttaataaatttgtctcgcggtttatatgcggattctgtaatttgttttgttattagactacgtttaatactttaaatgtgtatccgtatatccgatgtgacacgtcaaaactttacacccctaatctaaacacagcctaaaccaaaatgcagcacataaagcagtgatattcatatgaactgatcgagccaacggaattggaaattcgacgagaacttcattcacgatgacgaggaggttagctgggggttgtaaatgagacgaggtgcaccgtgcacgcgcttaacgagttaatggaaacctaccatccaaacccaaatgaaacgaatcacgaaactgggccacaaaatttctccaaattttgaattccagaggcgaccagtccggctcgaaatccccgccttataaattacgcacgccgacacgatacgcccccatcgaattcaggcgcaaaaacctccaaaacctttgcaatattcctcgtaaatcgtaattccccctcgcgatcgagctcgcgacgcccatggcgatggagagaaacgcggcgccgcgcgtctcggcctcgtcgtcggcggcggcgtcgccctccaccgtcggtgcgctcctctcgaaggcctcggtggctgccgctcccgcacgcgagatcccctcgccgcggtcgctgctgtcgcgcatcctccataggagtggcggcggcggcggcttcgggtgtcgccttcgcctcccccgatactgctccagcggcgcggccgccaaggaggacgccgccgccgagtacgtggaggttgaggttgaggcggaggctgcggcgccgaaggtggtgggccgccaagcggttgatcgcgagtcgcctcggagctcgctcggtacgtgtccatggcgagagcgagtgatcggatggcgtggtctggttcgattgatttggttgtccgtcgtgtgcagggaagaaggcggcggaggaggtgtcgccggcgagcctggggctgggcgcgagcctcatgctgctgctctccaagagcgcggcggagctgaacaggatggcggagctccgcgcccagatggagcggctggtgctcgacaccaagggggaggaggaggcgcggagcagcaaccaccccaacgcgtccgacgatcacgccgacatcaccaaggaggagcccaccgccttctccggcggcgcattatcccgctgctcacgcacggccgccgccccgggaaacgcagggcaccacgccgccgttccaatggaccagatggaagcggagctcgaggcggagctgacgctcctgcaatgcgcgactcctcgtcgggatcgtcaactcgaggtcgaacagctagaagcccaccgattcggatcaatttcgccgccattttctaacatttatttcctccaatccatcttcgcagatcggcgacgacgaggaggagtccacggacacccacgcggccaccttcgccgacgccgacgatgacacggacggtgctgacgacgaggaggaggaggaggaggagagcggggcggcggcgcagggcggcgtgtcggcgagggagctggagaggaggctgcacgagctgctccagtggcggcacgaggagcggatcgcggagctggagacggcgctggagcgcgccaggaagaggctgcaggagaaggagcgcgaggtttgctggtggcgcaacaccgccaagctcgtcacccgccacaaggacgactcccgcctcagatagcaagaattaatccgccatgagatgagatcaaacaagaacaagatcaagatcgatcatctcgcctcgcagtgatccgttttgtactctggtgatcatgctgcaactagactagaagaacaaattccaaccagaaaacattgattgcataaactaactgggatcacagattcacaggattcggttgctgcagcctatcaacatttggagcagatggtaaggtgttttttacctatctagtctacggattgattccaagatgattgtgtttcggcctttcattcgacctccaaacgtgactaaattaagatgcatggaatgacgcacaatctcttactaatttatactgttcggttcggttcggttcaatcaccatcgccgcgcgtaaatcgaattattcctactctacctgggccagcaaatcaggcctctcttggctcatcactttgatatatcatatcacaaaattcaataaaataaaataaaatgaattgaactacaccaccatcggctatgcaaaacctgcagaccatgcaacgtttccaaaattatgtggctaaattcctgtagaaacataataaactagctgtattctgcacaagtcaaatttgcatcagttgcggactttgccaagcaagacttgcttgccttcttgtcaaagatccgtctctcacaaggtaagagcaaagaaacctgatttctttttgacttttgagattcctcatccagattatctcaattgccgctagaatatgcaaaacaacttaatttgatagggcgatacaaaacatctgtgctgttcttttcttatattatatcatcaataaatatacagtgggataacattcacataacacggcagaggcaacaaggaaccagtacttccgagaagtttcgtctccgtggtgcctcagggcttaagaggtggccatcttgactcaaagaggtctccgcccgtggcagacacaagaaacatatacaacttgaaagtatttattctgtgtcgcagcaaacctcaaatacacaccagttaccattcattctggagcaactcccttccatatgcatcacagagactactggagctgatcctcgttatggatagtacatatatcctgtgagtgtgctcttcaaagaaccgtgcatatcacttgtcatccagttgtttttgtagaaagtcgagaaccgagagacgctgcaaaagtagcacagtacatgataaaagtcagtcaagagcaccacaaataggagcgcatggatgaaaggcagtacacaaggataagtagtagctacccgctgctcaagactggcctctccagattccagcttcaaattctcaaggcatttaattgcttcctcaaaaccctcaactgccatgctttcgttcccaagatttctatcgacatccgcaactttggcaagagaagttgctacatcaatgacctatatccaaaagtagacagatcatgaaatagcggcagctaaaggaaaaacactcaagaatatgtctgttccatgtagcagctaaatcctaccacaatcttacaaaatgatttgtgatcttctgttggttcatctcctgacattaaatttagataagataaagggcttgtttggtctgcaaccaatttgtgctgtacaaatttctgtaaagttgctcatttgatttgttgccaatattttttttgtgtacgcgctttaattggttttcgttaccaaaattttgtcagtgccaattttttggccacagaccaagtaatgaaataaagccatcatctcaatggtattgacaattttattggcatggttgaattgggaacaagcataaatataggttaaaagatctgttagccatcatttatggcaaattgccaaacttcctagtatggtctggcacttgctaccagacttcagacaacaatttgcttcagagaaaggaatacaaaaattctgtgtaggaacccctttttttacatccatttttttctgcctactatgtattatgtgcaatgtccatcagtaccaggaccatgaattatgggataaaatagctactggtccatgtgtaattggagcactcattgatatggtatctaatacacatttaaacacttaacatttctaattatgtctggataataaaaatctaagataaggaagaacttttgatcaatatctgttgatatcattttcatggacatatggtactctactagtgtaatgatatagaagagctagcacaaaagagcagggacaaaagagagtgatgaataaggttccttctgtttctaagatgataacagcagcccattttgtatttatagctaatcttaatcagtaatacagtaatcacctgggaagccacagctgagtgttcttttactgcacttctgcgaacgtccaacgaacgcgcataatagcttcttgctgagtggaggtccccatcataatagcaaagatctccaattttatttagtgaaactgagagagtatggaccaactgtagatgaatgcaaaagttaaattaacatgagaacttactatcatgctattatgatcatattaacaacaaaacacaacctccagatcctttttgggcaatttcgagaggaattcagcactttcttcatagtaagtgattgctgaaggagcatctcccaaggtccgactgtggcatggaatgaggtcaattatgaacaaacaaagaaaaaataagttaaatactgccatgattatgtgtcacaaatataatgaaaaataatagagcacaatgaaattcatggaaaaagttcagccagatattataacagagggatgaaaacaaaacaccctccagtgacatggaaacacaatgagttcagcaacaacttatgacagaccctaaggcttttatatgagaaggtaccagacatcctgactagaactaggctcttggtagctggtagttggctattacacaagctatcagcttgctattggcatcagtatgctggctggtgtagggcatggttaaaggtttcccacgttttccgagctgtgaatatactattcagacaaattgcgaccagtcataattggcatcactatcagcccacaacctgctagacaacctctgtggtctgtgcatcagtattgtagaacacactgaggcacataacagtttaatattttaatggataacaaacgttattacaacaagattctcctttcccttgtttggaaggcaagttctatgcctggtcgaaacatagaaaattcaggtattagaacacatgaaagataactaggttctgaatgagcagaaagatgaacgggccaaggctagaatgggcccttgtgcacaacagatacaaatcattgagcattgagcatctctcttcttttgaggaaagctacagacatttcaaagttaagaactgttctctcaattagaaggaaaaaaaacatgcaagaatttagctcaatactcccttcgtttttaaatgactgatagcaggcacgattcacttttgaactttgaccactcgtctttttgttatatatttacaaacacaagaaatgatgccatgttattaaagtgtgttatgtcctaaatattaagaatcaaacttttgttccattaggtctaacaacttaagagcaaataatggtcaaagtttaaatgggaaagtcaaacgtgtcaattatttagacacggagggagtaggcaataaacgtatcaatagcaggttcacatatcctcaagtccccaagagaaaattgccgtaccagcagtccccaagcattcctaacacagctccaagttgagaacacagttcttggttgtcttctttagatttcaactcttccctgatgtcttctgcacacatactgagccttgactttgcactttcaatgttctgtgcgcgaaaagcctggatatgtaaaagtcagaggtattgttaaaatatatagagcattaataaattaatacagaccagaggatgaaggatatatgcaaatttcaaaggtaaaagaagctcagagtaagaagcttatgggagttgatttggtaactgaccctcatcgcttgctggaccagaaaagctcctctctccatggagacatgctcgtaaatgaccttggtcttgtcacttgcggcttcaccatcgcctgcagcatgtgatctcttgattcgggcatggccatcaatgaagcggtcgacaaggccttgaagctcatcatcaggctcgatcccttggatgtcagcaccacacaatggacagtccttaaagcgcaatatgcatgccctgagaaggaaatccagtgttttggagaaagacaaggagatcaagtgagaaggtacatatattgacagaacgaattagaaagctattgaaatatgatacgcacttgcagaacttgtgcgagcacggggtgcatttgctgctttgatgtagcagagcgtggcagaccacgcagctgagtgggccaagcttgaaggtgttgttggagtcatagccaaaggggcactttgctggcaccacacgaggatcggtgttagcattgccagttttttcattatcgtcgtcgtcggtgtgattgttggctgtgacaggacatgaggtggttttgttgtctgattttacggggcatgtggcgccagcagaggcgagtttggcaaacgggcatagagagctcataatcggttggtcttaggtggattattatttacctgcataaaagattggtggcaagcagttgagtgaaagcatgagactagatgcagtagtagaattgaattgaattgagaagaatgagagagattgttaaagtagggagctaagcagaagcttgattattagatagaggttgggaaaaaaattggggttggtttattttgtaagaacaatttatctatcaatctctatctatatctatctataactaaatctatatcatcccaaaataaatccagcacatgagacaatccaatcggaaattgcaaatcacaaaataaatcacacataagatgagagaagaggtggaaatcacaaaataaaatcacatcacgtaggagatgagaggagaggtcgccggaccttatcctcgccgctgtggaggtcccgagctcggagccgaatcccgagccgcggcgccgccgggcagccgctgcgccagggagccactgagcagcctctgcgctgggagccgttgacccgcccctgcgccgctgctgcctcgggagatgccgagagggagagggagagggaggaggaaggcggagacgacgagaccgaggaggcacggccacgtgaagggggccggtggcagcaggcggatgcgggccggcagaggtaggggaggtgggcgtgcggcggcgctgggggtggggcgacgctggggtgggtgggagtggggcggcgctgtggaggcgtgcggcggcgctgggtgggtggaggaggaggaggggcggtagtgtggataaggttggatggctgtgagctgtgggaatcaggttggttttcaaaaaattaacacaaaatttaaaactttcgattaggattttcaaactttcaacccaaatttttgaagctttcaagttaaaattgaaaactttcaactcaaaatctaaaatctttcaactttcaccagaactcagccgcctctacgccctcgagcctttcctgacgccggatctgccgctcgcgcgcctcggcgaccgtagctattgcggggccatcatcgagaggtcgccggacccgcccctcccgtcgccgttgacggtggatccgtgcgagagtgaggcggagagacgacaggatccaggcggcggcggcggatccacgcaagtagcaaagacggcttaagccggtgttcgatatggtcaacgacaactcggatggaggagggagacagacgaagaaagactggatcaccgccgtccactctcttgcgtcgctggaggttggatcggggagagtaggagagaaaggggattttatcggagatcaaggttttcggaccctgccccctctggccggcgatttcatcggcgcgggaccgatccgagccatccatcagatctgatggctcagatcagccctgggtcaggccgccaccgctgttgggccacgtagtctttgggccgcggatgacaactgggccgtgctcagttcaccccgcgatgggccgttgccgataaatggccaactcgatgcgcgatcaactcgtgcgcttgcgctaaacgggccggccaattttttaggccggttagtcatgtacataattttctttggcattattttgagccatttaaaattgttggaaaattatgatcaattacttagaaaatatatatctatatctatatatacctaataaaaaaatgcaaagcttctggtttattttggtcagttggtttttttcccaacgctgccggggctgaatcctagcacaaccccgccgccatgtcgatcgtgcgtttcctcctccaattgattgcaaaaattgatgccccactccttcatcatcagtgaccttcctggtcttttttatcgtgaattttacgttttgatttgagaaaaacggaaagagtagatcgagtggattgaaagccctcatctaattttgggagatcaggaaagattcggccagatttgtggggaagatctgctctggcatcgtatgggcacgagactctcttcggacgttgaagacggagtcgactgtgggagcaaggcctgtggctccacttggggactgggctgaagggaggcaggttgagttgagggagttagcatactagcctagggcctaataggaaggaaggaatgggctttcggtccaaaaccaagaaaatttttttattaacttttaaattatagtatatagcaatcccaatattagaattttcattaacgttttcaatcgtaatgtatagcgagagagataagcctatctgaccaggcaaccgatacttttttaaaaaatacaattatagtagaaaaataattgttaaggtacacgtacatactttacagacgagtgatatttttaattattttttaatttttgacatcataatcatcgaaacttttactttaatatttgtttgagataaaaatttccatgaaacacgacatattaaagtatgcgcgctatatatcatccacatgtcaccactacgagactatgtgtaaatatgcaaaagtatttttgatcgatcgtggttttcattagttttataataaacttacctgttttaaatacaaattttttaatcatacaaatttttgtccatctactcttgcgtgaaagtgacctaaagaattcaccatttgttcctcccatgatacaatcattacgctaacacgttaggaatgtagttgatatcatacacatacatgtggaataattgtccaaacaaaaagaaaacctttgtgattaaaaaaatccttcaattaaactttatccaatgcgacattacccggtgcaacacacgggcattttgctagtaactaatataaatattcgtatttttccggtcgtcacatctaaattttcgtccgtttttcgtccatacccaatctgattcggttagcaatagccatggaaaaaaattgcaaaaaaaaaatctgcggccgtcgacgcccgcctccacgccgtccgggctgccacccctcccgctccgccgggaccaccgccgccgcccctcccctcccctcgatctagcggaggggagggcgtcgccggctctcccgccgctgccacacacagtgaaaggggaaaagtggagagagtgggggggatgggagggcgtcgcgctggggggagggtgccgccaccgccgccgctcgttgggggggagggcgcaccgccgctgctgccgctgctcgatacgggggaggcgtcgccgccgccgctcgcggggggagggcgccgccaccgctcgccgtgggggaagggcagcgttgccgccgccgccgctcgccgtgggggaaggtggcgccaccgccacaccccgccgcaccctgccgtcgtcgcgccgtgccggcgagaagggagggacagcgccggtggtgggagagacgacgctagtggcgggagagtcggccggctggggggaggggaagaggcgccggtggggagagggagagggggagggggagaggctgcgtcaggggtaggggaggaagaggcggcgtcaggggcgggggaggaggaggcggctggctcggctggggggagggtgagggggagggttagggttagggttttcatcaattttaaacttatctgagccgtctatcaaaacgaacggctgagatcgatcgtgggtttgggccgcaccacttgggctgcacgtgggccggcggtccactaagtgagaggaggagtatgggggtattaagtagactttggtctcttgcaggctgaagaagaaaatgggctgaaaaaggcccatagagaaaaaaaggatttttatttagatttttatttcaataaattctgaaatgatatttgtattatcaaaattagcaattaagctatgtaaattccaagaaaatttcaatgagtgtaattaatatagaaaatttaataaaagttaaatccaaccataacattttatttcttacacttactttacttataaattaatttaattatatacctacctacttaaaaaatacccaaatatttcagaaaatttgtatttcatttaattataatttaatatgttttaattcaattttatctgtttttttcttttcgttgcaacgcaataccacttttgctcagaaaattttatatttcattaaattacaattcatttttttcatataaatagttcaaatcaaatttcattaaccatatcattaccctgtggaacgcacgggcattttgctagtaagattataatatagtaatagggaagagaattaaatcgcatgaacgattcatcctcgatacatgaaaccctagaaatcgtatgatgggggatgggggagtaatcaatacttacgtacgtaggaggaggagagaatgaaggaagggggcaggcggcggcgagaggggcgccggagtcggcgggaatctgggtgtgcgccgagagggagaagagagattgtgagcggagcggatgagagaggggatcgattgattgccaaccgcaagctacaagctaagaagacgggaggaggaggaagacgcgacgcaacgcaaacgaatcgaggagtaggcccaccagaccagaagcttacaatggagtatgttgggccgatagcccatttgcattttggcaacgcattccatgcattaatggtggtagtccccaccacaagtcagtctgggactgtccaccaccgcttttatgactcctgtatcactttgatgtaattatcttgatatcaatagaactccttttatatctctagaaagaaaaacatttgcatcaacatcattattattagagattaactatatctaattaatattctacattacaaagcaacaactattctctcaattgggacattggcccggtccaccgaagaacacatgcatacccatcttgagaacaccaaaaccatcaacagtgtagcacaatcccctagtggtcactgtagtggccttaccaacgtttggattgacaaagttgttgtccttgttggctatcctgatacccttcacaagtgcggctttcctatacccctctttggcgaaatggccgctccccattggtggaggatctaatgaaacagttggtccacgaacccatccaccccaaaatgcatatgtagccttctcttgtagggtgtcaaagagcttactcggccaatatccaagtggtcgatatccaatggcactgctcttgtctaggcgtgctagccaccaatctttagtctttcggtcctaattatataattaacaaaagaaaaaaaatttatatgagtacccttagaccggtttattacaagaaactattctaaactcttgaagggttgtcccctagttgtttgcatgtcactcaaatggttatagaaaaattcaacaagatagtttaatatgtgatagatcactacacaaacatgtaagatcaaatttaacttctacatattgcagcagaaaaacaaatttaactagaatatacgttaactagttgtagtttaattgacttatataagttaaattttaacttacatgtttgtaaagtgatatatcatatgttaatacattttctcaaaaattttcaatgtttttcataactatttgagtgatatacaaataacgaggggacgtccccttgagagtttaaaatccactctcgtttattgccttttgtaaaatcacactatgtagtcacaaaagtaaataatcatgtagaattattaaccacaaggaaaatacctgaaacagcatgacggtaattatatactgaggcccattgtagatagaaaccggtgttattttccctccaataccagcaagttggctaacttgcacaaaaccaggacaattaaaatcatagcatggcttatttgaactgtctacctatcgccaaaagtaatgccaaggatgtaagttggatggattttgtggtggtggctgtagagctattactaatattcgtttttatagccacgtcaagtaaggaaaacatatagaaaagtatgtgtgtattacccaacgaatgtgaaacctgacaaagttgtccccactaaaacttggccatacctgaaaaatatgatgatgaaaaccaacaattatatagtacatgaatgcataattattgtttaagtttgcaatactatagatgtgacaaaattattactaataactaagctagagggaatacatatgattaagcagaaattcttagacaaaagaatttatgcttaatcatgatataaataaacaatgatataactcatgattaatcacaatataatggaaccgtgataatttcaagtgttgaaaataatagcacggtatgcaatgggactatatacttacaatggaacctgcagctatctcttcgggtccattattaagttgtacaaatgatgcaatgtggtccccattatttcgtgttcaaaacggctggttaacacttagggtagcgtgtgttccatagaaactattatcgtcccagtatttgatacctgcatactacaagtgaaagaataatattgaaggtaagtcaaatagctttgcatgccacattagaatagaaaagaatttaatgaagataaactatttttatatacaatctataattgacaataagataactaaaaaaatgttaaagggtatacctcttcttgtgaaccaccattaggcatatgtgcttctgagctattgtgacgcagtatcggaattgttccggttgggcacttgatgtcggggaaatttgattctgagatattggatgacagaatagattgtatatcaagatctaatggataagagcttggttccatctgcgtaacaacaaaaatgaatcctaatcaaagatcgaaaacaaataccaaaaaatacacttatctttatattggacggtaaagggaataaatacgggaatccctcagttgatggctttcccaatatttcatattaaagtatcatgatgatatcttatataatctactaatggatcctaaataaattaaacttggatcttgaaactgctgttctattcatacaaaacacaaaacttaatcaagcataatatttatgtaacatgctcaaaagcatattcttctatacgaaaagtaatactctacctggattatatggtttttcaataatggatggttcatagcaggttgtttgtatatgtcaacacaatcgtaaacatcaccatctcctgtcttttgaacaattagttccttgttagccaccaaatgcaatgcaaatacagaagagaaggatttattaatcacatacctgaattgtcatgtttagatctttactaggtatggttgaaccaattatcccatctcgatcaatatgtatcttcactcctcctactagaacaagatatgtcaggcatagagttacaatactgatagctagattttcttccattgttgagtctcaagaggtcatctgttctgtatgcaaatggaccattttatagcttgaggaaacaatttatcttcacaaggccaatgaaacatttattcattgctgaatgagaattcaatgaatttgcaattaatattgagggtgtaaggacatgccacaataatgaagtaatcttcaagattatttacactattaattgaagatatctttacagattttgtaatcctctttttaatgcattgtgggaaaaataatataggaaaggcataaatgataaatgtggcattaaatgcacaagatttggtatactagacaaccgtacgatgtaaatttattgtagtaagaacaaatttaatagtatagccaactgctacctataacaattgatgcatcatctatagctaatctagcgatatacccatgcaatagttagctatagatatatgctaacaccattaagcatcaatacatggcttgcctaatcccctcacaaaatttgttggagcccgtgttgtagttggctactgatttatagtccacttaacttctctctactctcctctatcctccaactcatcacaaatatggtgtagcatttcctatagcctacttacatcatcttattgcatttacactaatttttggaagaactttaaaatatttaatgtaagaaatattaattacatgatatatgataataatactagattacatcgggtggacattaatttaatgttttaatgtttcttcaaaatatttaaagcatgctgattgtcattgtgatgcagtaaatccttttccatatactagtatgatttattttgttaatttcatgtttctaaagtgacatatataatgtagcagcaatgctaattagcgagcattctctagcaaaggaactagtgaaaactacatccacatatgacatatgtgctctctcactaacgttgatatgactcatatctcctatagtgggatatcttaatggctatcctttgatacctcggcctcctcctcgctagtgatccccacacttgatcctagtgacgccgatgaggtcccatgtcttcatcagatttggaggcaggttatcggtagaaacttccatgaattcgagtagaaagtttgaagtcatgcgtagaaagatttgaatttttttttgacttaaaccactgcaggtccccacaattaatatattagaaagaacgaaagtttcttacaaaccaaaacaaaaaaaaaataaagtgtcttaaaaagttctgaatattttacttgaaattttcaaagttggaaaaatattggttgaaagtttttgagattttagttggaagtttcagactttgattcaaaagtttagggattctggtataaaatttttgagaatgttttaattggaagtttccacttttgatttgaatgtttagggattttggtatataaaaaaagagattttagttggaagttttagactttcaattgaaagtttgtgtttcgaactagaagtttcgggatacaagtagaagatctcatatttgaatcgtaaagtgttgttgttcaatttgaaagtttcaacaacgcaagtagaaagttttagaaattctagattgaagtttgagaatttgattaactcccacagcttgctctagcctcttgtatagaaatagggaaaggaaaacaccccgtgttggaaaaggaaatgggcacaagtgttgagattcggagtatgactctaacctagatacttcaagtcaggacacgcgaatcgtgtgaaagttactgctgagttgaaaccattcacgacctcgtcatcttgcatgtgagtgcaaattagcaatccacataaggtactaccttgtagtacaatgcaaatttgatgatttgtcactctttgtattgccaactgccaccctgtgagaatgatacatgggactcttcgtgccaatgatgagtgggctaggatggcaaattatctaatttatctaaagagttgtaaatcatcaaatctgttgcaatacaactatttattggtgcttcaaaggttgaaatgtgcgtaagaacatatccgtggcacgcaatatatctcgaggtcccgctagaatgcgtttagggaaataacgagtttcgaaagaatgaatgaagctcacttgcttcttaaaaattaaaaaactcatgattggttgcttccaaaaattaaaaaaaacagtgagcgaatggctaccatgtgggccatgcctcaggtgaactattctacaccatgtcactgtcactttttttgctccgcaatgaggttaggttggatcctagtgtgggccaaacgaaacaaacttgtacttgtcgcgtaggcagtgggcatgcatcatgtgggcctcatgggctggtggcctaagtagtgcatgtgaccgtgggtagttgcagtggacgcaagaggagcgcgtgcgtcacgccacccgtgggacctcactggtaggccgacaccactctatgccacctcgatcggacaccaccaactactcaaatggtccaagctttgctccggcaagcccacttgttagtccttggatatgggagctagctactgactggctggtcaaaggagcctccgctcaaaactccagccccctccaacacacaacattaatttgcttctttttgggacaatgaatatctcatcagtctaactatcataggagcccgaatctgattattaaaaaggaaatagagggtgcatgcatgcatgcatacatggtgttatgttgttgtatgttccctttaattccattatttctaacacataaacttatgttattacaatttgcaaagcacatcacatcatttagatgtacttgcctgggccaccatagtatacatgcataccatcgtcattaagtccataaccatcatagctatatagttttagattattagaaaaaggattggcattacggatgtttggagtaacaagcttgttatccttgtcttcaataacttgaatattcctaataaaagcggctttgccaaatccttcagaagcaaaatgcccacttcccatatggcgtgcaccatttaatttatcttatcttaatggcgttacaatagaaaagttcaagaaattctctttacatgcatcggcataaattatttggctatgagatggtagaaaaaagattccaacttatcatgaatagctcaactaatatcattgtgagctgaacaaaaagaatatagcaaaaatacttgcacataaactacatgcttagacatggaacctatatgaccaatcatacaaatattaagaatataatattaccttaaaaataagaacatttattacatattgtggtccattatagacagatatgggattgattcttcctccaagaccaacactgtgactaacttgcatgaaaccagggcaattgtgatcactgcaactcttgttcaattcttcattatcctattattagaatttattccaaagtcagcaaggaactgtaacaaattatatttgtaatatccgggttatcaaatttatatggtccatcatagatggttactgaagaaaatgtttatgtctcacccaacgaatatggaacctagcaaagctatcaccacttcttggatatacacaagacccagcacctataccaattccgttggtaccttttgggacaacactaatttgtatccatgatgcactaacatctttgctatctttcttcacacttggttcatagacatttattgatgcctgcatgccatatatctcatcccaatattcaattcctgctccctacaagcaaaaattatgatgccttgttgggataaaaagactaacataaatactacgaagatcagctgatcgagttgaaaatttccattgccatatccaatgcaaggataacaatgtggggtctaggttggcagttatcctcacattggatatcattttccaatttgtgcatgctcaagtgttattgggcagatttcccaaatcaaagtatatatataattctaatggcatattacacagaaatttcaatcttctagtgttgtcaaataggaccaacactaatacatttcccccgataagtattagtaattggatacaacaaacatatttcaaatctccctttggttttattgaaaaaaaaagtaaagcttcagaattaaaataagttacttatttcttaaaattgcatttgatctctgaatttctatttttttatatataattgctcataagatgggaacattgcacatatttcatcttatattatgtctcgttgagaattttgatgttagcactcaaagattgagtcgaaaatgatcatacttcgtaaatatgcaacaactattcatgaggcaataccatacaatagtctataatatcataaccaaccttttattactatataatttcaaaattttattaaaaaacctaccagcattggtaaatcatcattagccagtgtgccaatacgttgtaccatcatgttggccaaattgttgttgcgcactattggaattgttccaatggggcaatcaatggtagacaattgtgcttgcgagattgcacctactaatggcgatttgatatccatccctatcgggaaagaactaggttccatctatttgtcatgaaaaaacttgatcaccgtattcattaaaaaaaacttgatcaccgtataataaatgactcccaacgcacaaccaattaaatagatatacacatagaaaaatatgcacacatgatttgaagtgcagttttcacatgtgtagacgatgaacaatagatacaaaaagaagttattgttcttaatgttaaatcaaagtgtagagagtggataaagaacgatttttaaaaacaaatgtagaagcaagctatgacctatcatgaatacaaactaatgtaaagaatcttgctatgatgatttttcctacaattttcagcctatataccatataattatgaatatgaagggacttgcaaatattttttgatttaaaattaaaaatatctaaatcaccgtcatgtgatagaaaatcagatctttatgaaagtggctaacctgaattttatgtcctttgaacaatggatgtttcaatgatggttgtagattcacatcgacacaatcatatatgtctccatcttctacctactttaatgtttctctgtgcttgttagccatcaaaggatcactaaatgtatctcggaaaaaggtatacttgctaatacctgaatagtcttattaacttgtaaagttgtcaggattcgactagtattttctccattgttaatgggtttgagctcttctcccctagtagttagaacaagatatgacaagaggagagccagttgagaaacattgtttcctttcatggtggaaatcttgagtggtttgtttcatagcatttagaccattatataggaaaggtttcactggctatcatttaagatgtaatacattacaattaatgacagatgtacaatacatttattacatagaacaatcccagtattaattgcacaagatatggtagagtaagagccatctcatatttgcacaggcatgactacttccacctaattagtattatataaatgtataaatgaccttcctgcctaaacatgttaaaaacaagacctcatttattgataagattggtagcattaagcgaagaaaataggggaaagtcgtcttgaagttctacaacaaccaacaaacttatatgggtttcctacaaccctgcgttatggatgctcccaagcttggctccgacaagccagcttcttggtcatggaaaatgggagctaccggttagacagttggaggagcctcctctacagttatcatactcctacctctgccaacaacacatcaatggcagaaggaatatgctagctatgtgttattaagttccatttgcttctttgggacaatgagcatctcttcattttaactattacaagaaatcatgattattgaagaaacaagaggatgcatgcattgtgttgtcatgccatgtatgtaacctttaatcccattatttccaacacaaaagattatgttgttacagtttgcaaagcacataacaccatttagctatacttgcctgggccaccatagtatacatgcataccattatcattaagtccataaccatcatagctgtataattttggatcactagaaaaaggatcagaatcacgaatgtttggagtaaccagcttgttattcttgtcttcaataacttgaatattcctaataaaagttgttttgccaaatccttcagaagcgaaatggccacttcccatttgtggagggtctgaagcagctatcggaccttgaacatatccaccccaaaatgcataatcacctttggctttgaggtaagagaattgtgaacttggccagtatccgattggtgtattgtttgaaccatatgccaaccaccagttttcagtctttggatcctaaaacatgtcaagattagacaacaaatacttaatgcaaattctaaagtaatatttggcattgaatattgatatgtttgtgtaatcaaactaaaaaactgtaattaattcgtcttgatttgaactagtttggactagttttatttatgtggtcattgtaatcatactaatttcaaaaggaaattaatatagtttagattgttcttactcgacttattattgatatatcaagtctacatatatagtcaaacctgagtttccatgttgatcgagcacaaatatcgtacaattctcaatctgggcatgcattatgttacaattctcaatctgggtatgcaattatgtaatttatcttattttaatgaaactataacatcaaagttcctttttaataaattaattttctttacatgcactaagataaaatatttggctaggagatgatagggaagggaattgctataaaaactatgagttgcttagtttttaataaattaattttctttacatgcactaagataaaatatttggctaggagatgatagggaaggggattgctataaaaactatgagttgcttagtttttgaaaaacaaaaaaaatagcaataataaattacataaattgcacgattagacatagaacctatataaccaatcatacaaaatttaagaatataataacaccttaaaaataagaacatttattacatattgtggtccattatagatagagatgggatggattcttcctccaagaccaacattgcgactaacttacacgaaaccaggacaattgtgatcaacgcagccttttttcagttcttcattatcctgtcataaatatttattccagggtcaataaggaatcaaaacgaattatatttataatatctgagttggctaatttacatggtccatcatagattctttctggcccatcatatgccttacccagaatatatggaacctagcaaagttatcaccactaaggcttggagacacacaagacccaacacctatcccaactccaaccgcagcttttggcaagttactaatttgtatccatgatgcagtaaggtcctgactatctttcttcacctttgggtcgtagacatatattgatccccgtattccgtatacctcatcccagtattcaattccggccccctacaagcaaaaataatcatttattcttgcaaataaaaataacaataattgcaaagaccaaatgatcaagttgaatgttccatcggcatatccagtgcaagtaagacaatgtggggcctgggtttgtagtcattcccgtgttggatattatcttccaatttatgcatgtttcaatgctactagacagatttcacacatcataaatacatatatataattctaatgagttattacatagaaatttcattcacttagtgctatcgactagcaccaacgtggataaaccttcccaagaagtattagtaattgggtacaataaactgatttcaaatccctttagtattattgaaatattattcatttgatcgaatatcttgttaaaaaaccatcaaagtttcaaatttaaaactagttacttatttcttaaaattgagagagttttttttggggggggggatctctctgaatgtcttgttttatttataattgttcttacagtgggaacattgcgcatatcttgtcttactatatctctcgccgagaattttgatgtcagcactgaaagattgatttgaaaatgatcatacgttgtaattaggttatgaacagggacactagttgtgctgttaaatgccatatgcaattcatgggacagttccatacaaaagtctatattgtcacagtcagcctttcgttagtatatagttcaagcatttaactaaaaaaacttaccagcattcgtgactcattgctagccaactcgccaattcgttgtagaattgtgttgtccatgttgttgttgtgcagtatcggaattgttcctataggacagtcgaaggtagacagatgtgcttgcaagactgcaccttctaatggcgatttaatatccaaccctactggaaaagagcttggttccatctatttgacatgtaaaactttatcaccatataataaatgattcgcaacgcacgactacttaaatagatatctacctaacaaagtgctccaatgattccaaagtgcagtttctgcgtgtatatattatgggccatatatacaaaaaagaagtcataattttccttttttatgttaaggcaaaaagtgtagggagtgcataaaggttgattcttagaacaatctagaagcaagctatggcctaccatgaatacaaaccaatagaaagaattttgctatgatgagtttgcctacagttttcagcctacgcagtatgtatcatataatcatgaatatgaaagaacctaaaaatattgttttttgcatttaaacttaaaaaaaataaattgacccaccatatgaaagcaaatctcatgtttatgaaagtggcttacctgaattttatggtctttgaacaccggatgtttaaatgttgtctgtagattcacatcaacacaatcatatatgtctccatcttgtgcctactttgatttttgagtaaatcgtattagctgtatatgaatttgttaggtgggtgtaatctagtgcatgaactcgtaaaacattcattttggtaaatgaactaggtgcgtgcgaacgaaggccaaaagaacataacaagactattcttgctaatttaagtattgattagaatgctacataaatatgtacttgagaagaatgctacataaacatgcatattttcactaaaatggtttaataaggcctataacgattgcacggagaatgatataaaaaaaccgagaaatgatacaaggggtagaacaaagaataataaagtataaaccaagtttacaaatatagtatgtttcatgctcacctcacgtgtgcacgtcctatcctaaccagcatctaacttgatagaattggccatgacatgtccttttggtcttagtttgcacccatccaacaagttcatacaccaaaacaagtattttacaagttcatgtagtaaattgcacatacctgataagtttgtatatcaccaatataatttactcttgatatttcctcttgtttgtcatcaaggatgccaaatatacaacccctcccccccccccccccaaactcagaaagaaagaaagaaagaaaaagaattatttctcatacctgaatagtgatattaacttgtggacttgtgaggctttcattagctttttctctactgtttatagatttgagctcttttcctccaatagttagaagaagatatgacaagaggagagtcacttgaaaaacattgtttgctttcattttggtaatcttgagtggtctatttcatagcattagaccattgtatatataggtttagaggttccgctagttttcacttaagagatactatattggaattaatggcagatataaaatgcatttaattacacaagaaaaatcatagtattaactacacaagatatatagagtaaagaccatctcataattgcacaggtatcactgcatccctctctttgttataaatgtttaagtgaccttgttgttgtacacacattaaaaccaatacctcatttattgataagatcaatatcattaagtgaacaaagagacaaatgtcttgaattctatgaataccttctccatctgtccaaaagtttaacgactactatgttccttttagagattaagaataaagaaaaaaactatgatatctcttattaaatgagtggtggttggggagaagataataagagatggtgtttggaggtaagattgagtaaaaataaaataagggatggttggtgaagggagtattgctccataagtaggacaaaatttaaatactaaaggttcttatattttagggcaaatagagcatatctgaataagagtaagaaatttaaaataaataagtgatttcttagaatcgaatggagtagataatgtggtggacatcaccagcggctatcaggagaatgctggcggaaggcctggatgaacaccggcggcaactggtgaggttgcgagcgtgaaccaccgtgagtgtgatgacggcagcggcggcaatgggcttgaggtcatcgtcgatggctccctaaataacgacgtcatgtcataagcatgtaggcatgtactccatataaatgcaatacgtgttagctgaaatgggcaagagaaaaaaaaaagaaaaacacccgaaccatctaacatgacccatagcggaaggcactactatgcgctcgctcctcattgtgaacggattggtgctgtaggggtggcaatttccttgattgggggcacccctaatgaaaacggagcggatagtttccgtccgctccgaataaaaacggatacggatatcttttggatcggataattctcggatagtttagatgcggatacgaatacgaataattcggatacggatacgaattaaatttagccaccatatgtaagaaagccatctctttaagaaagtggcttacatcggatgtttacatgctggttgtagattcacatcaatacaatcacatatgtctccatcttctgcctacttttataattcatatatatgttagccatcaaacaataaagccaaatatagcccaaagaaaagtattcttgctcatacctgaatagccctattaacttgttggcctacgaggatttgactagagttttctccattgtttatgtatttgagctcttttcctcttatagttagaacaaaatatgacaagagggtaacttggaaaacgttatttcttttcattgcataaatcttgaatggtcaattttatagtgtagaccactgtatttatatatgtttgtaggaatccgatgttggtatttaataggtaatattttgcaattaatgcaaaatatataatatatttaattacatagaaaactatcctattaattgcacaagtaggatcgatacttcctttaggtattagactgatagcactcatttattgagagcaggtacaatagcaggctataagccagctataaacatattttaaagagataaaagaagagagaagagcagcaggctacagagctgtagccagctgcagcatggactccaagacataatgtgtgtatgaaaggtaggaccaggtataatagtatagtaaacaactattgtatgaattggctattacattgacaacattcagagcaagtttgatagtatagcccactactagctccaaattatctatagccaatgtaatagccaataagaaggacataaagggaaaaagcagaagacaagtgtcaagtaagcactctaaagtgacatgcgttatttggaatgattttttttaaaaaaaaatgaaccttttaaatataagagtaaagtccatcaccagtccctaaacttgtaccgttgtgtcatttcggtccctaaacttgcaaatcgatcgttcaaatcctcaaacttgttcgactgtgtcatccggtccttaaacttgcagatcactcatttaggtcctccaacttgttcagttgtgtcaccccggtcccttaacaggacggtctaaaaactttatatcaaaaattaattcataactttttcatgtgaacgctaatgaagacaaactttatatcaaatttgtagccctcgacacgacctacaactttgtagttgaaaagtttttgaattaaaactgtttagggtcccaaaatattgttgcatgtttatagattttgatattttaattttaaaattacattttgggacaaaaaaatgacttaaaataaaaaaaaatcaactacaaagttgtagatcgcgtcgagggctacaaatttgatataaagtttgtcttcattagagttcacatgagtaagtttagggacgggggtgacacaacttaacaagttggaggacctaaatgagtgatctacaagtttagggaccgggatgatacagtcgaacaagtttgaagacctgaacggtcgatttgcgagtttatggaccgggatgacacaacgatacaattttagtgaccggtgatggactttactctcaatataaattctttgagaacttattttcagatttgtatccttttggctacgctattttcactagcaaggtataacaattttaccacggtggtgtaatatcatggtgtgattttgctacaccagtaccaccactcgtagtggcatggcaggtcagtggtactatagtaccgcccacaccattgtttgtatccttgtcctaccatgctaccacggattgatttttcttaatttaaattcttcggaattggaagtagtagttattaatgtcaagagagcaaaggcaatttaaactatgcaaaataatttttggaatgattcaaaatatcgcttagaaaaaggttgatgcatgggcttgaattctcgttttgcccgatgcaagtcctatatactccacatgtttcatatggtaagactttctagttttgctcatatacatataaaagttaaagagtaaattgcattcacggtacatcaacttagtaagttggtgtaatttagtataggaacttgagaaatgagcatgctaggacaacaacttaccaagtgggtgcaacctagtacaaaaacttaataaatgagcttatgggtacaactacttgaaatgtgggtatgattttggtacaataacttgagaagtggtgtaaaaacttaattattttgagtatttttggctatatgtactcagcttttacgtactctgttgataatacttgcctgaatcttctctctcggttactcagtggagtgatctctctcttaaattcccataaggataaggaaaagtagacggttcgaaacccgtgcttaaatcctactcaaggttatacttatgtagatttgtacaagcattttttttttgtcattctagtaattcaaggtcaaacaaattttaccatgcagaaattttctagttggtaattgagatggtgaaaaaaatatctaaatcgatggtgcaaattaggtgagcaatatattcttacatattatataagattatatctacgggaatgctatgtgatgacatattaacatcgtgaactttcatagcactcattaaccaaaatagcatatctagccaagttattgcaccaaaatactaaattatcaaattcttgtattaaagcgcacccacctaccaagttattgcacttagacgtcacattctcaagttcttgtactaaatcgcacccacctgtcaacttgttgtaccatgagtgcaatttactcaaagttaatggatctagagacatatatatgtctagattcattaacatctatatgaatgtagacaatgctgaaatgtcttacattgtgaaacggagaaagtattatttagtgcgtttgagagaagggaaaaatgagaagaaatgttgagaagatatgtagagcgaggtgggtcattatcgcataattaattgagtataaattatttcaaaacttgaaaaggaaagattggtgttaaaacacctttctcataattttttttaaaggtactgtctaacagttcgagaagcatatgtgtctggaaaaacaaccgacttttctctacttgtgcttgtgtcaaacacctaatcttggtccaaattcagttacgcctagcaaagctttgggaaattggcagtgggtggaagacgcgtcggatgagggttaaacaaggttgactagttgagtacttcaggggctaatccaagcgtacatgggccggctgaactcttaacttgggttgggcccgccgttaaactcagaaaggaaatgccatcccgcgttttccctgggaagaggactcttcctcctaaggaaaaggaagagctaagaacccgacatgtcatctagctacccacattcccttccattttaaggtcggattaggtgttgttgtaatccaacaaggtttatagcaagattgctgatgatcaccttcttctcttccgatcctcttaataatttaatgttacttatctcacatgatgtcttaaatattgtgtagaaaccatgtctcatgcaaaacatggtttcattctcttttctcatttattcacatgtcacatcatttttcatactaggtgacagcttatttaagggcaacaacaatgtatatagcaaaagtagtccatatagatgggacccacacatatggactataactattgttatcttcacaatgtatatagatagcaactagtattaagaggggagaggaaatagagagaaataacatgttttattttatatgggcaacccatatgcttatagttggcttttactattttcttgctatggactggttccataatgttgttaggtggctgaatggaatattttattgcttatggactagttttagactacattgtggatgccctactgatatagacactattctagtcattgagttgaaaattgccttaggccattcccaacccaagacactagacatagttttcataaactccacatcataaaaaaataatagtactagacactactattccaatgcaaacaccactattccatacttaaatttaatgccacctatctcacataatgtcttggatgttgtgtagaaactatgtctcatacaaaacatggtttccttctctttcctcatttaatcacttgacacatcattttttatactaggtggcaacttatttaatgctattgacacaatcctagtcattgagttaggaatggtcttagtacctattaattaataagaagatgatatggtttaaattagatgtggcattcaaatcgactataaaacttcccctgagtagatagatagatgagacttgtaaagtgagatttataaaagcccacaccactacaaagctttcttccttcctttttaaacccaacctcccaacacctttcctcactctcctccctccctccctccctctccaacacgctcacccatgcaacccaacgcccgccaaatgcgcggcggcggcggcggcggcggcggcgggcaggacgacttcttcgaccagatgctgtccacgctgccggcggtgtggtccgagctcggctccggcaagcccgcctgggacctcacggccggcgccgtaggaggaggaggaggagcctccgatgaccactccgccgcggcgttcgacgactccgcgctcctcgcctcccgcctccgccagcaccagatcgacggtggaggcgacaagcccatcatgctccaactcagcgacctccaccgtcatcacggcctcgccgccggcgatgacagcggcggcgctgccgggttccttcccctgtcgctgttcgctgaccggtcgcaggacgacatcgacgccgccttcaagtcccccaatggcgctgtacgattctatatttctatcgcttgctatatagctcaacgattacaacttgaagggtgaattgaagcttcggtttacttgagctatatatggtgtttctttgggttctcttcttcgcagagaggtgaccatgcgctgtacaatgggttcggggccgccggaatgcatggcgccgccgccatgcagccgccgccgttcgggcaggtacgcggccaagaagcggttcaacttctccccccaattcattctgcttctttaccaaggttggaaacaactcaggaatctggattgtttccttgatttttgctcaacggagtttggtttgctccctgttcgatcaattgctccactcgtaagaatgcacctcttgttttcctcatgtcaaagggaggatcaatgccggcgcagagcttcggtggcggagcggccgcgagcggcggcggcggcggcgggtcggcgtcggcggcagcggcggctggggcatcgtcgggcggaggggcggcggcgccgccgcggcagcggcagcgggcgaggagagggcaagccactgacccacacagcatcgccgaacgtgtataccactctcccaccacctttcccttctcgcccccattttttattgcctccatgccatgttgtgtgagtgtgttcttcttgctcctggagctccacaaattttggaccaacctaacaagtcaatttgacctgttgcacacttcaaatttcggctagaaatggtggtttcggtagtaagaagagcttgaaatgagatggaacttgttgtgttcttgtgatttcctgagactttgcatgtgtttgatttgcagctccggagggagaggatagctgagaggatgaaggcgttgcaggagctggtcccaaatgccaacaaggtagctgaaaattttcctcacttttgctcctcttcttttgctttgttttacttctttgcgccatctttgaacaaagtaggaagctttccttgaaatgcgatgaagatgcacccatgctttctgcttttttttttgtgtgtgtaaatatcttatcttaaaacttagtgaccagctaagtgtgttgatttattgcagtattaacacatatgttctgtttctcttacaattaacatgatgtgatatcttcattcttcactgtatgattggaaaatagtaagtgcatcatagggtaggaaagaggggacatgaggcatatgatgcattgctgatttgatgttctgatgcttacactgacacatgttggcctttcattggagtatttgggttggtgattagctgctaacggtggtgaatgacacgtgtcgggctttcgttggatgatttgggttggtgattagatgctaattgatggtgaaggcagtagtggggaaagggaggtcagacatgatgccgaaatgaatgagaaatgtttctacccgttaggccaccaacagtaacagatgaatagccacagctcaaatttaggggaatgcagattaaactatggacttgatcattgcattagccaccaggttcctagagaactgaacatcaagaaaggaatggattagtactaggtgttatataatatatgcacatgtcttaacttcgagacatgcatttatacttggactatgtgacggctgcaaaacacaagaacaggagacacgggcacttgtctaatgttccagcctcgtctgttctccatgaactggatagagagcactacaagtcccacagctacatgccatggttggcacttctggagcttccagcgtcacgtctgatatcttgttttgcacaaactgtaatctgttttgtagtatctgaagcgataatgggtgctgatctgatgggatttggaataaaaactgacatccatcttcatatcttagctgatagggttgctccagcacaaagtagagtgacacggatcactgtcactgaaatgacgatgtggaatttcgttttgcagaccgacaaggcatcgatgctcgacgagatcattgattatgtgaagttcctccagctccaagtcaaggtaatctaaccctgcttttctacagatagatgaattcctgcctgttgctaataagttagtcccttgaatgtctcaaatcgcgcaggttctcagcatgagcagattggggggagcttctgcagtcgcgcctctagtggctaacatgtcatcagaggtacttatattatatgatgctttattttgaaaatctagagcactaccaatgacgcaatcaatggttaatggtactaggcgaggacttgctgatatgtgtaggacaaacatgtttagcccaaaatgctataatgatgtttattacagcacaaagtgactagggaaagtgttatcttttttaccatcaggttggtgataataggtagtcattatctgtcctctttaaagttagtgtattgattctgatgcatttaactttctttatttttataaacgagcaaatggttatctcttgtctaaagtagatctgtcaagaagttcatataatggaatataagcatgttaaatcttatcagtgattctaactttggcatttggaggactagaagtcagacgagttactaaaaacaaatgcatgcttgcaaaatagcataaatcaaaaggagatgtgccataaatttgcttaagaaactgatcaaaccttagtgggtaccaacgcaacaaaaagataaggtcggaaggaatcttggtagttcaagaattggatccaaaaaggacaaacacgcctgaaaagtgacaaggtagtactactgaaaaaaaaaatcaagcataatagtattagcctgtagaagctactaacccactaaggacaattcaaaccccttaagtctgaacacacactagcagccgagctaccataaggtcaactacctcaaatgtgacaaaaacgcccatcaattccacatcacctctctgttgaagaaatggcacagagattttacaatctcgagtcatttgctcaaattttaggtgtgtttttttgcagagtaatgggaatggcaatgccaccagcagcagcgggaacggcgaggcggccaatggcagcagcaacggcgacaacaatggtggcggcacactgcgggtgacggagcagcaggtggcgaagctgatggaggaggacatgggctccgccatgcagtacctgcaggggaaggggctatgcctgatgccgatctctctcgcaacggccatctcctccgccacctcctcgtcgctcctcccccgcactgggggaggcgctggagggtccctacatgaaggtggtaatggtacatcaccaccattggtgaatggcaccgccaccggatgtgacgacgccggaggtaaacagtgaggttggacagtgtccatgggaaagttgagtgatcaggatatgtcttctaattctaggggtggaattgtgaaatggcgatgctcttttctttgcctctctctctctctcttttgttttgtttataagaaaaatgatgttaagcatgcgagctttagttccagcttttcttgttgatatggtatagtagcttttctgatatctttcctcctctccttttgagcaattgagctttgagctgctctctaatataatctctagcagtattcttttctgttaaatttgtcgtggagctgtcgtttctcctgctgaatgaagactgtagaggtaaggaggaatcgaaattattggtccagaagggaccctgatcatattctgattcaaaaaaaatatcagagtacttcgtagcctggaacaggcatcaagtgcaaaggtttgtcgttggagttgaagtttgtgcgtgaatcagggataggatatgctctgctctctaacagcagcttaagctgtaaagtctccttcacgctgatgcaatccaggcgctttccggaccatcagacatatagaagattagatgcagaaacaacaggctgtacctgttcctgaaaattacctacagaatgtgtataagaaattatatatctaacacttgagctggaacagttaggtttccccttacgacgaagcaccaatgattgcgatgcaggaggcaacaaagttgaatgatatgaagagggcaaggtgatatgttcatacatgctagctatgctactactccaaactgcaatattccttcgttgctttcaactcgcacgtcgcgatgggctggcttcaagtaaacaaatccagaaggaatgatatgatgaatagattcaaggattcggacgggagatgcacccacgttggtgaagtaaatgaagggcatctttggtcgtgctctaaacaaaaatatcgcagtgacaactctgatggatgagttaatacaatgaaaaatagtctagaattgctctagagaaaaccaaaatacaagactggacacaagatgatgaaaaaattttaatgcgagacagatgaagccgcacaactgttgcaaaaaggaaaatgaaccgaaacaaaggccaagggattctcaaccttctgcctgaaatttggaatctcaaaggcactagaaaatggagtaacaaaccgcattactaacagagactgtaatagtaatagatatttcaagtgtaaagcctaacaaaaaggttaacagcgacgatacattgatgtgaacgtacccaactttactttggggtagattccttcctagccatgaaaagcagtggatgtattataactacagaaggaaagaagaattccttccctggtgtaaaagcagaagagaactactgtaccgtgcaccaaaaataagcagcaggttgcagggatggggaaagctgcttggggattgcacggcaaatggattacatgacacatcaaaccatccctcttgttttggacatccatgattaaatgctgagcctgttgcagaattatcataggcgagaatcacctaaaggagacagcattggaatcactggaaaggcagcattataaatcaaacaagggataaatcatgatcaagtgggtgtttcgccctccatactttaaacgataaatggatagacccaacccgctttgaaccacatggtttaatgttcatcacttatcatgttcaaatctagcatatctccatattataagaactcaatgagctctggtgatatgtcatgtttaactccaaactctactctagcccatttttactggtactcaatgaacaccagagtcctgacagttttaccccttcctttctaactgatgttggatgatgttatcaaattaatagggctggtggatgaagctatagcagacaaaacagtaaataaaaagaagaaacttcatgccatctgagaaagtagaactcaccaaatctatgtagcagatgcagatacatcatacaaagaataaattagaacttcaactaatctatactgcttcacgtattgatggttctctttcttttagaagcattaggcgctttatctcccgacttagatttctttgttgcttctgattcaagagactcttccaatttctttagagctttgatcacccagtcagaaaaaaaaagattaaatttaacacaaatcatatgagtaataatgcattagtgcatcttaaacaaaacagactgcaaccttaccagaggaaaaaactgggcgaagggtttctaccgattcctctggtagtgaatgaagactgcagctagaattatctgccttcttgagcattttgtcaaaagccttaacctgcaaagacagcccaaataaaaagaaaagagttagaatgagattttagacttatggcacctgctctcagtattcaattaggcattcttttagtgaaataaagtagaaaggttacacagaccatagttatccacacatctggacatatgttgcaataaaaaataagcatcaggtgttttatgcattggtaagtcctaaaccaaaacagaaagtcccagtgctaggtaatcggtggtgccccttctgttttctacaccatatcaattagcgtcaatctaacatataccaagtcaataaatactcaacttcttttctatgtttttaaacatcacaaatacaggcatgcgattaatctttcatgtgcaagcttcctacacatatagtcatatcatgtaattaccatgtcatattaataaaatcaactcactgtatattattgtactagaagaacggaaaactacttataattgttcagcaatgtattacctcatgtttccttaaaaatgtgaagcaagaaccagactctcccgcccgagcagtacgacctgctcggtggatgtatgtttttacatacggtggcatgtcataattgataacatatcttaagccatcaatatgaattcctcgagccattctatctgtaccaatcagaacatctatcttcccttccttgaaggcatccagtgtcttcctgcaaaaaatatgtgttgctaatcccgtaacttatcatggtgtgaataagttcaacataccaaaaattacatcctatcatcaacagaagttacataggtcttgcagttcaaacttcaaatccacatgatccagaaaatattatgatccatagaacttgaacaaggaatggtcagctagatatgatatttgcatactatttttatgttgtctatttgctaacagctccatgaaactgaacttacctccgagtcgattcacgttgcaaacgtgaatattcactaaatttgaagggcaagtcttcgaaaaattccagcaaggtgctcagtctgtgactggattccacagatgaagtaaaaactaaacatttttccccacgcagctcttggagaagaacaatcagagatagtggttttaaatttgatttacagacctgcaggtgcaacgcatcatcaagatgaacaagaaaatacagaatttccaaatagacttttacacattggatgcaccagcactaaagatgtaacggctaaaaatgtgctacatagagatgaggacaaaccagcttgtaggactgaagctttgttggaattctgtagcgcttctttccactattcaacagcaagggatgttgcaactcaagttgagaaagcttgctaggatcttgagtcagtgtggcagacaaaactatcttcgccaatcttggaaaggatttacctttaaaaccacgctcaacacccctatatgccatagcatagattaatcaagttttgaattgaagtacagatcaacaaacaatcctcagagctacaatagcaggaagggctgaatcataacgcataagtattacaagtaatatgtgaactttactaaaaggggagtgtaaaatactaaaatatgacaatgtaattaggtagtgtgggactaacgatcgtctaatggtagtcaatggatgcagtagagtttctccgttcatgtctgaccaggaatggttttgatcactcgagcgagtaagctggataactgttggcaaccaagactgataagcttctctcaacatcctgtccgtctcatcaacaacctgaaatgtcaatatattaagtagaaattaaaggcactaaaaagatggaaaagaagactcttagtgctaaaatcaaagtgcatatccaagcataaactgctggtctggtcaatccaataattatgtgaaaccaacataaggtaaaatatattaataaactattttccttattccaagctgtcctggaataatcatgttcttgctattgctgattgaacaaaagaacaaacaagtaatcttaggaaaagtaagcaagcggggaagattaagggggtggaatataactcaagaggacacatagattgttcccatcaacctaccaggtattgaagatgctccaggctgaaaccttttgtcatgctgatatgatccatcagtcttccaggagttgccaccaatatatcaactttagtctgtggttccatttggatatattcttcatcaagacttgggaaaagcccttgtttagacttctcaataagatttgaaacttcatccgctattgatgattgaccaactgctgagcctactgacaagcccacaacaggagcaatagcatcaaaaacctctttaacctgaaattgaacaaagaattcatggaacatcagtattgttcaacataacctgaagaacatgaaatagacttgttgactagctgttctggttagactagcatgtagaaggtaaaaggaacagcacaaacctgcaatgctaaatcccttgtaggtagcacaaccaaagcacgcaagcaccttacttttcgagtagcgagcatttgaacgataggcaaagcataagcaagagtcttgccagatccagttggggagttaatacagatatccctctcaaaagcaccaggaccaatagtttccagccatgctgctacttgaactggaaaaaatgattctatccccattctctgcaatggcttcaccaacctaaagcagtaaaacatagccaacacaggagtaaacatgttagtatttcttaacagcatgaagtattaaaagcatcctttctaagtacctcaacaaaattaactgcactgaaaacgcattcaagaatagcgagggaataaaggagattcgcaagcaaaacaactgaaattacaaactctcttagaaccaaacaagatgggtcatgggtgcatatgtgtgttttagagctaaccgaacttgtacaaattccaactctgaatactcggacaccagctgaacactattagcttagtgaaattacacaacgccattgatgtccagttggagtaacatcttatggtcacacacaaatcgcctaatcccagaattacaaatcaaccgtgaccaaaaaaaaaaaaaggaaaaacctacttgatagttcataccccacgaggatgcaaactaattagcatcctcaccgcatagttatcgacagctaagttcattccatgcataaaactttcacagtgccacgacgcctaggagctcgcgtccaagctagcgaatcgcttattcaagtgatcgaaagtatacaaaaagaggggggtgtggaggggggggggagctcacctgggatcgagacggggaaggtgcgcgacggggcagccggagaaggagtcgatgtcgacggggttccgcatccacggaaggtgaggcacgcggctcgacggcccaccctcctcctccttcgtcgccatggccaccaccatcacacgccgaggacgacgattcaaccgccaaccagggtcgtcgccgtcgccggcgccggtgagtagaactcgcaccgagaggcgacaggcgaggaggtgagtaagcggcggcggcgaattagggcgtggagtagtgtgatgaattcgcggaggccgccgcagcgcggggaagacaacgggccatcttctcgtgggccgcaagcaaaccaagcaggccacgttttcgtgggcctcaggcaaagtagacaggccgagaataaataggccgcgtctgcccgtgcggtggcccattccatttcccccggggtccacccgcacccttcccttccaccgcaagctttcccgttgcggtgcggatcccccacctcttctccgccgcctcgctctccgggatggacccctccgccgccgccgccgccgccgacgacgacgacgactaccacgccaccacgggtgggatggagccgcgtggagaggaggacaacggcgccagtacaaggggcgtcaccggtcggctactcgcttggcgcggggaagaggaagacgacgatgacgcggaggattcgggaggagggagcggagcaggcgccaacgccgacgaagacgacgcggcctccgctgtttcccttgacaccatcagcaacgactcgatcctgcttccgccggagccgacgagcgccaacctggcgagcctcctccgcgcgaggaagctgatcctcgtcgtggacttggaccacacgctcatcaactccaccagattcgcccacctctccgacgacgagaaagccaacgggttcacggagcgcaccggagatgatcggagcaggggcctgttccgaatggggctcttccggatgatcaccaagctcaggccgttcgtccatgaattcctgcgagaagcgagcgccatgttcgagatgcacgtgtacaccctcgggaacaggaactacgccacggcggtcgccaagctgctcgaccccgacggcgcctacttcggcgaacggatcatatcgagcggcgagtcgtcgcagccggacaggaagagcctcggcgacgtcttcgggtgggcgccggagatggagcgagccgcggtggtcatcctcgacgacacggcggaggtctggaaggggtacagggacaacctgatcgagatggagaggtacctctacttcgcgtcgagccgcggcaagttcgggatcgcggtgaggtccctggcggagcggaaccgggacgagagcgagcgcgagggcgcgctcgccgtggcgctgcgcgtcctgcggcgagtccatggggaattcttctccggctcggtgtgcagcggcagcttcgcggacgtcagggaggtgatcaggcaggcgcggcgcgaggtgctgcgcgggtgcacggtggcgttcaccggggtcatcccaagcggcgacggcggccgcgccagcgaccaccccgtgtggaggagagccgagcagctcggcgccacctgcgccgacgacgtcggcgagggggtcacccacttcgtcgccgggaaaccggtcacccgcaaggcgctgtgggcgcagacccacggcaagtttctcgttgacacggagtggatcaacgccgcgcatttccggtggagcaagccggaggagagaatgtaccccgtgaaaggcgagcattgaggacattggaatggcggcggcggcgacgggcggcggtgcactggaatggcgttcatgatgccgtcgagatcgatatgcttcggatcgaagttgaggctgccaatcttggtctggcaatggtcgtgcagcgatgttgattttgattcgttgggtgcactgtattctgtaggaaatcgatctggaaatgaaccaatacagtactactgaccaaagatgatagcgaacgaggtaaaggttagaactctagatcagcgtaaaccatctcttgtattcttcgatatacgcagattctgatcatatatagcgacgccatatgtttctttgcccgcatttttcggttgggcgtcgatcgactcgatcgccgatctctttttagcagaaagtcttgcgttctctctcttcaatgcaaccatctttgtcttgggaagtgtctggttatcgtgcgcttaccgtggagtacagaaaggattaccggtttgctaaatgtgttcgaatttaaattttgggaaaaaaaacaaaaatcttttaaaagttgctagaagtagtgcaacacctaagagcacacatccaagccattgaatcggttgttcaagtgaagtgatcaggatcgaagggaaaggaaaaagtacaccgaaggtccctcaacttgtcatcgagttacagaatcgtccctcaaccgcaaaaccagatatatgacatccctcaacttacaaaaccggtcacaataggtcattcggtggttttcacaccagtttaatcctatgtggcggctgagtcagcgtgggacccatatgccaatatgccatgtctctctccgttccttctctctctcacccttctcttctcttcttcggcaagc

SEQ ID NO: 58858 - DNA, 15788 bp, Oryza sativa
ttggttacggattccacattactgggatcgacggcaactcctcctgctgagatgacgtgaccaaggaacttcacttcagacaaccaaaattcacacttgctaaacttagcatacagttgatgttctcgtagcttctccaatgcaaggcgaagatgttcttcatgctcttctttggttcgggagtagataagaatgtcatcaataaagaccaccacaaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactggtgatatcctgatcgaagatctatcttggagaatacagtagcacctttaagctgatcaaacaaatcatcaattctgggcagcggatacttattcttgatagtcacatcgtttaatgcacgatagtccacacacatccgctgagtatggtctttcttttccacaaaaataaccggagcaccccatggagatgaactcggtctgatgtaccctttctgaagcaaatcgtctacttgccttttgacttctgccaactcattggctgccattctataaggtctcttatggatcggagttgttcctggtaccaaatctattctgaactctatatcccttttgggcggcataccaggtaaatcatctgggaacacatcgggatactcccggactataggaatctcttccaaagttatctggttcagtcttgaccttaaagactcagatgacaatgcatgaacagttacaactcgaccatcattgctgatgagagttacttttctgttagcacagtctatcacacctttatgtctggctaaccagtccatccctaggatgacatcaaggtctttggattctaacaagataagattggccagaaatggtactccttgaatttctattctgacagaggggctacgttgcaaagagagtgcttgattgcttggggtactaaccatcaaaggacgtctaagatcttctacttccatcccatgatttcccgcaaaactcatagataagaatgaatgtgtagcaccagaatcgaaaagcactgttgcaggaactgagttaacagaaaacgtacccaaaatcacatctggagcatcttgggcttctgcagcagcaacatgattgacacgggcctttgatgctggtgcggtagagttgctctgggcagggacaaccttcacgcgtcggggcttcggacacttgtcagcataatgtcctgggtctccacagttgaaacacaccacgggcttgctgcctggctccctcttggcaggttgttgctgtgttggagctgcaacaggacgtggagcttgattgcggatgttgttgccagcattgttgttgaaaaactgacgttgcggacgaacaacagacgaagaacctccctgtggcatagactggggtcctaaagtaagacgcggcttctgattactcccctgttgtgctttgaagtgagcaatccggcgtttcttctgctccatgcggttgtacttgtcttcctgacgaatagccttatccattaatttctggaaatcagaataatctccagtcatgagtgggtaagaaagctcatcattaagtccttccaagaacttctcctggcgctcttcatcattgcgcacatcttccggagcataacgagcaagacgattgaactcgtgcagatactccgtaacagagcgagatccctgggtgagcgacctgaactccttcttcttgagagacaccactcccgatggtatatgcgtcttccggaaagcagcggtgaattcaagccaagtaataggttcagcagtagtcctattcaggcggaagtgatcccaccattcagaggcagggccatgcaactgatgtgatgcaaatgagaccttctcctgatcagtgcactgaagcaaatccaacttcttctctatggcatgcagccaatcaccagcttcaacaggattagtggtactagagaaaacaggcggcctcacacgaagaaattctgctaacttattctgaggaggtgcatggttatttccttggttctgctgattctggagttgctgcatcatcatgttcatgagttgtgtctgttgagcaagaacttgggcaagagtgggattctctccattattgttgttattggggttgttagggccattcccattgctgcgagtgttcaccatctggcatggacagggcacaagaagagaaaccgggggaaactacttaggatagagaattactttaacttttattgatcttaactgagttttattacaaactgaagactctcacaccactaaactcaccaacttcctcacactcaaaagcaaacaaacgcatgcacttacatcccaccactgatgtaaatcacatgcgagacacacacaagcaaacttaaaacaagcaaactaacacaacgatctaagaccacgacttaacaagtcactctagttcttctgagcatcggaggtcgattgaaggctcgttcggctcgtcttcatcatcttgagttgctacccactcaatcttggaatgggtgcgcttggattcttcatcttcatcactacttatgataatgaccggaggatctgctggggcaacttctttctccaccacacgaacctttggcgccaattgatagcgagggacaaatagagctctcttccttgcggtaagacgaatcctggccttctgcggcggagcttctcccttcaatgcggctaattccttctccaaacgatccaccttgtcttcgagcttgcaaatcttaccacgattccggtcttcacgatcttgagctgctaacacagtctccgcacgactttcatccatagcccacaacatctcaaccaaatgccttgtggtagcatcattctcaattccttcagtctcaaggtaactgccacggtcacttccctgtggttgacgaggatgatagcgatactcagtgtcggccaactgatcactgtagcgatcacggagctctcctatggcgatccttgccacttcctgacatgcatggatgtagtttcttcctccagcttcgaacattactgaggggacctcttcactattgctgttcaaagtaactttgactcggcacttctcttcatgacgatcatgaggaatctgggcataaaaaggggcagtcccaaatccaatgacaaaggacatcgtacgcaactcctggacaaaaccctcaacaccaaacaagtactcaggcttgtagcgcggcatctaaagacaagtgaaaggagggagttaagacatctatccaattaacagcacaagtttttggattaatttgaataaagtttagaaatcaaaataaaccaaacctgcaggataagttgaaacagttggaaacaaggttacaagctttgtgcttttgagtaacaggttttaaaagaaataaaagaaagttataaaatcaacttgctaaatctattttattgcagcaagattaaataaaacaacattgtaaaacttttgctggtaaatgagccattggtacagtaataaatgtacggtactaataacactggaataaattttgaatgagaaccattaaaagagattatgaagtgcatgtgccattagtttggtttaattaaaagagaaagggaggagaacagttctacttttccaatatttttagaaggcttctatgggtaaccatttggcataacctagggtcaagggggctctgataccaacttgtcacgcccggaatttctatccaaaattccaaacgcttacatgtgtgtgaaccctcgtccaggaatcagccgaggcacacaataacaaattgataatagagtacaattattactctaattaataagcgtataaagtgtcattacagaggtagatagttcctctcaaacaataaatatctaagcagcggaaaaagaaataaacggcgcagacggctccactccacataccgaggtgcgagcttcccttttgtctgaaacctgtgcacacctcgcaatggcgtgacccgaaggtatacaaaatcacccactgcgaattccaggtcacggcgacggttatctgcataacttttctgccgagactgtgccacctttagattatcccgaatgattctgactttagcttcagcttctctcaggatatcagtcccgaacacttggctttctccaacttggtcccacaagagcggtgtccggcatttgcgcccgtacaacgcttcataaggtgccatttgtatgctggcttgataactgttattgtaggagaattcggcataggggagactcttatcccaggtcttcccgaaatctagtacacatgcgcggagcatatcttctaggatctgatttagatgctcggtctgtccatctgtctgcgggtgatacgcggtgctgaaatttaatcgggttcccaactcttcttggagtttcttccaaaaatgagaggtgaattggcttcccctatcagatacaattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctccttcaagtctaagtacatctttgtactgcccgggtgaatggaataagggctctcgtgagcttcctgaagtatcagctgtttgagttctcggttatctggaacgcatacccgctttccgttccatagggttccgtgttcatcctctgtgaaaccagcggctttaccctgtttcatattcttgaggagtccatgcatgtccggatcattcttctgagccttgcggatttgatcgagcaaggtaggcttggcttctagcgcagccaagaatccgcgaccaactatgcttaggttcagggcttccatctgttgattaagttcgggtggaatgccacggacgttaagagtgttgcaatggccctttcgacttagagcgtcggcaaccacgttggccttaccaggatgatagtgaattcccacatcatagtccttgatgagttctaaccatctcctttgccgaagattcagatccgactgggtgaagatgtatttcaaactcttatgatcggtatatatttcacagcgattcccaatgagatagtgccgccagatttttagagcatgaaccaccgcggctaactccaaatcatgtgtagggtagttgccttcatgaggtcgcagctgacgtgaggcataggctaccacatgaccgtcctgcatgagcacgcaccccaatccttggcgcgaagcgtcacaatacaccaggaagtccttgcgagtatccggcaagattaacaccggcgaggaaaccagcttttccttgagagtttggaacgccttctcgcattgcgggctccacacaaatttctcttctttcttcaacaactgtgtcatgggtcgagcgattttggagaagttctcgatgaatctccggtagtatcctgccaaacctaagaaactgcggacttgagtaactgtcttgggttgcttccaatcggtgacggtggtcactgtttcggggtccacagaaactcctttagcagatatcacgtgtcctaagaatttgacttcggacagccagaactcacacttgctaagtttggcatacaattgatgttcccgcagctttcccaacaccagacggagatggtgctgatggtcttcctctgattgtgagtataccagaatgtcatcaatgaaaaccacaacaaacttatccaagtattccatgaacactttgttcattaagttcatgaagaaggcaggtgcattggttaggccgaatgacatcaccgtgaattcatacagcccgtatcgcgtggtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttagtcttgtctttcttctccacaaaaatcacaggagcaccccagggggaagtactcggacgtatataccccttttctttcaactcttccaactgtttctttacttcggccagttcatttgctgccatacggtagggtcgcttgtgcagaggagtggttcctggagcaagatctatccggaactcaatctctcgcttgggcggcataccgggtagttcttccggaaacacatctccgaactccctgacgatggggatttctgacagtcctatctgatgcagttctgaactactgacagaggttgggggtgcaaagaaaacaaccggttgttccggccctcggtacagagtgacagtgcgcctcgcgcaatccactactccttggaattgagccaaccaattcatcccaaggatcacatccaagttcttggtgtctagcagaatcagatccgagggaaaaggaatcccctgaatttctatagggacggcagggctataatactttgctgtcataacccctccaggggtggtgatgagcagagggttcctaagcctttctacccccaactgatttctccccacgaatggcacagatataaaccagtgggaagctccagagtcgaacaaaatggtagcagggatggaatgaacgaggaacgtaccaacgatgacgtctggagttgtcagcacgtcctcggccgtcacgtgattcacacgaccccgaatgacatccttcccaccgttgttggagtggggaggcgcttggccttgctgacgccttggcttcgggcatttatccgcaaagtgcccgggctcgaagcagttgaagcacagacgctgctgaccttgagcgtccctgcggccttgaccagactgcacggttggcgtaggaggacggggcgcacgagtcccttgctgattctgctgctgctgcggctgtgggacgcgcaccacgaattgaggtcgcggcgcggagcgaggttgctgctgctgttgttgctgttgcgaggaggatccccctggataggggttggtgtagcggaccctttggttagcaccctgttgattgcggaaattcgccaagcggcgcttgtgcgactccagttccttgtgctttgtcgcgtcccaaaacgactctaaaatacatcctcgaaattgtgccgagaataattaaaattcatgtgaaagcctccaacaattaaaatgtgcaaatataaaagtcaaataaggcttggaggatttttgtatatttcctaaaagcctaaaatgcgtaaataaattttagtggaattttcagagcacaaataataattgagaagaaataaacaaagttaaaaaggttttataaaaagaaaaaccctaaaagaagtccttttcccccccttcctctcttgggccggcccggcccaactccctccctctctctcctctcccccgcggcccatcggcctcctccccgcgcgcgcgccgctgacgggcgggcccgcccgccaccctcgctgacgggtggggcccacctgtcatcgcctacctcgcgccgcgcccgccgccgcccgtgccctagcgccgccgccgccgccgaatccgccgcatcccgccgtccccgcgcgccataaagagggggaaatcactccccgtgattccctccctctttccccccactttcccctctctctctccctcggattcgctcggatttaatcccgcaaagttcgccggcgcatcaatggagcccgagatcgccgcgccggtttccttcctccccggccgccctctctcgctcccgtccctatataattgttccccgtgcctcactcctccgtttccgccactcgccgctcgctctttccgtcggattcgtgctcgcgccgttgtactctctctccgccgtcgccgccgagctccggttcgccgccgtcgtcgctccggacctcctcccgtctcggcgtcacctccttcggcttcgccgcatccccgtcaacctcgtccaccccttcgtttcgcccgccgaccgtcggagcgccgccgtcctcgtcgatccgaaccgcgccgccgtcttcctccgctccgatcgtcgtctccgccgccctcgtcgtcccggggtgagccgaggaccgccgttcgctttcccccttccctcctctctctcgggtgccgctccgccgcgtcggtggtcgccggcggtgaccatcggggcgcgggcgcgccgcctcccgtcggccgtgccggcgaggccgccttcgggcgcgccccgcggctgccaggtggggcccggccgtcagccgcccgcgcccgcgggtgcggctgacgcgtgggacccacggcgccggccggcgtctgccgcgtgcgcccggtccaccgtggaccgagaggctgacgcgtgggccccactcccgtggacccggtccgcgcgcccctcccctcggctgacgcaataaatccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccggtgtttgggaaagcgagcaaggcaagtcacatcatccttgagcatattgaatcccagtttataaaattattttgatttaaattaatgcattaccgctttatttcaattcccgcgttatcactgttttatttagccatgcctatttacctttgttaagacattattattgctattgttattattaccttgttcaccctagaataaacaaaaccccaactagtgggtactctattcctggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaacctgttttcggtggggtctgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctaggacaaatgaaggctacacgagctgcggcccggtagtcgagatgtcatggcacagggttggtgccctgctgctaggggctcagtcctgcctgcctgtcccgggggttccggccgtaggtgggattgggtcggtactcttgtctatggctaggatgggttggaaactatgtcacagcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaatgctgcttttctgcaaaacttaacccctatattatttaccccttgtacccccttgcattaatcgtgcatctaccggtgtgacttgctgagtactgtggttgtactcattcttgctctatctttctccccccttcagtaagagaagcttcagagaagatgtcttaggtggagtcctggcttataccccagttgagcgcctgtgaagatggagccgtaggcccgctagtccgctgctgtttatttttgtttgtcaggcctgaagcgcctttgtaataatgtaaatattatcgatataataaagatgtgtcttttatatcatgtttgtatggtgtaccccggcttttcctgggacggggattaatacactggcgttcgggaaaaggcaattttcccggtcgcgacaagatggtatcagagccatctcgactgtaggataagccaagtggataaaacctaaggacatattttataaataaaactatttgcgaaagttcctttttttctcctttcccctatgctatttgcaaaagggtttactcccttcttccttcttcggatttcaactagtactagatggtcaggtcagtgaagaagaagacatcgtcagttgtttgccgaagctccggaagactgcaggatccgctagcgaagtggaggaagcagtgaagccagctgtaaagcaggagtgaagatcttggagaacccgtcgcagaacctaagccaccctctagtgtttcgtttgtcgtgtgtttccttgcttgtgtgtgtagcgcgtggtttgcatcagtggattgtgatgtaaccatgctaggttgtttgcttaatcaacttgcagaataagtgaaacaaagaacacatcaacaagaagagttagttcctttaaggtcctatctctagttctggtctattctttcctggcttgtttcctctctcacctcaatccctgtaacagatgtttaacagagaaaaaggaaagaatgtcagcgggtatgactcaagtaactcaagttttcaactcaatctgccactggcctcaagagagttaaccagggcacacccttggtccattccaagcatgctgcttagttcacagctaccattggttggaagtcaagaccaaaatcagtatgtgtttgatcgagcctttgccacccaggtcaatgagcttccaatgccagaagagcaggttcccttttgtcatgattgtagagagcaaggacactatgccctgaattgtccatgggtatatgtcaaagaagccccttcccttggtttagcagggcggacatcgctaaaccagcctcctcacaccaagtcaagcttgcagcctagtgtgcaaagtagagagctcaacggagagaatccattgaatcccgggaaatgctttcctcctagcctctcgtaccacgtggggtcacatactaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaataccttccgaggtgcacgacagttgacccagcacctcctaagccgtggtggcagagtatctgatagtgaagggtcagatcaagtctcctcggatgaagaagatgagtctccccgacatctcggcgaggaagagatggaatccaaagcatgcccccgttgtggagaaattggacacgttgctagcatgtgtctcacactctgccctcattgtgaggaagaccatccaccaggtgaatgtcccacccgcaaggtcacatgttttctgtgcgaaggtacaaaccatgtgcccaaggattgccaactcagtgtgttgttgaccaagaccgcagaaatccaacgaacaaccctacgattgtctcatcagctagtcagctccaacagcaacatcgacgatatcatccacagcaccaatgctcctcccgctgcacctgactctgcaataaatcatagcgataataccttcagcaccaaccattctctgcaccgacagcctcaacaaagaattgtcatcgatggaagaagttgtgtctctccccgacctactccaggccgagccaagggcaatcaacctccggagggcgataccaagcagaagaccgttattcgcctcaaccagcaaccagaaggaaacttctcctgtgaatgatagcaatatgcagtcctatcacatcatcacagaaccaatcaaggatgcagtcactagaacaatgccagctatgtatccatgtttgtgattttcagttcgctacttatcactgtaatcgggagtttgcagcaatcatgtaataaataaacatattcatgattataaacaatgagtttgttatgtttatggatgattcatgttgaggatacaatgtaccgatgataagcaccttccctttttgtttaaggcagtgccttgtattcgtgtaataagggagaaatgtgtaatacagacaagttctgagaggattcttttggaagatgcggatatgtgatcatgtgtataattgtttactgacaaaggagacctagggtctcgtgtcagaggaactatattctaacctcgagttaataaccaacctgtggatggaaaagaaaaccaattaaactgtgttgggttaaaaagccaatgagacagtagttggggataggagtttggatacgcctcttacagatcaagataaggattgttggatgaaacccataagggtacccgccatgcctctacattgataagttcggatattcctgcaaacagttaagaagatccaggagacatcaatatttgagaacataatagtcgatggttggtaattagtctatcaggtatcagaaaagggtcaaaggtgatatggcagaagaacaatatggatgctccccatctcgaggaagcactaaagatgatcatcggcaattaaaccctagtggcatagatacagatagcaagcaatgtatttccctgaaggtggtcagtgcagcttcttgacaaaccacatcaaggtttcactgaaaggcagcaagccaaaggacctcatcgtccccagaagcgtccgcaatccacattaaagaataccacatgttaaagataagccgaaagatgattgataaaagagattggcaaagatgttctccagcatgaaagaagtaggccggaaggtgattgataaacagaaacatgctctgcatcgctcaaggaagacccctgatagtaattgccccgcaacagtcaccttgtcattaagtaagcaagatgacctaggtaaaagtgtttctatgaaggcaaggagtgaaatcttcaactcggtatcagatgctacacggagtgaaaagtgcaagcaccggttaccaggtaatgccatgtcttgggagatgatccaatgggaaggaacacatcaaggttaaaaggtgtaaaggaatacgttgaatgctaaccgaggacaacctgaagataatagtggaaagtaaactgaacataaagaaagtgaatccgagttgcttgttcgtgagagctattcccagttatgaatcaagtgatatgttcaaagataatctacagaggtcagattaaaatcacatctaacaacgaagcctcagatttggcaggataatgattagacagtaacaaatccagcaataaagccatttgggaagacgtcaaagtatgtcaagtgggataagttggttctcttgggaagcataattcaaaggcaaagttagcgacccttgcatcaaatagcagaagtacctagcaccggagaccaggaaagctaatatgagacagttcatgttgtcaatcatggtatccttagtaagcgggatatcatagtctaaagcatatggtggtaagctggaaggaaacgccaagcatggtattctcatgatgacaagcatggtatcctagtaatgacaagcaggttacgagacatgacatgaagttgataacttgtgaggttgacgccgaagatatgaatcgtgagaagttctggatctgaagccccatcttcaagtgccgcaacctagtctgagtcagctaaaaggtgcaccctggttcaagtcaggtgaagagaagattccatccgcagcaggaggtcaagccaagcagttccgagtggtgaagttttgctgaaagtttgtgaggacggagcggaagaagtcaaacaagaagagaagaccgcccaacctatcttcttgctagcctcctcgaatctcggggacgagattcttgtaaggggggtggatttgtcacgtcctgataaattcatcccgaaataaaaatcattttctaaaaggaataatagaattaattaaaattcgaaaagaaattggcaaacactaaaatgcgtataagaaaaattcaaatgtggcccggagaatttttgttaaattctccttggtctaaaaggcgccctcaaattttagtggaattttcagagcacaaataataattgagaagaaataaacaaagttagaatggttttataaaaagaaaaatcctaaaaaaagtcttctttccccccccttcccttactgggccagctcggcccagctccctccctctctctcctcctccccgcggcccactcggcctctccccgcgcgtgcgccgctgacgggcgggcccgcccgccaccctcgctgacgggtggggcccacctgtcatccctatcctcgcgccgcgcccgccgcccgcccgtgccctagcgccgccgccgccgcggattccgccgcatcccgccgtccccgcgcgccataaagagggggaaatcactccccgtgattccctccctcttttccccctctttcccctctctctctccctcggattcgtccggattcactcccgcaaagttcgccggcgcatcaatggcggccgagatttccgcggccgattccttcccctccggccgctctctccctctcccggcgctatataatcgtcccccgtgcttcgctcttccgtttccgccactcgccgcctctcctccccgtcggaatcgagcccgcgccgtcgcaccttctctccgccgtcgccgccgaactccggttcaccgccgtcgtcgccccggacctcctcccgcttccgcatcgcccccttcggcttcgccgcgtcctcgccgaccccgtccgctcctccgtttcgcccgccgaccgccggaacgccgccgtcctcgtcgacccgagccgcgccgccgccttcctccgctccggtcgtcgtttccgccgtcctcgtcgtcccggggtgagccgtggaccgctcctttcgcttcccccttccctcctctctctcgggtgccgctccgccgcgtcggtggtcgccggcggtgaccatcggggcgcgggcgcgccgcctcccgtcggccgtgccggcgaggccgccttcgggcgcgccccgcggctgccaggtggggcccggccgtcagccgcccgcgcccgcgggtgcggctgacgcgtgggacccacggcgccggccggcgtctgccgcgtgcgcccggtccaccgtggaccgagaggctgacgcgtgggccccactcccatggacccggtcc

SEQ ID NO: 58859 - DNA, 27922 bp, Oryza sativa
tacgattcgttgcaaaatcaaacggaaatcgatttgaagaagcttttgatccgttcatggccatggcgatcgacgaggaggtaagataccttggtgatgtttgggacgagcgagcggagcttgtagaggtggccattgagcttcttcctccgcttcctctccgcctcgaggttcttgcactgctgcctcttggcgccgccggagcgcccctcgccgtcgccgtcgtcctccgggtcaccgccatgcagcttcctcccctccgacccggactccgccacgccgccgcccgccgcgtgctgcatctgctcctgcgccaccgccaccgacggctcgctcaccgccatccccgcgtacggccacgcgcccgccgccgccgcctcgtcgcccacggcgtcaccaccaccaccacccaagaacgggtcgtcgtcggcggcggcggcgtcgaacaggttcagcgacgagccgccgtacatcagcctctgcgcgtcggcgcctccgtcccactggaagctgggcgtctccggcggcggccacgcctgccccccaccgtcgtccccggcgccgccgccgccgcactgcgccatgacaagctccgccatctgctgctcctccgccatctgcaccaacaccgatcaacccacaaatctatataacccatccatgcaaaacgcaaaggccgttgcgtgcagctaaccgcaagctctccggcgttcgttggctcacgcggatggcgtgagccgccgccaccaccgccgccgccgcagccgcagccgcatcctctctaactactactcctctaaccaatcgaacgaccgaccactcacatatctcgacgcgaagagctcgacgaggccgccggcgacggggaccagcagccgcgtcttggcgccaccgccgccatcagcctcctcctcctcctgccacgcatccaagcaacacacctcatcagtgacagagattcatattcagattcagattcagattcagattcagctactgggttcagtgatgaatcttgcttacactgctgctctgccagatcggctggttcgacagcaatgcctgcgcatgcatccttgatggatagtgacagagattcagattcaccaagcatacaaatgttcagagttactagacaagaaaccatcaattttgcaggtaatcagaacacgtatcgattgattgattaatcattcaatttaccctatggaggaggagtccagtgggattgaagaaggcaggtccagcagtgctgagacctgtgcttcaagctcactgctgcagcagaatcctgtcatctccaagaacctgccattaattttgtgttaatggttgtatatcactacagagataataaatcacaccgtaattgctactttgcatgcatgatatgatatgatatgccaagtaatcaatcacatacctctgatcaggagagagcctccagtagatgcagtaatcccagccatctgaaccaactagaggcctcaatgcagcatccaaactggtgccacctccattgacagcagctgcagctgcagcagcattgctgttcttcatcagcaggtggtctcctcttcccatgtggtgatcacccttgccctagcagtgacacatgaaagcaagaagaatggatgcaagtgtcagttgcagcattcacaaggcctgctttttcttgctgtcaggacaggataagttgatgtcaccaaggatacagcgaaaattcagggtatgatcacagcaagggaacaatcagattcagtctgaatattcatcagactaaagagacagatttagtctgaaaattcagtctatgttgaatcaaattttcagtaacttaaagagacagagatcaaagctgcattcttctggctcatcaggattgtatgtgaaatcttttctagtgaatttttggaattaagcagagaaagaaagataccttctgtcttcctgagatcgcttcaaactaactgacgaactgtggcagtgatcaacagatggaagagagaggcatcagctgatagctattggtaactgaagaatcattttgtacagaaggactattgcatcatgcatatatatagttcacatgtgtgtgttcctctgaatttagccatggctatctgatgatgtattgataccaagtcttcggaaatggctgtcaaattatgtatgatactagttgaattttgaattctttacttaatcactccacctatattgctctgaaggtttgttgtgggtaggtgagttgcaagaaaggtgtgagagttttctaactccaatacaaatgttgttgtctaatacgcaagtaatcgcaattgcgatgagtcctctcaaactacgcaatgacagttttggttatactacctataatcatggagataaaatgttcacaagaacctcttttacatgagttctgagtgaaattcagaacttgtctgttaattcagtaaaaaaaaaaaaagttcaaatgaacagggtgagacagagccttgagctgatctggtccctctccattgacagcagacagcaaacgtaagaggttgttgaatcgaaaaaagcttagctgtgtgagatatttgctgatgcaatgttactctgtcgtccacgcttcagagttctgagttcaacaagtcacatgataaaaaggacaggcacaacagaaaggaaaagggatagctacaaaacccatatgctgaatttgaactgcagatttaaacatggaatatacaaacaattcgattatcaccattaaatgttcttattacgattctttggttgggtgatagctaaaatacatcatggcagcttgtggaatgctttccacttgccaggatcaggacatatggataattggataagtttgagaagtctcatctcttcagaaactgcatcccaatatagttatgtttgatgttcagaaatcagaatgctactctttaattaaattcgacaagaaactcattatgttcagaactagtcggcaagagaacacctgcagcaatcactgtcaattagactttcagaagacgagtaacggtcaagtattttgttctttctgcaatctgaacatctttggctgcaataaatcattgcagcatgtagtaaattaactgatggtagtacaaacaacacaaatctgaaatcactggtgacaaacgaactgtaggtgccattgatttcattttgcatcagcaagagcatgagagtttatgcccggtccttcgagaacatacacagcaaccaacaagtactactgtactagcaatatataatttggtcttgaatggcacatgattcttctagtgataagctcgaatatagtttttattgacagcaatgtggaaacactgtcgaaaaagttggccggtgttggatgcaaagatggattcttgtaaatgcaaaatctgacctcttttttcttgccattgaaatgtacatggagggatcaagttccatgaactagagccatcagaaaataaagtttggcactacttctcccacttggactttgcccttttggtcagaatccctactctcttttagcttcatgaggaattctcttgggagtcctaactttcaatttaggcacaataaacacagatatgcattgcaagtttgcaatcacttgtttaagctttaaggagaatatttggcaatgataagatatttattgttattttattgtattattattattattattattattattattattattattattattattattattattattattattattattattatcatgccctgttccttttttcttttcaatgtctcattcaagaatcatataccatttggaccatgctaatgatgtcggtatatatagcccagtgatcatcggtacccagaccatcgaaacaaaacattcttcagttgatcttgagattaagtcactcctccatcccatctcaagaactgatcaaggaaaggaaaaaaaatggcactgaggagaataatcaaggagctcaaggaccttcagagggatccgccgacttcctgcagcgccggtgatacgcaaatctttgcattacatcctgaaaatcttcagatagaaatgttcagaaacaaaatcaagaagatctattgcattaaattttctcattgttgttgatgaattggtgaaaattcaatcagggcctgtgtctgatgacatgttccactggcaagcaacaatcatggggcccaatgacagcccctactctggaggagtgttcctggtgaccatccacttccctcctgactaccctttcaagcctccaaaggtatgtgctaactaagcaaacatcacttgtctatcataattcaatcaagattcaagaagttgatgaaacccaatcatgaaatgaaaaatgaagcgtctgattgactcattgattgggatcttgggagcaggtggcattcaagaccaaggtgttccatccaaacataaacagcaatggcaacatctgccttgacatcctcaaggaccagtggagcccagctctcaccatctccaaggtaattaacaacacaagaacaacatcatcatcagcagcagcattgtgaattggtaatgaactgatgatgattaatagtggatggtaactcactcataattggtgcaggttcttctgtcgatctgctcgctgctgacggacccgaacccggacgatccgctggtgccggagatcgctcatatgtgcaagactgatcgcctcagatacgaatccaccgcaagaggctggacgcagaagtacgccatgggctaagcttagctgcaagctagctaattgcagctgaaatggcaattggatttggatttggatgcaggggacaatcagtcaatcaccagcatgtcgattagaattcagaaatatagatcgtgccataaaaaaagatagtaataattcttgcttgcaattattaggattgttgttgcaaatctgaatcatcgttatcatctaacctataatcaaaaaccatcgtcttcttggtgaggaggaataataaaagtctgcgattttgacggaattattgttcgtcagaagtgaaattggaattattgttctttaaaagtgaaaatttttcactgacacaaccgacgctttggccgagtggttaaggcgtgtgcctgctaagtacatggggtttccccgcgagagttcgaatctctcaggcgtcgattaacttttttattttttttccaaccaactcgtaatatttttttatatatattttcactttctttcagaatccctacggttacttcgagacgatttttttggggggggattttgcgttacccttgtgtgaatcgaacgctaccacagcccaattgcgaacagtccagctgctggattgaaaaataaataaatataatacaacagctctcgatattataatccatgtgtttgtaactttgtgcttaaattttgcagcgacatcgagagctaaatttaatcttagaaaaacaaaaggaaggcctcaatcgggtcttttgaaatcaggggacaattgccaattaaccagttgagatatatatatcttggttccaggcacttccagctgagttttatttaacctggtgatcttctgagatgataggttttgactgattgttggtgacaaccacccaccaaattgcatccagtttaacaattttcaaacatgtacgcatgtatgatattgattctgctaggctgttgcatagatggcctttaaaaatgtaactggcaaagatacagaattccagcagattccacatattataatttacaaacaggcctctacttcaaagttcaaacatgctctccacaatctccagaaaaatcattatgttactagagctagatgttgactccaggtaaccattggaagttgagtaggccacttgtatgcaacaattggacaagtcagaagaacatcacagatcttgctccatttgcagaacagaatatgaaggggaaacataattttccattgaagtgaaataagaaggaaaagaataaactgagtgcgattacatcatgtctacttatgaaacagggataacaagaattttttttctcaaacacaggaaataccatctaggaaagttacctaattgccacgacttgtcagtcacacgagataatcacaaggcagaaaggagaaaatgaaacaaacggatcgctcattgcctcgacaaagaggccttgctgcagctgccagtaaactaggatccccggaccatgaatgctgtttcgctgaagcaagacgcaacaataataaagcctggcaacttcatcgttcttcttcttcgtcgtctactgatgattagatcacaaaatggagcacgcccccctttgcgcctttttcttcttcttcgccttgggtggctgcagcaccacctttattgccgcatcgaaaacgcccttgacgttctgcagatcaggggggggcaggatatctctgttagtatcttatatgttattgcacatttagcaaagaaatgggaagaaagcagtactagttgggtctttgagctgcattcgatgtagtatggggcgcctatttgctttcttagttcctctccctacaaaagtggcaattaaggaacaaaaaaatgatcaagatatggcaatgtagtccacaggagttgcaagtacatctctgatgctacagtaaataaggaattaaacaacccacaatgccacaactgtacctgagcagtggtgataggaacagcaccaggatggtccacaaaaaactgcttgtcatctcgaagatctgccagtgcaataaacaatgtgaaaaatgtaagtgggctacagttggatctttacaggtcgaaggggatattatctgtagaatgattggaatttaatttcataagacaggtagaaacaccagccaaaaaaaaaaagacaacaaaactgaatccatcatgacaatagcaaactgagggacaacgtgcaatgccacaaatctgtgagacagagtataactgttgcatgttgttgaaccaaagttgaatagtacaaaagtagaaccaaaagagcaaacagttcaaataggtttatcacaagaatttcttgcaagtactaaaaactatggctgattgatatactggtactatatatccatatttttcctcttttatagagcaccctgcttcatgtattatcactaaatgacgtcaccagtaccaagcattgacatcaaaagaacacacaccaaataaaatcgtatcaacctaaaaatcccatgccactacttccatccaaaatcaaaaccgaacttgtgacaggtacaaaagattagatttctcaaaatagagccttgcacggttcttaccaagctttgttcccacaaggatgataggcacaccaggtgcataatgcttcagctcaggtatccactgaaatataacaaagtttagaatcaacaagaagtaccataagtggagactaaaaaagtgaatcgagccacaaaaatgatcaaatcaagtatcaacataagacaatgacctatgaacataaatttatgagattattatcatcatctatcatctctaatgggtggaataatccattgaaggatgcatctaggcctgctctaaattttgtggagcctaattcccagcatggtaatagttttatcatcgaagaaggcaaaaacacaagaaaaatgccagaagcaacatatcattgcacagacgatctcaaattaaacatgaccaacaaacttctttagcgaaagaagaaaaaaagagcacatcaatattattaacagaaaatgaaagtgagtcccttgccttctttgaaacattctcatagctggccttgctgattagcgagaaggccagaaggaaaacatcagctccacgataactcagtggtctcagtctgttgtaatcctcctgacctgtggtattccgaaggaaaaacttaataacttggtagaagaaaacaagcatgcagaattagatagcagcgcaaccagattacctgcagtgtcccatagcccgaggttgacggtgttaccatcaaccacgacgttggcactgaagttgtcaaacaccgtcggaacataatcctgtcaaaagcaatgacgcgaacaatgagtgcacatatcgtctcaaggcacaaccgattcataagatacaaaatgaggtgaatcctactgttacagaactgataagatatctatggtaaatgtgcagtccattctcaaactcttgcctaaagataagattacaaaactgatatatactccactagattactattttaccaggcctattatacatggcaagaagtccacaggtggtccaatggatacactacccccactacatggtcaccatgtctcagggctctaataagctaatctaccccccaaagcagctgaaatgttctcttcttttgaagatctctcctcaaaagagggaaattaatgtgcaattgggaaattaaccatgcgcgaaaagcaagggtggtggtgtgtaattgattgggtgtggatttgcgtgaaaggaacaaagaatgcgcttaccaaccatggggaaggtgtgagatgtgagtggaggagggtacaggacaactagaaagtcgggaaagcgatatcgagctctcgacctggcggatccgcggtttcccacctttgatagagaaacgccagccaaactgattcgacgttatatgaatcgtggggggaaaaaacctgcatttttttccgccgctaatgctgctacaatccataaatgctgcaagcaatcaaggacgaattttttgtttttctactgcattttttttgtttgagcgttcacgaggaacgaatgaggcagcatttggcttcgatttgagccacggtttttgatttggtacggggtgccgtgcaaaagatcccctttttactcaaactcgaatggcaaccctaggcaggaattcgaagccgcattgtcccaaattcacgagcggcggacgaatcagaaaagccccacaatttgggcccaaatccagatcaagaaccataatcctagctccaagcctccgagcacacaagtattttttttcaaaaataattaaaaaaagaagaagcaaaagaaagaagaagaagaagaaaaggaaatgtttggaggaagaagaagaagaagaagaagaagaatacgcacagtggggaaggtgttggaggtgtaggagatgagcatgcaggtcttgccgacggcgccgtccccgacggtgacgcactttatgaacctggacgcgctcatcctcgccgctccccgtcggtcgcagcagacgccgccgtcctcctcctcctgcgaccgctcccccctctctctctctctctctctctctctcaagaaactccaagaaagaagaaggttgaaggaggagcaaagcaaggggtcgacgcgagaggaaggggggaggttgggttaagattgggaggtggaggaggcgaggcggagagggtttctcgcagatcggcgggtgaagcggtctcctctccgcgccgaaatggtgggtggccaagcgcaagcgaagcaatagcaatgccccccaatgcaaatgcaatgccgagacccgagacaaggaaggagagagctcgctcgagacggaggaggagaagaggaggagtagagagagaggtggtgggtgaggtgggtggaggaggtggccacgttgtgcgcgcgcatcatttccttctttattaccgctcctccccgattatcacgcacgcatatgcccattaattatttctttttctcgccccccccccccccctatcattttgtagtatattagttgttctatagttagggcgaaaattcaatcttctttagtagtaattctaaactcatgtaatatgataatgaataaattatttgggttcaaaatatcgatcaattgttgtttacattgtagcaaccaaccaacgccgatcaaatgttagcgcggctgactgggtggctactataacacggtaagccataccgatcagggtcatcattaattcgagaaagaaattatatcctttcaattaattaaaaagtcatgcacgataatataagtatcttgaaataaatgattttggttcaaaatatcaaccattatggatgtaaattgttgccactacagctacaaaccaatatagattaatactgcaccagtggctaccgagcacatatgtagccaacaatattcattaggactgaatatagcttttatatttttctcgtttattcaaagctttgtttgggacattgtaaaattttacaggattttcatatgagtcaatttttttcattaatatcctttgtttcagtttcccatggagaccatattacttgctaatgtgacagtactactacggagtatataccaattgcaattggtagttgtgtagttaattccagctcacctgtgtacaaactgtcaaatggtaccagtgtactgtagcttttacagatgttatataccggtggttgatgacttgatgccattgtcctaacctggtgtactcgttacattgtcctaaccctgtctgtcaggccgagaaacatatatatgtgcacatatatgtagtactatcatactccctccgtaaaaaaaaaaaaaaaaaaaaagaccaaaccctggatttctgtatccaatgtttgaccgtccgttttatttgtttcaaatataaaaaatattaaaaagaaaagtcacgcataaagtattaattatgtttcatcgtctaacaacaatgaaaatactaattataaaaaaatttcatataaaacagacagtcacacattagacatgaaaacctagggtttgtcttttttttttttggacgaagggagtatgtcaaactcaagcttccaaaaccatgggaatgggtgatcataaataaataaatgtcaatttcatactattgtaatttttatcatgtgttacaatcatcatattataataaaaatagttgtattataaaaggacgatttgttatccctatcgggttgctatttggattttaaaactggtccatacaccgaccttttacgtcaagaaaagtttttaagaaggcattcacaaccgccctgaccttatttatgtcatttctttcttctttttgatgattggatttattatttttatcattttacgctttacctactttgttcttttatattttgtgcctaccatctgcccaaactgcaccatccattattgccttatttgtgtctttttcttctcggcgtttttgccaactcagtaatcaactgctcagcagtcattcattgtttttttggcacaaatttattcagtatatatacagaagaagatgctgtaagttcaactaacaaaagttgctgaaaaacctttagaggaaaagtgaaattgttagttggaagataatacttctacatcaagtgaagtgaagttgatgcatctcatatgttgggcaagaaatatgatttctatttcagctctctttggtcatattataagttctaagattgatacatcgaagaaaaatatcaaactgtcctgcattgaaatgcaagtattatatgatttgtgatagaattggacaaattgacatgacaaacttttcttataaaagaaatgttacacgaccaaattccatccagctatgagtagtcaccagttggcaagaaccaaaacaaaaccatgagtgcagtgtaccatacataaaatagtattgacagctaataaaatccaggatccaactggctggattagattggggcagttgtttgtttctttccctctactgtgcagtcacaatgaccagaaggcagaagcatccaccactcattgtacccaatcaaattatggaaacaaatatactgctaactgatcagatggatggatggttcatccaagcttactggcatcccaattttgcctcattaccaaatacaacgaaaaggttattgttgctggtatcaagccaggaaaaacataccatggtcaaaatttatttttatgactattgttgtggttacctggtccagcaaaaggcacacgaaaaggttgagcaaaacccttatctggtaggctacagcaaaggttaagtacacatccattttttttaatggatattcatccgttttttaccatagggttgcacagttatttgaatttgtgtatccttttagctgactcaagtgtgttcgacaaaagcatcgcaattgtcattggcccgacaccaccaggaactggcgtgattagtcctgcaatcttggaggcctcctcgtagcacacatctccaaccagccgataacctcgagggctttctggatcctgagacatttcaaatcactagtaagcatagcatgcaaggaaatcaggaagggggtgtagggaaagaagcagccaagtcaccaatttctttggaaccttctgaggtattaactgagttaggatacaaaaacatacaacaaaacttaaagatatgcacaagccaacatttaagtgaaggcttgtactaaattgattaatcatcacatattgcccaaacacatatacaatgtgaagaaatttaccagcaaagatatgggatcatcaaaatttaataaggcaatttaagtttttataaatgggtgtccaacagtgggatcacaggagggtctactggtgtagttccttacctgccttcgatcccagctgcgaggatctagacaataatgttccctttgttcttgaaaaaaaaaactatattccttctaagaatgtgacattttgcatatatgaaccaaacatgattagaaacatgaagtgcaaaagcattatatattattttattaacaacacaaatacaccattagccatctggatcccaccaatgtggtgatattccagggaaccagtaacattggaaatcttattagcaggttcaaactacctccgtcccaaaatataagggactttggctatgacatgcccagttttcatgcataaaacttatccatctagaaatgggttggcattaaaagcaaacagatctgttgaatgttagggaggaagaattaaggaagccaatcagaaaagtaggtgtcttacatcaactggattgatgccaacatcaataatagcagcaccaggctttatccaactccctctgaccagattagcaactccaacagctgcgataacaatatctgcttgtcttgttatttcctcaggcttcttggtatttgaatgtacaatgctaacagttgcgttggctttctagtaatcacatatggcataaaaacatgttaattaaacactccaataaaatttctccaactaattgaagtgagaattaattcatacttgcagtaataatgcagcaggcatccccacaatattgctccgcccaattacaacagctctcttccctttgatttcaactccatatctgtgtagtaattccatgcatcctttaggggtgcatggaacaaagaacggatcccgaccttgcattgcaagtcgtccaatgttcagtggatgaaatccatcaacatccttctcaatactaacagcattcaaaatgttctcatcattcatatgctgcaaaccatcagagagcagaaatacagatgctcagtggatggaagacatggaaaacttgtgtgatgctagcaggcaaatacctcttttaatgctaacaggtaaaatcattcaaagtatcttgatcaaaaaattattcaaaaatatccccatcattaatatgctacaaacaatgcaacaagattaacagagaactgcaagcaccagtatagaccatctaattaaaaacaaatgctgacaacaaactcgaaagaccacaaagggaatgcgacggactacctaaaacaaaggatctgtttgcacacatttttctaagaccagatatctttcacaagagcagcatcaaaccagttaacataaatagaaacatttagtgtacaaattggagatggcaccaatatcacaatatttccagaaaatattgtgcataaagtaatgtttccatggtgtgccatactgccatacatatctaggaatgtacctcactaaaaatacatttaactaccagttcagttggtaagggccaaaattcaatatcagtggataggttatacagagacattggcccaaagaaaattgttgaaaacttacatgaggtaggggcaactgaaccaagatgccatgcaccgacggatcactgttaaatgttgcgatgtgcttgagaacctcatcctcagagctgtcttccggcaaattaacctcatatgacttgataccaaccgcttcgcatgccttcttcttgttgcgcacatacgtttgagaatccttccttgacccaactaggatgactgccagcccaggcacaaccccaattgcatccttcatcttggcgatctcaacagcgatttcctctcttatctgctttgccaccaacttcccatcaatgatcttggcacaagcatctgatgaacacagttgtaacacatgcaaaacgattaaaaaaaagaattgtcatatcagtgcatcagaaaatacaaggatctcttcatatactccatttgcaactacacttgctcaacaacgaaatcaaaaacatagtactatctaataatacaggtgcaactaatagcaaatgggtttcacctgaagagctcttccagccacacacaactcgacacggatgaatagaacattcacagtcaggcaagcgaggagaagtgggcgcgcgcacctgagtcggtagaggaggcggcggcggcggcggcggctgaggccgaagccgtgccgcgcgcgcgggggagaagcgggagctggggggcggcgatggcgaggggcctccgcggcggcgcggcgacggtggccgggcggaagcggcacggcggcgcgaggagggcgcggcggagggggaggaggcgggaggtggcggaggaggagcagtcggagagtatggaggacgccatggctagggtttagtgccctggagcggcggcggcgggaggtttttcgcgggcgcacgggaagggaaaagaaggggggaaaaagaagagcggaaaaaaaatggcgtgtaaatgcagcagccgctaaaccccacgtaacaacaagggtttagggctaatccattaataataaaagattttttagggtctaatcaataattaaaaagggattatttattgatttactactccctcaaaataagtgcaacttttggggtaatatttattgtaactactatgtaactgcactgtaactacattatcatctccgtataatttagatataatgttacatatattattttattacttatataggagttacattatagttatagtaaaattatattgcaattatactataagttagatttgaaagttttctttttaaaaaactttcgacaattctctagatagtccctttagctaaattttaggcccatttggaatagtggaaggctggaagatatgtgcaacttttaggctgtgttcgcttccctcgttttctgcgcgcatgcttttcaaactgcttctctagttttctagctaaaacttaattaatcatgcgctaaacgctgcttcgttttgtgtaccagagagtgactcccgagcacagccaaagagggtgcgtgctccagttgtttcctcggtttcaaaatcaaaatgttgttttgaacaaattttggaggacaagtggatatctaacactccttgtaacgatgccattaaacgagtacatgatcttgcaaagatagtcacaaagatgtagagaattcaggctatgttctactgttctcagaaatatttggattcagcaactgaaaaagacaagcagcatcacctcgtaacctttgccatccaatccaattcaaatcgacaattacagaacagctaagcaaaattccgctttattaactacagaaaaccgaaactatagtttcctcacaactgtagaaatgggtagtaaaatggaacatatcctatgctttatagtggagtattacagaaaacaaaaactctccctgattgatctgaatcttgcagcctatcgagaagcaggaacggcagtttcagctggggactcttgctcctgtaccagtgactcccactccacctccttcaggattctgaacctctcgtcgagatttacgaaaccggattgctgagtgaccgctccacaggtgccggctttgtgtatgaggactacggtgccgcccatgtcaggcccatgaagcttgccagtcagcagtacacggagcggcataaagagtgactttccctggtcacaaatggatacagccagaagaggtaagttataattgttccattcaggatatatggcacaaaaggcatttgcaacaatgggcttgaatgtgattttaaggtgaatatgatggttagtatatacaagtcaaaacaaaggaagcttactagggttgggttgtcaaagtctagatcaaatgattcggttgtattttcatcatttctagatatcaaggtttaggtgagacagattgcttccataaaaagttgtgtttgagcggcacctaagaacaaaagaacaaaatgattgctgtcattactcattagcactgacctttcttttaagtgatttgccaaaaattttcacccacttctgccaaccatcacggccctcagctagtgcttgacaaagttcaccgctatcataagcagaaatgagtcctgatgcaacctcagaaagcttgtcttgcaccacagatttagcttcatcactggtaatttacatgtgaacagaaaaacgaactgtttactccaacagtactaccacaacaaccaattcactgaagaaactttccttttttggcgacaatttatgaagggactttcagtgaaagattaatgaagggttcccgagggattaaatttaaaacatcacatttctgcagacctgcttaatgtagcatggaggggatacgacaacaggtttgaaagggctgcgtcagcatcagtgatcaaatcgatgccatccttcaaaagctcagccgcttcctgtgcaaaaaataaagtaattatgttattagtgctccccaatcagttaccgtccatttagcatatatacctaattctttttagtgtgtagttccaaagtacaaacacccatggtgtgtagaaataacaaaaggcctccaatcttactttagcaaaaccactttcagactcctggagaatgcctgtgtccttccatctatcctcaaaactcttgatgagtacatcagggggaaatgatcttagatgttgtccattcatccatctacaaatataaaaagtaatgcattatgtaaataggattgtttgtttattttccatgatcaccagttcaagtgagtagttgtgtgcacatgcacttcttaaaggcaacggtggattagataggccaacaaaatatcagtaggtttgagcttgatggtggtttctgagggtaggtcccagtaaacaagctttatcatgatggaatgcgcctttcaaacactactgaccagcaggcagcaaagtacataaatacgtatttattactgattagacacactgcatttattgcttatcagacttatgtttctctttgatccataatgtggagtgattttgcgaactccatacagtatatcaaatccattgatacactgtacatttaactttgttggtcatatggagttatggactggacatgcttcccagcttgtgtctgagttcataaataaaagaacctatgaattactagctacttcctccatcccaaaaaaaacaaatccattgatacactgtacatttaactttgttggtcatatagagttatggacacattctagtacaacgaatctggacagatatatgtccggatttgtagtactagcatgtgtcatatccagtactagattggtttttaagattcaccttctaaaatataccaacaattagtataatatgaattaaaattttattagtgaatattatcattggattgacatttgaatttaatttcatatggttataattttgttgctacaaaccttatagtatatcagaaattataagcaaaagattatttttggagatcgtgacgtgtttgacgtgcgatagagggagtagtgacaatgacttttcactggttcccttataattgaaataatgcctgatatcagactaaagaaacataacaataagtggaagcaagctccagttcaactaattatagtactgcaactgagatatcacgagtaattagagaatactgacaaattctatgaagataactcaaccagaaggagattggcaaaaaaaaatgatcttactttaattttacagcatcaaagactgctccacttttgttgacacgatttatagtgaatttttccactggaaatgagatataacagcaaagaatgggtaaatggatggtgactgtaattttcaaaaactgtgcagggaaagtaactgaacgaattattcataaactaacctaggtcatcaatggtgaagaactcattttcagtaccatcaccccaaccaagaagtgccaaataatttaccattgcctgaggcaaatagcccatctctttgtactggccaaagaaaagaggacacattgttacatttttctaacattgaaagtgtttcagaaaagatgtgaaatggcgagtaattagctgcaatactatattttgccaaaatctagttggttacctgtcccacagaagtagccccatgacgtttagacagtttacttctatcaggagctagaataagtgatacatgagcaaacgaaggcattggaaatccaagtgcctgcagaagacagtcataggacagtaggcatattatgttgagacatacagttcgaagggtcaaggttgtaaacaatgatacacaagataagaatggcatagaaaattactttataaataagagcctgccgtaatgtgtttggcagatgttcttcagctctgggggagaaacaagaggattgcaaacttcaggaagaaatcatcaaaaggaaagataacaaaataattagtttacattacctgataacatgagagatgcgcatggtagcatcatcaactgtgacacagaagttatacactggctggccattgcttctcataatcacgaaatcaccaagcgtgtctaagttccaactgacctttataaaactatccgatgcttagtgtgtgtgtatcacttctcataatttgcaagcatgaattattgacagtggaaggctaaaaaaaatgcaacgatgtggcagtgctagagtttctagttattacctcaccacgaataaggtcattaattttcaacgacccttccttcggtacacggaaacggtaagtgtaaggtgtccccttctctaactcctgttgtatttctgcatctgaagcagtcccccacttgcccatgtatacaggtggaagttgcatctgctttgcagtttctttcatctgttcaagttcctgaagtaacagaaacagctatcaaatgggcaaatagttgatccagtagaattccagaagtaacctagacaaattgctgacggggtttaaactaactcatcccttagtattcatagttgaataaatcactacgagtgtttcatatgaacacacagaaagatcaagcttttttttttgaaaagcaccaaaataatactccaacattacaacaacctgtgtataagcgcaacacaatgcatcacacatacatgcagatcatgcaaggggagaaatatacctcactggagcaaaagcactgatagactgcaccagactccatcagcttctcggcatactgtttgtacatcgaattgcgctcggactggcgatacggcccaaattccccaccaacatcgggacctaagcaagtacaaatatgagcattcatatcatctaccatcatagaggaaaaagaataactatttcactggtttatccatgcttaataaaaccaaatacacatctccacagttgcacaatatcaataaagataagcaatcagattgtatcaatcagataatcataagaattgagcttgccagaactctcgagtagagtagaattcagcatccaaggcctaactacggtggacagcaatagagcactacatcaaaatgatactccctccgtttcaaaatgtttgacaccgttgactttttagcacatgtttgaccgttcgtcttattaaaaaaattatgaaatatgtaaaactatatgtgtacatgaaagtatatttaagagaaaagtgcataggcggtccttaaacttataaggttgtgtcatctaggtccccaaactctcaaaatgcacatctaggttccagaacttgtcaaagtgtatcatttaggtcccaaatcgacatagcccctatagaatcctatgtggcgctgatatggcatgccatatggacgtgatatgtccttttcttcctttttcccttcttttttcttcgttttcttctcattcttctttttttttcctttcttctactcgggaaaagaaaaaaaaggagaagaaagaaaaaaaagaggaggaggaaaagataagaaaagaagaaaaagataaatgggtttcatttgttagtcaaaatgatgccacgtcttgtccgtgtggcatgccacatcagtgccacgtaggatcctataggggctggggcgatttgggacctaaataacacactatgacaagttctcggacttggatatgtattttgagagtttagagacctagatgacatacccctgcaagtttaaggaccgcccgtgcactttactctatatttaacaatgaatcaaatgatatgaaaagaataaataattacttaaattttttgaataagacgaatgatgaaacacgtaaaaaaaagtcaacggtgtcaaacattttgaaacggagggagtacaacttaacttcctaggcagtaaaacattagagcgatatagagaaatcaggtgggtcaactcaccttcgtcccagtcaaggccgagccaggcgaggtcactgagcacggcctcctcggacttcttggtggacctctcgaggtcggtgtcctcgatgcggagcacgaacttgccccccttggaccgcgcgaagaggtagttgaagagcgcggtgcgggcgccgccgacgtggaggttgcccgtcggcgacggcgcgaagcggacccgcaccgggccgccggcgccgtccggtgacgccgaggcggaggcggaggcgcggacggagagggtccggcggaggtggggccgcaggaggcgcggcggcacctccgggagcagcctgatgcgcagccatggcgaccccattgccgccgccatcatctccggagattgggagtttgttgcgagaagaaaaggaagaagaagaagaagaagatgacgatgcggatagagtttggggatatttgggggcccaacaaagcccacgcgcttacaaactgcagtagcccaacaaccacgaaggaagagagactgacaggtgggacccacaaagcagtgtcttgtgaggcattttatccctcagagcgttttaatccagcaaaatgcggagttggaaagttgcttgcaaagtagagataagagaaattaatctctttgatcttgtgaaaagaaaagaaaagaatatactcaggtggcgtttggatacatcggatgtttggatattaatttaaagtattaaacataaactacttataacactaattatataaatggtgctaattcgcaggacaaattttttaattctaataatccataattagcacatgtttattatagcatcacatagactaatcatagattaattaggctcaatagattcgtctcgcggattagttcagggttatggaataggttttgtcaatagtctacatttaatacttctaattagtgtctaaatattttagtcccatctaaacagccccccaatccattaaaaaaagaataaaccttttatcgttcgtcttattaaaaaatattttatgattagcaggtttgttgttattagatgataaaacatgaatactattttatatatgactgtttaaaaaatcataaacatatgtcaaacgttaaacatagaaactgacgtatgcactttctttaaataggacggaggtagaaggaaaaaataggttaagagcatcaccaacagtctacctatatgatttccaaaactaattttaagagattttagtccaaaaatcagcttcaacagatcccctactctcctaccaagttttggagtttccttctcccggttcctcgctccgtttatatgcgggtgcgaaagtcgctcccaatcacacaatcctgcctctctccttcgttcccgtaaaaaaacagaattttctcttggtagtttaacagaagggtccacttttaagttttggggattaaatttaggctatccattggagggaggagttttttcactttctatttttaatttagaaaaaaaataaatttttagaagaaaattatagataatctgttggtgatgctataagaggatgaaatggtgaggacatggctccaccagcccaccggccaaaacaacgagggcaaggaaatgcataattgcacatgatggatggatggatggatggatgagacgatgcatgggcggccgacgacgaccctgcccagtcttttgttgtgttgtgtgcgttgtttgatccttcgtctgcaccctgccctgcccttgctctgctccgtctcgtctcgtctcgtctttggtattggcctttgtagcatcactgtagtaaattatggattaatatatctcgttagattaatctcgcaaaatagactaaaagttataaaataagttttgtcagtaatctatgtttaatactcttgaataataaaattttggagcactttaatcctagcgtgaagcatccaaacagggccattgttgctgctgccttttcttcccccagccaggtcaggcctgcaccccccccccccccctctttcgtacctaacgacaaacaactcctctatgctcctcccgcctccacgtgtaaaacccgctcaatctacactagtatattcataatactatcacattcgttaaaatcttttatatcatggggaagatgaagcactgaagtgagtagattttgacaaaagatagataaagatgaagatgaaatcagaacacgcaaggtagatgaaaaagtcatcggtatatttttttaaaggaaaagtcatcggtatatgattaattaagtttaattattatacaaactttatatatatatataatagacacatcgtttaacagattaaaaaacacgtgctaacagaaattgagataaaatttgaatcttaaccagaagagaatgaagaacggaccacaggcacaatagtatttagattctaagttatctaattttgagtcgatgatacgtgaatcatttttttttgagaaccttattgattctaaaatccacattgaaaacaagtcaagtctatagctagtgggtttaatttctacatagatgctacaactatgacaaagtttagcttaattagcactcaactagcacaggaatacatatacatatataggagtatccacggtcgtactagcccacagcaaatagtaaattctccccacagcaataggcaggggaatcatacataggagtataaaggtaaaccaccagttgagctgcgatcaggattacagtatatgagcgagaatataatctgttggctccttcggcgagaatcattcaattcacaaggataatgatgatgacattcagcatccatatcgatctcgctgttcaaaaaaagctccacaacgatacgattcgccacaaaaattatgcttacgcgcaacacaaaaagacaagctaccccctctataggtgcgccatccctccatcccgaatcattgccttctttcgtccacaacgcggaaaatattacagaatttacaacgcggagaatttaatcttgccgaatctaatctaactgtaaaattactaacagctctattttttcgcttatacttatcagctaaaatttaattttcgaaccttaaatttggagttgattttatggtttttcatcgaagtttatttttcagccttttcttttagatcgttaagaacacgtatataaaagttttatttgtaaattatttttcgtttgcaaatttgttcagcctaagttttagagctcatttggggcgtaggattcttttacgacgcggagaattttctacatcctccggaatctgaaactagtccctgtaaagtttctgtgttttatgacttgtttgacatacagtactctcaaaatgaagcaaaaaagggataagaatatatcatcagagtatgcaataatataggatttaaaaacaaatgaatgctgaggtaaatatgtttggatggttacgcaaaatagtactccctccgtcccattataagtgcagtgataagtttctgtgtccaacgtttgaccgtccgttttatttgaaaaatttatgaaagatttttaaagttaagtcgcgcataaaatactattcatattttatcatctaaaaataataaaaatactaatcataaaaatatttcaaataatacggatggtcaatgttggacactgaaactcacaactacgcttattatggtacggagggagtacatatgattcttgtaggaaaatatttgcaactttctagtaacatatatgcagaagacaatagagacggaaaggtaggccacattttatctgttttcctttttattttccagatttttgtcctaggttatttggtaaacgcttctagaaaaacttatcaaaaataatttctcatattgcattgttaatttctcctaggacaaagtttctttcataaaaacattgatttaacacgctaatcaagcaatctgcctcaacaatccacataaaaatctgttcaaaaaggaccttggtgtgcattggacttgtcaaaggacaataatagaatactaagaggtaatgagctcatgttaaaattccaacgaaatgaaggtatgtcagaataattttgccattatatttcttgttccaaacaatcctggcccaatttgatggatcttatatgaacatttaaaacacgagaatttaaaaaatgaaaaacacataagtagaatggcatgtcagtgcaatcctatggaatatcaaaatataagaattactccctttgtattgttttgataccacataagaaaatactcctattacagaaatttggagagagaggatgacttttggtgaagtttctcaatgctctaccttttgataaacatttattgtgagcagcaaaccgttttagatgtggttaccgtcatcctatagtcaaaatcacttatattttgagacagagggagtattacagaaatttggcgaaagaggatggctttttggtaaagtttctcaatgctctaccttttaataaaaagttattgtgagtagggtttaccaaactgttttagatagggttaccgtcatcctatgatttggcagtcaccataaaaatcacgcagttattgtgatatatactccactagagagagttaccgcaagtaataatcacgaaatcttacggtttggtaaaccttgattgtaagtcaacgtagtcaagcgaaaccctgggtgcaagataagagatggacgtggcaatggcaggactgctcctgtgaggatggatgtggcaccagggacagtgagtgcagatgctgatgatcagaagagagagtgtccatgtggagggctggccggccttggagcaaaggaaaggatgagacgacggcaacaaaagcaggagagagggagtgtctctgacagagtgacagataggaaagggtcccatggctgctgctgccttcaggtatccgcacatgtctctctgacacgcaccaccaccccccacacagccaccccaaagattattttagaaaaaataaaaaattaaaaaaaaacttctctttctcctccagtactactcgtgctactactggtagaggagtaaaataaacgtacactcgtctactgctgcatctgctgcctgtcttcgcttttggatcccatcaactgaactgttgggcatatgaacacatgccttcttgcctgcctactgtccactccaccccctactgctgtcaaaacaaaaacaataatctggagtaattgctgattagcacatcaaactatgcagctttcaagtttcaactcccatgctttcttcttttgatcagaaaactgagtggatgttttggatggagtctaactttgtcataactcgatttgccataactgtggcaagccacacaaagtgtgaccaataatttgttggccacaactatgacaaactttagctagcaaatgagagtatgacgcgtgggccaatgtgctaataaaatatggattgactcaactgcggcacgcaaccaaacactagcctgaaaaattgtgacacgcctaaggtttggtgtggtaaaccgagaccaccaaccaaacagcccctgaggctttacccacaaggttattattgttgttaattcaggatttaaatattaacggataccttttgtctggctaccaggccaagtggactacctgcggaactactgaatcaaaaaaattaaaatcactccgagcttctgccacggcttaaataatgaataattttggatcataaatgtcaccttctgccacggcttaaataatgaaacattttggatcctaaatgtcaccatgttagaccatgtgtggcaaatcaacaattccagcagtaaacaattttggcccaaaccatcaaaatgacactagtagtacaatcaatctttttggttaactaaaacaggcatggataggagtaccagacaagtcctgcaataaatccagccgctgcccacccacaacattagaacaaccgcaatagtaaagtaagttgctctctataacacatctacatctcagcaatagactagattaataataaacctccttaatagtatgtctacatgggtatctatagctctctaatccattgcctcgtttttctcgttagtagatagctttgctatctctctttatttaatctcttttaagtagaaaaaaatgctgacatagatatcttgtagatagtatatagataatcattgcgggtgcccttagtactactactgtactagtagatggcaaaatggcactactgtaattttgctaccggttagtacatcttaacattggattgtattcatgatgatgcattaagggagatgatgcacgcagcagagtccgatttggtcaacaagaataattcttctttgcttaaatccatcaaccatggatcttcttttgtactagtagtaccattgatgaactacagtgattgttgcttaaggatggagctaaactggatacaccatgatccgagatcaccaccagatcaaggacaacaaagctactcctactagccaacaaaagaaatccaaaacaacaccagacacaacatgacacccaaggctcagggaactgacaatagtgtcaccccccagattcccagatgcagcaaagctactactcctgtactgtagtactactctcctccctaactactcagaaaacaaaaaaaaaagataatccattgtatgccaaagataatccattgtatgccactgagtttgtcataggtctacaatttaccactgactttgtcacgttctataatatgccatcgatttttgcttaacttctacgatttaccaccgccatccggttagtctccgttagtactgtacactttcatccaaatgaccaaaatacccctgagacaaaaactttcaaattttggataaaaattctgaaatgtcagactttaagtttttgga

SEQ ID NO: 58860 - DNA, 11609 bp, Oryza sativa
catataatttgcatatgtgttgtgctatgttgaaatgtgatattgtaatgtgcattggctccatatttgctatttgtgatttttatgcatatgttagggggagcctttgcttttcaatgcaataaatgtccatgtgctctatgtttgattatatatctatttgtggagtttgtcatcaattaccaaaaagggggagattgaagcatctaggcccccggtgttaattttggtaattaatgacaagcgctaattgtggactaaccgttgtctttgaaataatattttaagttaggtccacgtcatgtgtgcacatggatgacgatcgatggattaaaattgacggcgcaaggcaaagagaaagaagacggtaaaactagtgctttaatttagaattgatcggggtgtagggcgatcaaatttgctagtttatttctagtttcgccgtactattaagaggggtaatgacctagcaaagagatgattttaattgccacattaggtcattgcattatcacttgtgctcactttttcatcacacacacacacacattcactgggttcggcctgaccagggcaggtctgaccggccacaagttggcggtctgaccggcccataatgtcggtctgaccggcggcacatgcccggtcagaccggccccctggaggccgaaatggtgctcctcgggactgccgatacagagccgacggagccgtagtcggtcagaccgagccgatggcggtctgaccgagccgactccggtctgaccgcccaatcaactccggtctgaccggccgggccgatggggccctctgacagcgctacaactgctagttttctagccgttgcagagtagcacagtatgaccggccacatacctccggtcagaccggcagagcacaaagttgggggatttcgcccccaacggctagttttggtgggtgggagtataaatactctcccaccagcagcaaggggactctcttggcacccaattcaattgcatacaccccttgcacctctctcacactcacttgagctttgtgttcatccatctagtgttatagggttgattagccaagagtcaagtgcatttgcttccattgtagagctagtgtggcacttgatcatctccacgccgggtcattgcttgttactcttggaggatgccgcctcctagacggcttgtggagaagttgcccggtgacctctccgagaagattgttgtcacaccctgaaaattcaaaatatataaattgttgtttaaatgaaatttttagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaaaaaataatttaaattgaaaaaggttttgaaaagtcttcttttggctttgggccgaaagtcagcccaaaacccttctctctctcctcggcccaagtcggcccagtccgcagccgcagccgcccgcgcgcgcgtcctcgctcgctgacaggtggggcccgcctgtcggagtcgtcgtcttcctccggccgaaaccctagcgccgcgccgccgccgccgctttccaaatcggccgatcctttccttctccggccgaatcaaaagaggggaaatgatcttcgggatttcctctaccttttctcctttggaaacaccggctaaaatcgtttggaaattcgtggattcgagtttgtttcggattcgattttcccgaactttccttctcgtcgccggccgtcgtgggccttcgccgctgcctccgagcccctttaaaaggacccccgagctcttctctacccgccgccaccctcgccttcgcctctcgtcgccggtagcgccctagcgtcgtgagacctcgagccgccatcgccgccgtcgctccagccgtgcgccgccgccgttccggtcgtcgtcatcgctcgggaaggccaccgtcgggatcgccaagtcgtcgccgtcctcgtccgccccttcgccaccgtcggagaccgccggagcatcgtcgccgtcgtcgacccgatctccgccgtcgcttcttcctcgtcgccgtcgccgtccgttggtcttccgccgtcgcttgggtcgccggtgagttcgccgtgccgtccgctacccgttggtgtccaccgttcttgccgaagtgccgccgttcactggcaagcgtgcgccgtccgagccgtccgagccgccgagccgccgccgccggtggtgacgtcatcgccgacgtcatcgtcgccctcttccgtgagccggtcgtggaccgatcgatctcggtcgtccgttttggtcatcgtcgccctcttccgtgagccggtcgtggaccgatcgatctcggtcgtccgttttggatcaagtcgatctcggccgtccgttcgcgtgaactgccgccgtgcgcccggtccaccgaaaccctagcccgctgacgcaataaatcccttttccttttcaaaaataattcattattgcgtcataattcaattaaaatcaatataagtgttttaatccgatttaatcttcaaaaattcataactaattcatcttagctccgatttagttggttcaagtctctaaatttttctaaaattgagatctacacaataaaaatatccacatgtactgttcatgcttgtttatgtgctgttttggtgattttgctcttttctgcttagattccgtcgtttccggagagtccgttttcgcaggagaagagtttgaagagttccaaggccagcaaggcaagtcacacagatcccaaacaaccctttgagcatgttgatcccgtttaaagctattgtttctattcaactattgcatttattttcgaatgtcattgggtggaattaacctattgtttgctatagcccttttgttcttgattactttattccttgataccttgggttattataatttgactagttgagctttatttatattggttcaactagatattagatataattgcttagccatgcttagaaacattagcacacttttgggataacttatgattcactattatttaatgatagctcacgatggtcaatcgtgattggttaattaattaatgtgccaactaaaacttggtaatggtgggttgtgagcacatggttttgatggtcgtgctcatgacaattaaggaccggttcacgagtttcggttgtgaaacattaaccgtgccaaccacaagccagcgtgggcaacggctttatcttttgtataacatggttcattgcagggcaccagactgagaagtggcggagataagcccacgggggtcgctggggagtccatgccttgtttataagggggtgattatgatccaggaaggtgcgctgcagtggattgtgttatgcaaggggtattgtcacaactcctttccgaggtaccgtggtggtattgaggcacatggtgacatgatgtggggttgtgtcttatgggtacagtggtacacctctgatcagagtaaaactattcgaatagccgtgcccgcggttataggcgggtctaacaatgtctttcgtgattagtctcacccttctcaccatagtaaatgatgctataactggtaataatttgattagctcctggtttggaatggtatattcctggtttggagatagaactgtgcagccgggatggttattcagaatgggtgggcctatacaacagggtatgttgtatagcgttggattaatattgtttaattattacttaactgttttattaaattctcaaatgtttgctaaatgctgcttttgcaaaagaaaccctattatgccatcctttgttatcctgtgcacttgcatatttgctgcgtggcttgctgagtatgtcatatactcaccttgcaatcattcatcagaggaagagttctacaatgatgctgatggtgtggaggattaggtgtagccttggtcaagctgcttgtggagtggagccgtccgcgccgtttatcttattttccgctgcttagatctttattgattgagaggaactatctacctctgtaatgacattttattcgcttattagttagagtaatatttgtactctattatcaatttgttattgtgtgcctcggctgattcctagacgagggttcccacacatgtaagcgtttggaattttggatagaaattccgggcgtgacaagttggtatcagagcctccttgaccttaggttatgccaaatggttacccatagaagccctctaaaaatattggaaaagtagaactgttctcctccctttctcttttaaaccaaactaatggcacatgcacttcataatctcttttaatggttctcattcaaaatttatttcagtgttattagtactgtacatctattactgtactaatgactcatttaccagcaaaagttttacaatattgttttatttaatcctgctgcaataaaataaatttagcatgtcgattttataactttcttttatttctgttaaaacctgatgatcaaaagtacaaaaatttgtaacctcgttttcaactatttcaacttatcttgcaagcttggtttactttatttacttacctttttactttgattttccaactttattcacattaatccaaaaacttgtgctattaattggataaatgtcttaactccctcctttcacttgtctttagatgccgcgctacaagcctgagtacttgtttggtgtggagggttttgtccaggagttgcgtacaatgtcctttgtcattggatttgggactgcccctttttatgcccagattcctcatgatcgtcatgaagagaagtgccgagtcaaagtcaccttgaacagtaatagtgaagatattccctcagtgatgttcgaagctggaggaagaaactacatccatgcgtgtcaggaggtggcaaggatcgccataggagagcttcgcgatcgctacagtgatcagttggccgatacggagtatcgctaccatcctcgtcaaccacagggaagtgaccgtggcaattaccttgagactgaaggaattgagaatgatgctaccacaaggcatttggttgagatgctgtgggctatggatgaaagtcgtgcggagactgtattagcggctcaagatcgtgaagaccggaatcgtggtaagatttgcaagctagaagacaaggtggatcgtttggagaaggaattagccgcattgaagggagaagcaccgccgcagaaggccaggattcgtctcactgcaatgaagagagctctatttgtccctcgctatcaattggcgccaaaggttcgtgtggtggagaatgaagttgccccaaccctagcagatcctccggtcatcatcataagtgatgatgaagaagaagaatccaagcacacccattccaagattgagtgggtagtaactcaagatgatgaagacgagccgaatgagccttcaatcgacctccgatgctcggaagaactagagtgacttgttaagtcgttgtcttagatcgttgtgttagtttgcttgctttaagtttgcttgtgtgtgtctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattccctgtcctaagtagttttgcccggtttctcttcttgtgccctgtccatgccagatggtgaacactcgcagcaatgggaatggccccaacaacaacaacaataacaacaacaacagtggagagaatcccacacttgcccaagtcctggctcaacagacacagcttatgaacatgatgatgcagcaactccagaaccagcaaaaccaaggaaataaccatgcacctccccagaacaagttagcagaatttctgcgtgtgaggccgcccactttttctagcaccactaatcctgttgaagctggtaactggctgcacgccatagaaaagaagttggatttgcttcagtgcactgattaggagaaggtctcatttgcatcacatcagttgcatggccctgcctctgaatggtgggatcactttcgcctgaacaggattactgctgaacctatcacttggcttgaattcaccgctgctttccggaagacgcatataccatcgggagtggtgtctctcaagaagaaggagttcaggtcgctcactcagggatctcgctctgttacggagtatttgcacgagttcaatcgtttggctcgttatgctcctgaagatgtgcgcaatgatgaagagcgtcaggagaagttcttggaaggacttaatgatgagctttcttacccactcatgactggagattatcctgatttccagaagttagtggataaggctattcgtcaggaggacaaatacaaccgcatggagcagaagaagcgccggattgctcaattcaagacacaacaggggaataatcagaggccgcgtcttactttaggaccccagtccgtgccacagggaggttcttcgtctattgttcgtccgcagcgtcagttcttcaacaacaatgctggcaacaacatccgtaatcaagttccacgtcctgttgcagctccaacacagcaacaacctgccaagagggagcaaggcagcaaacccgtggtgtgtttcaactgtggagacccaggacattacgctgacaagtgtccgaagccccgacgcgtgaaggttgtccctactcagagcaactctaccgcaccagcatcaaaggcccgtgtcaatcatgtcgctgctgcagaagctcaagatgctccagatgtgattttgggtacgttccttgttaacttagttcctgccacagtgcttttcgattctggtgctacacattcattcttatctatgagttttgcgggaaatcatgggatggaagtagaagatcttagacatcctttgatggttagtaccccaagtaatcaagcactctctttgcaacgtagcccctctgtcagaatagaaattaaaggagtaccatttctggccaatcttatcttgttagaatccaaagaccttgatgtcatcctagggatggactggttagccagacataaaggtgtgatagactgtgctaacagaaaagtaactctcaccagcaatgatggtcgagttgtaactgttcatgcattgtcttctgagtctttaaggtcaagactgaaccaaataactttggaagagattcctatagtccaggagtatcccgatgtgttcccagatgatttacctggtatgccgcctaaaagggatatagagttcagaatagatttggtaccaggaacaactccgatccataagagaccttatagaatggcagccaatgagttggcagaagttaagaggcaagtagacgatttgcttcagaaaggatacatcagaccgagttcatcaccatggggagctccggttatttttgtggaaaagaaagaccatacccagaggatgtgtgtggactatcgtgcactaaatgatgtgactatcaagaataagtatccactacccagaattgatgatttgtttgatcagcttaaaggtgctactgttttctccaagatagatcttcgatcagggtatcaccagttgagaatcaaagaggaagatatacctaagacagcttttaccactaggtatgggttgttcgaatgtactgttatgtcttttggacttaccaatgcccctgctttcttcatgaacttgatgaataaggtgtgtatggaatacctagacaagttcgtggtggtctttattgatgatattcttatctactctcgaaccaaagaagagcataaagaacatcttcgccttgcactagagaagctacgagaacatcaactgtatgctaagtttagcaagtgtgaattttggttgtctgaagtgaagttccttggtcacgtcatctcagcaggaggagttgccgtcgatcctagtaatgtggaatccgtaaccaactggaaacaaccaaagacagtttcagaaattcgcagttttctaggcctcgcaggatattaccggaggtttatagagaatttttccaagattgctaagcccatgacacgactgctacagaaagatgtgaagtacaagtggtcagaagaatgtgagcagagttttcaagagttgaagaatcgcttgatatcagctcctattttgattttacccgatccaaagaagggtttccaagtctattgcgatgcatctaaacttgggttaggttgtgttctgatgcaggatgggaaggtggttgcctatgcatctcgtcagttacgtccgcatgagaagaactaccctactcatgatcttgagttagctgcagtagttcatgcgttgaaaatttggcgtcattatcttttcggtactcgtacagaggtatataccgatcacaagagtttaaagtatatctttactcagccggatctgaacatgagacaacggagatggttggaattaattaaggattatgacatgggaattcattatcaccaggaaaggcaaatgttgtagccgacgctcttagcaggaaaggctattgcaatgctaccgaaggacgacagttgccattggagttatgccaggaatttgaaagattaaatttgggaattgtcagtagaggtttcgttgcagctttagaagcgaagcccactctaattgatcaagttagagaagcccaaattaatgatcctgatattcaagagatcaagaagaatatgagaagaggaaaagctatcggtttcttggaggatgagcaaggaactgtttggttgggcgagagaatctgtgtccctgacaacaaagatttgaaagatgtaattctgaaagaagctcatgatactttatactccattcaccctggaagtactaagatgtaccaggatctcaaagaaagattttggtgggcaagtatgaagcgtgaaatcgcagaatacgtagcagtatgtgatgtttgtcagcgtgtcaaggcagaacatcagaaacctgccggtttgctgcagcctttgaagattcctgaatggaaatgggaagaaatcggtatggattttatcactggtttacccagaacgtcatcaggccatgactctatttgggtaatagtcgatagacttaccaaagtggctcattttattccggtaaagacaacttattccggaagtcggttggcagaattgtatatggcaaggattgtgtgttcgcatggcgtccctaagaaaatagtgtctgatcgaggcagtcagtttacctcaaatttctggaagaaacttcaggaagagatgggttctaagctgaactttagcactgcttatcatccgcagacagacggacaaaccgaaagggtgaatcagattttggaagacatgttgagagcttgtgctttagatttcggtggaagttgggataagaatctaccttatgcagaattttcgtacaacaacagttatcaagctagtatacagatggctccttacgaagcactgtatggtcgtaagtgccgcactccgcttttgtgggatcaaacgggagaacgtcaggttttcgggacggatattctaagagaagcagaagaaaaggtgaaaatcattcaagaaagattgcgagtggctcagtctcgtcataagagttatgccgacaatcgccgtagagatttgagttttgaagaaggagattatgtgtatcttcgtgtcacgccttttcgaggagttcatcgttttcataccaaaggaaaattagcaccgcgttttgtgggaccttataagattgtcagtagaagaggagaggttgcttatcagttagagttacctcaatccttggcaggagtccataatgtgttccatgtgtcgcaattgaagaagtgtttaagggtacctaccgaagaagctaatcttgaatagatagaagtccaagaggatctgacctatgtggagaaaccaatccgtatcttggaaacaaataagagaagaaccaggaatcgagttatccgtttttgcaaagtccaatggagtaatcactcggaagaagaatcaacttgggaatgagaagatgaattgaagtcagctcatccgcatctgttcgccagttcttccgaatctcgaggacgagattctgtttaaggggggtaggtttgtcacatcctgaaaattcaaaatttataaattgttgtttaattggaatttctagaatatattttaaaagcctagaaaggaagatctagttttaattaataaattccaatataaaatggggccagataaaattttattaaatactttgcttaattctataattcctagatttttctgggatttatttgagctaagaaagtatttttaataaatggaattgcatttaagaaataatttaaatggaaaaaggttttaaaaagtcttcttttggctttgggccgaaagtcggcccaaaacctcctctctctctcctcggcccagccggcccagtccgcagccgcagccgctcgcgcgcgcgccctcgctgtcgctgacaggtgggtcccgcctgtcggagtcgtcgtcttcctcgggccgaaaccctagtttcgcgccgccgccgccgctttccaatccggccgctcctttccttctccggccgaattgatagaggggaaatgatcctcgggatctcctctaccttttctcctttggaatctttggccaaatcgtcttggaaagagttggattcgagttcgtctcggattcgttctacccgagctttccttcgccgttgccgtcgccgtgggcctttgccgccgcctccgagcccatttaaaaggacccccggtgcctcctctacccgtcgccaccctcgccttcgcctctcgtcgccggaagagctctagcaccgtgtgccctagtgccgccgtcgccgccgtcgctccagccgtgcgccgccgccgttccggtcatcgtcgtcgctcgggaagaccgccgtcgtggtcgccaagtcgtcgtcgtcctcgtccgccacttcgccaccgtcggagaccgccggagcatcgtcgccgtcgtcgacccgatctccgccgccgtttcaacctcgtcaccgtcgccgtccgttcttcctccgccgccgttttggtcaccggtgagttcgccgcgtcgtcctctacgtgctggtgccctccgtttgtgccgtagtgccgccgttcgccggcgagcgtgcgccgtccgagccgtctgctccgccgagccgccgccgctgtcggtgacgtcatcgctaacgtcatcggggtcgtccgccgtgagccggtcgtggaccgtcgatctcggccgtccgttttggattggatcgatctcggccgtccgttcgcgtgaaccgccgcccgtgcgcccggtccaccgaaaccctagccgctgacgcaataaaccttcttttccttttcaaaaataattcattattgcgtcataattcaattttccccgatttaagtgttttaatccgattctcatctttaaa

SEQ ID NO: 58861 - DNA, 902 bp, Oryza sativa
cctctcgtcaccggtagcgccctagcgtcgtgagacctcgagccgccgtcgccgccgtcgctccagccctgcgccgccgccgttccggtcatcgtcatcgctcaggaaggccaccgtcgggatcgccaagtcgtcgccgtcctcgtccgccccttcgccaccgtcggagaccgccggagcatcgtcgccgttgtcgacccgatctccgccgtcgcttcttcctcgtcgccgtcgccgtccgttggtcttccgccgtcgcttgggtcgccggtgagttcgccgtgccgtccgctacccgttggtgtcctccgttcttgccgaagtgccgccgttcgctggcaagcgtgcgccgtccgagccgtccgagccgccgagccgccgccgccggtggtgacgtcatcgccgacgtcatcgtcgccctcttccatgagccggtcgtggaccgatcgatctcggccgtccgttttggatcaagtcgatctcggccgtccgttcgcgtgaaccgccgccgtgcgcccggtccaccgaaaccctagcccgctgacgcaataaatcccttttccttttcaaaaataattcattattgcgtcataattcaattaaaatcaatataagtgttttaatccgatttaatcttcaaaaattcataactaattcatcttagctccgatttagttggttcaagtctctaaatttttctaaaattgagatctacacaataaaaatatccacatgtactgttcatgcttgtttatgtgctgttttggtgattttgctcttttctgcttagattccgtcgtttccggagagtccgttttcgcaggagaagagtttgaagagttccaaggccagcaaggcaagtcacacagatcccaaacaaccctttgagcatgttgatcccg

SEQ ID NO: 58862 - DNA, 553 bp, Oryza sativa
agttttcaaaaaggaccaaaatgtaaaaatttcatacggagggagtatatatcatataggagtactactttggcagttcggcccaaacctcgcgccgcactgccgccgccgccaaagccgcaagccaaaaggggaacacccgccgcaaaacccccaaacctctcgccgttctcttcccccatgtctccctccgcgccgccgtccgccctccgcctccgggggcttcccaaggcttcgctgccggcctcctcctctttcccgccctccgctcgcttcccccaccacctctccatgtccgcctcctcgtctcgccgccctccgcccctcgccgcaacggcggcggccgccgggaccgggagtggcgcctccccatccctcctcgcagccgacccgggccaccgcgacgccgtcctcctcgccgctcgcggcgccatggcgaactgcctcggcgagaccagcctccacctcgccgtccccgggctccggctcgcggccaagggcaaggtgagcaaaaaaaaaaaaaaaaaccattggcctgtgttgccccactgat

SEQ ID NO: 58863 - DNA, 13290 bp, Oryza sativa
ttcattgcgtgcgtgattatgtgcgtacgctcgtgtgttgcgtcagcgtgtaccaccacgtaacagagtttcatgcctactactccagtttagaggtgcaatggatacaataccggttaccgctgggttttcttaccccgtatcatctccaaccatacctattcgaaacagtatcctcccacatagtcactgatatatggatccgtgaacggtgaggctcacatgtcaattaccatgtccttctgactccatgttagaaaatcgcaatcccacctatccgtaggtacaagattctctctatactgtatatgtgcgggcaataactacccgttgcaggtcggactcaggtttaaccaaggtcttaggctaactcaatgcatgttgagccaagacatgtctttttacatttgtgaaaatgcatggtttatatggggttttaggcctaggtccgacccatggcctaagtggctcatgacctaggtctgtcattgacctgccgggtaccgatacacgtgacactttgagcacttgcaatttacactatagtcaaatgattagcaatcatccattaacatcataatgtcaggtatacaatgattttaacatcaaagttagcaaataaacagaccaaacaactacattccaaaatcaagaaattaaatgataatgccatacaacagactagggaagaggttgagaggttaaaggagttttatcgaatgtccccgaagagacaggttaaaggagttgggagtagctatatttatggcgccatatttttcaccaaaaaatagtcggcatgtatttatattgtaagtttctaaaatatatatgtaattttagtgcatttacaatgtaaatctcgaaattacatatgtaattttagtgtatttataatgtaagtaccaaaattacatatgtaagtttctaaattacacatgtgtaattactgtgtaaatagactaattgcattctttgatgaccaacacgtgtcacgcaaagcaaaaaggagtcaccaacttaggagcaagttgttcgattagcttatcagatgtactttacatgaatcgtgaagaaaattagatggtagatcgacaaactgactgtatttagcctagaaatatgtcgacataattttagcaaagccgaaggagttttatgctacagatgataactattggcagtttttctatgcatacggtttttttaaccatggattagtgggtgtggatggctaaagaataaacccgtagagtatatccaatactcctcattactataccatatggatataacaattttttctcactagtaaaaaactgttgggtacttgggtctccaaacgcggaccctcgtcgccgtatctactccagacaatgcttatacaagcttttaagaagatgttttcaccttgatatttatgttttcaagtccttaaatttcctttgcctggtgattttgacttgtctcgtcacaaagcaaaagagcagcaaaaatggaatatgttttcaagcccttaaatttctttctcgtgatttaaacttgtttcgtcacaaagcgaaagagcagcaaacatggaaaatatatcgcctcaaaggcacaaaaacactcttaaagaccatcagcctaaaccttgaacttttctcacatcgataccatagaagtttacagttaacacccagttcatcacagaattgagaggcaatgaacacagctgttgcaacttgcaagagacggttggtatacaatcatccagacatccagtacagaccatgcagtgtatttctacggatattttgagcacagcttcaggcatctacaaacatctcacagccagtgacacaaaagcagttcttcattgtgggtgtcactgcagaatctggaaaaggaagaatctcacacggcgagtcgttttccaatttcggataagcagcgaaggcaacatttaacgttactttccccgccaaaaaaaaaaaaaacatttaacgttacttgtaaccaagcaccgtgacagcgtatagcttgcttgtccaggggtgaatgcccacaccagcaagcaaaagatgggcgacaagaattcctgcagcggaagcagcttttcatcacagctcagcacctgtgatctctgtggctaccggccaaggccatggtccatggctgcctcatgattgccaaacattaggctgattagggttcatgattaagtccctaatgatggcctttaactaccgtgccttgctgaggaattccatctttaatgtgtcctctagttgtgagaatgtcgatgagaagatacctgaaaacaaaagaacagtacttttttgtcattgtcaccgagataaaagaaaaactctaattttgtgcatgtactagtaagccagaggagctatcatgcaattggtacaagtatcatacatgcagaagttctgtttggttcacatccagttgcaaccactattggttatacataatacaattggaatttgagggaatgagctaaatgctcatgctgcacatgtatagactagagatgaacagagcaattatataacctaaccaggtttgaaatatgacaagcaatctctatttaacagaaagatcagctagagattcttgtctgcttgtcctactatctatagagcttgatttacttccctctacaacctgaataattgtatcctcaattgcaaggacggtcagtcgacagtcaataacaaaagcagcagcttcaatgccaacatgccatatgatccgtatctacaggctctgcctcctgcaaacttaccagccaaactctctcaatgcgtcaatggtccctagcgttcaagtgtcatttaggagtatgtctccatcgtggaattagcactagcagctgtctagagccagtgacaattcatatgctagagccagctaggcatcagtactactgtcacccttcttttactggatagacaaccaagacaattctcaggaccgtttcatgactataggaccaacacagcttggcagaggagggcatgaacaggattctccatctcgtgctgtacaatgtacatttgacaccatttggtggatcaaaattttctactcgatcaacagatttcattatgattgagcgtttatgcactgtaaaacaacctcacatctacaaaagcaagtgccaatcatcctgaatagcaagagttagtacagataacgaatcaagtttcagctccccatcttgcccttttagtgttttatgcatcctatagaattaaaaggacacaaatagccgatgatacagacatcaggggatttatacatgcttgaatctggaatggagttatatggcaataggggaagataaaagaggttatcactgcaggggttggaacaaggaactgcataaacatgctgcagcagtggcaggagaggtttcctgcagatgcacgaattcaagtgatttcaggctactcttgtgtttaagactcgatgccatcctttctgactcacaaactggttggtacgttatccaaatctctaggttaacgtggaagtcagctctttccacgcatgccagccagctgcatgctaaataacttgagggtggacatttgtattttctgaatggccacagaccatctggttggtgcccatgattaagcgccagatgctgtattcgttaaaaatcatcacccttaaagattcactcatcaccacttaacctgaatgctctcctgaagatggctatttcaaaggcattgtgtctgctgaatcacatggaattcggcacctatatactagacaacataaatctggctacctctggaaatttcttcaccagtaagctgaccaatggagtaaccttatgtcagttcatactgaaatttgcccctgctaccataaggaacggacaaaatcttacaactcctctccaaatctctgtccgttggtaacaaggctaggctgaggcatacactcgaagtctgattaagatgcaaaataggtttctggaacacaaattaacacatgatgccagaagaagatgggtttgatgggtgacagaaagctttggggcatggacagcagtgagccaatgatagcttcagggtgccaatgccaacggtagttgagggagggtggtagccaggcaccagtgcaccacgaccgtggctggacagtggctacaggcatacagtaaaatcaagtacactgttggcatatctgacaagataaaagaagagtagatcaaatgaaggtgatggtagctggagaattgatgttgctggcaagagggtgatcactctggttgcattgggtgggaaagatagctggaagaacaatagtgagagggaacgaccaagcccccagaggatggattgctgccatgtcacattcatgatttaatagctcaataattcccattttttagtttttttatacacacagatgaagcatccgtgactgtcagtttcacatggaaataataatggccaggccagaggcaaagtgggatgccattagactcaataaaatagctcggaactcaaatcaacaacaatggtatatgcactcaattgaaatataacatacagtgaaatttacacaaaactacaagatcaagaaaatggcatgttatgcattgatgaaaaccaacaaaggtgtatctgcatgtttggacaataaatgtgatatcattcacatgaagaacaacgattacctgacagtgctttgttcaataatgaacctctgactaggagtgtgcctggcatttgttcaaacacctatatggaaaaaatacaatgattttttttttgaaatatacacagaaacaactgacaagttcataggaaaaaaacataactaggtaactgatgaacataatatacttcaatttatcctaagcataccgaaatacggaaggatgttccagtaacaccactatgaagctttgtagagttgccttctacagaaccagattcatcgtgcaacattgcagcctgagcctgctcatctgataaggtaacctgaaagaagagtatttcatacaattcttggagatcgatacactatagaatttgtacaacaacaaaaaggtctgtgtactggtgtaatttgacagaaggaatatgcggcagattaataaggaatcttacatcaatagaaaataatgaagaatcagttttacacgatagattagaagcatggaaaaagctctcagctgacttcagcacttgaaatgcaccatattcacgtcgaaggccctgaaagccattatgtaaatgagatattgaagcgaagaagcttgagaaggtgcaatagtagtggaaactcagtatcaataactcacagataaatataagttggctgattagctctttattaataagaggaaagggcgcaggtattgtccaagaacatacaaacataatggtagataagattcgagttggatttctttttcttttggttgctaaagaaaaatagctgtgcaatttatggaggtaaatgataatatgaatcaaagggacaaaaggtgacgtgatactaacttgaagcataaaagaatagttggcttttccaggtgtactggatctaatgaccattttccttggagcaatgaatgaccatgcaaggccccatctagctgtttgaccttgcacgaattcagtagttttcacaactgacaccccagcttcacgaacttttgaaaccaatatttttagatttgcttttctgccaaccatcgaagtaaaccacctaaaacaataaaaggaacaatgagcccagagacaattaaaaggctattatcatgttaggttagtatttgaatcacctgaaagagttcttaagggaaacactgtcttcaattatacgagttataaatgcctgttcaccaccaggacaaaccatctcttcagcagttccaccgcatgaagtttttggattaagaccagcttcctctatactttcaaagaaaggaggattgcacatacagaagtcaaagctctcactatccttcacaacgccaagaaggatagatggtttcgacctcagtacaccatccactggcttcgaagtgttctccctggctgcttcaccatcaactgcttcagattcagaagaacaggacattttgtttgcatttctaatctcaaccagagctgctagctgtggattgctctccacattctttttagcccattcaagggcaacatcagtgacatctacaaacacaggggtaatccgattaaaagagaaatgcaaataaaagttcaactaacataagaaactctaattgatgctttgcaaaacttatattgtacatgatctaaagcataccagatccaacaaagctccagcctagtaaagaagccccaagcagagggtagatgcaattggcacctgtgcctatgtcaaagccccttacagtcttgtttgaactggatattggtggtatgaggtctgatgagagaagatcctcaatccagtggatgtaattggatctgtttggcacagtagggcacagctgtccatccggaatccacctgacggtagttagcgacaaatgtcatgttcatatattagattaaataagatattgatcacaaaccatatgcatgacacttagccaataacatattgagcactagtaaatattttgcatgacaaacgaacatcacgattctctctcttcaaataaacatggcagctaaaacttcttcagagaggccatttgaattttgaactgttagtgcaacaatagtaccatttctgatatagtagcatcatcagaaaaactactgaagttacttagaacaatcaaattccctcaagctcactcctgatagtagcaactagcatcaacagttcatagaatgacaaatgagacgcaacagcttgagctcgatgctgcggatggctgaattgagtggtaccctagtgattcttcagcagagcaataccgggatgcactagaagcacagacggattagggttcagggaagtgagcccagagagtgtaattagtaccaaccagttgacgccgtggtcgtggaggaggaggacgcgcgtgagctcgcgggtggcggcgaagtcggtgaagtcgatggaggcgcggcctccccgggagacggagacgaagggggcgaaggacgggtagagcgacgccagcgacgcgaagtccggcgccgcggcggcgtagcggttgcgcgggtggatcgccggcgcctccgagccgtcccgccgccgccgcttcctcccaccccccatgacgtggatggaccaacggcggcagagctcgagcagagatcgccggagccccgaagcgccgcgggggaagcgacggcgagcggcgcggcggcgcaggtcgggtagaaaagctcggggttttctccggcccaatccttcgtttagatctttacatgggcctcgagtccctatcacggcccatccacaattcatctttgtcaaatgcagacatatgtttggcagggcttcagttccagcttcatctatctcgaaactgaagttcaaccaaatggtttggagtagattaagtggtatgaaaaactatactaagaaggtgaagcggtgttcagctccacaactccgctttaaactcaactccaggagttggaagtcctgctaaatagaccatagcatagtgtttttgaaattcactgagaaaacaagagtatgaagacatggtttgtgttttcatcctacaatgtgatacaggtaaaaatgaaaaagatgtcagtgtcatttatcattaagcaaaatttataaaccaccaagtttagggtatctgtcatgcaaaccacaaatattgtggttttctttaagaaaccttagattttgagtaaaaccacttagggtgtgtttgaggagaaggggattgaggagattgggaagatacgcaaaacgaggtgagctattagctcatgattaattgagtattaactattttaaatttcaaaaatagattaatatgatttttttaaagcaactttcctatagaatttttttgcaaaaaacgcaccgtttaatagtttgggaaacgtgcgcgcggaaaacgaaataaacaaactcactctctctcaccctctcgaatgctgcctaaggaaatgtttggttgatgcctaaccttgccataactaagtttaggctagttgtggcatggtggcataaatgtggcttagaaatagttggccacaagtgtgtcatgcttagctctaaatttgagagcatgacatgtgggtcccaaagttaagaaagtgtggtataacacaattgcggcagcgaaccaaacacatgcctaaaaaactgtggcatggctaaagtgtggcgtggcaaagtgtgacaaccaaccaaacagccctaaatgtttcgtgaaactttgtgtaggcttacattgttcatttaaccaaatttatgaacagcaattgtgttaaaaaaaaggtagtatgagatattttttttaggtacatatacacttcaaccatattttcaatcaacatcgagtattatcaacagtatggaggtacgtgtgtatatgtaatcgactgttttatatcttttttaagtggaagcggcaagagtattgccgaatatattagaaagatagtgtgtgaccctgtttataaggaaaaccgggccaaataacatacaactgcgcgttttgctaaagtgaaaccggcaaaaattttacacagaagacacaaaagcctaaggcaaacacaactacaaaccgcataaggccgtgggaagagtaagatcctaaggcgaagccggagatgaacaacgacataagccgctgtcgacgcccgacctaaacagttggactgttttatatcattattagcgggggattgtattaagtttttcaataatccagcgcaaggataagatagaatataagatgacaaggttgtatttgaactttgtattggaatatgtttattaaaacattttgcccaaaatataatacggatgtcttaataaaaccggttttgggaaatttaatatttatcatgttgagcaattggagggtttcaagatcattttttgcaatggtgagatttccttcaccaactattttttgttattaaaagggaaatgaagtcatcttgtatttatgtaacacaacaaactctccacatcttcttataattttctcctctgtgtttagatcctgaaatgaattggagatcaggttttaggcgccacagccaggtgcatggagattggagacaagacgaaacggcacttgcctgcaaaaagtagtggatactgtctttctacttctccgttcttccaatgatgaattggtgattggccttttcaaggtagttgcagcaagtatctatctatatatcctgaagatgacaattggaatcgatgttcagtgcgtcgtcaccaccacttgtcatgctttcagaacgtcaacgacacacaacctctcgttttttcctttttgtgaagtaattttggcgaatacgagcaccatgagaacagaatttcgcacaacttggaaagctgttcttcaatttttgcgattcctaacgcaaccgcgtgtggaaagagagaaggaaactaaagtgagatcgatcgaatcaagcatctcctgcgtacagtagctgccagccatgatcacttgtggcagccatacttgaggcatctcgatcgttttcaggacgtctctggcttgacagctgagttgagattattcaggttgatctttttgcttggttcagatttcagatccgtcagacttttcaattctgttttcctactcgttttacaggttctgaaattgccaaatgccgaccaaacgaactcaacacaagacgtgattctgttggtattgggaggagataggaaggaaaaacctgtcctgcaaatgcaaaaatgcaatatgccatattgccttccaatgagagtatgtcagcattcaagcaaacagccaaacacagattatagttcgtcccatagaggctggatgtggaacgttagccaaaaactggatttgtaatcctaattttaattcattttaggcgttccttttcaaattttttaaggctgtgtttagttccttctaaaattagaagtttgggttgaaattggtacgatgtaactgaaaatttgcgtgtgtatgtcaggttgatgtgatggaaaaagttggaagtttggatctaaacacagcctaagtttcggctttttaaccaaatatcaatatactaaacgcctaccgtaaaactactttttcgtaacatcgtttttattctatggcttataactcgaagcctatcaatgtgactagtactattttattacttaatgaaacgtctatacattatatatatcaaaatgttataaaaccgtaaaaaagccatgatatcaaactgacaaaataatactctatccatcctaaaatataaggaattttatgtggatgtgacgtatcttatactttgggtgagaggaagaggtactaataccactattatattgtactccctccatactcgtaaaagaaatcgtttaggacagcgacacggtttccaaaacacaactttgacttcttatttctataaaagtatttattgaaaagtgatatatgtatacttttataaaattatttttcaagacaaatctatatatataatttttatattttcaaactcaacaacttaaaagttatttatgatttatattcctaagatttgatttaagcattgtcctaaactactttctttataagtatggagtaatatgtattggtaacagtacagtatatacagcagtagtagtagaatatactgtactgtagggggaggtttgggccggcagaggaatgggccagtcgcacatgccgtctgcgtgcgcttcccgcgacctagaatatcgcccactcgctcaaccgcatatcccttcctaataacctctccgatccgtaaacctcgcccatgcgccacgtcccccctagtgtcctacctcccggaccacccggtcttggtagaccacgtccacctccccaactaaaatatcctccctaacccaaccaccccacggtaacccacgtacttaacgcgagttaccccccgcaaagatccaaccgcctctcgcaccgcccgcctgtccacccacgcctactgacgaacccggcccacctctccgggccccaccatgtcgtcaccacgcaggccaaaatcggggagagcgtgtcgtggtcccacctgtcattggcttcgtgggtgggagcgggtcacgtgcatctcgacatgactcgaggaggtaaccatggttatggtaaccccaccgccttgacacccgtggttaggggtgggggcgcgcgatgccgccacgtgtgacgatcggacggctgcggagggcatcggggttgggcgacccgcctatttaaccgcgggggcctcgtcttcctcaggccacgcagcgatctgaagtgaaacagcaaaaaaaatcaaacaaaaagaaaaaatattccccatctgtgaaattcgcaaaaccctagcgcggcggcgatgtcgaacacgagggtgttcttcgacatgaccgtcggcggagctccggcggggcggatcgtgatggagctgtacgcgaaggacgtgccgcggacggcggagaacttccgcgcgctctgcaccggcgagaagggcgtgggcaagagcggcaagccgctgcactacaaggggagcaccttccaccgcgtgatcccggagttcatgtgccagggcggcgacttcacccgcggcaacggcacgggaggggagtcgatctacggcgagaagttcgccgacgaggtgttcaagttcaagcacgacagccccggcatcctgtccatggcgaacgccgggcccaacactaacgggtcccagttcttcatctgcaccgtgccctgcagctggctggacgggaagcacgtcgtgttcggccgcgtcgtcgagggcatggacgtcgtcaaggccatcgagaaggtgggatcccgcggcgggagcaccgccaagccggtcgtcatcgccgactgcggccagctctcctagatctgtgctgttccccttcgcctttcgccagtatcagtcgtcttgagtcgtcgagtccctaaataaggaggaggtggtggtggtgttagtctttttatgagttcgtgtcgtgttggtgagatgagatcgcccatggtttggttggattaggcggagttcttggatcgattcggtggagttggatctgcgatccttcttggggttggttttaaatcttaattcgtgtcgctgcttctatgatatcgctatcaatcaatgagaacatttgggatccgtggattttctgtgatcttacacctgtgtggttgtttgttcttgcgacagtactaacgttcttgcgattaaagtagattaaactatcttcgtgagatgagcggtttgtcgccgcgtgatgcctgactttgatgtgatttgtgggacttcgtcttatccatttggttattattatttttttattttgcaccgaggctctctctctgatgtgatccactgtttctgatctctgatgttaccaccaccagagggtaatttgatcgcttaccagatctctgaaattatgcttaccggttagaggggtaaatgatcttacaagttgtttacaggttcaagaggtgaacataattgcgtttcaccagaggatactagaaccttttttgtgttgaaaaatctattattaagggcagcagtactaaactgaattattatgtcttgaaaattctattattaagggcaggagtactaaactgaaggtcgccgttattttagtgaaaagacaaaagttgcaacacctgtagtaggagtagtactccactttgaagaatgaccattctgaaatttgctaggtacgctgtcactgccatcatcttgctgccttgcctcccacaaggccacaacccagcgtacaattgtacaatcaattctctctgttttttttaaatcacaactttcattagccatactaataactccctccgtaaaaaaaaaagacaaaccctgatttccgtgcccaacgtttgaccgtccgtcttatctgaaaaaattatgaaaaaaattaaaaagacaagtcacgcataaaatattaatcatgttttatcatctaataacaatgaaaatataaattataaaaaaatttcatataagacggacagttaaagttggacacggaaactcagggtttgcctttttttttacggagtagtacttagtactatagtatttttttaccgcgagcacacaatatatttgg

SEQ ID NO: 58864 - DNA, 19180 bp, Oryza sativa
caaaccgccccgccgtcatcgccgtcgtcatcgcctggccccgccactccgcgcgcaagccgccaagggacggaggcagcatccctcctccctctgccgcgtcgcccccgctcacctcccccttttccccgaatcggcaaaggggcaagccccctttctccccctccttttcccctttttcctcctcgtcggcgtcatcctccctgtcgccgctttggccgcgaccgccgagcgccagctcgcgcccttgaccgcgcaagtcggttcccaaaccgacattgccgcccatttaaaccccagcctcccatttcccttcctcttccattcgcctccgtgccattgttgccgctcccgtgctctgtcccgcctccgccgtccatcgccaagcgccgggagagccggtgcgttcgtggacgcggaaggggactccgggcgcgccctctttttcctcttcctcggcccgaggccggagagatcactcccgcgccgtcggcctctcgtcaccgcgcccgtcccgcacggtagtgcctccctccgttcttcctcctcgctccatctccccccccttagctttcggtagtagctcgagtagtctccccgaagttagccggcgccgccccgaccgttgccgtcgctcgccgtgtgctcgccgccgtcgccgcccgagctcggaagcgccgctcgtcgccggcctcgctcggcgtagttccgcccaatccgacgctagcatcggattcccgtaaccgcgtagatgctctcgccgccgggaattagcccctagtgacctcgtcgccgtttcccccttctcccgccgccggttgcctccgccgcaatccgccgccgtcgagcaacccccagcaaatccgagccgttggttcgtctcccctcgtcacgtgcaaccgcccggtgtgctcgcttttgcccgtatcgccgtggttcgctccgtcgctcgccgctgtcgaccgccgtccgttccggccggcgtcgtcgtctacctcccgccggcccgcgtggcagccacgtaggcgccacgtcggcgccagctcagcctagaccgggtcgagccgaccccggtcagtccctccccgtgcgcgcgttccaccgcgagccgtgaggctgcgcgtgggcccgccacacctgcgtccaccgcgaaccacgtgcgtgcaccacgtccatccttcaccctagcgccgcgccgcgtgctccctccgcacggtgagccgagccgctgaccgcgcgtggtgagcccggtccaccagactctctatccttcctccgcgcgcgcgcgtcttgggccgccttgggccaccttcttgggccggccggcccgttaagctcggccgagccgccctttctctcgggccgcgccctagccgcccgagggaagtctatattccctccctctccctttttcttttctttcttttccaaaaaggatttaattaaatccttttcctttagaccaaaaatccaataatcttagaaattcaatatcttccctaccgtaaatccgtttgactccgttcaacttccaaaattccccaaatctcgagatctatctaatggcacgcttagaggtcattaatagggctttattttcgccgtttgttgagttgtcccatttcgcgtgtagttccggagcccgaagacccgcagtgcgaggatttcgaggatcaagctccagatctcgagcaaggcaagccacctttgaacatcttgagcctatatttgaaatttaattatattgcttgcaaaatattatgcattgataggatcgcacttaatctgttgttccgtctgcaaggcagattggcggacctgcctaatttgttgcatttgatccttccttttttaattgttataccatgtccccttgtaaccacccagttgcgcctcgatattcgtgcactctgtgcgagtatcgacggtcaccttcaaacttaaaatctgagaaacaacttgggtaaaacttgggttttacaaaagacttggaaaacccgacacctaggtcggtgcttgcgaactaaatgaatttctaaaaccgcggaccggggaacgtaccgggtgtacggttttcccgctcccgcacttaaggaccgattccttggaatttcatccgaacataggacaagtacgaccacatgggtggaatgggacacccctggctgagtaactagcttatcaggggagccatgatgccgagagacatgtggattcgccggggtggtgtcggagaggaccccctaggcttcctggcacagtatggtctgggacctaacctgttgttggtctgggacccctctcgtcggcatatggtaagcctgtgtcggctttggaaatgccttgtcatgaaagcttggaggtctcccgacgtggctgatccccacgggctgggtgatccggattagtaatgtcgtgtgggtaaagtgtaccccctctgcagaggttaacaaactgttcgaacagccgtgcccacggtcatgggcggatgtgaggtgattcctagcgtagttttgtttgacaactgcttgtgaaattactgttgtgaaaaagggttcgatgtttgaaaaatcagcagctgacgggatcagctaggcccgggtggccgtttgaaaagctgttggccgggtgccaaccttgttttaagatctaaagattgatacattgcacatactccgaccggacgggacgcactgtctcaaccgtgtcgtttgagaagcactcacctagatgtttttagaaaagagttcaaataaaatcaattacgaaaacaacagcctttccttgaagcctgcattaaacacttatttcccctagcttgctgagtactcccgtactcacccttgctctatataaatatccccccagttgctgataaagatgaagcggatcctgctgatgaggagttcttccaggagcaagccggttacgatgagttttagggtttcggcctagttcccaagtcgcgcctgtgttgtttggtccaagtcccggcttccgtttcccttttgtaatgcagttgtaagctcgggatctgtccgcagcccaacatgactgtactcctactctataataaagagacctctgttgctgtgatattctatcttcctgtgataccagcactgtttcctgggactggtatcgattaacaggttaatttagagcgtcacgggctaattccagtcgggactagctcggggcgtgacaatggagtaattaatttgaagtaatttaatgaaataacagatttagtgaaattaatttgaagtaaatgatttgcttttttttataaatttagttaaacttaaggaagattgataagaaaaaagtttaaacgatttataatataaaacgggaggaatattatagtatttttgtttttgaggggaagtgtattatagtacttgaggagcaaaaacgacatgcatcgtcgttgactgtcattttgtcttgtttggctttagtttccttgctttcgcttggcgttgccctgccaacatcagcttagtttccctgctaattacgtcttcacaaatttcctgttcataaataaaccctactatgtcttcacaaaagcttgttattcctgcagttttccacaagttcggtgttatcgcaaggaaaaaaatgttgagttcagaagaagacgtttctcaaaaaaaaaaaaagttcagaagaagacatggaataatttgctggatgtgcatgcaacagctggcccaagtcaacttaatcggttgatgtaagaaagaatgtttcttttacacaaaaaggaaattatataagcaaagcaggtatctcgagaaattattaatttgtctagcttgttcaactctatttcataagtaagtagaaccgatctccatagcttggcgtttagattagcttatgaattaggttgggtttttttaggacggaaggagtagttccttatgtcggtagaacatgtcgtttggggctttctgcaaaggtccagaaaaaagactgaagttttacctcattctcagtataacgactacgttcagtaaagaagcagtatcatttcccttaatttgatacaatatcaagatgtctcaataatcattactatcaaaatcattatgcaccttgtatgcatatacagatactcttgtactgtactagatttatttttgacctgaagaagcaggacttgatgattgttagcatcgttgttggtcaatggctattagtagtagctatgactgtgtttagtaggtcttggattccatattcagaacgcggaggataatatgtggtcatctggacacgctattgcaattgcaggcattgatatctgaagcgcgttgaagtggagtgccctctagctccctccctgcttgctgatgccgcagttcgtacgtgagttttggttaacgtttgagtaaattaagataagcacccgtgttaagtctcaccgaataaactgaataagaagaagaaggcacatccgatcctatcacctatggcgatgtttgttcaatacttgagtccttttttttagataaatacagtacttcggtctggtgtattttgtggtgcaatttaactccataaattactttcagaaatgtgcagacctagcaatgtaatttcaaggtctagtaatgtaaatgagtgaaagaaaacatgaagaaaatgaaagctgctagggtttgctggcaagaaagagaggattgagaaccaaaactcgtcaaaacaaacacaagtgaaatgatttggttccactaatttcgtgtattattaattgacagttttgtgcgaaggaaaaaaatacaaaggggttttctacacaattctagatgcaattttttaatcctacaaaatatgccatgagtacaaggtatgctcatagatagttagatggataaatgactctttttatttacattagtaatttaaatgtgtatttttaaagtaaagtgacttgtctaaataagctggattaccctttatacattttactttaatctctttgtctcctttatcttgcagagactgtaaattcatgaggtgatgagattattactgcaaattggatatggagaagttgttctttttttcttgtgaaagagcgagaagttgagactgagaagagcagccagcaatggacacaggaaatgggagcaagaatcttgctatatgtacgaccgagccgtacgatttgtttccgaccgagtcatgcaaccaatcactgaaattatgcttatacatacaccagtccaatggatgggtcggacgtatagcaatttcgtgggagcaaatagggatcagtagtactgtagtagtagtagattcgcttgccgtcactctcgtcccgtttgccgctgcactgcactgttgccctcggccgctggctgcctggattagtggtggtgacccaaaagtcaagaaaagaaaaaacaagttgcacttgcagttttgcggctcacttccccttctccttccccttccgtgtgcatcccggcttcctctagctccgccctcgacgccaaccccaccaatccgccgcctccatgccctccccttcctccccggcctgagattagcttcgccgccgcgcccaatcgccccgccctgctgctccccgccgccgattccgtcccccgtccaccgccatggatcgcagcagcagcagcagcagcaacagcaacccgcatctcggggtcaacaagctcggccgcaacatccgcaaggccacgccaccgccgccgcagccgcagccgccgtcacgcccgccgcagccgcagccgcaggtctacaacatcagcaagaaccagttccgcgacatagtccagcagctcaccgcggggaccccctccccgcctccgccgccgcagccacagcaccagcaccacccgcaccgcccgctgccgccgcagcaccagcagcccaagcccccatccatgcgccttcagaagatccgcccgcctcccatctccacccccgtcgcgcggccccctcccgtccacaaccaccagatccccaaccctaaccacaaccccgccttccaccgcccaccgccgccgcagcccatgcccatgcctatgcctggtccccccgtctgggctgactcaccggtcaccgcctacatgcgcatcctcgagaactccctcttcagcgccaccccgccaggcgccgccgccgccgctgccgctgccgccgctgctgctacgggacaacaggcccctccgcaccaccctcatcccccacccccgccgccggtgccgtcgccagggatactcccctcgccgagcggctttctcaacctgctctcgcccacgcccaggtcgccctacccgctgctatcgccgggcttccagcacccggggccactcacgcccaacttccccgcgctgtcgccgctgccgggcactgggatcctgggtccagggcccatggctccgccgtcgcctggcctctggttcccgcagtcgccgtcagggctgctctcgccctccgggttcttgccaattctgagcccaaggtggagagagatgtagtgcacatcgctcgccgcagcgcagcacaaagctcccgtgaaggccacagccgggtaacatttgacgctagggttgtagctactgtgaggtgaattggtcgctgccccggagatgggcgcaggtgggttgcagcttcggacaccactatttgttgctctcacttactgcttgtgtgattagtcagtcattatatcagtcagtctataaggtggttgctcatatatttgtaattgtataactgggaaagtttttaattcattcacttctcttagctgcaaaaacctggacagcaaaaactgggcatgttgtagtttagactcttgagtgattaggcttgaaacatgtaattgtaaaactttagttcattaaagattagccctttctcactgttattttgcttacgagtgatgtttggtttacctactcttgagcagaatgtttgccctacctttttctttcctagggggaagctaacttttagacatcagcttgacaggagatcagcaactctgtcttatttgtaccaacacctatcagatgagagttgaggtttagtacatcattgttatcgctatcactttttgagcgcttgccagatatactcatatatctttacagtaatatggaattaatattccttatccctaagtgtgtgatgtatatctttacattgtgatagataccgcagcaatgttactttcgaatttgggaaatgccacaatgtgaatcatgctagtcttttcatgcatccatggagcttgataagcttggttagttggttgcatatccatggttgaaaagtattggttactggtttctgccagggatatatatacctttttggtcccagttattagcatccaaaaatgtccatatacctttttgtacgaatggggatacactgatatactctttggctcttgtatgctactgattcattttcttgtgtacctacaatgtgtgatggacccaaaagttatgcaacacactaccaataatatatcctctgattgaaactttcaatgtgcaaaaaaaaaaattctagataaatttgatatttcttgaaatggtgtggttgatgtgtattattctgtgcatcacagaaatgctgttgcttttgcaagtgagggttcctgggttatcttaattttcttctaggttctagccttttgagttatatggcttattatagtctgctattcctctgttctaggattaatttgacatctccttgtgaatcctggccttgtaatgataaggtagggaataacttaagggtggttcgtgttgttctctatatataggcaatcagtattctttgtgcacctcatacctttgtaagttaaagagtattattgcaatcattatcaaattttgtaagttaaagagtattattgctatcattatcaaatttcatggtaatggcatgatagtttttctgaaaaggaacaaggtgtatgaccatgccatgcttgcttgtcgaagctagggcagcttccagaaagcaataccgttgctacattgtggtattgttgcataatactttcaaggatgaaaatttgaatctctggatggctttcttttacagcttttggtcccttatactccggattcagggaatctcatgctgcacataagtaacctttccaattctctttacctgttctaatgcaatactggtatttctccacttattttgaagaaattaaagacattgcatttgccatatcaactacaccattgcaccatactttcctgctgtttctggtctgtatccaagcatatttgcttcagggtaacaagttaaataccagggtgacacgagtgacaagtaattagccagctgtaactctagtgtttttgaaggcttgtgttggttagcaggcgtgccaatcatgccggatagcttagaagcgttacactgtctttgtattcgtgaagataaatttggcagacgtggtacaattttttttaataaaaaatgtaaagcagtactagctgtttgcctcgtcgtagaagtagaagggatatattcatttggtgatgcggtatttgtgtaagcaaatggatgttgctaatgcttggcgtgtccgtgtggagaagaagaataaataatccttgcatagctttccggggtcagccgaaaatatgggcaattacaggacgtaagacatttctgtggtcaagtaaatgacgtggcaaattccagtttactttaagggacatatatttgcgtgggggccgtggacggctgacgtggaaatgggccagcaacctttatttgtagtgcttcattatattgcttgctgattctggatctggtcaaatcaaatctggatcgaattcttcacattcacaggttagagcgtactgcgtgtggcgagcagattaaccctctgttgatctggctggcaccacttgactggctaagctaaaatgctcttcttatacaaagtggctgtcaccatcactcatgtaccttgtttttcattttctttgtaagtattttttttggtcactttgttcttgtgggatataatcggcgtgttctttgcaatttgcaaaagaaaagcggggagaatatggcaagaggcaggcacagcacatatactagagaagatgatgattatgatagtgatgtgcttccagtccacaaaccggcctctatccgagctggtggagcgcctgctggtagcctggtagtatgttgtttgtttggcaacccacaattatcaataatacaagtatgtactccttttgccttgactaaacgagacatttcttatacaacgaatctggacatgtaagacatttctgtattctaattattttgggagagagggagtatctatctacatattgctactgctaagctattactactaggagtactccagaatctgatgaagacgattaatccaatccatcctgcaggctgcaggaggacaggagtggagggagacggaccaccacccatgtatctgcatctgtatcattcccagtggcccagatctatcgatatgataatgatgatgatgatgatgatgggaaagacaaattaattattgacttttcaaagcacaccctcatccgcctcgctgaaatctttgaccaggacgacgactactggagcctgcagccgcctgatgcatccaatccaacggtaacaaactgggggacctcttttcttatcttctcttcccttctgttattatagtactagtatactccatgatgaatatcaacggttttagatttcaattctgctagcatgtccaactatcatgcctacatactgagggagtagatagtactttttttttttttgaaaggagtgggagtagatagtactagcagctgtgatatttatttaacagcaaaatgggtgatttctggattcagagtttcagacatttcatatggatacatgttgcttctgtacgtttatggttcggtgacaaaatcactcaatgggtacaaattaacgagcctaacactagtaccaaaaaccaataacctgaacatatatggagtagttgcgaggaaattaaagaacgggttgttagcatagggtgtacatggaattcgagtttaagatactagtttggcatggctgttcaacttggtgaaatgagctttcttcttgagcaggctcccgaatttcttcagcaaagccttcttcttcttatgctggttgtgctgctccttgttgaaagacgacgtcggcccatgaatcagcggtccattcatctgctctacagctgcatcgtctccctgcgactcgatctcctcatcgtcgctcgactcattatcatcgtcgtccctatgcttgcttatgtcatcttctatgatcttgctgttctcaagagtcttcacctccattgctaaagcctcctcctttccatgcttcactatcacctgctgctgctgctgcttcatgatcaccgtctccacttcgacgtgcttaatctcatcctcttgggttctcctgttgctgctgttcacatcatctcgcacattgtccatgggcgagcagatcatcttccggaacatgttgtgctgcttctctgggctcctgatagccgccactccattagccgagtactctcctgctagcttcctagctgtggaggcctctgcaaccagtgaagagagctcatcgatcttcgcttgcgcagcggcctctctcgtccgcaggccgtcgtactctcgtgcaatgctcagtagctcctcctccttctccgcaagcgtctccttcaaccttaggctgctgattttctcttcttcggcggtcaggttggcctcggtcatcttggactcgagcagcctcagcttggcctgcagctgagccttgtcatccttggcagcatttgcttcttgctctgctgctttcagtgatcccagcaacttgtccatttccagcttcatcagtagtaccttggatttctctgtgccttttgccgcctcttcttcttcggctttcttcgcagttgcctctgctagtagctttgagagctcgttggcctttgccaaggcagctgtctctctgagacgaaggtcagtgacctcatcattcagagcaagcacttccttctcctttcttgacacaaggtccttgaggcctactgtgctctcggactcatcagctgtttgttgaacgccagtagatgagatgctactaccttctgaattggtgagttcagattgtttcagtttatcaagcagctgggttctctctgccttgagctcctgcacttgcttctctgcagctccaagtgacaccattagactgctcatctctgacttgatagagctcatttcttcttctgatctcctgatcatttctacaaacccggcctctttcgatgcccattcgtcgttggaaatcttggcttctgaacccagcttctcaactgtcttgctgatgcattcaacctcgctcttggattcatcaagcattagctggtacctgtcctgtgcattcttcatctctgccttgagctcggatatctgaagctgtgcactgtccagctctgtctgttttgccagtacacgttccttggcttctcttgcttccgatgacacttcgcgcagcgcagccgctaaatcttcgacggccttcttggccttatccctctcatctctggcaccatcgagctcctgctcaatcctgatcttgtcttgagacagcaggctgatctgcgagttcaccgtcttctcgttggtgacaacctgctgatgtgcttcgttgagcagcttatgttgagaggtcaagcgatcaatggtggcctgcagctgatgcgactccttggttgcaacgtcgaggcgcctgttggtctccaagaagcactccttgtactcgcgcgcttccttctccaaggatgacaccttctctttgagctggacgacctgggattgctcgtgctgcagcatggatttgcattcgtcgaagctgctcgtcagtgactggagcgagtcctcgttggatttgttgagagaggagagttcgtggaggcgagcttgaagcgactctgccttggtcttccactcctgggcggcgaggttggcatcggcctctgccctcttggcgtaggcgatgtcaaccttgaggccatggagaagctgctctgctctgcccacgtcctccttccgagacgcctctgcgttctggagctcggctcgtagcccggaggcctcggactccagcttggcgacgatcgccgtggcctcctctgctttcgtctccagctccgactggaggcgggacacctccgccgccagggtcgccgccttgtcggcgttggcgtcggcgatctgcctggccgtgttcgtggcctcgacggccagtgccagctcgtccttgaccctgccgagctcggcggcgagctcggcgcggcgcaggtcgatggcgtggcacctggcgttccagtcgcgttctttcgtctgcgccaggtcgatggcgagctgctcacgctcgatggacttgaagcgctcgaggtcgagggcctcctcggcggcgctctgagcggcgtgggcgtcatcggcgaggcggcgggcgagggagaggtcgtggaggagctgggccttgtccctgtcgatgacggccaggtgttcccgcgcgttcttgaggtcctcctgcaccgcgttcagctgcgcctgcagcagctgctccgccgccgacgccgccgcgggcctcgcattcgctccgcgcgctttctgcattctcttcgatccaccacatatcaaccgatcaatctaagaaatctataaaaactgaattcgttgatcgatcgatgagaatgcatttgatccaagttagttggggaaacgtacatcgggagttgtggcccgggatgccttgaaggatcgtcgttctggcttgggtatgtccatggaagatttgtcgagcagcgcattcgcattcgcatgcgcattgttggaggtggaagcagctgatgatggcctgacctgctgcagcctagcaactctaggcaccgatgaggaagccctgcagacgatttagctttgatcaccatctatccatcttgttactccaattaagagaatcaaatactagacatgaatacatatctgacgactgactattgatgcagcagcagcagtaataaagctagtattagatgccttaaaattaacacagtgcaaatgcaatgcagggagatgcacacatacttgggcttggatgcttgctgcattttgttggccggccggagcgtacagttttaagttgagagatggagcatgctgcaatgcacacagacaaatgatctctcgtcctatttgttagtatgagctactcctatatgatagtatcgatccatcgatgatatatccaggtccagtatggcaacaatggacgtgctgggctgtttcgtcccttaataattatggcatgcagaccactactctaatgttatacgcatgttgagctggtgatgatcgatacgatcagtgcttttgcctgacgttgatgcccaacactaaacacgattacatcatactctttaactcatggccccatgtttgacacacgtactattcttcttcaaggttttattttgcttgatgatttcttatttaaaataatggcatgccaacacaaacctgaattctaaactctaaaactaaggaattttgtggcttccaagttatggcaactttgaggaataaaaaaaatatagttgttgatgttttatatgtgaggtgtatgaataaatgcagttgcataagatttttgtctttcaacttgggccttattatggtccatttgatcactcagcctgtcgaaatacagctagtcgccccaattgtcttattatcaaagacaccaccaccattagtgaagtgtttgagagcacaagcaactatccagctccaaattaaggttcttatatattactgaatgtgatatttttgtgtccccaaattttggatccataccaagtgtataatataaaacggtatttcttgactataacagatgatttttttttgacaccaacagatgattcgttggttgacagtagtaccaacacagatgcaagtaaaacatgaatctgaattctgaagttgtccgttcaaaaaaaaaaaaaagaattctgaagttgtcgaggaaggagacaaaaaagtgtaagtttacggagtttgataactgggccattggaccgttcgaaaaagataagtgggccattggtatgaggcccagcagataggcataaggcgaggccagcccatggggcagtattcctttctttcaacttttggcagagtccatgcttagtggctaagctaaagcagaggaggacgacagacaaactcaagtgaagactggagatttctttctttctttcattcctttcctcctgcgagtgcgagtgcgatccggggcaaggcaaatccgattccgagctcagaggcatcaggcgtcgagttcgtcgatcgatcgctgcagagaagcagagagagatcgagagagatgtgggtggagattctgtgcgggctgttggcgtacaagatcatccgccgcgtcttcttcgccgactccgacgaccccgcgcacctcgccgacctcgattccgcccactccgacctctgcttcgccctcgcctccaggttccgtctcccgccccctcccctaatcctcccccgatgccctaaatcccctatctccctccctccaggctcgagaagctctactccgcccgctgcttcgtcggcctccgcatccccgaccccgacgccggcgagcgccagcatgtcgacctcgtcctccttaccaacaggtacgtccttcctttcgtccccccgtcttccgccccattagtacctctaccctacatcccctgcttattacagatttcttcaattctatgtacggatttgtaccacctctctactgcacctcacaagttcacaacactagaatcgaccaatccacactggccttcactgtaatttgcataccgcactacaattcatggatcattaatgtgtgcgtttgtatcatccatgttcaattacttgtggggatattgctttgtgcaaccaacttctcaccttctttcctcaacagggaggtcatggtagtggctatccacaacatttctggttttgttgaggtcgataaggatggcaactggacttgccccagtgataagaagaacaagcatggtgttatcccaaacccggtatgtcatttatttccttcactgcctcattatgacccattgccattgcctcttgcagtaaggcaccatgtatattgcaactcttgttttcattcggtgctatactcttgggtgaaaaaacaaaaaacaaaggcaacatacataattaggctccgtttgacattttggtagattatggtcatcttgcttggtgcaacttcttttagacatttcagcgttcggcaaatttcttttctctcgatctttgttgcagatgataactattatgttccgaaaatttggaatagttgtgagaaacataacagttgatggcatatttttctaaccttaagtttatataattaaaaggaactgtaccgattataaatttccatttccacagcaacttcaaagtaagttataatgatgctaactgtcattggtcagtgaggcttacaacaaactctaacctgtgtacagattctgtcttgtgacgaaaactcttcatgttgaattcttctgtcagtaaactttatgctgcttagtcccttactcccttgctattattgtcttccaaaccataaacatatgtgcatatcaggtcggaatctgatttgggattttgagtgtttgagcgtgcacagttgatagcccttctcatgttgagcattttgttttgctaattgtttcttacattttgttctgtaggtactgcaagtcaatagactggctgccaatcttcaatcgtacttggagaagaggggagcaaaactgcctgatggtcatataactggaaagattgtactgccaaatcccaactgcaggttagttcttcatattgagctatgttctttgtgatcgtacttgcagaatttttctttctgttttttgtttgtctttttattttttaagttttaactatctaacaagtgctccaccaggccttcctatgccatcactcttcaaccagaagttatcttgtacgatcaatggaaagatcttaaagcagattccaaaggtggactttcaacatggattaaaggtgcattcagtggaagcaaaggtgacatgcaagattcgttactccaaaatctacatttcattctcagcacgtcgcctatgtgggacaggtaaagaacatggccatgaacacttaaagcgaacagccaagaagcaatctaaaatttattccgataatcgaatcgcagcctatcacagaacatccgttacctgttagttctgcacaaagatgtagaggctgaggtcaaacttttatagttgatatttccttgtgtaggttggaactcaaaggggacaggaatattcttggtgaattcattgaattcaaaggcaggcacgatgatattcaggccttgaaatgtctgaagagatcaaaagtttgccgattcatagtccagaaatcaactctgtttggaggttttggtaacttttctgcactgtaccttcttgttattctgtttgcgaagcactcctgtgaacgtacatgggtcgaataatactctaaggttgtcagaaaaatgcatttgtttcctggaagctatgctagtacaaaatgaaataagaaatgagaatagatcaactgatatgcacggaaattgcttattgatgtcttgcactaattcatatttgtaaaataaaaggtgatgtcttgcactaattcatatttgtaaaataaaaggtaaattatataattcagtagcagtagatgattctgttgtcataaataaatgagataattagcttgattgacttgctacatttaccttacctggtcgttttgttattgcattgcaggtcggtcaagagtgcaaatattgtattcaccacgagattatcgtgctgaaggaacttcatcctctgaatggaaagagatatcagtgaaacaatatacagaaattctttttcagccattgcactcgaaaaaagttaagaagttcaagctgtcaagtgttgcttctgtgacactgagtgcctagtgagttgaaattttatccacggggtacttcctgttgcagtagtatatagagtaccttcctggcttctgtatgtgctcctcagttaaagtttgtcttgttgtttctgtacaccaacctgtacttactttaagatgtcagttagcatgaaattagaaaaaaatgaatgatttgaatatgcctcttaatcgttgatatttagtttcatatctgtcactggaagcggagtccctatcccttcacagtattgctggtagggattgtcggtctagtttattttgttctttcttcatctatgcgctaaagatgtgagtggtcattttctcttctccggacccacctcattgattcacaagatggacctggaacatttccttgctggccatgtgcttttagtctatgaattcgtatgcatcaagaaaatcgtgtacaaattgtcaaggagttgtgttgttttgggactaagggcagaaagataagagaaatcgtgaactgtaatacatattgtcaacgagtgatgttgtgttgcgactcaagagagggcagagagataggagggacgtttacaatgctatctgtatctgactgactagggtctccgtcagatgtcaaacatgattttattattattatttcccatggtttttgtttaaaggttggtgatcttgacctctttggatagggtatttgatgtttgtcaaagttgtggttaaaccatgataatggatggatacattaaaactgatgtgcaactatatctttctcgtcccttcaacatgactacatcacaaaatggctttgcatagagagttaacacagctgcaaatatattttcctagtgtttgatcacctagggattttgtttgttggtatataagtaatcattgaaatgatcttaccctctgtaagaatggaatacatgtggcagcttggccatgtacaacatgtacatttgaccaaaccaaatttccctccctttagaggagaaagaataaaagaaatagaagaagatacaagaggagtagtacatgtctagttgcacgtgtgatatataaaataaaggaaggcaaatcccctagtttaatttaatttatgtccccgtatacgccactggtgaagtccagcatgagtttgttgagcttctttgtgtggatcctctgtgggatcaccttgagctcatcactgcaatttgcaaacaaataaaaaggtccatattaatcaattgatactaattcatattaattaattaattaatctaatctaaatgacgaagaagaggaagacgatgaaggaacctcggcggcgcagggggtcgcggcgcggcggcggaggagatgagcatctgggcgagcttggcggcgtcctccgggcggcagatggcgttgttgaagcagaggtagcgtccgtaggcggtggggcactcgtaggcggcgatgtgggcgtcggcgaggaagtcgacgtcgacggtgacgaggacgccgtggtcgtacatgtcgggtgcacccttgaggtaagggtggccggcggtgaggccggggccggtgagcaggccggcgttgatggccaccatgtctactcctctgtccattgccagggcccacgccgtcctctccgatagcgtcttggccagagcgtgccacagctgcaattgatttaaacacaatgtcactctcactcactgtgcaattcttcttcttcctaacacaattcatcaataagctataatccgctacttggatggctgtcaatttcatgatccaatgaacaagtaaattattaaaggagtctgatactacctctttttttttaagagacaatccattatatgccactgagtttgtcatagctctacgatttgccactgactttgtcacgttctataatataccatcgacttttacttaacttctatgatttaccattgccgtccagttagtctccgttagtactgtacaattttgtccaaatgaccaaaata

SEQ ID NO: 58865 - DNA, 5828 bp, Oryza sativa
gcaccgtacgcactccactccctgtacgcctcccacacgtctctgaggaagaagtgcggggcctcctcccgctcggcatccacgccgcagccccgccaccccctcgcggctctctgcatctgcatcccaaatccaccgccgattcagaaatggtcgcactgccgcaagtaattactacgatctaaccctaccacgcgaggaagtcaaagggcagggcgaaccttggaggggaactgagcaggcacgaacggcgtcacggcggccacgaaccgctcaaggttgcccgcgacgccggggggcgggaccggcgccctcgccggcgacggggacggctcctcggccgccttctcctggtggacggcgggggcccacctcgccttggggagcccgtggtggtggtaccctcgccggaccctggatgcgtcgtagaagcggtggtcgccgccgtgcctccggccgagctccacggcggtgcccatcatcccacgcgcggcacggcacggcacgacgcgacgcgaccaagcacaccccgctcaccctccctggacgcgctaatccggcgaggaaggcaacgaatagacgaaaccctaaccctaagatttggggaaacctgctcgattggaggaggcgccaagccaagccccaagccaaaggggggaagaggagaggaggaaatggaaaagaaagggagaggaagcaacccggcgccgaggggtaggtgcatttataggaagaggaggaggaggaagacggggaagcgcggggggcagaagcgggatttcgcccgcgcgagcctggtatgccacggctcgacgctggcgggtgggccccgccctccccccgcgggcgtggggcccacctgtcagcgcgtgaggcgggacgggagggagaagggggaggagaggaaggtacacggttgcgggatcctccgctcgtgattggtcggcggctcgcctctccggatcgaccccggattacgcacgcacgcacccaatccgcacgctggactgggctctagtgctctacacgcgctcgcgccgcattactgacatgtgggaccaggcgaccgcggggcccacgttacagtgggtgcgtatgttctggggggggagcgtggcgggctgaccccgatcgggcgcactggacgggacgccgcgtgtgcgggcggcggaacacgtggacggcgggggaaaggggggagcgtgtgggccctgtcctgtcggggtcgagctcgagagcctcgggatcgggcaggtggatcgcgtcgtggcgcgacgaggggagatagatcaatcgcgtcggatgatgtttttccctggcgcgcacgcttctcgggacaggtcgctgacaggtgggacatattggacgtagtaggctggtcggtactatgtcagtgggaggcgtggttttggagtttgggcatgctgtgttgtcaaacaacgtgtccgtggacggttggtatttctattgcgggaaggtacggctaaaacgtttaaaccacgtgatttaaccacgaggttatggtgctaacagaaccgtccccttgcacacgcagttaaaaagcatttccccgtcgtgccaataggcaaacgctccccatcttcgacccagtggagtagaatttactaagagcaagaataatacagtagagtccacttcctactattattccatcttaaagccaacatatataatgtattaactataaggttggctacaactttcttcttctctctatctctcacctatacatttaatatatttacttaggagcttgtgttaaactagctcttgcatgaaagccaacatccttgattttttattatctgtcacctctacctaagcttatagtagatttatagctcactattatacttcctctaagggcaattgcaaagactgacactaaaaaattataaaaatgcaactataactgttattcaattagcaactttacaagattaaaaaaaacggtggcaaatttacaaatgccctaatttataaaccattgccaaaatttaaattttatagcttaattttatagcagcacaccaataaaaataatattgtgagatggatatgataacagtatctaagatgtatgatcttggtgttattaatacagtgttgatccttagttgcaaacacgatggcggtaaaactctaaccatgctagcattaaattggactcatagtcacaggcaccactaaagggttatttggttgtttgatttggttgtttgaaccactctggcacgctattaggtataaagagggtagtttggttgctacttgggctacgttctttgcaaacttttggaggaaaaattttaaaaaccgaaacgataaagctcagtagcacacgattaattaaatgttaactattataactgaaaggaccttgatgtcgcctagaggggggtgaataggtgatttttaaaataaatgcggaagctaaaacaaaacagggtcggattgtctgatatcaggtcggatagttctatgtgatcggatagtctgaactgagatcagactatctgacctgcacaacaacaatacaaacaagataacaccctaagagatctaaattcaatccacaagcaaagaggtgagctcaaccaacaacaatattagcatggcacaaagcaatgcaacaagaaggtaaagagagtgaggatatcaccgaggtttatgcgccgatgtatttcccggagttcaaatccttgaggggattctagtctccgttgaggggctcgcaaagagccaggtctttttcaaccctatcctcgtgatgttgcacaaatgcactcatccttccactaagggtatctctttccttgcggaggcgagatccggccttcacaaacttctcttggccaaccacacgtagatcggtggcccaagaacgacacctagccgtctaggagtcctcaacctccaagagtaataaacactgttggaaatatagtcatgaatcggcatattttaatccaaaatgttaaagcaataatcatggcataagcggtgtagggtgatcttaacataaccagtagcataccatgcgcatcatgaatgtcaggaacaggaacattacagtaacgcaataacatgctagaggcatcatgaatgtcaggaacaggaacatagagcacataacagtaaagcgatagcgctaacaaagggaataggagaaggatataccccgagaatggccctccgctggattgtgaggcagaattgcctccgttgatgttgtcgttcgcggcaccggctccagctcctggcgcaccaccttcggctccagctcttggcggcgcaccacctctgccatctcctccagcagcggcggcggcaactccagacacggcgagcagtcgtgcaggaggcactccccaaaaacctgatcacccgcctacccggtgcagatctcaggcgaagatgtggtttcggaggcattgctccttccaatctctcgtgcgcgcaagagatcagaagcgaggaagcgataacagcactggcgcggaggaggaggaactaacatcgggaaagaagcaagcatccggaatagatcggactcgcggcctccttatctctcaggagagagaggcagtcgtgggaacgtggacgcgctgttgcggagagaatcgtgggaacgtggttagtggctgcaaaagaatagcgacgtgacgcacgcacgccgccgccagccagaccacgcctcgcccacgcccacgcccacggcctcggcccggcgcgcgcgcgcgcgtgtggcattccgacctccacctcaaccagtcaacagggggcctccaataactccctatttaggttgagatattcctcgcttaaatcctgaggtggtattattatccttaacacttattatgggcctttgagatttaataggataagttgggcctaccccaattattctaacaatccccaccaagtttcaaggctcataagaaatgttctcaatgttgtgcctgtttgatataccagggttttggtggagactgttaagttgaacttccacctaggaaatgagctacatcagaccacaactgaacaatggactatgccttgaattgtcagttttgtgtgatcaggtttcactcagaaccttgactggtactgggctgccgttcgcatcccctctgtttggagcatataagtcaaactccaggcctttcatgagtatctagagatcgcccaaacctcatagactgtgactagcagtcgaactcatataggtgtgttccttctgagatgttctgcaggtcaacatctctgcttggagaagccactcggatcacattaaggcatgagccatcctaccatgcaggaaagaagagaagcacatcatggaaatgagcccttttcaagggtctcttctctcagtcacacaatagtttgtttcgccatccaaattcacaggatctccgatcacaatggacaggtttccactattgtgcaaccttaggtgggtatcaagcccatttccctcgatgcactgtctatcacattacgtggtagccccttagtaaactgatctgtcagatttctagccgtttggacatagtccaatgctatcacttcggagtttttctgctttctgacagatttcagtcttctcttgatgtgcctagatgacttcatgttgtcctttgaactgttcactttaataatcactgtttgattatcacagttcattaggatagctggcactggtttttcaaccaccggcaaatccatcaggagttcacgaagccactcggcctcaactgtcgcagtatctagtgctgtaagttctgctttcattgctgacctcgttaagatggtctgcttgcaagacttgcaggaaacagcgccccctccaagtgtgaacacatatccacttgtggcttttatctcatcagcatcagatatccagtttgagtcactatacccttctagtacttttggatacccggtatagtgaattccatagctcatagtgccctttatatagcgcattactctttccagagcctgccaatgatcatctcccggatttaagacaaaccggctcagcttgcttacagcaaatgagatgtcaggcctcattgcactagccaagtacatcaatgaaccaatgatttgagagtatctcagttgatcccttgctatttttcggtttttccttaatagcacgctgggatcataaggagtaggagctggcttgcggtcactatatccaaaccaactcaaaaccttgtccacatagtgggattgcacaagtgtaatcccaccctcatctcctctttgtagtttgatgttaagaataacatcagcctctcccaaatccttcatttcaaaactcttggacagatagtccttgacctcctcaatcacattaaggctggtcccaaagatcaatatgtcatcgacatataggcacaagatcacttcttctcccccaccatagcgatagtacacacatttgtcagcttcgttcacaacaaagcctgcagatgtaagcgtggtgtcaaacttctcatgccattgcttaggtgcttgcttgaggccatacaaggatttcaacaatttacacaccattccctcctgaccttttagtatatacccatctggttgatccatatagatctcctcctccagctctccgtttaggaaagttgtcttaacgtccatctgatggacgagaagaccatgagaggctgccagagcaagtagtactcgaatcgtggtcaagcgagcaactggtgagtatgtgtcgaagaagtcctcgccttccttttgggtataacccttggccacaaaccttgcct

SEQ ID NO: 58866 - DNA, 4985 bp, Oryza sativa
cctatactacttacacgagattggaggcactaggcctcagtacatggcacgcgtgtataccttattaccgccgggaccaactgaaagaagtcagtcccggataaagaggggaaaaaaaacccgggcgagggacgagcgtcgagtctagggggtcgaaccagactcgtaggctggtcggcacggagcgagccactggctcctgccacccgcgcgtagcggtcctcgaatcaatcaatttcctcccacgggaactccatggtgatggtgggctgggccagtccgggccgtgttaccatctgcaacttcgtgccggccgggcccagtacgggaatcccatcccaacctccggcaggagcccaggacggcacggcgcaagtatccttgttcctccggctctgctcctcctcctcctccttccaacaagagttgattctacagtacagatccctccctcctccaagctttcccatggcgctgcagtacgtggaggcacagcgccaggcgcgccccgacctcgccgacgcctacgccgacctcgccgacctctaccagcgcaagctctggcaccagctcaccctcaagctcgaccacttcctccaactccccgccgcccaggtctgcacttttccccttcctcttagatgcgcctcttctaggttagccactgccccccatacggatctcgccgcaaaccctacccgccgcgtttgtaggtgctcgatctcagccctagttgagttggccctgccctgataccgatccggccgccgcaagaagccaccactttgtgtagacttagctgaatgtttcaatcttggattacttcaacaaccatatgcttagggttttaactgatgggcaatcctgcaattctaacggcattcattctcccacagactggcgacaccatcatacagctctacaacaatttcatctctgacttcgagacgaagatcaatcttctcaaacttgcccacttcgcggtcatcgcttcacgccagtaccctgacaaggatgccgcgattagtttcctcgagggggtaaccgcaaaactgcgcgagacgagggaacggcgcatcgatgaacccgttctctatgtcaagatgcagatagctgcaattaaccttgagaagggagatcaaaaggagtgcaagaagcttttggatgaagggaaatccacccttgatagcatgactgatgttgatcccacagtccatgctagcttttattggatatcatctcagtaccataaggcttgccaagaattcgctgaattctataagaatgctcttctttatctggcctacactactgtggagtcgctctctgagtcattcaagctggtattaacaatgccaattacataacagaaaaaaaatagcatttcctcctctcattagttagtttaataacaacatactgtgcatattgtttgtattgataatttaccctttgacactgtcatgtgtcaggatttggcatttgatctctcccttgcagccttgcttggtgataacatatacaactttggggaattattagctcacccgattgtaagttgggcttttcttgggcatgatttctttgttcccactgcctacctttcatttagtcatatcatttgtgctagttgattacttgattatggcattaactccacttgcctctataaacgttacatgcggcttgttgtcatcctcaggaataatcagtttacaaattatgctttgtaatgtgaactgcagggctcccaaagaagttgcatgtgtgttatagtagttaggcttcgtggttttgtagttctgtacgcagattaacaacatttattgctaaattggcaacagtaatttcatgagttgaatgtatggagttaagattgacatgatttttgctatgtagcgaatataaaatacaatgaaaaatcatgtgataacttgtgattgttttttggctgaaatttcaataatgtaaatgtaaaccactgaattgttattacggaagctttgtactttctttgaatggaaacagcgtaaacttaattttgcataaattaacggcaaaccatctttagttgaaaattaacttaggtgtactaattttttgttgggaaaattgatattgacctgtggaagccttcagcccccaaacagaattattccacaaatgcgtacaaggtgtttttttaatgcttgaatggcccctaaatctatgtcagcatatagttgtcaatttgatacatctctgttctgaaactgctattttttaatccttagatcaacagtctaattggaaccaaggtggagtgggtctatcatatgttgcaagcattcaacactggcaacctagctctctaccaagaactttgcaaggtccacaacgctgctcttagtgcacagccagctttggtgcagaatgaacgaaaactgctagagaagatcaacattctatgtctgatggagataatctttacgtatgactttgctacttgcttttatatgacaagaacaaatgccctattccatcgttttctttcttctaaaccttgtgttctttttcatattgtagccggccatcagaagacagaactatcccattaagtgttatagctgagcgcactaagctttctatcagtgatgtggaatatcttcttatgaagagcctctcggtaactgcatttcctactttctatcttccataagatattatttgcattttcatggaaattcattgttgttatgcataaattgattttaagcttgggagttgctgccggtttatgttgcagctggatctggaatagtgattgttgataacttgtgatgcatatcactgctgtcaattccttgactttcttaacttgtaatttacttggtgattctttatggtttgttttgtgaacctttagtggtgagtaatgacctacgagtgtgttggcagttcaactagtcctgtgattcatgtcttttcgtttggatgatcacagccctgtttcttttcttgttgcatgtcacttccttttgccttaatactatttcagtgtttgcacaatgcatcagccagtattcctagtgctaatgcatcagcttcattaccgttctttccagttccacctttttcagacttccattacagtttctttctaaatcattagtacatgattctcaccctgaaaagcaggctatctagtacttcctctgtttcacaatgtaagactttctagcattgcctatattcatatagatattaatgaatctaaacatatatatgtgtctagattcattagcatctatatgaatgtgggcaatgctagaaagtcttacattgtgaaacggagggagtagtcaaatattgaaattattttagtcgctagtgtatcagctgccatgcattttctccactgcaggttcatcttatagaagggataattgatgaggtggacagcacagttcacgtgtcatgggtccagcctagagtacttggaattccacaggtgaaggccttgcgtgagcggctggacgcatgggtcggaaaagttcacactacactgttgtcagttgaggcagagacccctgatcttgtggctgcataacttatcgaccacttgtcctttcgctatacgagcttggtcaacaaggctgcggtgcttaatgagaggtgatctggctgtggtgcttatagttttctggagaatgagaacatgttgccttggatatttccctgcgtcctgttgatcaggatctgtaatttcaccctttcttttatcctttgggcattgagtcctggagctatcacggaaaagatacaaacgggccaaaagtttcataccggcaagatgttatcgtagttcttttagtcaaatttagattgtaatgcagaggatattttccccttttatttttacatggatgcaggaaactctagctgattcccgttgtgttaagaggctggtgcagtagtgcatgacgtttggactggcaaacagggagcgcttattcgttgtgcgttttggtgaggtgctgcatagtgcttacaatacttttttttcgaataattataatttaatgaaattttgcaaaaaaaaaaaagaaaaaggaccaagttctaaaaaatcagtaacctatcggcaattgggtgccgacaaggaaaaagatcccatggggcatcgctaggctaagtgtacaatctatgaaaatagagctataggaatgcatgcacatttcaatccatagaaatttttcaaaaggtttgagtggatgaaatttttcaatatgaaatagagggagtagattttgcaccctacacgcactcgcattctgaactttcacttttttagtctagccaacaactctatcgacaaccgttagacgagcttttgacatcacacatccagctaatcgtatggtgaccgtctgatgtaacatgttcgaactttgattattcgatatggtgttacacttgtgatttccagccaaccgacttctatttttgggaatttgctaaaaaactatcgcaagtttttctttaaaagaagactttcaaatataattatagtatattttagactgtcgacctatatttttggcaaattttaaataaattgccgtaagtttttttagataaaaagctaagggcctgttcagattgtagccaaaataaatcttaccaaaattttggcaaattgacaatattgctaaaattttgacaggatttcctatgtatttatcaaatttagcaacaaactaaacgtaaaaattttttgacaacttaaaaaaataatgatatgattgaaaatagcattaatctgaacagcccctaaacaccaaggcactctctaggcaagcatcccaccttcgtcgacccactgctgccggcctcgcgagttcacccaccaccggagccgatctccatctcgcgagcagcaatgcgggcgccacaccccccccccccccttgctatttctcgtcgtttgctggtgagtatccgtc

SEQ ID NO: 58867 - DNA, 32372 bp, Oryza sativa
cttacattgtgaaacggaggaagtagtacatagggagtactactgctgcagctgcaaaaataccagccgaacacaaaagtgtttctacctagaatttttgtagatatgctctcacctccctccgcccgtcgcctctttcgccattgcagcagccggcgcgcgtgaatccatgcagctagcaacggtgtgagatcccgtacggcgcagggatggcgatggcacgaatccagcaaggagatggcagccacgtttgcgtatggagaacccaactgctggttgaatcctcgcatactaatactagtggtattcataaacttcaagtcttattactactccatgacttaaaacagatcgagattcgagcagtacccaaatccatggggctcaaatctgatttgagggagttgggcatggcagcaactagtagttggattctaccacattcaatccaactatagccaaagttcaatccatgcccttctaccgcgaaaccagatatagaggatcccttgttccgtgaaaccagatatagagtgtccctcaattattaaaactagatcaatttaggttcctaggcggttgtgatggtggttttgtcatgcgtgacgtcaatgttggcatttcaattagaataaataaataaatgaaatatgcagaccttacatatcattggcatcttcttcctctgccctctctctctctcatatcctcttatttctctctccatcggtgggggatgggcatgagataaagcgttctccgtcaacgggagcaccatgccggagcatgctctcgatgacagccatgacgttgaccagggcaaggaacaacgagcgtgcggatagcctactggagcccattgagctcaccattttgatcaccaatgccgcccaagccacactgcccgccggatcgggaggcatatttggtaatgctgcaccccttcaccaccgggttgcactcgtcccatgctccttcaccaccaggagtgccttgagcaagaagggggtggaggagggtgttgtgattcagtcagcggcgtatgccgcacaaagaaggctgcatgttcacagcctaggaggacctagtgtcccagaccatcgagcgaaggaaggcgactatggtcttatacacctcgatggttgtcgttgtgccgcccacgacgagaaggctacaagaaggcaccggtgctagtgagaggtggtaaaaagggctcttgcaagtgggggacattgtaacaaccggccctctagaacctcgtagcgcaacacatccgacgggtgggcacacttacacataccacctcacttattctttcatccttgcttcatgtaaaagggttaacccgagagtgatatggttggagtgtcatgcctttataaattggtttcacccttgctaaactagtattgtggtactaaacatacgcacacaactctcatgggctacataggtcacgtcctaattagcgtatgacatgccatgacatgtgcctcacgcgccatatgcccacacattgattcatacgcacaatcacgagggtcggctacgcagacagttctcatgggccacataggccacatcctaattggcgtatgacataacatgtgcctcacacagagcccacacgtgtcatgcgccatgagcccgcacattgattcgtacgcgcaaccacgagggtcagctctgataccatttgtaacaacccaccctccaaaaccgcagagcccaatgggtcggcccacttacatatatcatcccacttacactttcgtcctcgcttcgtgtaaaagagttaactcgggagtgatatggttggagggttaggctcttataagttagttctacccatgctaaactagcactgtgatactaaacatgcgcatgcagctatcatgggccatacatgccacattctaattggcccgggatgtcacaaacatccacaatgatgtgctagagcgtgtcctggacagtcgcacaccgcaccaggagcttgagcttgactagagtacaccgtcgtgcaaacctgcttctccgcatgccaccaccctcgctaatgtagtgagcctgaactccgccaatgatgatgtcaatgctcgtagatccaacaagggcgcatgggatgagacgcgcggaggcacgtagggtgatgagataactatcgttgcccgcgtgcatccaaatccccatgtcgttccgccaccgctgacagcggcggtcgagcttgggcacaaccacccttctcattgcctgtggtagcgcacggggacttggtagtgtccattggacttcaccatcttcttgctccatggggggggggtgcgttgtcaccttcatgtccatcgctgcggccgtgcaactccccatccttcctcctcactcccgcctttcgatcttgctcgtcgatgggcacgagcaggatctccggcggcgcgggcggcagcggcatcgtgttcaccatcgccaactgtggctagggagggagaggagggaaggggaagaccacatagcttgcgcccgccgttctttgagctcgttgcgctccatcactgcccacctttagtagtgagaaagcggaagtggcggtggccgatcggtgagggagcatgaggagggagggggaatgttgggagagagaggggaaagaaggtgccgcccgccaggggagatagagaggtgagagtgaagtgggggaagtaggacccactgacaagcattttgtttatttttttaattttgcttataatgacacttcaacaccgcacgagacaagggctaagtcaaaacaactaaccatgtaggtatccaccaaccaatccaaaccgtttttggatcttgtctgcactagttttaggatttgagagacgtgttatatctggtactgtggtaccaggacgtgattcaaactctacgtcaagacaagggatcctaagtgaacttattccttgatttgcaggtgggattgggaagaggatattttcctttccagtgggttaggttgggcagcggaatgataataggcttttggcccatattccattccactttttaaaaaaattcctcatgcatttgggctgttaaatttctgtccttttcttttgtgagggtaagagagacttattaattgaacataaggagcattacaatcttcaagcaatagacgttgataccgtccagagtcgactccagctagccaaagagcactactacggcagcgtatagcatgctgagctagctcatgtgatacctttgtttattattttgttcttctgtttaccttggcgatacagactccaccaaataatatgtgaccaaaattacaagactgatccatactagtgccagaagaaaccgaatttgcaatttgtgtggaaatcctgtccttagcttattaggtgaaggaagtaccaactagcaaggagcaagtaattgtcagggagtgtgatcctgaagaagacaaggacaagagaagggagccaagtattgagaaggcagaagaagcaggaagacaagctgaagacttgggccgtcatccagctcgtctgaggaggcccaataccaaggtccaaggcccagactgggttgcgtgagtcacttgctcgcctgtgagctggcgtgatgttggtgttagttaaatactgttctgtaaactgaattaagacattgaattggcaactggaggcgtaggcggcggcggctcgatcctgttggatctgagaggaaactatcatagtgttgccaaattatgtgtgtgcttgagtgaatccttgtgagccctaacaatctggtatcagagcccttccgtgctgcatttcctcttgatttggctgtaaatttttctccagagcgaggtgggatttggctgcttcggcggtgagaaatccacaaaagtttcggctccctcaatctggttggctaaattcggagagcatgtgagggattacggtccaaaactagccatggatctagacgccaagtttgatctcttgttcaagaccattgctgacaacgagaagaagaggatggaggcggaggagcgtaccagggcggactacttggagttgaagaagacggtcgagggccgcataccggcgatggagaagaaggtggaagaactaggtgagtcgctgcagtccttgagcaccaaggtcgagcagctggaaggcaacacgatgcggcaagtcaagtttgaaccattctctgctgcaagtgcttcgggtgttcaaggaggagctaaggaggagcagttcggaggtgttgcgggaatgtttactcctaatggtacgcctgagaaattttccccttcccctattcctttcaattgcgattcggcatcacccacttttggtaacggaatggggacaatgaatctaagtagtgctattcctcctatgacttgccctcaatttactggtgataacccccaaatgtggaagtcaaactgtgaacaatattttgatgtctatggaatattgccagttcactgggttaagattgcaacactcaatttttctggtaatgctgccttttggtttcaatctgttagaaatcagatgagtgggatttcttgggtgtctttgtgtgatttggtatgctccagattttttaaggataggcagcaagctcttatcagacaatggttccatattaagcaagagggcagtgtttcagagtatgtggaaaaatttgatagtctgatgcatcagttgctagcttattacaactccctgttgcctgtttactttgtgactaagtttattgaagggcttagaagtgacatcagaatggtagttttggttcaaaggccacaagatttggattcaacctgctcagtcgcattacttcaggaagaggctatggaaggtgttaagttccagggctacaagagaccaaacaattcagttatgattagaaacaactcaccagccccgatagttggacaggcctccacaccccagaaaatcttctctcctcaaattactgaagatagaaggggcactgaagctgcaagagcaagagatgacagactgtcagctctgaaatcctatcgcaggtctaaagggctctgtttcacctgtggtgaaaaatggggtaaggatcataaatgtgccacagcagtgcaattacatgttgtgcaggagcttcttgatattttacactcaaaatctcctacataaattgaatcttctggtggagaacaagaaattgatgaagtgggagatttgatgtctatttctcaacaggcagtttgggggactgaatcctctcgttctatcagactcatcggctgggtgcagggtactgaattattgatgctgatagactctggcagtactcattcctttatggatgaaacagttggttctaagatggtgggtgtttctccactcaggaagcccttgtctgtgcaactagctgatggtgggtccttgttatgttcccatgagattgctaattgtaagtggtggatgcaagggcattctttctctagtaatttcagactcttgaacttgggtggctatgatatcatattgggcatggactggttggagcaattcagtcctatgcaggtggattggtcacagaaatggatggaaattcaagttaacaaccagcctgtcaggttgcaaggtataacttcccagactaacagttgcaatgctatctctgctgaacaatgcttgggtatggctagaaaggggtctattctgtatttggtccaattgacatcttctgtttcagaaatctgtgacactatgcctgaagcagtacataatttacttctcaagttccaggatgttttttcagaacctactgaactccctcctaagcgatattgtgaccatagtattcctcttgtacctgtggcaacacctgttaatttgaggccataccgctttaatcctgctcttaaggatgagattgaaaagcaaatttctgatatgttgaaatctggagttatccagcctagccacagtgctttctcatccccagctctgttggtcaagaagaaggatggtacttggagacttgtcattgactatagaaaattaaatgccattaccatcaagggtacttatcccatgccaatcattgatgagcttttagatgaattatctcaggctaagtggttttctaagttagacctacgagatgggtatcaccaaattagaatggcccctggtgaggagtataagacggctttccaaactcatactggacactatgaatacatagtaatgtcttttgggctgacgggagctccggctacctttcaaagtgcaatgaatgatactctgaaaacagttctttgatgatatcttgatctacagccctgattttgagtcccatctggatcatattcaccaagtactagccttactgtctgaacatcaatggaaggttaaattgagcaagtgctcatttgctcaacaacaacatacttatcttggccacaccatcagtgctaccggtgtccatactgatcagagcaagatccaggaagtgttaaactagccagtaccaaccactatcaagaaattaaggggtttcttgggattggccggttactatcgaaaatttgtgaagggatttggtctcattagtaagccccttacaaatcttttgaggaaggatgttccttttgtgtggaccactgcaactgactcagcttttaaccagcttaagtaggctctggtgactgccccggtcctagccttgcctgatttcaagaaggtcttcattgtggaaactgatgcttctgaagctggtattggggctatgttatcacaagacaatcatcctatcgctttcattagtaaggccttgggtccaagaacaaaaggcttgtctacttatgagaaggagtgcatggcaatcctcatggcagttgatcaatggaggtcttatttgcagttgggggagtttattatccttattgatcatcatagtcttatgcacctttctgaccaaaggttacacacaccctggcaacataaagctttcactaaactccttggcctcaattataaaatttgttacagaaaaggtaccagtaatgctgcagctgatgctctctctcgcaagtttcaggatgataacagtgaattgtatcacatttccagctccaccccactctggttgcaagaagtaacaaaagggtatgctcaggatcccttttcccttcaattcctcactgaattatctgtctgtccaacttccaggaagcatttttctctctctgctgggttactgaaatataagggcagagtttggattggtaacaatgataatttacagcttcaactcatgtctgcactgcatgacagtcccattgggggacactctggctttctagttacttataggaaaatcaaacaactgtttgcttggccaaacatgaagaaaatggtaaaaacctttgttcaccagtgccaagtttgtctccaggccaaacctgatagagcaaagtaccctggcctccttaaacctctccctgttcctgaaggagcttggcaaactatatccttggatttcaatgaaggattgcccaggtctgagcattctgattgcatcttggttgttgtagacaaattctctaagtacagtcacttccttcccttagctcacccatttttagctctatctgttgctaagctgttcatgaaaaatatctttaagttacatggtttgcccctggttatcattttttttagagataaggtttttactagccaactttgggaacacttgtttgagggagctggcaccaagttacatttcagttctgcatatcatcctcaatccgatggtcaaaccgaaagggttaaccaatgcctggaaatatacttgcgttgttttgttcattcagttccttccaaatgggctgcatggttgcatctcgctgagtattggtataacacatcctatcactctgccattcatgctactccatttgaggtcctttatggtcatcccccaaaccattttggcattggtatttcagactgttctattcctgagatggatacatggttcaaggaaaagaagttgatgcaacaacttgtacagcaacaccttcaccgcgctcagcagcaaatgaaacactttgccgacaagaaaagaagtttcagaacttttgctattggtgattgggtatacttgaaacttcagccgtatatacagacttctgtggctgtcagagctaatcacaaattatcattcaagtattttgggccttttcaagtgatttagcgtgtgggcagtgtggcttatagactttaattaccacctcatagttctatccacccagtgttccatgtgtcccaattgaagtccgctgttggattctctggtcttgttcaatccaaactgcccactgatacttctacattgcagtttcccttgcatattttggacaggcgtttggctaagaaaggtaattcaactgtcactcaagtgctaactcaatggtctgattctctcccagaggaagccacttgggaagatatggaggatctgcgttcccgttttccagctgcattggcttggggacaagccaattttcaaggggaagggcttgtcaggaagtgtgatcctgaagaagacaaggacaagagaagggagccaagtattgagaaggcaaaagaagcaggaagacaagctgaagacttggggctgtcgttcagctcgtctgaggaggcccaataccaaggtccaaggcccagactgggttgcgtgagtcacttgctcgcatgtgagctggcgtgatgttggtgttagttaaatactgttgaattgaattaagacattgaattggcaattggaggcgtaggcggcagcggctcgatcctgttggatctgagaggaaactatcatagtgttgccaaattgtgtgtgtgcttgagtgaatccttgtgagccctaacagtaatacaatgttcacaagttgggaatatgcgtgttttcatagttttggtctgctgatggatctcggtaggatgtacgtaattctagcagagatctggtttaaaagctgaaagattttttcctgttgcccctaggggttgtattttctcctgctctattcaataaaaaggcactctagtgctattttccgttaaaaaaagatttttgttaagaaactgcagaaggtaatgcatggattcagccctttatttggtttattttttatttggtttatatacatgctcaacgaatcaagtggaataataatacaagaatggttgattggaataatacaaggcagtgttgggtggatgagggagacgatcagtgcgagtgcgggacggcgagtctcttgacggtataattcttggcaaaggcggcgtacaccacaaagttgatggcgctgatccccgtccagagccagaaatagtagtccagatggccgtcgttgaggtcggcggggagccagcccttgttcgaggtggtggtgacgacggcgacgatggagacgacgagggagttgacgtagtagcccagcgagagcgccaggaaggagaaggccgagcagaggctccgcatcgacacgggggcctccgagtagaagaattccagctgagcgatgccgcagaagacgtcggagcaggccaggatgacgaactgcggcagctgccacgcgatgctcaggttgccgccgtccctgacgctgcgcagccgccacgtctccagcacggccgccaccgccagcgccggcaccgccagcaaccgccccacgcccatccgctgcagctgcgtcagccccgcggggttcccggtgtagcgcctggcgatcgggacgaccaccgtgtcctggaacaccacccagatcatcatgaagatgacctcggcggagttgagggatgccgccgggacagagaaggatccgatcttggtgttcatggcattcccctgctgcacgaaggtggtggccgtctgacccaaggaagccgcgtacagcacgctggtcacccatatcggcagcatccgcagcagaatcttcacttcctccacctgcgttaccgaacactgcagccaccctccacccccaccctcatccttatttatctcttccacctcctcaaaaaccactgccgccttatctaaccacctgaaatgaaacaaatataagtctatatccaaaagtaaccttttacacaaattaagattatcaaaattcaggacaagtgacacagccccctgtcgatcatcccatccattactgttgttcggtttatctcactccttagttcagtcggcttttgccttatgaatgggtagtgttgttgttttttttttgtacaatctatctactgcggcgatacactgggacgtcgtccccccttgaactgtgtttttaatcttataaataaagtgatgagttctcgaaagaaaaaaaattcaagacaactacaactatatcagctattttttagaggaagaagaacaagaactacctaaggccagcttatatatatgttcgccttgaattgcaaagcgtatataaagattaagtcacagaagtacctgaaaccatcagtatgtgctagtttgactgattgtccattgcttaaatcagcatcatccccttcatacaggagtgcgttatcggcaggaacctccagttttctcttcttaaaagaggcaacaaaaaccattacaacactcttgagtgggcttccactgggaagctggaccttgtacactggtgttcctgccaaaaaggcaactgtggcaacaacaaggcatattgaggagatgccgaatccgagagaccaagcaacattttgctgtatccaaacgacgacagtgcccgaaatgaacactccaaggttgatagcaatgaagaacaagctaaagaaagattgcttctttttactctcttcgaggtttgaatcgttgtactggtcagctccaaaggggagtaatgctgatttgacacccccggtgccaaccgaaataaggtagagcgcggtgaagaagacaaaatactgaaaccctgttgcaggaggacatgagctcccattgcatggagcaggttgtagtgatgggatgacagcagaggcggtaattacaagcaacccctgtttgtttgtggacatatataactcagatagtacatacttatatggcatgagcacaacacatgcaaatgcaaatgagaggaattactactagatagctagctagtattaaacgatgcacaaaacgatactagtacatggcggatgcacttacaataagatagaaaactgtagagatggcaatggtcttgtactttccccagtatgtatcagccaagaaggctccaagcaccggtgtaagaaaagtggttccgttccatgtatcaacattggctgcgttagaggcggtagttccatggaggacggttccaagataaacgaccaagttgagggagatgccagcataggcaatgctctccaagaattcaaaggctacaatgaatgaagatgtatgaagtatttatattaggatacaactatggagtccgtgattagatttaaaaaaatgccaaattggcagatttaactagacagttgttctgcaatcacaagacaagtattctgacaagtgtggaaaggcgttatattcatttttcataggagtatatggttaattaattatgtatgtgtagatagatccatgcgactggtggatcgaggaggaagataaattaattaagaagggggtgggggctggggttaccctacccaagataagagcaggagccttccagttgaaggggggcttggtatagtgctgattggatgcggaagcctgcaagcagagggagggaggaagacagtgagtactgatcgatacagggcggtgagaaattgagaatgctcaatttaatccaatccaatccaatccaatgggaaattaatcccttccctcccctccctttctaccgtggagttggagtatatactagtactgccgatcatatggaagcaaagaaaagcttaattaggaaggatttagaattggggatatatattagtagtagaaagagagaacctggtggtggagcagcggcagttgggcatctccgctctccatgcccatcttcttcttcttcttcttcttcttcttcttgctcctctcctcacctcctcctcgatctcggatcttctaccactggaatggaatggtgtaatggtggcgaacaagaccccaactcctagtagttgtatttgtcggcttgcatcgtcacggtctctgtcacctcattaacttgctccctacaccctataatataagcatttctagactctaatacgatctatattattttgaccaatagtatatactataaaaacgagatgttttaagtaaaaaaactgtagtttgtttaataataaatttagtaacatcaattttacatgattgaactttttttattttttctattaatagtcaaagttaaaaatgtttgatttattagtgtgataaaaatacttatattttgggacggatagagtagtaaattaatactactccctccgtcccaaaataagtgcagttttgtactattcatgttcaacgtttgactgtccgtcttatttgaaaattttttatgattagtatttttattgctattagataataaaacatgaatagtactttatgtgtgactaaatgtttttaattttttcataaatttttcaaataagacggacggtcaaacgttgaacataaatagtgcaaaactatggaggtagtagcatacaaatacaatactccacggaaaattgatgactactccactgccacttgcaacctgtgagctgctgttttgacctcgtggggatttttattttctttttcaattatttatacatatatttataagggaaaaggattggtgacccacgacagccacgagaaagcgacacagactgatgggcttaactgggcccacgtcactaggccggatatcaattgggctggatgcaatatgggccttcatctctctcgtcgctcgatccctcttggactcctccccttctcgaacaaaccctaacaacaacagacaagagagaggcattgcacgatgcggcggtggtgcgccgccgccggcctcggcctcggccgccgcctcctctcctcctctgtctccgcccctgcccaccgccctcttccggcgcacctcatccccagccccaggccattgcccttctcctcccgccaccacctcttgactcctcctctgggtctccatccctcctccccaccgccgatgcaatggcagacgcagcaggtgcgccacttcgccgccaaggacagatcgcgcgcgccacggacgcccaccacctccaaggtcaagaagtacaagatcaagcccccctcgtacgcatccctccttccactcctctcttccatcattcaatcactattatcaacttctcacttactacttttttactactagctccatgaagtttcgattcagagtcatgaatgacggccaggtccgcaggtggagagccggcaagcgccacaatgctcacctcaaggtacaccatcttccatcttcttccccccatgcctttcctgctaggcctaggaccttatcatctctctgttgcttgtacgtatccaattgttttcctagtgaaacctaatttttcgatttaataatgatgtatcatgatttttcagtttattactgttatatcatggatgatgaattccctgctctttgttactatctttttttgcaaaaccgcatatgtctcatcgtggaaacatggatttccctgccattttctctctctctctctctcaatatgtagttcaccatgatccaacgccaatctattggttccgtgcccaagagagagagagagagatatgaatatggaccaattcggtaaaccttttagatgtcccgtaacttcagtctccagaaaatcataatgaccatcttctcttctcccccatgcctttcctgccactttaacttctctcttgaatgcctgttgcttgtaccagtgttcagtaccaaactttcgatttatgctgtctaaatggaaattttgatttgttactgttatatgttggatggtgaactctctgctctgttatctttgcaaaaccacatatgtctcatcatgaaaacatggttgccctgccattttctcttcctcgatatgattagttttaccatagtccaacgccaatctattggttccacgcccgagagagagagagagatgaatatagtggaccgattcggtaaacctttcagttgtcctgtaacttcggtctccaaaaagttgtaacaaaatctgacaacaccacttgagctacccttcctcctcctatacgctacacagaatcgaatcaaactcatttccacatagccaattgcagaactcattaaacattttccaaagttcattgatgcatccatgtctttcttatatgatcaaagttactcatagccactttaacttctcatttctactcactatgttatttagctggtactgccggccagtgcacaccgagtttgtatgtgatgctattgtttatgttgttgcagtcgaaggaagcgaaaagaagacttcggaagcctgcattagtgcacttagcttatgcaaaagtgataaagaagctcaacttctgcagctaggaaatcaggacagacatgatggagtttggcatgcgagacagattgatgagtactgagtgccaactactgcattcctcacactgatttgaaatgttatttttttcccaattgttgtttgatgcattctcatctggttttgttttctgcacaatctggctgataaagcccacccgtcttgtgctatgtacaatattcagcataatagtgggataactgctgctggtgaagaaattggtcttgcacacacatcgattctacttaacgtcttcatccaagcttcaggccaacttttaacatggcaatatttctctgagagtttagatatggacactctggtcacacaaaggcatagttgttgttttctcagattgcggccagtagattttctgctcgagggtgaatgccgttgatcatcgccaggcgattttgagtttctgaattcagttactgatgatgatgatgactacatcatgcacacataaacctaaagataagagcatagcggacacgatgtgccttgttgatcatcagttccagggagtgtttgagacggaattggtcgagaaaatcaacaagacgctatatatttcctacattgtccagtctcatcagctagcaccctagcagcaacagggattgcattgtggtaacaagattcttcttgtcgtttgagctttttatcttagctttcggacctcaggttttcctttcagcctgtgcccatctctcttttccttcttttcaattttttttcttcccttcttttgtggggtttacagtgtcctttggactgaatatcgccatctcattcattacgaaatgcagattgggacactgcgaagtgatggagatatatagagatccagattcaggcacacgtcgttgttaataatcgatttagcttgtttgctagttaccctatgcatatcactctccattcagtagaatgttgaatcaagacattgatcgagaacaaccaagctggtaacagcgtcagcgtgaaattacatatcaaactgacctttaatttcggcatgcagcttgctcactatcattagttggctctatagcatcgatagtttttttttctcgaaatattttttgcctcaattttcctcattatcatatagcagcaaaaggcttttttttttgtttcagtaaaaataacagggtaataggatcatactactactccctcaattagtcactagaagaaaatgggttttggacttttcaaagttaatacgactatttaatttcttttgtataaatccaaggttttataatatgaaatctattgctcggataaacttggctacaaatattttaatatgtccaaaatcgacacatcattttcataataatggatagagaatcggtttctatatctataaatggatatacacaaccaaagattacacaaatacatacactccacatctcataatcgagattaaaaaaacaaaccaccaaaaagaaaagacaaaaacactaacttcatgtttttcctcatcacttcaaacatcggatgtggagctagcatgtctttctacctgcacactctctcgttgacactgtagcaaccgtaaaaacttcatttgctctgccatgagcaaaggaaggggccaggactagtccgcccagctgccttgacatcaccaagcaccagcctcataccagacggacaatcaatgccccccttagcatgagcacatccatcgccgctatgtcgttgttgtcgtaaaataccacctccgctaagctaccgcagcttatctcaccaaaagtcatcgccacatcgcacaaaagcgatcatgctacccctctgctgtcaccgtagaatctcacatcagacaagtcacggaagcttatctcgctagagaatcatcgcatccacgctgtcatcaccacaaaccacaacctccgtcgagctgcagtagcttatctcgctggagagctgccgccacaacaccattgtcatcacaaaccacaaccttcgccgagctaacatcacagcatatcttgtttggagagtcgccactatcgagtcgtcttcacccctaacctctgccaccacccttggcattgctcctagcgcgccgctgagctgatcagccaccaccatcaccaccaagcaagccaaccgctactactgccagcaccaccaccaacaccgccatcgccacctaggccccaagcactgccacttcgtatgccgctagtagctaccaccgtcgacccttccacctctcagaatgcccccaccacctccgttgtcactgccatcatgcctccatacccaccacgacctgtgctagctagggcctacgtcaacgccgccgttcgcctctaacgcggctttgccccgtctcggccgacgagacaaggaggaacgggagggaaggagggagaggaagccttatagtcaaattaacttctcgaaggattgaataacaagaactaagcctactagatgaggggtgaatggtaggaacaccaaaaaccaaatctattttgcaaaattaaaaagttaccctcaaatttaatgaagatcaggtctgaccgacgtgtgtgtttcgatttgactgggtagatgccgctggtttggccgacgatgctcttttgatctggctgccttgctcaccgctacaacctcctgacgccaccggtctatagacgtggataccgccgatttgaccaccaccgcaccaccagttggaccgccgctttgccgtcgatgtgaccgttgagatccaaataaaaacatatcaaagaaactcttgaaagtagatcaactttattgcattaatatatgtttataaattgcatctaaaacactcctccctctcaactcacgaactaggcccgaagcaaatagtaactttcctctcccaaaacgttgatatccttctagtctcaaccagtcttctatttatacccataacattactgcccctagccacgaatccaactagaactagcactcctaatcaacataggaaacctatcaaaccaggcaaacaatgtcaccatacaactccacactccaatcttctcaaacttggactccgttttaaatttgacctatctttccataggcacaactctacgtgtatgtcatatgaaaaccttcacctccacatgcattgttctctagcctgaacatcccattgtctagcgtgataagtcccaatccatcaccagctacattcccatggcctcaactaacacctacacatgaagaacaaaaaatttcatatttgagtataagttcgcaccaacttgattcacatcagcacacaatagtatcacatacgaataaaaaccatctagaactcatatacatgaaacaatctataaattccacaaaaacaatccaaaaccgactccctcctggagtctgccggttcgaccgtcgggcactccagttagactgcacgaacaccaccggtttgactggactcctagagccgacaaaaaccgtccacaataaaaaaaactattcactgtattttaaataaatactttactttgataattgttcatcaccaagattaatcatcacatgattgtgcaatgtggaggcattctaaacgatattccttttgtgacgggagggagtaacattttaactaacaattgtggcgtgctctgtaacaagtaattaagcacgtacgctagcttacattaggctatatatagatggtaaagtagctagctagctactagtagcttacaagaaagtgtggctagtcgaacaagccgaagctgtgaggatagtcttgatgaaacaagaggtggtgcttggtgtcaataatggtacacagctgatggtggtcgggctgcagcagggagggggagatgatcacgtcctcctgcttgaggtgagtggtcgtaagacgatcgtggccagtctgactctgatgatgaactggagtactgtcttggaggcgtatgttggatgagttggaggaggaggggcgggtggagccggcgagggcgttgcggtgggttggccatggatggttgtggtcggaggtgtaggtgacgacgagcattgtggggtcggcgcggctgcgctccacctgcttccgggcggagcaacctttggagctgctgcagcggtagtacccgcgagggtagggcgaccccttgatgggcttctgcccgtacttcctccacgcccacaggtccgacggcaccacctcgccgccgccgccgccactcgcccccgccgggatgcacaccaccttcttcgtctggctcttcctgtatatatatatatacatccttacagctagctaggtactactccagtataagaagttaaagaatacctacgtaccttcgcttgatgggcggaacgacataatgagcaccagcaaataactcctcgccgtcgccggtggtgtcctcctcaatcgtcgtcctcgtcctcgacgctccctgctgctgcacctgcactactggtggtggtggcaacagcgcatggagaaggtcgcaagctgcagaagcatccaccatgctctgctgctgctgctcagcgtgttggctcactgctgcaagctggtcttctcctcctcctcctcctcctcctaagaggtgcacatacggcggcgatgcagcctgatggcgaggcgccgtctgcagctgaaggctggccctcaccacatccgagaggtccccttggtcggccgacgactgccaaaacaagctgtcacacatggtcgatcgacgctatatatctcgctagcaagagatctccatattaattccagaggagattaatcaggccggccggacagggattatatgtatatagtattgaagaagaagacgacgacgacgacgacttaactagagtatattgtggccaccatgccatgcccttgcatgcatatatgaatatataccagcacaacggaaagaagacgaaggaactaacacaccccacatccccatcgatcgatcgatcgaagctagatagtgcgatatatagctagcaagagataggtaatagctagtcttgtcatacatcaacaacaaccgatgatgatgatgatgagtactagtgtcactcacctacagctatactagagttactccatcatccattcatctctccttttaggctttatgtatatatatttccatttcctttcactaccaccctgttaattttactttgatgcatagttattgttttgattgatctttgagtgggtcggcgggcacggacgggactgattgatggatatatctgtcagacagacagaccctaaatagattgatcaacaattgttgatgggtgcatggccatggcgatctcaggtatcaatccattcacccatccattcatatacatatactgtatctcccccaattaattcatccgatcctcactgtcgatgtgctatctatcttgtgtacttttccatatgcatgattaggcagctttcatcaacagcaagaggcatatccatgcatgccctccagataaaaagctatactccatagtacctttaattcgacggacggcatggttctttttacatgagaaattcatcatatatctgatgattatgcaagcaattgcaagtacagctagctagattaattaaactgtgtgcatgtagttcatcgacaatcatatcgaacgattacaatgtcatccgctaattgtaattaatacttggaatttagtggggattgtccgggcccacatgtcatccgctgctactatatcaacagtattgcataggatgtgcatcccttggacttaagtagtactgaatatatatcctatctttatatatagttggtacccattaagaagcatttacttctataaagccacataatcaacaattttaagccatcagatcatattagtataaagataacaaccgctgaaccaagaagctacttattcattcaattcaatcatttattagttatccatctattcacctccctttgctccacctcatagtcacacgtagcactgctacatattttatgcataacaccatgttttccggatataatatgtggttattgtttaatatgtatgttttattttattatgcatgataaggttgcatataattattaggtatagttacctgaatccattttcagaaaaaacttgagtggggtagagagatgcaaactgtttaactacaacgatacccatattgcgcatgaagataatattcatatattataacaatacacaatgacacttgaaaaaacaaaacatgaatggtattgtaataacataaggcatatataaatccacattatcatatattttatatatacatagagttgcacttaaccatttaaaactatgattttgtttgacgataaatctataaaacccatggcaaagacgcggggcgggctgccaactagtatatatgtatgcctgacccatgattcttgtgtagatatctgtaaaaattattaatcaaacaaaatgcattttggagctgccacactgctagctagagtagctagagttggattctcgtttccaaggattagacgacaaggtagaatgaatgaatggacaaggatcgattaaattaagctagcagctagcaaccccatgagttaaaactcagagcatatgtagtatgtgcagtagatcagcaagtgcatggactgtggtataaccggccgtatatgtttagtataacctgccgatgtttggatggtggtttagggttgggcgacggaccatggaggcaggggttgtaggggttccgagcgaaagcttagcccaagtcattgggccaacaatgatcatacttttgggcgtgttaaccctccagaggacactgttgaggtacccctcctctcttagcaaagagctctgggtgtaaaccttgtctagttttttggacggacgacgacggcgtctttcggtgtcgcgaccctcttgagggcataatttttacctcttgagggcgtaatttttagagtcttcgttccgtggtggtggtgatcggtctcgcatagcgatagccaattcggtgcccggcttccctctctgtagcatgtgtttaggtggttggcacatgatccggggcgtgtgctctggtgtacatccttgcttgatagccaactgtcaatgtaaaacttttcttgtaacattttcttcctatcttaataatattggatggtctccttcggctattccagcaaaaaccagccgtatatacccagagattaataattaggctgcaatactagcactctcttcttttacatggaaacaaattcaatagtccacatccatagttttttttttagaaatgcttttcttaatatatactgccaattataattcaaatggagtccattcaattcactgccgcacatcgttacagatgagagcagtttggtcgaacctaattaatgcatccaaggcatggaatggaggagtaactaaaaacattactcgcagagaactggtggtactgatcgatcgagtgtgattttctttcctctgcatgcagtgcaggctagtaactgatcaattcaagtgtgtgtgtgtttgtgtataatattcctaattagatataacaatcatcactagtgcactacagtagtcgtatggcgacttgcatcaagaatggaaggaacagaaagttgtttgattctccactgcatatattactataatgatatggcctggcgatcatacacagtatcatattattggtcgatctgtagctagctgtacataacatggttgcctagtgagctgcatatgttgtacttaacccccaaacaaatacaaagaagatgaatataagcacaaattaatagtgcgtcgcgagtgtctgtgttgtactgtgtaattctaaaaaaaaagtagtgatgtaagagcatcttaaaattttactcctaaaaatcttggattagctagtatcgtcccaaaaaaattgggcccaaatatcacctcctactccaagaatgcccctaaatttgatttccaccaactttaaaatatgccatatcatctcaagtaggttctgcttcgaccgtttatgtctttttatttttccggtaagagagggatcgatgctaggcgctgctaaccaatcgcacgctagcggctcactatgctgtgcaacaggacgatctcgtgcatgccttgcagttgcgacagcggacagcgtgggcatcagcaagtctacaaggcgcgtcgaggagggcagacagggctcggccatctcgcggcagggcactacagagtaacacatgaggtttcttggttgtctcgacgacgccctagacggaggggtagcgacgccttggacggaatggatgccgcacactagtcggagcagaggcgagcttgtcgatgcctttctgagcactgcccctgtgacggagggtcaccaacaccaggagcgctcggcaggatgcgacaactctagattgtcacgagaggagaagaaaaggtgcgagcggcaaaatcctcccatgatttcatcaatggttttgggtgtcagtaaatattgggaccgtctttggatatctctttaagacatggttttagattagattcctataatttatcttttagaactggtattagggagctcttggagatttctaataatctactactttatctgtttcacaatgtaaatcattctagtattttccacattcatattgattttaatgaacctaaatatatatgtctagattcattaatttcaatataaatgtgggaatgatataatgatttacattgtgaaacggagggagtacttgtactggagtagtatactaagtgatttggattaagttttggcagcgcctaaaactcggcccatcccagaaatgggctcccaggtgaatgaggagcccatacagatgaagtctggtgggtggttggcccatccatgttcctcttcttcctcctccgactccgacccgcagccgcaggaacccaagaggagatcggaagaaagagagagagattgaggaggaggaggaggaggagccatggctgcggtggtgcgtggcgtgttgaacggcatccgggagaagggcctctccaacttcctccgccatgcccgcgacgaaggctacttgtaagctacctataacccctctcctcctccatctatgctacgcagggcgccgatccggatctccatgcgtcccgtccgctacctgtttctcctctttaattaggccccgatccatactagtttcctctccccttcgattcagcaccgaatcccctcgattagggttgttgcttcatgccgcccagcccaaccgattggccaatggctatccgaccctcgcttttcttttcgctgcatttctcgataccatctgcttgctccatcaaactgaatatcgcttttgtatcatttgcagcaaatgccttctggatggaaacctcttgtaagttcccccttcttactagctctccgtttattctttttttttacacatatctggatgtgtctgtttgtctccccacaggtcgccgcagcctaatgtagtaattatcatcctctcttttcaggcaaactaaaatccacaatatcggcgccacacttgtaggagtagacaagttcggcaacaaatattatgaaaaactacatgacactcagtatggtgagtgaggtttctcgcatacgctacattttattctattatgcaattttaattcatttcaatcatggaatgtactagagtagcatcaattatcttctcacaacaagacatgctatgctatcctgttttgcttttttttttttttgccatcttgttttcttttcttccacttctgagatttgtaactttgctcataagtgatcaccctgggcttgattggtatgcatgtctttgtagtaatgtaacgtttcttactttctgtctcctccaaagagaggtgctttctacaaaactaaatactggtaaccctgcaggaaggcacaggtgggtagaatatgcagagaaagggcgctacaatgcatcccaagtgccccctgaatggcatggatggctgcaccacatcaccgacagcactggggacgaggcaagttttcttctttgtgttggctgtgtttcctagctttggtcctccgacataactataggttatggtaatgctttatcgtatgccactgacttaggaatttggatcttggaaaaaaaatgtcttgccctcaaaaccaaacaagtagacacaaatttggcatcaaaagtgaaacaaccgaatgtccagacaagtcaaggaaagcttatctgaaaagggcaaatcttggttattgcttcccatggctaaatgagcaaacatgcatgtttagttaagttagcaaacaggggagcctttagaatttactgcagtctgtatatgatgaaaactctggtggtgcttgttacttgtactgtccagtgtgatgcttagaaatgttattaccttttaggcgttttcttatgtaatattcagcggtgaattcacctcccgggcagctgcctaggcttaacgccattgaaccatttagcctagtgataaaacaacaccgatttgattagattccctggcaagttaattagttgtaggtgccaggtagcaagctgcaggcctgtttggctgtgtcccacagcatgaaggtagcaaccggtggcccaaggtcatccttgcctaatttagttaccttcagttaatcatgttgatgtggcccacagtctactcagccagcatgtatcccatagcccaggaaaggcatacaaaaggaatatttttatcttatatttcttgcagagttgttatgatgctatgatgtagtataaatttgagtaaatttcacaaaactacagatttaaggccaagtatcacataacttcatatttaatatcgacgttatcacaaaactacagaatttagaggtcaaatcattagcactaccattatattggagctataaacattgtagttttatgattgaattggcactaaacctgtaattttgataaatttgctacttaatctatagttttgtgaccatatatctaaatctatagttttgtgataaactgataaatttaaaactaaatatgtagttttgtgaaatttactctataaattttcatttatctttttttatctcgcgtctccgaagagacttcatttacttttttattaggcttatctactttttatctactagaaaatctgctggaatttatatactcattggatcataaatttataacaaaattgtgactccgatagaaatttgagcttatagacatgtttgatcatactggttttcattagggttgagcaccacccaggcttccaaaaattgctggctttgccactggtaatagttgctgggaatgtgggtgggtgttgtggttggatgggaaaggtgattctgacatacttgggtatgttgtggcagctactggagcagaatgctaaagcgtacatcgtggatcacaaggagaacttctccggcgagggtgaggaactgatctaccactccaaggggcatgctctaaacccaggacaaagggactggacgaggtaccagccgtgggaaccaaagaaagaagaggcaacctaattaaggcactgatccagtgtgtcatttgatttggtgtctaaaacaacagtcagccggctcggtgggctgaatctgaataatgttgtcttgaggattgtttacctgagaatggaagaacatgatggagttttaattcccatatgatatgtttgtttatttttgatggagcggagcgtcgtccccattgaatggacgagggttgaatgctggtttgctgaaatgaaatattgtcgattgtctggatttgtgatgtgatagaacgtcggtatcgtccgtccttgactgggctggtagctgctggatctggatgtgagagagggctactggctacgtggttggcttcgtctcggtggaatgaaattggggcggaagcggctgccacgactcattgtgtagtgtctgcatgtgttgtttgtgaatattttctgctggctactcctaataataagatattttgattgaatatgacgtatcctagtaatttggaccggcttcatatttagattcattatatgtgtcgcattcaactaaaattttttatatttatggacaaatggagtagctccctactgctaatatttgctgaaggctcacccccaacaaaaaaaaaaataaagaagggaaagggaaagaaagactgctgctgagtttgtgacagcagcaatgtctgtcaaagtttcacaaaggaaagataaagaaagactgctaagacggttgctaaagtttcggcacgtaggaaggaaaggaaaagaaagactgttaagaaggcggctggtttgattgaccatgtgccgttcataggagtagtccatgttatgtagccaaatgactcgtatagttagcttggaggactgagctttgtgggtgggttggttggttggttatacaaagacgctacgagtccgggaataagggggcaactaggaagttcctcttcctcctccgagaacgagaacccacacctccataacttcaatttccaagttatatatatataaaaaaggcaatggcggacgatcctctctccaactccaccaccaacaacaaggtacttgtcgatcttgcttctaccaattccaattactactactccatcggctcggcagattgatttgattgtttgcttcttcttttttctgattgatttcagagggcagaggggatccagctccagcacggcgactgcgagagcgagagcactgcgcccttgctgctcgcgccacacgagtcctaccgcctctccgccgcaatcctcccgtgggttcctcttctcctcctccttcttcctcctcttcttccttggtcggtaataaggctggcaccttcttctgcagcttcctatttccagctttgggcggccttctctatggctacgacatcggagcaacgtctggtgctaccatatcgctcaaggtctctattactatactccactattcatcgattttgttaataatagaactatatattacttgagcgattacccatcattttgctttgcagtcatccaccttcagtggcaccacatggtacaacttgtcatcgctgcaaaccggccttgtcgtaatgcccttaccctctcctccatttgtttctctttttttttccttgtacactaccacaatttcatttcttcttcccaattctcgttatgcttatgcaggtcagtggctcactctatggtgctctcatcggttccatcttggcattcaacattgccgattttctaggtctaatacccccacccacctcctctcttttcttttaacattgccctagtcttctgttttcgcttatgcttatctcttaccacaggacggcgcagagagcttattctttcttctgtctcatatttgattggagctcttctcacagcagcagcacctaacttccctatcatggtggttggccgctttttctatggcataggaataggattggtaatcaaccacaattatcttattcatgccatacttgacactgcaaaacacatacaaacaccacacggtgtttatgacgcttacgctaactctttgctttcgtcaggctatgcatgctgctccaatgtacattgcagagactgctccaagtcagataagaggcatgctcatttctctcaaggaattctttattgttcttgggatgcttgtaagttcacattacatgacctgcccttttccccctctcttcctttctctctcagactacttagtcatttacttacgtttctcttttgcagcttggctacattgcaggcagtctctttgtcgaagtggtttctggttggcgctacatgtatgccaccagtacaccattatgtctcatcatgggaattgggatgtgctggttacctgcttcacctaggtggcttctgttatgtgccatacaagggaagaggaatattatggagtcaaaagaaaatgctacccgttgcttatgtcgattgaggggtcaagcttctcctgatttggtttcggaacaagttgatttgattctggatgaactgtcatacgttgatcaagagaggcaagcaggcttcagtgagatctttcagggaaaatgcctcaaagcaatgataatcggatgtggcttggtgttctttcagcaggtggtctcttaagtcatcatatagccatactcgtatgttccatgatgtaaagatgaaactgacggtgtgtttcttatgcacttgctgtatgaatctgtcaggttactggtcaaccaagtgtgctatattatgctgcgacaatccttcaggtactgatgcttttctgtatgaattacgtatttcagctatgtccttttgtggtgctatggttggctctcaaaaaatggaagcccctacatgttataagatgttaccccgtattgctcaagaatataaaaaataatgttattcttgtaaggtcaagtggggctcacgggacctccagacaccatgctttcatcgctttagttcctgtatttttcatagttgtcgtttttctttcatgcagagtgctggattctctggtgcatctgatgctactcgtgtatcagttcttcttggcttactgaaggtatatagtacttcttaatattagttcacatataacacacgctgatattttcaaactttaagctgttccatatttgccattcccctatgaatgaacatgaactagcaacaaattactacaatagtacaaactgatacacccataagagcaataacctgtaccactatttgtcttgatattattcgatacgacaacactaacgaaaaaaaggacacagctagcactcaggcattgagacggcagcaccaaatacctgatgacatgaccatcttgggaggatccccttttcctttttatgtgctgcatctcctctcctcttcatctaaaattaatttgtgcatccataaaagtgaagcttgtttgtttcaagtgttttgagtctccactagaatatcttaccatcccagcaaaaaaaaagagagagaatatcatcaccatgtaagccagagaaaaaacaacatcctttgtcacaaaaatactaacaccaccatgcaacatgcaagggctcatgatgcaacaatgagcaattactaattgtaaaaactatgaagtttcgcgcaacaaatcgatagacctactgccacaaataccaatttaacaaaacagtgagctagtgagctacatgtcctagctgcatcaattcagtgcaacaaatcaacattattgcagatacagttggttttggtgcaagaaataaagaaacatgaacatctacaacaaataactcttgtgactaattttgggaagacaagttgcaacaaataaatactctctgcatcatttcaactgatgttgtgtttcttttgtagttgattatgactggtgtggcagttcttgtggttgacagacttgggagaagaccattactgattggaggtgttagtgggattgtaagtctagcctcaacatatgcactcttatctaaatatgataaaagcagtcatgagcttcttcaataaatatcaattcaatcattcacatgctcgttttctctgttcaatgtgatacacaactgatatctcaatagaactgtatctccttattttctgaaaaaaagtacttaatcgtatattttcatgttcagttgtatgtttctgtggaacaaagtagcatcgaaatttgtagggatgagttgactataggtgctataggcatagttttcacatgatggtttgttcgtatttctgaaaaatgcagtgatgttcttttgagtgaaataatacaataatcttcaaggagattttgctgcctcactcaacttatctgttaattggtttaatgtgcaggctgtttccttgtttttgttatcttcgtactacaccttattgaaggatgctccttatgtggctgtaatagcacttctactctatgttggctgctaccaggtactcacagccagtttacccttgtttggcatgaatgaaaaaaaatagaaattttatgtagcaaagtttcagttgatattctgcccgtgtatatatatttggctatctgtctaatgataagttattctgcagctgtcattcggtccaattggctggcttatgatttcggaagttttcccattaaggctgcgagggcgtgggttgagtattgctgttcttgtgaattttgcctccaatgcactagtcacttttgctttctccccattggaggtatgtctcaagttggtttgtgcaatggagtgtacatgacatgccagccaagaagaggctatgtatgagtgtactgactgctcttatatatgtgactgtggtgtaggatttgattggaactgggatcttcttctctgcgtttggggtgattcaagtggcgtctcttgttttcatattcttcatcgtgcccgagacgaaagggctcaccttgaaagaaattgaagccagcctgtagatccagctgccctgcggctgctggcacgtaggagaactgcttattattcagagatgttgcaagctgttggactgactgactgactatctttgtggtgtggtaaggtaacacagtgagatccattgagagtgagttatgttgctttcggtcgttgctttggttggagaaagagtatagttcaaacatatatgtccatactgggttgttgttcataatacatgagcacatcattttttttccttgagaacgatatatgtgtgattaatgctgtacagcaggagcagttggcttatgccatgttattgggcacctgctgaatatttggcatgatctaaaaataataatgtcttcgtcccagaataattacatttcatggaggttaaagaaaaattagcggcacacacaaatgaccacaataaccttatttaatgattacactgtatgtatgtagactttattaaaaatgcaatctttttaggatataatttaaatggtagaaatacaattagtgttatagaaccaaggaactaggtgtaaaagatagtgtagtgctaacctgtagctctagtttatgttttagagtaataaataaatttgtgaagaagggaatgcgaatgctacttccttcgtctaaaaaaacctgagactacatgaatctgaacagaagtgaagtatgtactagaatacgtcacatccaaatatccagtactatgttattttttatgggatggagagagtaggtctgaacatgagtctgacctgtgaattcagtttgttggatacagttgtggaacatgtgagatgaaagaatgagagatgagaaggaagacgtggcagcatgtatgtgttgcgtagagttgttgcacatgtatggctaggctaattaccgttccctccaagtccaaggaatacatgtgatgtgccaactgcctttttgtgtccgttgcgtgcttatttgacttaactgatcgaatcgatgatgaatggatggatcgtgcatgtgaatgatacttacttctctctgtttcaaaataaaacaatttaaaattaaacgaatatgatagatctttatctcgattcattatattaaggccgtgttcttctcggctagccgggttaaagtgatgtgtttgggaaggg

SEQ ID NO: 58868 - DNA, 1434 bp, Oryza sativa
gtagtattttgttgattgttgtgtacccctccgtcccaaaaaataagtccaatcctaactacgaacctagacatgcatgtatacaggttcgtagctagagtttgccttttttttgggacagactagtacatgtttaatagtgagaaatagttagtttacgagaatacctatagtaactggcacaaaaattatgttgtggcaaccaaataatttacttgttgataaacttgttgtttacacattcattggtgcactctcaatttatgagatgagtgatagtgttagatccatgactcactgtgccattctggcccttggagtatttatgttcctaaatattgaaaattgtttgtagttatttttgttatgaattgccacccttattttatttgaaatgacgtttgactagattctatatcatggattgaatcattcacaaaaaatgattttcttagctcatctattgttccaccatcttcaatagatcttcagttaatattatatcattttgcttgtgagagagtaagtggtatccacacaaaagatctagtatatatcaattgatagtgtaactctattttgaagatctatgaatggtgtaccaatatgtgatttacgattatgatcatgctttttgtttgtatattttctcccgtttctatgttgcttgatactagtcaatagtgctcttgttcttcactagatttggaacaaattaataattttgtgcattgtttagttttacatctaaatcatttgtgttttcaatctgaatatagtttatctttctaatgtgtttattggaattgaataaaatattatgtaattatttaaaaaaacattctactcttatttgtttgacatagaaaaagatccgaaactaaggttgtagattctgatatacacgtaaatactacaatgtgtgaaaatcacaagtagcatgtaatgaacaaattgaaaagaaagctaaacatacttttcaaaaaacctaatcataagttgaagataaattcgactttctattgtattatcctataatatgaaaattatcaagtgattatgctattttttttgtagaggaaaacaattattacataaacaaaatatgaaattgtattcgctagattttctatgaaatacttttttgaagtccttagtttttatttcaaagaagttatctgaaattgtattcactagattttctatgaaatacttttctggagtcgttagttctttatttcaaaatttgttttcaaactattatgctatttagaaattttatgtgcattatcagtttgttgtatggatttcccatcaagtagatgtaaactcttgtgacatttttgtttgagacatccgttcgtttccactagaaagagtggataaagttttggatattcgtgagcacgcttttcaaactgccaaacggtacgt

SEQ ID NO: 58869 - DNA, 47485 bp, Oryza sativa
catgctatataaccaatttttcctttaaaatatagctatttctagcatgatgtcttgttctaaaatgaagctatttctccacctaccttctcctcacaaccaattataaccattcttctttaactactttttttttcaactaatcataatcttctttcaatcatttccacatattttcttaatatccgtactaatctcaaaaatactatattttaggacaaacaaagtacgagactttacaagcaccaaggctacatagttacaggtcatgcccagcacgatgatgtgtcgagtccaaaatctggtgatttcatccccaaatttttgtcggaatgctaatcccaaaagaaatagctcatgtcgtcctttgatcaacgtgatggcaatttagcagatgacctcataaataaaaaagggtcgcaactgccatcgttagcatgaacaaaaaaaataccaggattttcttgctacctgcgatcaagtcggtaatatttcttctgattaatgaaagttttgaccttaaaaggcccaaagtagtggctactacaatacgtccataagtaatgggtaatgccaaggagctcgttctgacaatgtaactgctgaaatgggataattagcaccgaaaacaaacaaataatcaacaattgcaataaagaacctactcgagttcccacttccaacaccagtgcgaattaccttagcaatttctcgaccggcaacagaggtaaaagagcaagaggaagacgagatagtggaagaaaagtaagacaggaacatggaatttaaagaaggataatacatgactttctgtgtccaaaacttctaatgctacaaaactcccaagaattggtaaccgttatagctcacaacgcacaaatacaatagggcttctgaaatgtacaacagcggaagatccttgatgaaagattactcaagctttcttgtcagacctattaagattcaaattgaaccacttctttttacttgatttatctttaccatctatgttaccattctcgggactctcagtggggtatctactactgctgctaccagctccaacagagttcaccatagttcgttcggtcgtgaaggaggagtggatgtcatccctttctctcagcatatcatcaacctgcagaccttacaactctttagcaataatccaatattattagcaaaagtaatgaagaatcatcagggttcagcctgagaaaagaatatgatacaaactttatcatattggtagatataactatttgatgaatttttgtgaaggataaattgatgccatttggtttcaaatttttacagcgcacggttctgtaagctacactactatgtactcccttcgtcccaaaataagcgcagccatgagtttccgtattcaactttaatcgtctgtcttatttgaaattcttttgaaaaaactaaaaaccagaagtcacacgtgaagtactatgcatattttattataatctaataacaagaaaaatactaatcataaaaaaaattaaataagacggacgatcaaagttagacacaaaaaaatcatggctgcgcttattttgggacggagggagtatacttcaaactattaacagctaggacactatttaattgacgaaagctcagaagaaactgcatgtcaactgacaaaataatttaacaagtcaattcttaataacagtatttctgctgcattcactgacatggctgcaccaaccatgtaaatccactgtgcagacttaattatacgcaacttcagtttgagtgggtaccaatattcatataaccaaacatcagtgttggcaatcaagtactagctgcaaatatgcaactcacttagaatttgaacacagcatggagccgagcacttatggcctcatcttttcgcttatgcttatgcttatcatccaaatttgaattttcaaccttaaatttggagttgattttgggatttttttcatcgtagtttatttttcagcctttgcttttagatcgttaagaacacgtatataaaagttttatttacaaatatgccatttcgcttatgcttataaacagccaactgatggggccgttaaaaggttctaacaatgcaatgagaaaagcataccatggattcacacaattcagagtcaacgttcagactgcaagactgatagaagaagagatatatgctaataagaaagataacacacgactgttaacctaggctacaagttataacacatttcttgcaagttataacacagtgattgcttttcaaagtgccctccaaaggaatgtttgaaatcatattctagtttgacttattttctatgaaagaaaagtttgccggtgcaagatagacatcaagaaaatgtggacatgtaagaatttagagacattgtttgagagctagcctgacaccctctgtctagaagaacagagaggcatctacatagtcaatatgctgctgtgccagttcaaacaggcacaagctcactacaaaaaaacggtaggtgtgatatgtctaaaaaacatcactatgtagtctgcttcacccttacatagttatgttagactctacaattagagggcaaaaatacgatgactatttcttttgtctctacaatatccacaatgaagtatcaattgtgaaagaaggaaaaggcattcagaggagaaaagatgtgctcaccgcttctttttcttgggtgtatctgttggtcacttcttgaaaccgcgctaaagcctgcacaccatttaactcgatcaaagctctctccaaattgaaaagaaaactaaatacatatttcatgtgttatgtagaaaaagatgtagtggctgacttttctgtactcagtttcaaattggcgcaaatcatttctcttctctagaattttagactctatttcctttagcctctgtgttgtgtcttcgtaactctttgcacacattgcttcaattgtatagctagctggcttgaaaaaattatcacctgaacatattaattaggatggatcagaacggaggtatgtcattcatataaacagataaagtaagtttgcagaccgtatacagcaaatatatgagttccagatttgagagccgacacttcgcacggctggagaccttccaaccttttaaagaatgcagcctcaggatccttggccattgccaactgtagtaggaagcagcaaagtctcacatcacatcaggcccaaagagcataaaaactaaagctatatagcagaacatacataccgcattcactgttgaatccatacgatacacttgaaaatgcaagaaatacatgcctgcagatgtcaccttaccagtcttctgactatcttcctggaagtgcggaaaaaaactggaggttattatttttcttgaatatgcaagagagctgcgtatcatttaatcatttaaagaagaagaaaaataaagaacaaacagatccaagtatccaaccccttacaacgtttgacacataagagccacataaagaaaatacacaaccaacactagtagcaatgcaaacaacaagctctcaagctcctttgctccaataccacaccaaagggtgccctccatttccaccaaacgcactactaatacaacatccctggctacatcatttcactgcaatatgtccatatctcccaggctattacaataatcaaagagttgagccttttcgtttcagtttgtgaacttgcttgctcggtactactaactcgaaaacctaaccgaatctggttgggtatcatagcatgtagacccgagcacttcaatccatatttgccgggcgaccatgcaagaaaccagcaggtgttggataatctcatcgtcttgatcacaaagacggcaagctgctgggtgtggcaagccacgtttagcaaatctatccgccattcaacaacgattaagcatggcgccatagaaataacttacaatgtaatggtgcccaggtttaccaaatgcattattaagctaggcttctaattttttttatatgcagcacattaacatacccaaaatgaaaaaagaaaaaaactgcagattaatgtaaaatattaagatcatgttcatagctggttaacaaaaaaaaaatcattgttgaccattcatactactccctccagccacaaaaggtgagttgttttttacttttcacactcaaaagacataagtttgatcacttagtttattgcatgaaccaaaataagaacttagacaagtacaatattaatgttcttgttgtcacaaacttggctacataatgtccttatgcctaaaaacttacgttccaaataataattacggtcaaaattaatttgtgttgactgtgtgcatcctaaaacgacactcttttgtgattagaggcaataaagaagtcaatggcagaactagagacacagatgcaaacttggagacagctagaaaaacattggctcttatccatttggcagacagttatgtacagcatgcattggtcacttactgcacaattggtatcaaaattaaaattggagaagtccagaaatatcacattttacataaatgataaatttttatatacttctagtctacgccatggactcttggagagctcccacccctaccactcgcattactcataagtggtagcccacaatagtaaatgggtcaatcttggctgtaataaactgcttcgaccataagcaggtataaacagagtacaaacggtccaaaaccctaactacccactcctcttcctccctcctcaacaaccgcctctcaatcctactccagctgacagcatcccaaccactcccacttcaacaccaatggtgacgatggcagtggcctccaacgctcaacatggcacctcctctcctccaccagatggatccatcaatgagacaatgacacaccattgctcccccagcccagcagtggcaacctcaggagttggaatagatctgacaatagcggaaacctccagcgctctacaggcggccttgtctcctctagccggatatatcgacagcacccctgtcctccagcactcgatgccaccgcatccaaaactccttcaaccagatccatcaatggcatcccacttatccaccagaatggtgatgaaggcagcctactgtgctcgacaagctcaagccaccaccaccaaaccttgtcacactgttggtttcactgccttccttccctgacagagagtccttgcatgctggtccttgcagcctcctctcctatcacctcaacctcccattagagaacacaaggcagttactgccgttgcgtcaccactagggccttctttctttttgttgttggtttgggttgataacacagaatgtaatggatctacatgtacacgcattatttttcttgtggtcgtaaacaagtaccattgactgtaaggtctcatgaacatggatgtaaatagaatttgcttgattataatgaaatactaatgggattgtaatggtagaaccttttagctcaaagtgtaatcaaaatttacccctaaaaagtgccatggagctatattacaattctgatagtatttatggctgcggactacttcatttacaattatgtggtgtcattttatctatgttacgattacagccatggagaaatcatttacaatcgctgtgaatctccttcattcgagggaggtatttgtagttgcaagggaggcatttacatcttgctgtaaaaaataaaaggatcttagccacccatataaaaactcatatagataaacggtttttatatgggtggctaagatgcttgccttttttagggcaagatgcttgattcatttatggaaagataagggtgcattttcttttcattaaggtggccaagatgcttgatttattcatggaggctaagggtgcaacagagaacctcattatccaccaaaatgcaaaatgtcacgttgtttaatatgccgagtgtaaaacgccaggtatttatgaacagagaaagtaatactaatccatggccgcatggcattccattgacaaataatgagaaaaactacagaacacatcaatcatgcaattatataaaggcgaaggctcgaaagtacctgaagagctagtccataacctccattaatttcttgttcaaagaaaagcagctatagagaaatatttggcaaatgagagaattaaataatatcctgaaattcaaagagatgcagaacataaaagcttcaattccagagcaattgaaggaagaatcaacctcataccttaaatttactttgtgcggctgaggtgactctgactacaatgcctgactgagcttgttcttcacttattgttacaccataaaaatgagcactttgcttgtcaacctataaatagaaaaatatatatggtagccgtcccattataaacaagaccataaaactggtattggcagaacctttcccgttgctgatgatccaactgggagaggtctcactgtaactgttccactcatagcttcttcaagaacattaggagatactgtggtcttgattggaacaccgagcttgctaaatggtataatatgtaagaaagttagcaggcaattagtgatcctcgattctttctagaaaacaattcatacagatgctacagtcacctgaaaagtgcagcaaacattgtgttcacagttccaagattagataagtcaatttccatatccattccttcattctccaatgcctaagaaagcatattacaacagatggttagattacaaaccaacaaagttacattatttctgccaactatgtgaaacttggcaaacacatcttaacctacacgcccaaaataattgaagtgcccaaaaaaaatgccactgagttcaaatttgtaaaggataagctgtggcccttggctacttggtacaattatcatcttaagcatattatccatgacaaaggtacttagtcaaatggttttggaattaaaatagttatacatggtggaaatgcttctaatagtttgtcattgtttagaggatacaggttctccattacctcttaagtggtttccagggattgtctatctatgacaataaatatcaagctagatgagtaatctccatttcttctttgacagattccagggattaaatctctctctatgagtctacgacgttatataccaagctgccttagctaatcttcattgcaacagaagaaaggattggagataaataagcatccaaaaatctcatcagttatcacatggtctaataaatacacagcaacagtatgatacatgtcggtgcagcaccaccaaaaatcaccttgctggtcatttatcccagccaaacttctccttattgattgatcagaaaaggagaagaatgcagaaccattggagtaaaagcaaaatacacacaaaaaaaactgttcgaaaatagtctggtagtcagcatgagattatgagaatagcacctcaaaaccagcagtatcatattgcctccgtttctcaggatctgacaagatactatatgaatatgcaacctctttgaagagttctgatgcttctgggttactagcattcttgtcagggtgatacctatcaattatatcaggaactatgagtacagaaaatcatcaagactgcagatgcaggaatgaatagatagagcagccaagcacatcagtacatcacacatgtaaatacatgacagacctaattcagtaatcaacagggtgtaatggggtgacagtatttgagatgacacattaatagagaggactaataacccaaagaagaatcatgtggtcatcaaaaggtagtaaagtatagatatccaaaagaaggaaaaactcattgccatggaatttgctcatatagagcatgctaatccaaccctttatgaccaaacagtttctaatcccacgtaaataatctactattagagtacaagtcactctaatgttctcttttctgttccattgttagtattgcaccaatcaagaaacaaaatgttctatggtaacccagaaacagtacaaaaataaggaaaagacagtaagctcttatgtttgtggtaatagcatctaacaaaaaatgtatctatagaaaagaatgcaagtacaacaaagaaacttttgctctcattcaatgcttcctcccaaatttaatccaaaacaataaatacacttgattcagtttcatctagaatgatgtttgcgacatatcgtttcttcagaaataatgttacatatctactcagcacaataaagtaagagcatcattcttcatgttgcattggaaaaatgcggttgttatgcgttcagtggtccattcaataaacacaattggcacatcattagtcaattacacatgggcataaagttcagcgctgttaaatgcatctggatgagaaaagttcaagtgattctgaggaacaccacagctgatgtggtaaattgctgcagctgatccaaacaattgtgaccatgagcaatgaagccgcagagaacgcattcaactaaactagcagcacgttcacattctgcaatctgaatagcgcgatcgaaagcagcagcaagagcagggcggacaggttagggggagcacgaacttgagcgcgagcttgcggtaggcggacttgatctcctggtcggaggagtcccttggcacggagagcacctcgtacgggtcccgccgcatcgccggcgccgacggcccctccatcttccccgacgacgccatcacgcgacgaaaccctaacaacaacaacaacaacaacaacaaccacacgacaaggtcacctcgccctgcccccccgaattggcaggaaacccgcacgagatcgggccgggagatggggctcacctgaccacggcgcgagcgggagcgcggcgcaggcagatctcgccggccgcctcgcgagagagggaaggcgtgagccggcgaagcggagaagggaggccagggggaaggatgggtttgccttgcctcgaggtcggggagaaggagcacgagccgcaaggggattcagttttttcctcctcctttttttgaatttttattcgtggaattttctctttttttcttcccctcgaccttggattcggtgctcctctagtcctctctgctccaaggaaggggaggccgctgctgctttgaggggcgtgcgcttttcttttcttttatattttttttctttcgatttgattgattaccacgtcgatggattgtttctccgtgctttttgccgttttgggttttccaagtcgagctgcgaaatttcgctatgccgaaatttcgtcacttttgggaacttccgctggcgacagcgtgtcatcaagtggcgtggacggccgcggtatgaaatactcttccactttaaaattaatggtatttttaaatattatgatatttatagcaataatatcataattatataaaagtaaatacaaatatcgatcaataatattatttttttatcaaataaaacttaatttataatctaccctatagttcatcattgatatcctacggaccttattcatcaaatctaacgtccgaaaatcatccaatacatcagatctgacaacagcgcatgcacgcagggtcaccagctgaaaatcacacacgccagcaaatcaatcacggcccattttccttcgcatgccttcctctacaaccctcacccactaatcaccgcgtccctgtactgtctgccaccgaggtcgcccagatcgacgcttgccctagccttcctagatccctcccaccatctacctcctgtgactcccgtctttcgcaccctctcccacctttttttcacacgctcaatgcccgctggcagtcgcccacctcgccgatctcctctgcgtcgccaccaccgaaacgtaggtcatcatagtgctcagcttgatgattgcggcttcaccaataccagtgctatattatatgtattttctttagtattggttatggcacacataggattttgtttccagataaattgatgagtgtgaaattctcctgacttggtaagaaaatctataatttgttggccaagtagttcctgcttaagtacttactaaacaacttttgcaaagacgtccttttttatagcagactgtgagacttgtctattctcgatcaattatatagattcgacagacaaagcaagtaaattcaactaatttcttggtgttggaaaatttgactgttccttgctgcttcatgaaaatgttaaatattttgtctttccattgaaagagaggcaaagagatgatagatttaatcccttctatctgtttttatatgctgcattgcactttgactagtgcttttgcattctcaatttcggttaaagtgttggtatgaaggttaatgaattgtctaattccgaagtcacccaataatttgttccgttttgtgtgaatcttataccaatctcattatatatttaattgtcaaaataactgttaagccgtagcgtaagcatgtgcatgttaccagtaaattattgttggttaaatatttagggagttaaatcttaaaatgtgtgcacgctttattgggatggagagagttctataaagttgctattgttttccatatatataaataaatttcatgaaaccttaagtctcatatatttttatttgtttaaagaaagtattgaggcaaaaagttttgtacaagcttatattatatatttgattattatatttatactagtaaagtgtctcagcgttgcaacggaaaaaactaccacataccatgcatgcacgttgtatagtatttgggggcaacggatcgtaatgttgatgtagtacatcgtgttctctttacccgatcatgaaaattgcagggattcctatttcgcgtgcacactggctacggaagtaacgcgcagccacgcccccctcgacgccctgcgcggttagctctgtaattagtttcattagtgctaattatggtaattagcaatattttccttttttggcagggttttttactagtagattgaaaagaaatctacgttgaagtcaaattttaaaaactttcaatcgaaatttgaatttttttcaagtcaatttttgaaaaatttcaacttttcatctcaaatttgaaaaactttcaattcaaatttgaaactttcaacccatatttgaaaacttttaacctagattttaaaactttcgacccaaatttgaaaactttcaagtcgagatttgaaactttcaattcggattgaaaaatttttaggttaagatataaaaactttcaaatcaagattaaaaaacttctaactcaaaattttgaaaacacatgtgttgaagattgaaaaaagtcaaaaaaaacacgaaaagaaaacgctaaaaataggagaaaattgaaaaaggaaaaaagaaaatcgcaaataaaaaaggaaaagcgccatgtggaggggtgtggaggctaaatggtaaaagaaatctgaccattgcccttggatgtaaatgaaaataaaaaaatataaatgatgaaaataaaaatctttatttggcgatgatttcactagtgaccggtagtaataaggattttactacgttgggcatgttcgaaagctagagcaatgctgcggtcagctttaggatggatgaaacacataaggccatccctaacctaatgactaaaatggtgtcaatagcattaaataagttgtcacctaggatgaaaaatgatgtagcaagtgagtaaatgaggaaagataagaaaaccagatcttgcatgacacatagtttctacacatcatctaagacatcatgtgatataagaaacattaaatttaagtatggaaaagtggtgtttgcattgaaagagtatatctagtactagtttcttgatgatatggagtttatgacaactatgtctagtgtcttgggttgggaatggcctaagagttgcatgggaaatttagccgaaattacttgtagcttcctatctggtgcttgatgagagcagaattaatgtttcctctgaccttgttgaacattttatggaaggtgaaggatccctgagcaagtgcgaggtgagagaccgcataggccctcgaaatttagggccaagtgcaaggtgattgaagggccagtggctgcgatgcagatcaaataaaaagacaatgttagtagagacatatcaacgtttgtgaaaaacatatagccttgctctattcatataatttgtattttttaacacaaggccttattttgaatttggcacggggcccccaaattgctagggacgaccatggaaagttgtacggcatttccctaattcttatacacttgcagttgcaattatcatatcttgtagatttttttcaagtcactcggtgaacttctgttgcgacatcaagtgtatgtggtatcttcctcaaatgaaatattcttgagttctggctttgtagactactctagagaatctgtttctgccgtcaggttagaccaaactgatggcaattgagatgttcaattgatagttcggtttgggcctcttgcaaatcgagaaggaaaaagtctatattatggtattacctccttcgactatggaccgagtcagattttcctctcttaaccaaaaaaacagacacatagtctccctcaatgatgtggccatcaagtatatgcatacaaccaagcatgagaaatataaaacattgccaaagaatacgttggatgaatggaggatctacaagatattaaagtccaatgagttttggaacccaattcggcctccggagacagcactgacttcaaacggacctagcaccttcatgccaactcgaatttggatgatcttggacttcgtggaaagcttatctcgctacctttcaaacgcatccagtctcatgtccaaattcatctcgagtcaacgggaatcgccaaaacaagacagtgttgttgctgaaaccgaacttgggccttgggccttgtaatagactaggcccatctcggaagtgtctccctccacctccacgaattagcacttaaccctagctttattttcctctacaaatagctttgtacatcctaaaaaaataattgggttttgtttagttgaattttgccaagtgccattcaccttgtctctagtcctcgttcgattagtcggcgactattgattcagagcccacaatagttggtgtgttgatttgccgggtcgattagatctaccacttcaatcgcaactattcctttgtgcttaatcacctattcgcaatatttagattgcatcttatcttgttcttgcagtgttctctcgtttgcattgcagggatcatcaaccgcgcgtcacggttggtatgacatcgtttgtggtgtagcgattgcacgacgtcctagacttgttctgttggtagccacgtcgcaaacgtcacactcgatcaaagcgagagttatcccctcaccagaagatcgggccacgagagaaagcgtcatcactcaactatcaaaacggtcagtttacctcatttagtagttagcacaacagtctcgtctaacgtgacgcattgacttggcccacttgtatctacgtgacatcatagtcagtacttcaacttttttaaaatagctgccatatttgtcccccattcctccacctctctcctctattccttttgtaacagccctacattcataaccaggtatttagaagtgcatttgttgtcgtttagatttcatatttactatattgcaatttgatcattggcgataacaaaattaattctaatcggtaaaattgaaaccacttctatttgaacaataacttgaacagaagttacatgtgtaataatttattcaaatactagtttatttatcaccaacaaatataaattttgtggaatttttactctctgtttaggcctcctaagaattcaaaccaactttcagcctaaccaatttcatcttttcaccagaattaaaatatttcgaatttttgagtgaaactttgaaaaatggaacctagaaaccaacacctatcaccacaacaaatcccttaatttttgaactagttttacctagtcaaattgaatttaccaagagagggaaagaaaataaatcctggaaattgcaaaaacgaatatgtactcagtttttcacctacctctctcaccctcattaacagccacgacttgggcccacttgtcactgaccttgggtgcctctttagccccacaacacacccatgggcgtgcttccacctcaggacttaagggggggggcagagataaccccttcttcttcctcccctttcatcttcactgcttgttctttcttttttttcctcaagctgagctctcatctcacttctcctccccaaatcccatccaatagcccaagatcaattcatgcatgttagatcacaacaatccccatcatccaagctttccatccatcccaacatcttgcacatgcatggagagttgagagagattgaaataggagaagagagtggtggtttcagcctgcatggttgcagcagcaacatgactttgtttccctctatttggtgagcttccttgccatccatggtgcctttttttttatttcccttcatgttgaacatctacagcaacattcaacaggtcatccatctccattattgcagctaggaggtggctgcagctcatccggtgttaatctcttttgatttcggttgaagcagccctaggcaacgtctcttaccgtcagcccgaggccttgctccgtctcttgccatcagcccgaggccttagcctcatgaccctacgtccaggttgctaccatgtgagcgaagtctggtggaatttggagaaaagggggagcgaaaatagaaatcgatttctgagatagcttttgagctgaaagaggtttgcgctttaaaaattcataactagttcatatgaactccgaattcagtgaaccaaatttctgtggattaagaaaaacgtgatcttcaatgttgtaaaataaaaatgaccaacatttgtactggttttcccagtaaaaatataaatagctatatgtatcccttgtgtggtctagctcttatgaaattcgtaagaaattattggtaaaagctaaaattatgaaaccaattttgttgagcttatattttagtactctttgctgttgtggtgttgtttttggaaaaactacctcttaaatcatgtttaggagtttatttagcattcctatgtttctaacttgtaagatctataaataaataatgacaacacatatagctgtgaaataatttttcataggagctgtgagtgatgtaatttactctaaaaataatcattattatgaaatcttggtttgaaatgcattttacttgtaatgtactaaaggaaacgttaatatttacagaactgccattttcagcacctaagagcttgtcattttcatatctcccaaaccataagtgataatctggtgattctttcacctaaattcaagttaaaatatgatctacccactgtatttatttcataatttattgatcattttgcatgtgcatgtttatttggctcttattcgcatattgcttcttttcgatagattcggagattccggagagtaacgagccatatcccgaggaggatagtgactaccctcagcagcaaggcaagcacctaagcatatagaacctatactttctctaaaaatgatttggttgcaatctatacgtatatatatgcatgcattgcctagatattaatattgtcagtttatggtgtatgggtagaacctatttatgcatttagttcttgtgttattgctgtccttatatcctattaccacttgttgggattacttgggatttcttattcattaatgcttagccatgcttagtgctaatagaactatagggatggacagtgctattaattgtggtatataaacaacttgcattattgggcataaaacttgagcacttacactaaataatggttgatgaaatatgttggacttggacgggtgatagggcgatgatgggaggttggtttcccctgatgcaagtagccccgtctaggtcgttaaggaccgaacattttgacatctattcaagcacccttcgtacttaccacatgtcttatttgggaccggcttgttcttactagttctactgtgatcatttataccacattggagagttgtgaggcaggtagcctttggagggcctcgggtgcctaggtttggccgggggtgcctcctgcgtggcgcgcccaccttggtcacatcacgcacgcacgtgactgagtcgtcgggaaccccagcgtggtataggtggttggggtggggctaagaaagggcatttaatgagcttgaatcacttgtgtaccgcacttgacggggtgtgtagcatttgatctttgttcatttcgtgtgggtccaattgtacacctctgatcaaagtataatctattcgaatagccgcgtcctcggttatggacaatgcttgatgtgttagctagttatgttagcatcaaatgtggattattatggatgtgattatgcttgatggtggtgttggcatgttgtgccatgttggtatggactttggtagtccatggatgatgatgagagcgccgtttgggctcatttgcttatacatttcagaattatatacttgctgtccataaattaaaatgatgctagatttacttatccttgcttattttactcattaattgctcaataaaattagctttatgcaaatgttgaacctagagacccactgtaggctagaaagcttgcatatttctctctcccttatgtatatataattttgggtaagacttgcgagtacaatcttgtacttaaccggtgtctgcaattttaggagaggattccggttatgagttatgcttcttgtgtggtcattgctctgccgagggcggcgagggcaatgagtgatctcttgcagcttggctcttgctcggttggtttgccctagtggagttgtggcaccaccggttttatcttttgcttatgaactctatttgagacttccgctgctatatttatgtgttgtatgttgagacctcggaccctattatgtgtcatatacctcgctgcactttaaccctattatggtacttgctatgtttattaattgcttgcgatgaaagtgtgagactagtcgcattcctagggactagctaagcacgagtaacgggttttgatcgcttgagataattggggatagcgctttggatcgagtcactggggtatgcttttggtcgccaccttcgagtggttgacgggcatatgacgtggtggactggcaagctatcttacggttatgtcttgcgctcactactcgacatttcgtttattataatagaaggttgtcaaccgcgatcatggacacattgaggacgagtggctatttatgcgtgtatggatcccacttctccaatagtatgtggtggtcgcgttggacactggatggtataatactcggggtgtccacaccttttatctaccatctctctataaatgggtgacatccaagcaaagccataccatcattgtcaagtcaggtgtactctcgtcagccttcgtcttcctagtcaagtctggtaccccatcattcgcttcttgcgcctcttcttcgccaccttcttgcctcctctgccgcatcccatcatttctggccgtcgatagatgcaggaacaactgtcctcattgttggatatcgagctcgttgatgctcctcctccagtcagcactcagacgcaagcctatccccacacccccaccgtcgaaggagtcgatttgcaccggttttgattgatgtggaaggtgttatacccggttttatggttagagagatgattcgatcgagggtaagagacgagagaggcaaagtagacttattctatcccacgaccacacccacccaggacccagctatcgaatcgccactttgccagccgacgaggcgacgatgcacacagccacgtgccatcctggcggagatgcggactcacacgaacggagggcgatggactggggcccgccgggccgtgctggcgctggtgaacggaggccggttggcgcctggcggcggaagagcggtgaaacttgaaagatgcagtggatggcggagtggttcggcatctgaccgtggtggcgcgggaagccaacggccgctgcgctcccttgagagttgaagccgagaagtcgatggctcgcggacgacgcgaccatggatgtggtcttctcgttgcccactgcccaggcatggagaaggtgattcaccggtgcttcggtttaaactaaaaactttactgtagttgggggttttcggcttgggttttatatttttttccccttcgtagtttttgttaaagtaactagctgggtggcccgcgcagttgcgtggctagcaccaatataaaattatatattttttacagaactttttatttttgttgctttgaaaagtcacaccagtccactacttattcctttgccatccctttattaatttgcttgcttgatctaccgcaacttctatttattcttgttggaatatttcaaaattaggtttttagagttaattgtctcattgggtttctttttataacttttagaagtccgtcaaatgtcgctattgtactcgtctacggcctgcccgctgcctcccctctttatcattgggattttcaaaatcgaatataattattgttgggttcattttttacttcctagaagtcccgccaaccgtcggcggctccaccactatactactctacaacctactcgttgcctcccctctttattgtcattgaaattttaaaatcgaacataattatcattggttttttttttcttttgctttctaaatgtccggccaactgtcatgacagtgctacttaatggtttacccatcgtctcttttcttaatcgtcggattctatttggggttttgtttatagcttttagatgttcaatcaaccgccaccactctggtcctttataggtttgttgcttctcccctatttattgtcatgtgtcatctttatgttctagatgtactatttttaaaaaaaatccatattttttattccgatatcttgttgtattcctacttgaacttttataattatttttctattttggaattcattttatattttatttcaaatttcaattaatcttcttgtcctttaagcaaattatttgctttctttttctaccattgatatatagaggtagatatctatatctatactaatataaaaagggggagttatctccttgcaatgctgcaggctaaatcaacatgttggtcctatcatcatctgcatcctcatccgcatagctctcatccctaccgtccactgcgattcaccctcgcacagcaactccatggagaccactacacttcatacgtccgatggataacagaaaaacggacgcttgttatgttatatttctgacacatgcactgatatgtgcaaaaacactttaatctattttttctcttaaattatgtatacaaattatgatccgattacactattaaattcgttgcaattaaatcttcaaaacaagaccacacatgaatatattctgacgaaatttttttagctaattattgaattatttttaaatgttgcacgatgttccaccaggtatattggaattgtttcactgaatagatcgaaaatgtttcaatcgtttaaatcaggctttgtttcaccttatataaaaacaatgtttcagcaaataacgaaataatgttccagttcacggcaacatttgatatatacatagtgaaacactataaatacactaggtgaaacatttttggtagaacaaaaaaataaaataaattctcttaatagagggtttctaaaatatgtgggtaatttgttgcaaaagaatgtttcaattcacttcaacattagatctatacatagtgaaacatttttttgaacaaaaaatgaaacgaattcccttaatatagggttttcaaaatatgtgggtgatttgttgtaatggagtatgtggtggagacacgtggcagtgtgaccggggagacgtggtgggtcccagggggagcatgtgcgcacgtggtgggggcggggggagcgcctgattttctccccctcccccgggcgaccaaggcgggatctttattgtaaagatttaattgaaacgaatacactgaaataaacggatcatagactgaatgagtagttttggagaaaaatgattttaaagattacattcaacttacgtatgcatatatacttgcacaaaagttgcatcctgagtttctaacatgataaagagatgaggaggtattagcatgtaacattaaaaaggtgattcaaatgggggaggaaatgatgaggcgtccgaagtttcgccgtgatcggacgctagatgggaagtatttccgcaactccatcctatctccaccgtgattttcgctcccatcaccgcacgaagacttcgcccgcggtactcgctactaccgctctcgaaccccttcctgccacacccccgcgccgccgaatctccctgacctgccaccgtcgccgtgtcctcctcctccccacccaccgccactgcatcgcctcctccccatcgcctccgcgtcgtcctccttcacactcaccgctgctgcattgcctcctccacaccgcctccgcgttgtcctcctcctcacccaccgccgtcgcgtcctcctcctccccatcacccgccattgcccgccattgcctcgccgatctcctctctcagcgccaccatcaatcccgcggcggtcaccatccccgagtccccttcgccggctcaacagtcgtcgtcagatccgccgacggggtgaactcggcaacggtggtccagctctcgatccctaacacatgtcgcgccgtcctgtccaccgccgccgcgtccgcctccccatcacccaccgcgtcgtccttcgcctcgccgatatcctctctccgcgctgccatcaatctcgcgacggccaccgtcgctgccatgcagccgtcgtcgtcagatcctcctccactgccccaacgccggttgtgtcgtcctgtccgccaacacctgcgcaccctccgtcgcttgatattcctgcgagttttattaagaaaattacttttttcctgctgttgttacacttgctgtgtggagagaaaactttgtcagaagctaaatattgttgttaatgttcttggtcaatcttttttcaggcattacagtttgcaaccaactgatgacgaaattgtgatggctccatgttatttgcaccaactgattaactgaactatgctatacacatgggagactttggttaaaggattagaaatcagagtaattagaaaaagatacatgtccaatgctaatgcaaaggcttgtagaaagattatgtagagtgtttacccgaaataatctctagacactacaacacgatcatgtattctgagagccttctagctacttcagacggtgacagtgcttacctctaaggtattgtttcccttgcactctgaattaacatgacaaattctataataaattatatgcagcaatcaatttgatttatctccgtacatgctgcaatagaaaagtgcaggagctgaaatatttcttcgccaggtcaagaagaataggaacctaaacggtcaggtataatcctaaggttctttattatgtttcacccgtgagtggtcatgtggtggtttgtgtgcatctaactactgtatcgactaacagttcaacatgccctattgatccggtgctaatccccaagagctacttgattaagctcactacacaaaacagcgtggatatgacttcatttggtgaatattcatgtatatacattatgtttcgtgatatgtacatatagacatatcaaggaatggttttgttatttatttgtagttttgttccatactccacaaaagtagaaaatcaatgattaagctcaattatgatttattcctagtagcttggtttatgtgacttgggactgctaaacagtacacagctagcatattttgtttatagtgctctagataatatggaggctctagacaatggtgtcttggagctccttttggttaaacaacatatccacacaaacaaggtacattatgcttgctctcaagaaaaaaaagggttcgtttattcagtgagtatgcttttcctctagaaatcattagctgtagtgttagattcacaatttcattcatttgcaagatattcaatggaatttctatgtgagtaaattgttgtgcatatgaaggtgcatttgacaaaggtcaaggggaattggcgaactaatcagtacgacaactgttagtcaactaattagactgtctagtgtttagttttaacaattccattgtttcaggctacccaaacttcagacagaggcagaggagcaggaccacatgaactccttaatatagatgatcaacatgtctccatatctatccaggatgttggtcgaggagattttgttcttttatttagcattgattggtctctagttgatgtatctaatttcatatactccgtaagcacaacatgaaggtaatatccatacgtgcaattatttctttacttttagtttttactattttataagataacggttcactggtcaagcaagggcaaagacctatatttgagtagtacctattagatgaactaaacttggcatggaacaattctaattctgactatgaaaattgatccatttctctggtccaggaatttgagtgtttatcttttcattaccaaggcttagattgcctcacaatgaacctgcccaaggaccaatctcttaaaatttggtttgagtggatccaaagacagatatattaaaagaaatgatgcatctttctttagagacattttattgaagcacaaggtgtgttgtgttcccgacctccgtgctaggagcgtgcaaccgaattgcattccatgaatctaattaattttgccttcatattggcttgttattttcaaccttgattggcatggtccggcatagtagtagttctttaaatttcacaaatacaaaaaggtaactactgtttttcttgatattgttgtctgattgctcttatgttgtcccccttgaatttttcttacatccctgatcaagcaaatcaatgatgtgttgaagaatattatcattgtgctgcaggttcgtggtacctaagtggtccttatgtgtacaaggatcaatctgctgatgatataaagattttgggctactattaaaaaaaagtgtagcaggtacccaaatctcacaccttattatgacatagctagcagaaaatagcttgaattgatattccagtatcacacaagtataagacctcatctaatataaagatctactgttgccaccttttcttttatcacggattggcccattggattggttctgagttattcgctacctgtaacctgttgacctcaataaaagttttagcagttgaactacagatcataactgattttaatctgaatgttttctaaatgcatccttgcttgatggatctctttagcataatctggtgatcgatacgatgcatgcacttcataagtacagtgcaagttgtgttagtttttcaatgttgctagctagcttgagggaatggtttgtttcaaaacaaacgagttagttgtatcttcaattcttctcattcttcatattctgcggaattgttcgttaaaatctctctatgttcaatcagatattggcctagcgattcactgccagtaagcttgggattacattggctaagtatcattaagtgtaagtttttttttaaaaaaagaaagctattctaagagcaggttgcaatatatgctacttggagttacaagttagctgttctttttctagaaatattgcagggtttttgtattttctaacaaagctgattgaccatgctatgctgttttgtcaggttcaaaggatcataatatatatctgcaactctactttatttaaaacttctaggagaagttgaggatcacacattcacatataagtgaccatttcttatacaaatgtaagcacaatttttttatgaccagtagcatcggatgatcaaagtgtcttttatctccgttttccacattctcttgaaccctgaggtttttttttctgtctaatccttaattcatacaaggaggaccttgtattattttatcttatgcttttgtatttcaatgaaacatggcttgaatataagtttatttattctttatttgatgtgaaatgaatcgtatactttaaatttaataaacttattgttgttgtaatatcggtgatatgctaatctcaagttaatttatatttgcatgacgtgccttgcacttgcacgattactagtattattcaagctttgctttcacgatgtaacacgcaacatgcaaagacgacaagacattcagtgcactagttatcgtgcagatgttttgacaatagaattaacaaatgaagaaaaatctatgcaatcttttttaatgtaatgcactccataatctgaatggttatcttataaaaccactctgttgaatcactactttctgaccaacaaagataaaaatatttagagggtacaaaattgctaagcacaatttatacattgcgatgttgctactttttggaagccaacaattatagatcagagcttggatgtggacataggagtacagaattcattactttcatctttgtccgtgaccattttcattatcttgtcataaacagttcacaaaatacaattcggtaaaacaaaagaatcaattctaaactcactatttcttctccatttattcatcagcaaagtgactcttcgacattcatgtatgcaaattgtaacatctgaaaacaacagcccaccataaaacatacctatcatctagtaagagccatatctttgcaaggactctttgctgcaatttctatctattggtattccctcttaaggcaataaaaatatacaactatctgtgctgaataacaaaccattaaaagtatataacatctttactcaatcattatctaaaaaaaatctttactcaatcaaccaattcatataataactgcgacgtaacgtcaacaaaaagaggcaaacatgggccaagagaaagctacagagacctagtttggcacaattttctggaacggcaagatgcagttattgcagatatcaaattaccatcagtcaataggtgcaggttttactaaagccaaaagtacatcaacagaaaaaagaagccatgacatgcactgtttataatagaaaaatcgaagctccatttatcaattacttctgtgttgaactgaaaccatccatgtccgtgtaatatacaacttaaaaacaggcaacaaggccattagttgatccatctcaattgatttaatcttcagactgacagaccatattaatagcaaagcacatagttacctatgtaaaacattctgcatctgctttcaattcgcataatctatacaatacaaacgaaaaaacagtaaaaaacatgacatgtggtcaatggtactctaacttctacacctactgaaaggttcaatctgaggcaaatacatgatcaacaggatatattagatttgtacccttatggagagctcgacagctagcttctgcctgatcaagtgatgatggggatgggccaatatttggtagcgctataatcatatactcgatatgtacagagagatttggaatacctatcgagagggtttaactgttaaaatcagggagccagttagagaccataactgtcttatagaatagcatcattcagtggaatgaaaacacagatgtattgagctctttcttagccttcaaaaggttatcaatttttagacaacaaaagatatagataagtggcagtcatattaggaacgtcaagcagtagtcctaacccaacaaaataaagagcagcaagtaaggcatgaagagggtatggtcagaaatgaaaaatgagagtcagctgcccagcaacaagtctcgtaaaatcactttttaatacacacactacagttgagtatttctataggccaataaaaattttctgcaagtaaaataaaggtagcaaacaaatcaaatgtcagacaaaaaataatagtacctgtcgtggcacaattttgcattgtagggcttcgtacattatccattgaaagtaatcagaatgaacggctatgtcgtggagcacgattatggtatagaattgcaaatgcaagacactcttgtgcatcagtacaccatatgacacaaacttcacgcgaagccctatccaaagatggttcactataatgtctttgaatatatgtaagccatatagggtcctatcactaaacttgttgaacacctggcaaagatggttccctataatgtagaatcctcctagtccctgtatatgcaagctcaatatctatacataatgattcaagagtgccaccataaaacaaaataaagaattctcatcaatatgccaaatcaaggccaaaagataattaaatagccaatgcctgtgtctaaatattccctactgtagctgaaatgccatgactattaagaagtttacacttaaatcgttgccggctattattgtttgacaattctagtacaaggcatcacttctctattctcctctgtaagtattcccactgttggaagttagttcatattggatttgttataaaacagtgatttgctatacagccatgtgaatcgccggttccagattatatccaaattttggtacgaaatggcatattcatatgttatcttcatgatctgtcattgccaaattttactgtataaatagaaaagaagcttactttttaggtcaactgtagaaatagaaaatacatgttcatatatatgttttcttacttatctacatggctggattttaccatagaaatataaaagatgaagtgaagcagaaaacaagcttacttttaatttcaattgtttgcttgtttggttctttccctctcgatttcaatgagaaacccattaaaaaggaaccgaattaattacaaacttcagaaaactgtaaaatcctctaacgacaacatgcttaccagtgacaacaaattaggtatctgtctatgtgaagctctagttttctaaaaaaacatgaatatgtacttacctcatgatttcattaaacatggccactaaaaatctttatagtagatgagatttatttaatttctgtaacatcaaaatttcggttcaagttaatataacattgatttactcacattgcaaggtggtagaaacagaagatgaaactgaaactgcatatagttatacaaagtgcaacatcaaattgaatccaagccagacatgtgatgcctcatctgccctatgtgatgcttcagttgtagctcttgtaggtgtggttgtcggcagagctagaagagtagtgggctgcagcaatgaaatagcctgcaatatgaaacagaggaaccaaaaaacaacaaatttagtatttagaccattacaaagctgagaaaggtctgggtatgtactctcctaacaattgtttttgaagatccaattgtaggaggatcaaatgctgctccctaaaaaccaaaacatccattcaggataagaagctaagtaagtaaatatgcaacagttgaggcggaactgggaaaaattattattagaggttagaaagcagtacattgcaattagcctgaatttaccaccaagaaatttactcttctgaataattctaatagaaataccattagtccactaaacctacatagccattaacaaacaaataccaaacattaattttctgattcatggtgaaattagcattttcttattttgaacgaacctgaatgttggtactttcacatgtaaagtacgatgattactaacatacacaccaaccaagaaatttatcgagataaagtttcatgccttgatatccttaagatattcggatcagaaaagccagagaaattcctgtgtttgtcacgcataaaaataagttgcggacctagagttgaccatggattactacatattttatatacaataatcctaccatggcctaatacatctcaacaatagagtcaaataaaacaaaattatcaacacggagatcaaatgattccccctatgtgcgagttgtagatgaatctaacgtacactctatcagacaaatatataatgatataaaagagacagagaggtataggcttgcctccatggctatcatggcttgcatccctaccactgctattgtttggctaattgcctcatccagtcgaaccaaaagtaggtgcttgagaaaatcaaaatatcatgtctcggtgcgccagtaatggaagcaaaccaaacctaatggagtatatataaaggggattcttctttttcacctgggaagaaatcaccacaaacctatcctctggtctcctcatcacctccagtataccggccgcagtcgacggcttggaggcgatgtagccggaggcgtcgtccttcacatgggttgctcaggcttgtgaaggggatcaaagtgacttcagaggaggagagtcgcagaccagaatggcgtgtgccgcagctagtccagggaaagggcataccaccccggcgccgtcggggtagtccaggcagggctccagtggaaagggggaaccaccccggtgccggtgggggcagaccatggtcgcgacgacgggaagaagcgaggaagcgcggagcgaggtgtagcgcggggatgggaggagggagcgagtagcgcttgggggcgtagtcatcgcgtggggacgggaggaggcggagtcatcgcagcgcgcgggggcaaaggcggagtcatcgcgacaggagtgcgagcggtggggaggatagggtcgtcgaaccacgaattttttttaaaagcaatatgattttaatggaaaatcgcaaaactataggtcagttaggcaaaatcgcaagtttagcaccctgtcgaacaaccgcggttcgacagggatacctatcgaacaaccacagttcgacaggtacatgtcgaactacgtgagttcgacagggtaggtggtccaaaaacaaataaaaaattacatgaacagtatcactacaatgctagtcagggacatatcgaacagccaaagttcgatagggttgcgtgaacagcgtgctacagtgatgctacagtgctcgcaggcacatatcgaactgccttagttcgatagggtattgtgaacagtgtgcaacagtgatttttctcttttttttaattattttaatcacctgtcgaactaccgcagttcgacaggtacccctatcgaactgtggttgttcgataggtaccttgtcgaaccacggttgttcgatagggtgctaaacttgcgatttcgcctaactgacctatagttttgcgattttccattaaaatcatattacttttaaaaaaaattctcgaaccactagggcgcccggacctgatgagattagatgtgatggcagatggacgaatgagatgagatggggtgatttcacctttaggattggaggggtgcaacttcgaaaaagctaatcggcgaccagtcgcgcgcgccctcccctgcacaactggacacgtgtcgcacgcgaaggaggcggcgaacggcgcccgcgcgtgagtctttttttttcggtttttctgttttggttttttttgtttctcttccgtttttttgggttctctttctgttttggtttttttttgtttctcttcccttttttcggttctctttctgttttgtgttttggttttccggtttttttctcttccttttccggttttcttaagatgtacatatgcaaagtttatattcgtatgtatactaaattttgtatttgtacacatacaaagtatgtattcgtgtttttttctcggtttttaatatatacatacaaagtttgtatacgtgtatgtaaagtttatatattcgtatgcaaagtttgtatacgcgtatgtaaagtatttttttagtacacataatttttttatatacgtatatatatactttgtatacacatatataaactttgtattttattaatataaagtttatatatatgtgtatacaaagtgtatataaagtatatacatacgtatatacacactatacacatcgtagtagtattgttgtagtagtactactactgtagtagcagcagcagcagcgcgcgccagtagcagtagcaggagcagagtagcagcagcagcaggagtaggagtagtagtactactagtagaagagcagtagcagcagctgtagtaggagcggactggtcgcgcgaccagtcgctcgttagggattcccgtgcaactcatttttatattactccctccttctcataatagggattttgagtttttatttgtaacgtttgaccactcgttttatttaaatttttttaaaattattatttattttatttatgacttactttattatctacattattttaagcacaacttttcgttttttatatttgcaaaaaaaaaattgaataaaacgagtggtcaaacgctgcaattaaaaacttaaaattccttatattatgggacggagggagtagtacggaagtactccatttttcgtgtacaactttgactgtatgaaatttttttataattcgtatttttatttatgttagatgataaaacatgtttaatattttatgcgtgacttgtctttttaaatttttttcataatttttccaaataagacggacggtcaagtgtttggcacggaaaccagggtttatctttttttagacggagatatatattattatccattattgtaattgtagtggggaaagtatttcgtagtgctagagatgggactagctagctgtctttcgacagatttcacagcccatatcacacggatttatcgatcattagattagaatccaacgtatattaataaacaactatagtaactatctaatggacctccatatgaacgaacccaataatacacatatgggttgcaaaatatttcataatgcaccagtctattagtaaaatatatatcatgttaaagttacaaatgtaattacactatagttacgtggtacttacatcgtagttacaaatgtaattactatgtagctaaattgtagttacgtggtagttacaaatgtaattacactatagttacgtggtagttacatggtagttataaatgtaattacactataattacaatgtagttacgtggtagttacaaatgtaattttagtatatttacaatataagttctaaaattacacatgtaagtctctaaattatatatataattttaatgtatttataatataagtcataaaaattacatatgtatatccctaaattacatatgtaattttttcatgaaaatacatgctggcgaaatgagaaatttaaatttaattgtttggatctcttaaaatttggattgagtggatccaaatacagatatattaaaaaaaatgatgcatctttctttagagacatttttttgaagcagtgttcccgacctctgcgctaggagcgtgcaaccaaattgcattccatgaatctaattaattttgccttcatattggcttgctattttcaaccttgattggcatggtccagcatagtagtagttctttaaatttcacaaatacaaaaaggtaactactgtttttcttgatattgttgtctgattgctcttatgttgtcccccttgactttttcttccgtttctgagcaagcaaatcaatgatgtgttgaagaatattatcattcagctgcaggttcgtggtacctaagtggtccttatgtgtacaaggatcaatctgctgatgatataaagattttgggctgctattaaaaaaaagtgtaacaggtacccaaatctcacaccttattatgacatagctagcagaaaatagcttgaactgatattccagtatcacacaagtataagacctcatctaatataaagatctacggttgccaccttttctttcatcacggattggcccattggattggttggttctgagtcattcgctacctgtaacctgttgacctcaataaaagttttagcagttgaactacagatcataactgattttaatctgaatgttttctaaatgcatccttgcttgatggatctctttagcataatctggtgatcgatacgatgcatgcacttcataagtacagtgcaagttgtgttagtttttcaatgttgctagctagcttgagggaatggtttgtttcaaaacaaacgagttagttgtattttcaattcttctcattcttcatattctgcggaattgttcattaaaatctctctatgttcaatcagatattggccaatcaattcactgccagtggatggatgtactgatattgaattttaagacttgtgaaatgtgaaatgcatttgatattgcaatcatttgtggaatgttaattcatttgaatctgattttgtatgtactgaaatattgtatctgggctgaattgtatgggctgaaaaaatcagatgagttgtgtgggctgaaaaaattatatgggctggaaaaatatatgggctaaattgtaggggttgaaaaaatcatatgggctgaattgtgcgggctagaaaaatcatatgggccgaattggtgtgggctgaaaatttgtacaggctgcactcattaaaaagaagcaaataatatactgggccagctagaaacaaccccagaaaaaaaaattttgtagcccgtgagctacatgggctttagcaagccgaatcttattttgtgactttttttttcaaccatgtcaactgccaagtcagctgccacgtggcaagccccaggattttgtgataataaagcaatgtcatatgcttgtgacaatagatgtacaaacgtcacatactaaatttatgacggtggctttttgacgtttgaaattacgtcaacttcatatattatgacctaataaaatgtcaaaaagccacacacctctcgtagtgttagctgtgggattgcttggtatttattggatgcgaatccgatcagcataggaatcagccggttcggtgaatagtagtagtaatctgtaaaagtttttgctgtaaaagttttggccataggaatctctagaaaagctattgcatgtgaatccgtgtattatagcgtttcgtagtagtatttttatgtcatgtgacaggagtagtagtctgtaaaagcttccaattccataagagctattggaatacgtgtaataaaccttttcgacttttgaacttctaaaccggttctgacttgatattaccttttgtccggtttttattgttgtgtatatactttgcgaaactctgattaaatcttaccgctaaaatctagatctattatgatccaatggtttagatatttttctttttcttcgattaatgtgggaatttttagcctgcacaataaatacggtgtctcctttaattttaaggctgttttaataatttaatttaatagatagatagatagatagattttttccaatcataatttcagtttacttttcttcaatgttaaagttttaccaaacatagaccatactagtgtaaaccgaatcgaatacccacgcctaaaagcaacgacgatatgctggcgcgtggtagcccaacaatcccaatccccaaatcatcccaattttctggccacacttgcatccctctgccgccctcctctcttccacctggcctctgccactgctcccagctcccttctcatccactgtcactgccactgctctctcgctggccaaaggagaaggagaagaagagaagagaagagaagagatggcagcgacctcatcatcatcctccccctgcatgattgcctcgctacgcagcagccatcgctgccgcctttcgccctccgccaccgccacgtcgccgccccgcctccgcacgcttcctccccgccgatgccgacgcaacccctcctcctcctcctcctcctcccgccaagcggcggcaatctccatggctcccgccaatcctcgccaccgcctcatcgccccgatccacgccgccgccgccgccggaggaggaggaggaggcgcgggcgccacctctccctcgggcctacccagcgtgagtcgtcaatcagtcaaaatgcacgcagcctcgtcgcgatttcgcatgacctgccgatcgaactgacatgcgtgagctatgtatggattttatagctcgtcgggatcgcgcacctgctggtgtcgctggggatcgtgctggcctccgacaagttcctgaagcaggcgttcgcggcggcgtccatcaagttccccagcgccctcttcggcatgttctgcgtcttctccgtcctcgtcgtcctcgacgccttcgcgcccgcgctcgccaaggggttcatggacttcttcgagccggccaccctcttcatccagaggtggctgcccctcttctacgtcccttccctggtcgtcctgccgctcgccgtcagggacgtcccggctgcttccggcctcaagatcttcctcatcatttgtatgcacatcactacgctcctatcgttgcatgcattctgctacttctttcttcctcctgatcatcgtgcttatctgctccgcctctgcttcctccggattttacattctactacttcgtatttgatatgctgatcaattaacttgcagtaaatattaccacaccaacttgcattgtggattggccccattcataaatcacaacaattttacttagagggtgtttagattcaggggtgtaaagttttaccgtgtcacatcggatattatatagggtgtcgtaatagggtgtttggatactaataaaaaaaactaattacagaatccggcagtaaactgcgagacgaatttattaagtctaattaatccgtcattagcaaatgtttactgtaaaaccacattatcaaatcatagagcaattagacttaaaagattcgtctcgcaaattagtggcaatctgtgcaattagttatttttttagcctatatttaatacttcgtgcaagtgttcaaacgttcgatgtgacagggtgtaaaattttagggtgggatctaaacatgcccttggtttcagattaatttgcattcaatctgaaaaaaccgatggtgtgatgttatctggttttcatttcccagttggtggctggtttgcttcactcatggtggccggatacacagcactcaccgtgaggaagattgtccagacacagcttataccagctgagccgatgagcaagccgtctccgttcgcgacgctggaattctgggcctggggtgctgtctttgtcgcatcgtttgctgttgcgtatgttaaccccacagcgcttggcaccacggcaagaacatgtcttcctttcctcctcgcttcaactgtactgggatacatggttggttctgggtaaatacatatgctttttgtatacacttaatctgtaagatctgacgaagccaccagctgccttgtttactccatttctctaacaacatacatgggtcttattgattacttggcaggataccatctggtgtcaagaaagtgcttcacccaatcatttgttgtgcactctctgcagatttggcagcaatagcatatgggtatctctcccggtctggagttgatgcagtgctaggttgtaaactaaaccctgatcaatagtgctctaatcaagttgtgaattctgaaataagttggttttaattgccaggtgattacctcacaaaggcgccatctaatcctggagctggtgacgtcctgatgggatttcttggttcagtcatcatatcgtttgcattctcaatgttcaagcagagaaaggtagtgcttgctgctgtttctgcagaattattctcagttagcatgcatggttatggtgtgagatgattcatatatatcctgaggctctgtgtttgttgttgctggtgtgtgttggctaatcaactaataatgttttgcggtgggtaaaactcagcttgtgaagaggcatgcagcggaaattttcacatcaattgccatcgcatcaacattctcgttatactcaactgccatcctaggacgggtgatagggctagagccttcactgaccatatcaatattaccgaggtgcataaccgtggcgttggctctgagcatcgtgtctttctttgaaggtacggacctagtacatacttatattgctggaaatcaatttctgttcttgctggtcgatcagctagatatataatatggagtactcagctagcttattatatatggtatggatgacttagtttgtgtgtcccgggcatgcaggtgtaaattcttcgctaaccgctgcggtcgtcgtcctcaccgggctgatcggcgcaaattttgtgcaagcagccatggacaagcttggcctcaacgaccccatcgcgcgaggaatagggacggcttccaggtacatatatacctttgagttttacttttgagatttgttccggtccaacaaaaagtatttcgagataccgatacctcacgggttcacagtatcaaatcgtttccgatcgttagatctaacaatgtccatcctacataactagatccaatggtcggaaacgatttagatcaaatgatcgaaaatgatttggtataccacgagatagcaaatttctttacttttacctacctgctggctgctttttttagtaagttaagctgcatatatatacatacatacagcagtatgctctatgaataatgtttgcatttacgttgcagtgctcatggactgggaacagcagcgctgtcggccaaggagcctgaagcgctgcccttctgcgccatcgcttacggcctgacggggatcttcggttcgctcatttgctcggttccggccgtcaggcagagcttagtgttcatagctggctgacaacacgcacggtacatcagttttgtttttgtttgttttttctttttcactttcttttgggtcgtcgtgcgtgtatagagcgatgctcgcaagattgcaagaatatatgtatacagacacattttttgtgattatgtctccgttgtaataagaagcaagagagtaattttgtacccctcggtgctcactaccactaaactagctccaacattccatgaagcagcagcagcactgcagcagccagcaggtgagcagggtacagacagtgtcgtactgctagagcttgcatttgaccattttgtgacccaacgaactaaatgcttgtaatgtcttaggtcaaacatcatgtggcatatatacgctaacaaaaatcttgaccgtagcaaatactccctccgttttttaatagatgacgccgttagactttttcttacgtgtttgactattcgtcttattcaaaaaatttaagtaattataatttattttgttatgagttattttatcactcataatactttaagtgtgatttatatcttatatatttgcataaaatttttgaataagacgaatggtcaaacatgtgagaaatgtcaacggcgccatctattaaaaaaacggaagtagtatctacttttcagaagcaccaatgatttagccttatagcaaaacttgaaatttactgaagaatcaatagtcgtgttgtgtggagttatggatgcatcctaatcggggtttaaattttgatgcctacaaatattacaaacatgcagttgtgctttaaataggaactagcatggtggcccgcgcagattgcgtggttagcatcattatattttctctcatgtaatagcatatatgttttctcattatattattcaaatatattaaaataacaatataattttaaattttgcaataactttacaaaactactaatgtgtaatattcatatcatatttattttaggggtaattgtgttcttacccttgctttacagttcaattgtgattttaccccgctttacagttcaattgtgattttaccccttttttttttagggtttgtaatattgcccctgcttttttaaatgaagcagctgcttgcccctactatgttacctcatgtaatggttttaaatgtgtagtgaatggacaaatatacctctactataattttggcatgaacaccggacatgtttcaagttaaatttgtgcgtatttaatatgggacctaaatgttagacaaattttgtacaagttgacagaacactatatttaggatagttttgacagaattttagcaataattttgacacaatttaaaaaagatgacagaacacattatttgggacaatatgtacagcatctccgtcatatgattagaacacattatttgggacaataaactcctccgccgtcgccctgccgatgccgctggcgccgccggtgatgacggcgaccttcccagtcagcctacaaacccgcaaatcacattcacatccatccccgattcgcaatcaagaagatgaaatcagcgtccccaaccaatggctcaatgcaactccaagctgaatcgatcaaatcacctctgcgaataggaggcggtagcgaaggcactgacggaggaagacgaagctgcaggtgtcctcctccccctgaattacaaaagttttgatccctgcgcgtgcgcccgctgctccgcgccctcctgcgcactggccgcggggctgccgcgcctccctgcgcgtgcgcacgccgcgccgcgccctcctgcctgtccgcctagcgcgcgacgatgccgctcctctccccagcgcctccctgcccgcgcgcaacaccgccgcccttctccgccgcgcctccctgccgcgcgcgtcgccgccgccgccgcttgtcgctaggttttcgatttggggaaatcgttccagcaagagaagtggttactggctagcccttttagtgaaccaagggatggtcattcacaaactataatatcattttctttcttcgttttattgggaaattccgggcccatcaaactaccgtgaaaactaggggtaaacgggtgcttcatttaaaaaaaagcaggagtaaaatcacaaaccctaaaaattaggggtaaaatcacaattaaactgcaaagtagaagcaagaatacaattgcccctatattttatatacatgttagttattaattatttttactatcaaattttagttatttataaattatatatattcctatatggactctagactcgtcttttaatttctttttttattctgaattttctgtaaattgtatttctatatagactctatgctcttcttccaatattatttatttttatttatgaatttttatattatattttatatacgtgttagttaataattttttttaatatcaaattttagttatttgtaaattatatatattcatatatggactctagtctcgtcttttaatatttcttttttttattccgaattttctgtaaattgtatctctatatacactctatgctcttcttccaatattatttattttatttttgaatttttattatttctaattgtatttctatatggactctaaactcatctttcaatattttttaatttttaatttcgaatttcacttacttctaaattgtactctgaccttaaactcttcttcccatgtttttcttaatttcgaattttagttatttgtaaattatatttttatatggactctaaactctacttttaattttattatgtttattccaaattttagttagtttttaaattcctatatggactctatactctacttctaatattccttattttttaatttccggatttctattttttttcttaattgtatttatatatggactctgtactctacttctaatattccttatttttaattccaaatttatattatttcctaattgtatttctatatggactctatactttacttctaatattccttattttctaattccgaattttagctattttctaaattgtatttctatatggactctgctttttctttttctcctattaatgtaagaatttttagactatgggagtgaacgtggaggctcctttttctattctgaatttcaactatttctaaattgtatttctatatggactctagtctcctcttctaatattccttattttttaattctgaatttcagctatttctaaattgtatttctatatggactctgctttttctttttctccgattaatgtgagaatttctaggccatgagaatgaacgtggaggttcttttttctattcctttaataatataatagatagatttagtgaggttttgagatttgctgccgacctctggctatttgagcacgtgtttaggggtgggttcgtggatgtgtgaatatggtaaaccttttgtataatcctcacaggatattgatgactctaatcttactcctccatccaacatatgaaataccccatgcttgcaggataccaagaatcctttttaacagaatttcttaggtcgccttagtacagcgactccatatgtgacaagccctagctcagttgctatccttagagcaaatcaatctaaatcgttttcgcaccagtattttgaattttttttaaagaaaacatgaatacacctagaagggaaaatgctaaagctatcttcacgaaatctaagacaaactatgaagtccaagggaagagccaaggtagaacgaaactagtggggttagaacgttaccaagagatattaaaaaaatatatcctcaaaaaaaaaatttgagaaccctaaacagaatttgatgcatgaaaatagtcgtcttttccaatggatgcctaaaactgattccctacaattgataagtgagctcggtagagaagaaatctgatttttcaatataaaaaatcacccattcctaccaacagttcctcgtgctcgcgttcggatccgtggatagaaacaaggaggactcccaacttatggagagcgagatatgtggagatggggtttttaatttttttttggcacctctctagtggaactggaatcctatttaacacatatgcactagcaagataagtagcgcacaccttatccaatctcctttttctcttgttgaaaatttttaactcggatttaaaaaccttcaacttaagatttgaaaacttttaagttaagttaacttaaaagttttaaacttagatttaaagactttcaggtcaagatttaaaaacttttcaactcagaattgaaaactttaagtcaagatttgaaacttccatttcagatttgaaaacttttaaatcaatatttgaaatttttaacttggatttgaaaactttcagctcagatttgaatttttgagttgagagttttaaattttgagacgaatgttttgaaatctgagttcaacattcgaattgaaaattttcaatagaatattttaaaatttaagatgaaacatttaattataaaatacaatgaaaaaattgccaaaaatcggcatgctaacgctaatcgctattaccttaacattaatctctactagcgctaagcgtaggaggtatgctgcgggcgggcttgctggtgtggtgtgctctaggaaaatgcggaaatccaaaattatactccctcagtaataaaaaagtcaaatctagtccataaaaaaaatcaaatctaggacgtacaacgaatctggacaatcagattcattatattaaacgggaaatctatttcgagagcgctctcggtttagctgtatagtgcgacacatctcagagccgtctaatcgtgcacgtcatcgtggcgtccatccacgtgggtgtctttttcctcttcaaataaagttttctctcaaattacttatccgatctataatccgattataccattgtgttcgttacgataaatcttcacaacaagatattacatgattatattacgatgaaaaaatatttatatttgttaattacttttattatataaataagttacttttatcatatatatataagttagttttagatttgactaaattactttttagacatataaaagtaaattcaataaagtctaaaagtaatttacatatattataaaagtaacttaaaacaaaacggaagtaactttgtcacaacattagaagtaaattcgttgtagggataaaaatatgactttatctagaaattaaatttaatcagcacagatcaacacacgtaagtttaacaatttttaaaagtaacttcaatgtttttcaaaagtaacttcaatgttaattggaagtaacttttgcatggttaagaagtaactctctataaatatgtttaattaccgattttttttcctttcatttttgtttttcatgtagaaagagaaaagaagataaaacctttgatggattgtaaataacattgatggaataactaatgagaattaaccatgtataagatgtaatagttacttcctgataacatagaagttactttctaacatgtaataaattacttttaaattaattaaatgtttgaatatattcaataggaaaaagtatgaattaccccctcgaactatcgcggtcgtctgaattaccccccctgaaccacaaaactagacattcttcacccccaactatgcaaaccggacgaattacccccctcgacccaatccacggtggttttggtctacgtggcgtacacgtggcagtacagtcagtgtttttttaattaaaaattgtgcgtcccgcatgtaatactcttcttcctctctctctctctctcgcagcgcgcacggcgaggacgagtgcggggacgggcggtcggcaggaggctgcaccgcgtcagcaagaagcctttggctgggaagaagcctctgctgctaaggtggattcagacgaggatgacgcggcggaagagtgcgacgatggtgcggtggtgctcggcggcgttgagcgagaggtagcaggcgaggaggtcctgcaggtcctccagccaccagacgccattggtgcacagcatcttgatcatgctgtccaccagcttgatgaggacatcctctactattacccactggcaaagacgcaaaagtcgagcgctaaccgtatgagcctctgaataatcctaccttgcttagcttgggagaaggaagacaccttaaaagggagagccacccttcccctattggactatttttttaggggagattgggcctttccccgagtgggtgtgcctaagaactgttggggtctgggcaaccttaatttgttgggcctcggccaaccccacctgggccagatctttatcatttggtatcagagctgggcccttgttaagagggtgggaatgatgaggacatcctccactattatccgctggcaaagacgcaaaagtcgggcggcgaccgtgtgagcctctgaataatcccaccttgcttagcttgggaggagaaagacaccttaaaagggagagccacccttcccctattggattagtcttttagggagattgggcctttccccaagttagtgtgcctaagaactgtttgagtccaggcaaccttaatttgttgggcctcggccaaccccacctaggccggattgttatcattttggtggagatgcggggtattcttgaatacaaagaatacaataccgtgaatagattattccaatttgcttgcaaagctgaaagagaagtgcagggacgcaacaagcataggagttcttttgcaggtgctacttccacacgacaatcaacaccacgtcaatttactacggccgttcgtccacctacctccacgccatcccatgctcaagaaacaagcaaaaatgcttcagttcagactccagccaagagtgcaacttcggtagcttccactggacgtacccgtgatattacatgtcataggtgccatggcattggacacattgcccgcgactatccaaatcagcgagctctatttgtgaatgatgatggtgagtatacttctactagtgattgtgatgatgaatatgctttagttgccactgaccatgtaggaggacaagataacgatgacatcgaggaagtccatttgcatccagagtcgctagatcagtatcctagcctaattgtcaagctagcacttagtgctaaagagaagtgtgaagagcaaaaccaacgccacaatttattccaaagcaaagttcttgtgaaaggccataccgtcaaagtgattattgatagcgggagttgcaacaatttagcaagtgaagagatggtcaagaagcttggcttgactacccatccacatccacatccgtatcatattcagtggtttaatacatgtggtaagatgaaggtaacccgcttagttaaaatactttttctataggctcctaccatgatcaaattgaatgtgatgttgtgtatatgcaagcttgttctgttattttggggcgaccatggcaatatgatagagaagttgtttttgatggtaggactaatacatataaatttatattcgatggtaaaagagttgttttgcattctatgactccagccgctgctttgaaagatgatcttgcaagtcttgaatgtgaaaagaaagcgaaaagtgaaaatcagattattactaagaatcttgcttcacctagtacaacagaaccaagtgccacaaagaatgaaattaagttgacgggtgctttgttagcttctaaatataatatttgtgcactagaagagctagattcttgttgctatcctctattttgcaaagatcatatacccacattggctactgcttccagtactttatattctttgctactcgctgttactaaccttttgcaggaatatgagggtgcttttcatgatgagatacctccaaggatgacccctggacgacagagtgaacacgatcaagaagatgggattgagtcgaggacgactccaattcaagaaggggaggatgatgaggacatcacttcgtcggaaacgcacataacttcacacgttccaatgataattccaagtccaagtccatttcggcctccggagacagcactgacttcaaacggacctagcgccttcttgccaactccgatttgggtgatcttggactttgtggaaagctatctcgctacctttcaaacgcattcggtctcatgtccaaattcatctcgagtcaacgggaatcaccaaaacaagacagtgatgttgctcaaaccgaacttgggtcttgggccttgtaatagactaggcccatctcggaagtgtctccctccacctccacgaattagcacttaaccctagctttattttcctctataaatagctttgtacatccttaaaaacaattgggttttgtttagttgaattttgccaagtgccattcaccttgtctctagtcttcattcgattagtcaaggactatagattcagagcccctaatagtttgtgtgttgatttgctgggtcgattagatctaccacttcaattgcaactattcatttgtgcttaattacctattcgcaatatttagattgcatcttatcttgttcttgcagtgttctctcgtttgcattgcagggatcatcaaccgcgcgtcacggttgatacgacatcgtttgtagtgtagcgattgcaggcgtcctggacttgttctggttggtagccacatcgcaaacgtcgcactcgatcaaagcgagagttatccccctcaccagaagattgggccacgagagaaagcgtcatcacagctccagctctgctccgtcgactccatcaccaccgcctcgctctcgcgcagccacatccgccaccaccgcggccgccggctcggcctccccgcgctcaccgacgacgacgacgccggcaccggcgctggcactagtgtgccggcattgttgctgtcgtggccgccgccgctgctgccgacgcacgcgcggccgccgacccaagctccatgtgtcatcaccgagctcgcatttggatctggggtggtggagcgggattcccggtcgccattcacgcctgcgtcctcggtggaaccgcgtccgccagtctccatcgccgatcctggcacggggaggtgggatggggcgcggcgcgacggctcggaggaggagctgcagtggcggtggtgtccccgtgcgtccccgtgcgcccacaacgaggagggggagcctaccggccaccgcgcgtccccgtgcacccggttggcctccgcctccggtggccgccgtcgtcctcgggcccgctccgccacccacaactggctccgccccccatgcgccgccgtcctcacctcgccaatcgaatcaacgatgtgtccgcctccgcgccgccacgctcgcctcacctcgccgaccgcccacaccgaccgcccgtccccgagctcgtcctcgccgtgcgcgctgcgcgagagagaaaagagcgagcgagagagagagaatagagagagagagaggaagaagagtaagataggcaggccccataattttttattaaagaaacgctgactggactgccacgtgtacgccacgtagaccaaaaccactgtcgattgggtcgaggggggtaattcgtccagtttgcatagttgggggtgaagaatgtccggttttgtgattcaggggggtaattcagacgaccatgatagttcggagggggggtaattcgtacgttttcctaatcaatatgaatctcgttttgtcacatattttgggtggagtacaatgatgcaaatagatcttaaaaacaatatgtgatttaaaatatataatttattaaagggattagaaaaagatacatactattgcatttttcaagttaaaatgtgacattagatggagtacaaaccagctatcactaactgtgtagtcacgtccacaatgaaaaaagtatgcattaaagttactttctctttgttataagttacttctataatatatgtaaattacttttaggctttattgaatttacttttatatgtctaagaagtaatttagtgaaatctaaaagtaatttagatatattataaagtaatttataatttttcatcaaaatataaccatgtgagattttattataaagatttaattgttacgaacacaacggtgtaatcgaatcataaatcggataagtatttaagagaagattttatttcaagtatagatggatagggtttctcatagatgatgtggtagttgatttagacaaaacaattaccactagatatgtagtcacgtcctatattaaaataagacacattcaattctatatttattttttatgggatggggtaagtatgattgagtgttacatttaactatttgccttttttaagatgtgacaattacggatttaacactcactatttatgacatgtgtaccatcatgtgtctataacatatgagtttaatggcaaatcctttatgaccattcgtaaaagtggaaaatagttaattattcctgattgagtagtatagggcgtg

SEQ ID NO: 58870 - DNA, 1234 bp, Oryza sativa
agacaacgtggtagccaacccgatgagccaaaaaaaattcgaaaaaaaggagaaaatcggtagcactagggcttttattaattgatgatgtagctaagaaagtacatcaccgatcaaatggcagcatatgcgggcagcacacagtcctatggtgacctatgtagctacggtgggggggtcgtcaatagcatatcaggagatagtaccgtcgcagaatgatgaaccacttcaaataactcagccgacacaagactacgggcacattgacttcagcggcgttggagagacacacaggtctgtccacgatcaacgttcaactgaaagattattgttgtcaggacgcagacctccagcaggggctagaagaaatgcaaggtaaagaacactagcacatcaaggaatttcgatgaggagaatgatcagtaccatgattatatatttcttatgtctgatgtatggcttacttcaaacaaatctgtgtgttaaactatctaacgtgtgtgatacatttaaaataaaaaacttttaaatattaaactgtcttttctacatctaaatggacacttataaatatttacctgcagcacgataacaaagttttccacaacctttatacattacttcagtgggtttgaaagtttcatgaattcacgaccttgacttatggtaagaccccaatactcaccataatcaccgtgtactcagttcataccacaagatagagcctgtgaattcatgaaactttctaacctattgaagtttacaccatgagtacaccaacaataaactcaagagtaagagtgatccactctactgaagtctgtcttctttcccttcgtaaggttccttttataaacagtccgtgagtaggctatccaaactttcaacagtataggacaacaaacttttgacgctacttcactgctacagcatgtgcataatgctaagacaaggcgagagaaactactcttttctatggacatacgtgacggcgacattgttgtgtgcgacaaaataattgctacagcatgtgaataaagctaagacggacgagagaaattactattttctctgttatgcgtgaccatgacattgttgtgtgcgacaaagtttcagcgtggactatttggatcaaatcggtcgcatgccacggtattgcgagtttcaaacgctaccgcacgacatgcatgcggggagagggcgatactgcacaacgggcatgtaggagcgcaga

SEQ ID NO: 58871 - DNA, 11642 bp, Oryza sativa
tcctgcagcccagcagtgagacttactccctccgtcccaaaaaaaagacaaaccctagttttcgtgtccaacgtttaaccgttcgtcttatttgaaaaagttatgaaaaaattaaaaagataagtcacgcataaagtattaatcatattttatcatctaacaacaatgaaaatactaattataaaaaaattcatataagacggatagtcaaacgttggcacaggaacccacgttttgactttttttttttataagatggagggagtatccttgacatcaatcacgaaatttccctcatcccgagcggtacgaatcgcatctcgtggtagcaccaccagtcaggtctagcggaacaaaaacggagctagtcagatttggaatctgtttatacaattccatctccatttgatcgcagcatattcctttcctgttgcaattaacgctagcgtcatcatcacaaagtgcaactcataatctcatacgcagattgatttgattctccgtgtaaggtgagtttagttccaaacttttttttcaaactttcaactttttcatcacatcaaaatttttttacatacaaactttaaacttttttgtcacatcgttccaattttaattaaattttcaattttggtctaaactaaacacaccctaggtaaaaataccgacaaattaccatcatcttccgaaaacgtgcaagcaaaaaatggcaaaggattgtcatgaaagtttacacgctcggtcgatttttttctccctgtgtgtgtgagccaggtgacggtggggcccacatgggtagagagaatacagggaaaagaggcttgggtcccacgagacagcggctggtggcggtgaaaaggaggacggcgcgcgagattcgaggcagcagaggagggttttgtttggcgtttggctcatgaatgaatggatggatgagggtggggcccacgtacgtgtgcgtgcaggtccaggtcgcgttggtgctacgcagtgtttgacccggggtgggtggttgggtcgggttgggcgggtcggggtcgccgcgcgcgtcggggatcgcgtcgcattggtttggcccaccactactattgctttccctgcccagcccaaatgcaaaatgatgattggcctggccctcgtcgcgtctcgcctgtcagccgcgaaaatattggctcactccgtcccaaaataaatcacagataacatattattatattttattattatataataaaataaatattaagcataaatattattggatgttcaaacgttggacatataaaccacaactacacaacatagtactatttttaggtccccatcgtttcgcttttttttctggcttattaggaaataaaaataaatttgtaggtaaaatttttatatatgtgttcttgatgacttaaaagccaatgctgaaaaagaaagtacgttgaaaatatctcaaaatcaatctcaaaattaagtttgaatatttaaaatttggctttttctttggcttattaggccatccgatgggagccttagtgtatttttttcacgttttaaattgatcttgctgtcaattttactatgcataaaggttgacatatattcctagatataggtacaaatattaggattcaaaatttgtatacaatttaaatgtaaatatacttatagttattatttgagaacacgttgcataaaaaaaagtatagtacgatactcactccttcgaaaaaatctaagacctattttatttttggtttctgtaaaaatctgagtcatatttgtagtcaacatgtgctaaattaaattgttgatcggaaaccaagaaacaattctagtacttattgattgcatgttcattggttttgccatatagtgagtgagttaattgcttcttggttttaatgaaaaagaaatagatctcatatttttggaaggatccatctacttttgatagtcatatttccaaatctgaaaattttatttttgataggcatattttaattcaacaacctatcctcttaatgaatttctcggatttaatgcatgactctccattcttctacacaaaattggctatatgggcatcgagaaatgtaaatattaatgaatcgcttgtttacgagaaatgactattagcatgtttaaatggatgataaatagaataacttattcttaatctatatgccaagatgaaatattactatcaaaagtagatagaaggagtactacgttctagcgctacgagtttgttttttttttatcatacgagttgtacttttatacccaaaaaagtcactctgtcctgtcctgttgaagattacagtactggtgggttgatcttctagaaacagaaaatatactttacaatggattagtagtatggtttggaaattatggagtggtgacgagtagtctgttgaagcagaaatcgctggcaatcaaaagtagattagaaacagtggatttggggcgtgatggcggtgaggttgcaaccgcgcaagcaacggcgtcaatgcctccgccggtctgccgtgattacttcacctgcgaccactcgtctgctctgcgtcattctgcctgacatcctcctccgttcttgtcgctttcacaacgtggaaaatgagggctccattattttgtacgattttcgtaacgtatgaataagaataaaaaaaatataggaacaatatgaaaatatatgtgtaaacttaagaattgaaaaacatcgaaaactttaccatgtatgttcagtaaacaatccaaaaaatttaaaacattgggttggagtggattgttttttccccctataaaagtagagtgataataaattcctttttgctggatccctttaaaacagatggcagtttagtgtcactccaaaggatcccatatttctctatttttcctttaaaatttctttgaaacgaatgagcccggaatggctcatcatcttccattcctcctctcagttccatccaactcacacatggatagagtggagatgcatcactgaacacaagctagtttcagaaacatcactgaaacagccaagcatgctggtggtagtatctatcacaggatttaggagcagctgcaggaagaagagaattcggtttcggtgctacctttcatcctctgatctcagctgtgttcagttcagctcttggcattgctaaaaggaattgttagttctatctagttcagttcagctctgaatatgctggttttacgtttgttgcagatggtgtctgtcactgaagactgaaactacatttaaactgtatatgtatcatgcacgattagatccagatgggctccttttctggcagaaaaccatatacatcaatacatgctggttgctggatcttcatgtctattctttcctgctggatctactatagcttattactagtagatttcccagataatattacctcgatttttcagatagacaaattctgtctttgcacagaaccacacagaagacgacttactttcttcaccctgcatgctggatatatagcccttcaacctataaaatcgatggagatatcatcatcaacagggaactatcatctcatataagttaaaatttgaccttatctgatctgccataaactgaactttggttctacttagtgattatctgggaaaaaaattgttttttatccatcccacacatacctatacaaaatttatcaaatcccaatgcaatgtatttatcctctacttttacaaacttcagtagaataattattttaaaataaatttattttgagattcaaaataaatgggagggatggaaaatgatcatattctgaaacggagggactgagggagtattcgttatactactgctgcttatcttctcttctgggatagggtggcactgtggcagagcatattgaacgttctttggggagagagcccagtttgacaaatagcccaaattggcctactagtcactgggcttaaagctctgagcattttttattgggctcagttcagaattatcgggttttatccctcaattcttcagcttttgatcacaaaggaataagtctattttgccttcctcatctcttgcctttgattgaatcatatctctcaaccataaaactataggtataatgtctcttccaacttcagaaactggtgcaaaatgactccttgaatggtttaggaagctgtttttgttgtcgtgataggtgagacccacatgtcagcgactttcgcctatctcatcctcttacttacctctctcctctcttcaatcttccctcctcctctctcaccttctagtcgctcacctgttgttttgatgccccaacctcctctccctcgctgctgcagccactgcctattgctgcttttgcttcaacaccaccatcgcaacctcctctctccctcatcgtcacagttgtcgtatgttgctgctgctgcttcggggaagtcgagggaaatggaggaggcgctcgcggccacaggaggaccgggtctaacaggcgaccttgggagggtaggatccagctatagggcgatgtccggtggaagagccaaggtgtcggtgaccttatctccttccgagtagcggtggcgccgacatcgagcttgagtggccacattgtctcctctccatcctctcccgatcatcgcggatgacggctttgccatcgttgggcttgagctcttctttatcctccactaccacgccatttgcgtatcttgcccagaccgtctgagcccaaggagagatcttattttgcgcccccggttgcactggatttgattttaaaatcaccatccgcgtacccgacctgattttgcggttaagagatctgattcaaccgagggcaagagacgagggaagcaaatagatttatcccttcacagaaacatgactactgactagtgtcttatttgggtgggcttcaatcctggcccatccacatgtatgggacaaggcctaactagcacatttataattgtcttgtttttcatatatccagatatctatttagccataagtatggcttctttgtgagagatttaccgataaagatctgattattcctaaacggcaaaataggcaggcccccagcggaggactcatcaagggctaaaatcacgcgatgaacaatatcatgggccttaactagcccttgtcccctttctcatgctgaatcaaacattcaaatcagattcgatttaaatagtttcaaacctttcaggacatcctttcattgttctccactgtactggtaagagtaaaacaactgtactggtaagagaaaaacaatacattgagaaaactaggatattgggatattgtggtattgtcttgctcacaaaaagaataatatatgtattttatttccctaaagaatgatgaatatatatgattagcagttgctatcaatcttggctgcatggccaaaatacaatactctcctatggtaagctagctagaactgctaaccagtctcactcacacactattgcaaaacaagatgaacactcgctcaactgtttgatgatgaatatagaagctaacaaaatttgtaattactaataattaaacctttaatcactagctactttgctagtagtaatccgatcgaattcttcttcctcctcctcttcttcttctctcgttgcactgatccaaaaaagttggatttctggcaatggccaatcaggatttcattctacccgcctcatcctgctcgccgcgctgccgccttgtcacgccggatctgttgccgccggagccgcgcctccgcggtcatcgccgccttgcacgccatcgccgcccgcttctgtcccaggtggtaccactccgccgccgccgccgccgccgcggccttggcggcggcgacggcgacggcatcgtcgtcgtcctcctccggcgcccgcgccggctcgttcaggtccagcaccggcgccggccggacaatgtcggctgccgccgccgccgcctccacccgccgcttccgattcacctcctcttcctcctcatgctcccgctgccgcttcagctgcaaatagtaaaaatgaaaaaaaacgtaaaaaaagagaaaatgaaaaaaaagtaagatgaggttgactccgactcaattggggattattcggaaaggtcgcatctttctttccatttggactggttgccaaccatgccggggtgtcaggtgtgtgtccacgcaaacacctcgaccaaagaattgaattgaagcgcaagaaaagagtagcactagtgaagcattgaccttatcatctatctacaacaacgatgaatcgatcgaacataatttgtttttacgattttagaggatgcaaaaattggagatgaatcgatcgaacataatttgtttttacgattttagaggatgcaaaaattggaatatatgtagctgtaaatttttttaccttgcgctgcatctgcttcaatccgtcattggtgctcctcgagctctgcagccggactctgtactcctcgatttgctgtttttttattcaccacaaagatgaacaagtgtgtcaaaatcccaacgatttttgcgatcgggatagttgaactcgagagcgaattcttcatccatccattcagttggagagagagataaagacttggatagatagagagagagagagggtttgataaatctcaccttggatagatgcgagttttcctgcgacaagctcgcgacgacggcgcgctgctcctcaacccactgatgagcaaagcagggaagcaaaaaagaacagatcaatactgcttacaagctaaaatcaaatcgaatccgatcgaattgggaggagaagagagagcgagcgaatcagatctcacctccgcgtgcgacgccggcgccttcctgggcggcgccgccctcgccgccacgtcgtcgccgctgctctcgtcggggacgaggaacgcgagcggcgtgtcggggctggcggcggcctcgtgtcgccgccccacgtccgcgggcggcgccggcttcttctccccaggcgtcgtcctcggccggcgacatccccacgaggggatctcctcgcgctggacgcggcgtctgcggcggcggcgatggcgcgcgcgcacgaggtcggccaggtcgcggaggatggcggccacctcgtgctcctcctcggtgaacgcctcgacgacgacgccaccgctgctcgccatggcggcggcggaatcggcagcgagagcggaggagagatttcttcgtgagcgaggcgagagagagagagagagggagagagagctgagctgcggattggtttggtttatagcgagagcgccacgtggcagcggggagggcgtggggattaggtgaccgcacggtggactccacgggtgactgactggtgggtccctggttttagcgactccgttatggttttgcgtgcggagggagtctggttttaaaggcttcacaataccgccccctgtttcaggtttttttttttcctccgtgtaaacagggaaatctcctattgagtttacatgtcatgaatctaagcaaaaggcttaatttcaaaatgaggggaaatctagtgagttactacaagggaactgtactaatttctaggaaaatttaactaaattttccttaaactagcgagttcgacacggacgagcgatcaaataagatcgagtttttgttgagagcagggatttaataataattttgtaaacaatatccatatgtttcaaaggagggctgaataatttagcactcgcattttcattaattacgcccccatcatttttagattatttgcttcacgctttttaaaatgttttcttaaagaaaattttccctactacatttgctaaaaccatatttgttctaaactattatttgtttttttattttttttcaatgcatctaatttcttcatataaaaaaagtacttcactacactcgagtacctttcgatcgagcaacataaaacatctcaaattaattacagctttttgccacccattggcatctgtgactgtcaaatgtcatgtcaacttgtctgaaaattcctttttgtcagatgaacacacagaaacagcagcagtgacagttttgctatgctaataagctagatcaacctcagctgcggcggctgtctgctgccgccatggtacggcgagcagaagagctccatctgcggcggcggtggcggcggcggcgcaggcagcacggccaccggacgcagggaagagacgtcgtggagccggctgctgtgctgccacgccgccgacacggcggcggcggcggcgtctggccttggatgatggtattgagggaattgaaactgccacatctgctgctgctgctgatgctgatgctgattgggcatgagctgctgctgaatcttcataatggctgggtttggattgcacatgtactgtggcatctgctactcgatggccaagaaacaaactgtgatgagaaattgagaatacaattgaatttgtatagcaaaaaagaaaacaatcatgttgtttgcagtctctcttttatccacatttcgttttgtcggaaaaggaacaggctatgatcaataacgatagaagtggttttttttttctgtattgtaagttgtcacaagaaaaggagtttgtactagtaactgttatgagatgcctataaaaaagttagtggttgtctataaggcattgacagaaaaacgcctcacaaatcttgcaaattctaatagtactattaatgatgtaaatctttcttttgtttcagaagcaatgtgcaaggacaaacctgttgaagtagtagtgcagtgtgcgtcaaattccccctggtgtaagggagatgctgaattggatatggcattgcaccgcggggagcgatcgggggatgtaaatactgaacatgctgcacccctgataacgccgcagaagtgggcaagttcagaaaattaccactgacctgaaagaagcaacacaacatctttcatatagaaacagagatagaaggaaaactgaagtagctgagatggttgaaaaggcggtcactgctcaccatcttttgtcgggcaatggtcgtgtcgcaaacactgcaagatggctgaacaggtagccttacatcgaaatgcaaggcgtagaacttctcgtcttgtgcaccattcttacttatggtagaaccgtctggagaccttgaaatgtgactgtgacaaacttcctcaggttttacccggttttgtgatgccttctctttgtccaaatgcatttggatgagatgacacatgtagacatgggtaatgcttctcttccatgtcttcgagggggtaccatttttattaacgagggaaagctgcagatataaaatttgtcagctcagtagtcaaagaatacaatcatagcagttaacatataaatatcccttcatgatatcagccttaatagaacatagcattcaacttaggagagagagtttccttatccatttattctggaagaaaagaaggcatagaaaaatggatatgttaacaatacttacattctcatgttctccagttcctttcacagtttctgcggcagtattattacacgacgccagtgtgtttgaagatggcctggaaaagggacatatttagagatcgatgatgaaaacaacactgaaggtttaatcgaaagttacttgatcaaatacctatgcgaggcacaaggttttgaagtctggaccggtggcacaatttctgacaatagtgaccatgtattagccaagaaatagtagaagcatcgtgactagttggacaaaacggtatgaactattcaacctataaattgttatgacactataaagctctatgagtaccttgggcagtgttattcttgacatttttcctgtcatgttccagaatatcaggcttcttagaattttcctgcagaaaattcatattggggagaaagcatgaatcgtaaggacagactgaaaagtgaaaaaatgacaccgaggggcacaaagcagtaccaggcaccgaggggcttctatctttgtgggatgaattgtactattatcaaactgcactttcagttgcttccgactgcaaacagaaataatcaaataaacatggagagaccatttaccaaaatacaatacgagatacgacagccatgagcaatttccaacctgttattgtagtctttagatgggctcggtaaattcgttacaattcccaaagaaatatcatgtatttgcccatcatttgacaaagttggatttgtgttgttgcaggtaccaccacaaggcacatgatttatttgtgaaacattgccagttcgttccactggttcatcaagggcaggttggttagctacttccgtaccggcagttggcaatgccgatattttctcatccacctttgttgctcctgtagaagtaaccagtcaattatatatgcaacacattgtcaaaaagatgctgaatatagtgattaatacgataatagcaagtcaaacactcaaactgcaaacatacctgctgaataagacactgaagtaacatttaaatctaagttatcttctgccattcctctgtcggacgacagttcacaaagatggggtatttgagataaagatagcaaagcatccacaactacctcctcctccttcgaaaaatgattcgccaactgctaagcaagaatgaagaaaaaatgattcattttcaatatttggtcctgcctcttgacaaaatgaagagatatttatgagcacaaaaacttaccggaattgcattacatcttgtttctcgatccataaggaaagtctgagagctgatagctgaaagatggcgcctcttcttgacatgccgcggtgatgtagaaacagtttgactggcacgtttatttatggctgaaagtagggggaaaacagaatttaaatattaactcagaaatgtaaatctttaatctataatttgaactgttattttcagtactcaaaacactttagttaataaaacatctaatatgtgtatgcaccagagctcacggaattaaaatgaaaatggtatgttcaaatatcatagcgaaccatcagtttgggttttgtgttctcacaggtgaatagtacccaccttaattaaaaaaatgcactctatattttctatcccgctgtaaaatcttacagtattatatgctaaaagtcttgcgagaaaaaatagcacagcatattcacttagccccaccatagatgtaaactaaaaggaaaaggcatgataaaagcacacgaaataagttgtccctttctatagctctgagagagaggatatacagtgattagtactcctacctgatcttaattttctaggaaccggtggatcaatagcatcacaatcctcagccacctttgaaacagaaaaatgaacaaaaaagatgtacataaagaacaggaagcaaatgattgaacagcagagaaggctaataaacgggacacaaaccttcccaaggctcttcactctcttcctactaatcagactgctgaagctagctgtggtcagtgaggagagcactgtatcatcgtagtctccatcagaacctccttcctcccctttcatgtccatgtcagtgttgcttaatctccacttcaaaacctttgcctttcctttcttctgcctagatatcaggtt

SEQ ID NO: 58872 - DNA, 33397 bp, Oryza sativa
  unsure (1)..(33397): unsure at all n locations
agaggcgactggcattagatatcgtgtgtaactttgtactccggtaactaaagaattttatcttttgaaaggttgtggtacagtttttagtttcaccgtactccagtttagataaactaatcgtttagaaccaataagcacttcatccaagtgtttagttcagagtctttttaaatagtttttgttgacaaaatatttttaaatagttaagaatcagatgacactcttggaaataatgcactattcatctgatgaaaaggtgtacagctacagaacctgtatattaaaaaaaaagaaaataaaagcaatatatagaatcatttaaaaaggaaaagcaggaggaaaaataagctcattggtgaatgtcatatcatgctgcgaggagaactttgtgttgtgaaaaggatagtaatcacaaggtatggcttggggtgcatatctacacgtaagcagtaggtgacaatcgttaagacccaagacaacatcataatattttggagatttcttcacgaaagtttaacctcatcgaaccatccaaaaccagaaaggtctaaacaataaaactttccccgaaaaaaaggtactaccaaaaaaaaagaggtttcttgtggtgtgtgatcgatggtgaggaaagttggcatattttgtatgagctcatccatccaaagttccaaaccaaaaggccaaaccttatattgactgtttaaacataaattcatgacaaacctagattcactgtctgaacataaactcatgacaaacttaatttgaccttatattgactaatacaaattcatgacaagcttgtacaactactgcttagtgcttactctactcatatatgatgtaatcatttactctagctactatgcagtagtggtggtctctagccaaccccctagcagtagtacactagatggtgtgatcctgcccaaagcaatactacaagggtgctaattttccaagaaaataaccttaaaatggggtttcaaaaagaaaataaccttaaaaccaatcacagcgccatactaggaccctatatcaaggtgatcagtggggcccaccagagtggaacaaaagaacaaaaaagagcaccagaaaagattatttttttatttgtaaggatgcattaggaaaggcaaaggagagataattaagataaggggcattttggggaaagatatatgcatgagtgagaaaggaaagctgctgggttagttcactgtaaccatctggactggacacatgagagagaagagagaagagagagagaccactggggcagaagagaacagaacattacataccagcagcagcagcagcagcagtaggagaggaggaagaggaggagccactccttatcatgtgtcttcttgtgagcccagccaccagcttctccctcttcttctccatatccaccatccaaaaggttatatgcccaaaagatctcagaaaatctccatctccctttctctcctctcctccacacttaccataggcctacactacacacaacaaatgcagcagtaatcagtatgaatgaatacaagaagatatacacacacagagagactcaacaacaaagtgaactccagctttatggaagaggagtaatgctagtattgagacaaggagacagcatccagagggtcagcagtacaatggaagcaaaggcaataccaaaaggttaggataaaaaaagggggagttatgcagcttggtcctgtgtgatgaaatgcagaagaattagatgctagcaaagctgatgagggaaggggggaaaggtgatagaaaaagaagaattttttttctctggtggtgtttcttgactggaaaagattcatggatctttagccccccaagaatctcaaaaagaaaaaaaaagactgcatagagttgcaaatcattatccagatccaaccaaagacaccatctttctgaattcttcagggtaaaaatgaaataagattttggctcccattcgctgcagggaaaagatagagataagatcactctgcgcacatggtcgcatcgcaccttggaaaatgaattcagggtattctcccccacacaaaaggcttgtgaattttaacgtcaaatgctctgtccgtttcaagaaaaggaagtagtaataaactatttaattcatgctactaaactagtcatatgatttgatttgcagtgaactccacatttcatacccttttgtctcgaaatcgaaattatgccaagaagttaatcaaacaaacgatggagacgaagcatgtagcaaaaacataaaccaaaccgcgaaatcaaagccaaccgaaataagatagacagacagaacagcggtcaagcccatcctgaaatcgagacgcaaccacgacatcaaagaaaccgcaagaaacagggcagaattgcagggcagttgatgaagaagaagaagaagaagaagaagaagaagaagaagaagaacacaatccacaaccaaaaccagcagatgaatcccccttcccttcctccaatccatccatccatccatacaaacagaccactccgaagcactaacctccagtcatatgcctatgcaccgatccatctctccctccctctctccaagcttcttgatcagcagcaacagagagagataaagagaaagagaaagagaaagagaagatgcgagatggagatggagaaaaaggcgaggaggcgagcgagcgagggagagaagggatgagtaaatgcgaggtggaatggaagagcagcaactgcaggagacgtcgcgctttttgttggccgctttggcgtgggcagaaacggaaaccttgcatctgcatgcgctgcgctgcggctgccactgcacttgcatctgcggctcactgccccacatgtactaccacttcctgtatagaccaaccaaacaccaatacagcaaaggtgaaaccaaggtggatggtggtggtgattggtgcagggtgatctgctcctgcttctatggcaatccctatctcccacttaaaaaatatccccaatctctctttctaactgggtatttagagcaaaatattgttattgtgggttatctattattctagttcttattgttgcctgactattagctctctttgagaggtttttttaataagtagctatagcttcttttaagtaaaggctggaatttatattccattattaaacaagctaaataatttttagaaaaaaccttaataaataattaaaaataaatggtctaatcagtaatgcaatagaacaaagttttagcttttattgcagtcaaggcctaattatctattatataaaaaaatactgaaattttggtatggttggttgcttgattttatctctgctgcatccacagttttaattaatctaaccttattttttaaaaaaaacttaatagatttattagtttattaaaacgagtggtctaagtaatacaatagaatacaattttatgataaaacacatattcttttaggaggtagagcattatagttcatttcggtcatctggtaaacaatatgaaaaggaaaacatggtaacatgtgtgtgattagctagctgtaattaaaagtgcaatcaaggcaaagttatggatgaatctaccacgtgtaaatatggagtcctctctgttggcatgtgattaattgtaccactctttgtacaatctgctctggtccatttacaatatcacatctgaacgtactgattccaattatacaccgcgatatactatatcttttgatttaatggaggagaacatgcaaatatgcaattcaaatggctcaagatgattttcttggaagagagtagaaatgagatcatgcatacacatgagttaggaactcatcccgcgcatacgcaaaacggacaactcattagtacatgattaattatgtattacaaaacagagtagttattttttttagaatagtactaatatgatttttaaaaataacttttctatagagtttttttgaaaaacacaaagtttagtaattaaaaaaaatgtacgcgtgaaaaacgacaaacataaggtggaaaatatggctgccgaacagagccaaaatcagttgcagtgtgcagaggtgtcagtgactcatggattagacagcatgccaccaaaacagagaaaaaaagagatagcaatacgattactatgctagtctcactggcacgtgggccatgcagctgacgcagcacagcaccgtgtctcaagggctgtccagagtttgtgtgggccacaaactaactacgcacagaaggttcaatgggcccatatttgcaatccgttctggcccaatacctgacagcccacagcaagcccaccagagagctgggcccacgcgtcagttacacgtagcgcgtgtcccctctcgtttgcctccgaatcgggtaaagccgccggtggacggaatcgacggcggagatcccatcccttccccttcgccttcacatattccttccccctccaatcccaacacagcagcagcaattctttacttaccgtctttgcaaccttatccacctcctaaccactcactgacatcttggacccacaccccagatctagccctccccgcgccgggtataaaacccgtcacgtttccccccatcctttaccaatgcccccgtcgcgagcgcgtccacgtcagcaaagtccctgcatgacccaccggtgacactgccaggtgggtccttcttcctcctgggcccacagtcagtgactacgcgtagcggacgggaagagaaaaggtaaattatttactcttacgattacgctaatttcctcgcgtcctttgcttgcttagattatccccaaaaaggaaattattaaactcaaaagactcttgtattttctctccccttggttttgaattcgctcgccgccgacgcgggtggcttccgtcgagaagcttctggaagcttccgggaccggggcgccgtcccccgcctcggcgttcgtgcgtgcggcggcgaggcggcccgtggctcggcgatcgatccgttgcttgcttgcttgctgcgggaggaaaggtattcccctctcgttaggattcgatttcccgtacacgttacgaatattagcttgtggttttagatgtggattaggcggctgctgctgccgtagtagtagcggagctgcgatttctgcgcttcggtggtgtttccgctgctgcaatcgccccgcgcgaggtggcgttcggttcaaagctgtgcgcatttggggagatttgcgagtcaaatgtagcgattccctgtgtgctccgttgatttatccgcctaggtaggcattagactcgtctgaattgcggggagcggttttggctgttcgtttgatttctacctgtgtgcttccattttattcgttttcaaacttccgaaactaatatatgttttcagcatgtttaggttatttggtttggtcttgtctgtactagtaatcatgtggattcctcctattgcttgtagtgcttgtagtaatcaaaagggttcctggaagttgctatgatgctaccatgattgaacactgcacttttaaatgcacaattgatcatgcagtaggaaaggagtgcttccatttattcatgtctgctgttctgcaattgctcctgtaaatttgatgctcatagtccatctttgttttcctaggccatttttgctcaaaaaaactgtataccccatgctctgacagatgtttctgtgaaatagggctcaagatggtcgtctcaatcattaccagagccttaatgtaagtagcagcggtagtttccttttaatttctggaaaggggcaatgattttggccacacctgttatgtgttttgctatcttttgattttgcagacttattcttggatatgcatacccagcctatgattgctacaagacagtggagctgaacagacctgaggttgagcagttgcggttctggtgtcagtactggtttgtattggacaccccctttactttagactatcattcttggatttaattctctacttgatcacatgctcagtgatgattttacaggattttactagcagttctaactgtttttgagagagttggggataattttgtatcatggtaatgtggccatctgttattgtggttttttttgtggttgcagtttggagggaactttcatgcttgctgatgatgattttgttatcatacaggttaccaatgtatagtgaagcaaagctggcatttatcgtgtatctatggtatcccaagacacaggtatgaatttcttatctctttttaatttcaaaatcgtatggcttttgtaatggagagcattttcagggcacttcctatgtgtatgagtcattcttcaagccgtacattggcaaacatgaagctgaaattgatcgcaatctacttgagttgaggactagagctggtgatatggcagttcattacttccagaagatcgcagactacagtcacacaaggttctatgaaatcttgcaatatattgcttcgcagtcagaggctcaaagatctcgtcctcaggtacttcagaaaactcttgaagttgcttgccagccataatctctcagttacttccatttgctggtggaagttagaagaataggtctgcagcatcgtctctctcttgggcagatcggaactagtaatcttcatgattcatgattgtatttaaaatttcagaatcaaatgcatgcagtaacatacgcattcagcaaatttgacatacctatgaggttatgacctattggttctatattcctttcagccctgcatttttcacatcccatgtctaccattaggtatttaggttcatatttgtgttgctgttgatgagatgcacaatcattttcataagtaagacttagcttaatcgtggtataaatgtactaccaagcctttctatggaaaggtctgacatatgcatttcagtgcattttttcttcttagtgcttgaagaatttgggttactatatgatatatgaatttgattctgatcctgtgggatatttactgaactaacaatgaaaatccaacttaaaaataatatcgcgaggttccagaaagatagttaacctaatgccatttcagtggattattcactatttctctatcagtggtaccttttttgagaacttatgtgcagctgtttgaaaggctgtgtttgactgcttgttgttgagaagttcacgccaactgaatgtatatgtccggctacgtgatcaccatctagcgacttacatttttcttgtttgtttcatcaatgggtctgttagggggaaccaatagttttaaacacagtagcttattttttaaaatctaaattaagcattgttcttagatgtattagtaatatctgttgttagctggtgtcctttatttctctggattatttctgagcttaggagcttgagctaatttgaccatgctgaatcaatttcttaatatggtagttttactagttcttgttgtaaggtgctggaaagtttctaaaattgcttcagcaagagaagcacaaccaagtggatccgattcatttaggtcgtgtgttattgtggttatcttttgccaagctcccttagcagtgactcctaactagggaagttattttgcgccctaattccatctgtgtttcaaacatgaccctttattttattatcttaacttggttaatcatggtgctgattttaccctccaaataacctgggtccacgaaccaattgttttttgggtctctaggaataggatgtggaaccttgctgatgtcgaaatggacctattatatgtttattaggagtaaatgtataggcgcttcatagttctgaagttgctattttttgtgttccaacctttcttgtcttgttattttaccatatttataatttttttgactgtttcatataaactattcattttgttacatggaaattaccgtgtatagtttggcaatgcaaatatttgtggtcattttctggcagggttcaagttgaacatctccaatttatttttgcttctagcaaagttttttttttttttgcagggatgcttctagcaaagtttgtttcatgcacattttttctcatgttaaattattactaccaccatcacactcattatgatgttacactactcgtcatagtactaatgtatgttcagtttactgacaaagtaggctatctgggcacagtttactgacaaagttggttaaattaaaactaccaccatcacactcattttcagtttactaatgtatgtctagtaaagttgttgacatgatgcatgattgagttgttatctgagcacttagaggtgtaatatccgcttcatgtttctcagttgtatgttcagatgattgtttttgaactagatatttattactaccttcatattttaatgtatgacgccgttgactttttatcaaacgtttgaccattcgtcttattcaaaaaatttatgtaattattatttattttattgtgatttgattcatcattaaatgttctttaagcatgacataaatattttcatatttgcacaaaatttttaaataaaacaaatggtcaaacgttggtcgaaaagtcaacggcgtcatacgttacgatacggagggagtatttattatcgcgtgatgcctgcatcagcttatatctgtgtagagctacacctgactctcaacgtctctgtttctgcaggcacagcaacaccagcagcgtccaccacctccacggactcggcaggtgaaccctgcaccgccgcctgttccttcaccgtcagcgcctccgctgccgccacagcctccgccgccaaggaaccaagctcaagctgacaaggccccaattccggtcgcccctccaggcgccgccgtgcctcctgcacagccacagccacagccacctcaagcaggcgctgaagccgtcacaacggagagcaccgaggcgacgcaggcggccaatccaccggcgacgacggcgagcaacccgcatcaagcgccggtaatacccgacgaggagacgctcatccaggaggcgatccggatgacacggagccggctcaggaggcgcatgggtggagcttgaactggaccgccgccgatgtacgtaaagctcccacgccacgggatcatttctcgtcatacgtttcgctctcgacgcagggtgcacactgcactgcatgcacatcctgaaatctgaatcctgtgtaaaaaaaaaaaaacaatctgaagcctgttggtttcgtttcgcggtttcgcaattgtgtatagatcccaccaggtcaccaggaagtagaacagtagattgatggacattgtgatggcacgagaagatcagtaaccgagtacattggtaaagaaagaaagatacttggttggtagatgatatgtgaatgtgagcaacttaggacaattgtccctcatctccttgccctgtgacaattgtcctttcctccttgccgacgataagatacaagctgattcttttcttttctatcactctcaagatactcttcggcctgaaaaaattgaggatatattgccaaagctgaagtcacatctttgtcacacacgagaatctcatggtaatgcaagaacttcattgtctgctaaggaaatcaaagtttgcacttagtttcatccctgccaatatgataccttcatatatttcctcataaagtataaggccctgtttagtttgcgaaaagaatttttttttggatgtcacattggacgaccggatgtcggaagcggttttcggacacgaatgaaaaaactaatttcataactcgtctggaaaccgtgaggtaaatttttttagcctaattaaaccgtcattagcacatatgagttactgtagcacttatagctaattatggactaattcgtctcgtgactttcatgtaaactgtgcaattagtttttctttttatttatatttaatgctctatgtatgtatccaaagatttgatgtgatgtttttggggaaaaaaattgggtactaaaccaggcctaaatcactccatatctaaacttccgaggccatctttcagcagacctagataaaagaaaacaacaacaacaaacgaacgaaacttcgacctcgttttatatttcgtttgtgaacttgtgatggcaccccaaaaaagggggaaaaaatgtcaggcaagaagccaacgaaacttcgacctcgttttatatttcagaactaacttcgacctcgttgatagacgatgcttcctatgtgaagatcagctacaggtttacttttgtcattctcgaaagtccctatctgtgtcgctctagttgaaatttcgccaaagcactgagaccaggagccaacctggatcaggtcccagctagctgttgatggcaacctggttggctgcttcctacaaccttatgttccattccgttgtgccagatatttagacatatacagtacttcatccgtttcacaatgtaagtcattatagcatttccctcatttatattaatattaatgaatctagatgtctagatttattaatatcaatatgaatgtgagaaatgttagaatgacttacattgtgaaacggagagagtatcatttgttagaaataataccattaattgttctaaagtaagcgtaattctagaatgtatgcattcaaaccttgattccttaaatcattaataatatatttgttatgaaaaaaacttccttctgattatattttaaataaattttataaatatataaaaacaataatgagacatgtgcattgtgtggatgttcgaaatgacaaagaaaataacgaagccattatagtcgtcaagcttattttccccacataactaaaacgtggttgcaaatgtgggttccatattatcacgtatactcacgtgatcatgtcacatcttgatggggaaaaaaaatcaggagccgcaccgactcaaaggttgcttaggcttcgttcgattgctctggagggggagtctaaaattaattaaatattaattattacaaatttaagaactgaatttatttgtttttaaacaacttctatatataaatatttttttaaaaaattaaatacaccatttatcagtttgaaaaacatgctaatgaaaacgagatagttgaagtttggagttgaagaatataacatggccttagtaggaacttattgttcctttctccgatgatcttcgacctgaagatgggccaggaatgtagtcaaaattgtacatattacccctttccgtattctcgttttataaataggccctctagaaaatttattttaaaatagacccttaactcaacggcattagcaatggaccgaagtatgacacatcggtgttacaaattttgtcgttgagaattgagatcctcgctaagctagcacaaactctatgtcgaattgtcaacaggtggttgccgccaaaaacattggcgcaaacattatacataatttgagaaattagcttacatttagccagaaaccaacgagtgaatggtaatttagtaatctgttgattacgtttacataatatttacatcattacttaagggcatatttgttggttaatctatcagtttacgtcaagctcaggccagctcagtaaggttcttgtattttgatgtcaaggttgatgctgggtttatttttagaacaaatttttagtcggtctatttgtagaacaagaacataagtaggactaagatgtaaaaattccggggtctcgtgaatctgtgatagtgataaatctgtcctaaattgtaatgaggacaagagttcataaatctaaaataggtagtacagcgacaactccccctgcagtgtgaaaaacaacaggtttatggttctatacgtactattaataaacgtgtatgcgcgtgtgaaattgggcataaatacattttgttccagaggaatttggttcagatataaaaggtacacgcatggtgaacctcacgaaatggaacactgttgactgaccagtatgtacagtgcgctccatgtttaacatgcacatgaccatcttgaccaaaactagccctagatactacaaacccatgattgatcttaattaacggcaattatattctctgccctgtttttaccattaacgcttaaacgaaatgttgcgaactgcaagtcgtcctggagcatctccaagctagacatctcttaaaccttgctctccatttacggtcccatctttttacttaatcacggaataagctaaacgatatatttgcaaacgaaaaataatttatgaataaatatatatatgtatatgtatgttcttagtgatttaaaagtataggctaaaaaataaacttcaatgaaaaactctaaaaccaactctaaatttaaagttaaaatttcaaattttggctaatgagtattagcatatcatcttttacccatttgataagctagctagtcaaagattcatctctatatttttcatgtgctctaacatgcaatatcctctccaaactacactcttcattttttttgtgggatccacatttcagtctatatctcatttttccttctcttcagcacaaatgagtgatttgaccagctattattctggcttgctagatttggccagcaaaggagtgattttactagcgggatggctcggtcaaccaaatatagcaagtctcttggtttgtttttttctcggggtttgcctaattttgacgtgacgagagatccacctttcttggagatgctcaaatttttagttgggtgccaatttttttaagtatatggacacacatttaaagtattaaacgtaaactaataacaaaacaaattacagattccgcctgtaaactgcgagacgaatttattaagcctaattaatccgtcattagcaaatgtttactgtagcaccacattatcaaatcatagcgtaattaggctcaaaagattcgtctcgtaatttacatgcaaaatgtgcaattgattttttttcgtacacatttaatactccatgcatgtatccaaacatttaatgtgacggaaaagttggaagtttgatgaaaaaattttgaatctaaacacggccatagtaatgcagctttcgatatttagactgttcggagctctttgttcccaactcctcttttcgttttacgcgcgcacgtttttcaaactgctaaacggtgtgtttttttataaaaagtttctatacgaaagttgcttaaaaaaatcatattgattcatttttttaaaaaaatagtaaaaacttaattaatcatacgctaatggatcgctctgttttatttgcacacaacttgggggttaggaatacgggtttccaaagtccaaacgcagccggctggttgacgaagatgacaatgtgaacgcagtggagtagtgcgtggtggagggacaggagggtgcaacattgtgacatatgcatgcatattcagtagtagtaaggtggcgtatttggatttcccgtcaatcggatctttggatactaatctgagagctactaattgtaacatagagtacttacaaaactaattgcaaaaaataagagctaattcatgagacaaatttttttaacctaattaattcataattaacacatgtttactgtagcatcacatatgctaatatagattaattaagctcaatagatccatctcacgaattagtccaatgttatgtaataggttttgtcattagtctacgtttaatgcttctaattagtgtcacaacatccgatgtggcagggattaaaatttaatccctggatccaaacagagtctaaatctccatcatctagtatatgtttaggttggacattgactgaatagcagaggttatcgttgactctgctctggttcaattaaacaaactaatgttgtatttaggggggaaattatgccaaaattttaaaattataacaagaactcttgtatttgatttagttaatgaaattaaataagtttataatattataataatagtactttttattcaattctatgcatagtatttgttttgttttgttttcaaaataagtgtttgagaaataattgatgatcggagttttaaaacataaaatattattttttttaccggaaaaagtactatacaaaaccaacactgccagccatgtgtgtcatagcaacaggcctaacagaagaccgatggatgggtcagcggatgcagcaacaaatcggcaaaaaatggttccttatctccaggggtatcccttcgatttcgctaattacaacgggaaattccaaaagaaaaactgaaatgatagtagaaatcacgtggtttactgatcattggacagtgggtgatggcactggcctttgttcattccatcgaaggtgacagtgaccggccagcacctgtactgcgagcattttcacgtgttcatgtacccttttattcataaaaataaacattctaagtacttcaaatttattacaaatactaaaatatcatagtactattcgtcttataaattacttcttatttaaatttcgtttatcctactgtcgaaacaagaattcgacaataataaaatagggtagcgcacgagacctaaaagtgaatggatgcggagacaaggatttagacaggttcaggctctctcgatgagatgtaataccctactcctgtttggggatttgaatccgtcgggtgtattatagatctgacgatctagttgtgaattataccccctagagggcctcctgcccaccttatataggatggggggcaggattacaagatagaaaccttaaccaatacgatatcagtttcctaaatctactttacaatattatcaaatcaggactttaggccgttccataatatacaaggaaacgtaatacccaagtcatgatccgttacatatttcataaatataagttatcccctataaccagtcggataaccataccgtgtgtgtatgaggtacccataatctccacacctacatcaacctgtcctcccatcccctatacatttctcattaaatgaggagcgtcaaagttctatcttcttgatcttaatatctacttaaataagctagaaatgcttatatttgtggatgaaagaggatatatcatattatggggatgtttggttattaatgagattggttgacaatatgatattgaatcttatcgaggtaaggtagaagaagacatgaactgattttatgttttattgatttactacgcgatgactttattgaaaaagatcatgctcacaatatcttttttcacttaggactagatatccatattatcaccattagtattataggagtgtttggttcatagccacattttaccaaatgtttagcaaagttcaatcaatctggtctaacgtttagttttttatatcgcttttgtggcatgctacaaaatccttcctaaagtttgtgtaattcaataaggatttcctagccacacaaattatggtaaagcagcacctcagttcaaaacgtttagcaaattgaaacatgcagccaaacaacccaacccaataagacaatgacgccgcacaacgtacagttcatatgggaaagccattttaccaaatagtgatatttttataatgaaaatttgactatcaaaatatgacgtcatacaagtatcataattacttaacacttcacatatataagtttctcaatatgtagattgagttttgagttagaattttcttttggaatgatatgacacaggagagatactcaatattcatcaaaatatttaaatattttttataattaatttgttcgggagtttataactaattaaaccacctgatcagcacagtcagcaactcagcattattcaagcgcttgtggatcccacacacacttcccatcttcgatcttcctataaatgaagtggccatgcattccactttttccatcccatctaaactcgcttgagcttgatatgccacagatcaaggcttagaagagatagctaattactctacgctaattaatccagcagcttagcttagcatagcttatctatggtttgccacgtcttctcgtccttctcctcctccctaattcgtgtgctggaggcgccgctgctccttccagctgcttcggcttcttcttcttcttcttcttctccggcgagccggagcggtggccgccgccgccgtgcagcccacgtccgcccttcgccggcgatctatcccggccgccaagaacttgcctctcactcatccatgctacccaccgacttcgacatcaaggtaagctacgtaccctaattaaacaattatttaggtagctactttctctattttgtactattatagtcattttgttttttccaatcagaatgtcaaatatgtttttatgctactcccttcgtagcaagagttagaaatattttatatttaagttcttttgcaaataagttgttactatttgtaagtctctatatatgcaagactttaatagataagtaaattaaatgtttgatcagagatcatccgatgagtcatcttaatactcattgcatttgttgcatacgtgtgcatgcaattcttgatctttgctatatgtagaataagttaatttttctttgatcatggtgccaaaagtaatatgtataatttttatgaaagaagggagctagtatgtttgttttatattaaaaatgttattaaaagtttaacttacataaaagtcaaaacgaacatgttatcaaatagtgaaaattaggtagctaataatgaacaccatgcatgatactactaatcaatatatttgattaattgctaatctagctcgtgtttaattgatctgcaggtgttgattgagcggcacgaagccctgacggacgacgtgcaggagatgctgcagcatcaacgccggcgacaccagaagacggcgagcggcggccgggagcggatagccaccgtcgaccacctcaggcgcctctgcatggaccactacttccaagacgaggtcgacgacgccatggacgcctgcctgctcgaggagctcgcccatggcggcgacctgcttgacgccaccctcgccttccgcctcatgagagaagctggccaccatgtctcagcaggtgagatgatcactctttatgtgcgaacgcgcgaaagggttgcacgtcaatactttagaagaaaaaaattatagttacacaacgcaatcagctagatcggcttataccaggagaagggagaaaaagcaaaataaaaagctgaagcttaaaaaactacagcggctaaatacaaaactccaagcagttgagaggggccgagccacgctacactcccaacaaatcccaaaaacggcaacaccagctaaagaacacagatggccctccgagggtgtgagatgatcacacactaatgatcatatatcatatgttacagattaatcaatcaactaaccatgattaattgtcaattgcagatgaggttcttggaagattcacagatgataatggcgaattcaggctcgattacagaaaggacatcagagggttactcagcctgcaagacatatcacacatgaacattggacaagaagcctcactctgcaaggcaaaggagttctcaaccaggaaccttgaatctgccatcaactacctcgagccaaatcttgcaagatatgtgaggcagtcgctggatcatccctaccatgtcagcctgaatcagtacaaggccaggcaccatctcagctacctccagaccttgcctatccggtgcactgccatggaggagctcgcacttgcagacttccagctcaacaagctactccatcagatggagatgcaggagatcaaaaggtacatattacagtacatacattattgaatcattgatatacatactagctagctagctactccccccgtcccaaaatataagaacataggattagatgtgatattttccaatactatgaatatggacaaacatcatgtccagatttgtagtgctataaaatatctcatctagtacttgttataatttaatttttgttgtaacaaaacaacaatgattcttacttagttgaaacacacttgtatcgaacaatagtacgattcatagaatcatagaaacttactatctccgttctagaatgtaaaaggctttagtgtttaacacggtaatcaagaaagtaggtagaattaggtggtgtttgaatctcctgaagacgaagatgaagataaagattaagtgtttcatacaaacttgaaagatggattgatctgattttttagaacaactttcatataaaaagttttcgtatgaaacgcaccgtttagtagtatgaaaagcgtgccaatttatccaaaagtttatctacttttttagtggattcgaaagggaccttaaatggagagatgttgtgattagggttgtgaacctataattggttggaaaaagaatatcaatggagaaattataatatgttgggataaattcttagttgtagaaaggaaggaatacatgcatagtcatagctacttgctatagtttaatttcctgtattaattgaacaaccgtgtttcttcttaattagttagttgaaacacacttgtatcaaacaactgtaagaatattcataagtaggagtagtaccttgctcttccatgcatagctacttgctgtaattaatttcctgtattaattgaacaaccgtgtttcttcttaattagttgaaacgtgcacgcttgtatatatcaaacaactgtaagattcatagtaccttactcctagctacttgctgagtaatttcctgtattgactgaacaacagtgtttcttcttaattactttattcattttataatataaaagattttagatagatgtaacatatactagtacaataatgaatctaaacagtctgacacatcctagtaccagattcattgtactaatatgtgtcccatccacctaaaatcttttatattataggacggagagagtatcaaacaacaatgtgattcgtagtaacttacatgcatgccaactacttgctgtattaattgaaacaacagtgattcttcctaattagttgagcagttgtatcaaacagcagtggttcatagttaatttgctggattaaactttgactatgagtgtctgaaaatgataatatgaactatgcatgcagatggtggatggacctgggattggctcaagaaataccagttgccagggaccaggttcagaaatggtttgtgtggatgatgacagccatccagggtgcctccttgtcaagatgcagaattgaactcacaaagatcgtctcctttgtctatattgtggatgatatttttgatctggttggcacacgtgaggagctctcctgcttcactcaggcaatcagaatgtaagtctcagcttaagatagataattaacatgagtcttcaacatacatttgattttccctattctcttttttcttattcactggattatttgctctacacatagagatatgatttttcaaaaacttcttgtctagctattttatttcttagactacttattactaatataagccatttgttacatttataatatttaatatttaatttgtccctataatcaagtagatatataccatcaactttcattcgcgaataatctatttagaacagagccttaatttaaattgttattatgattataagtaacaattaataatgatttttttacaggtgggaccttgcagctgctgattccttacctagctgcatgagatcatgcttcagggctctacacacagttacaaatgacatcgcagatatggtcgagagagaacatggagtaaaccctatcaatcatctgaagaaagctgtaagtaatttttcgtttgtgttagaacatttttttaaaaaaatctcattcacaacgaatttgcagcaggactgaccatgcatatgcaatgcaattgactgaactttctttctaccatgtgtatcttgtgcagtgggcaatgctgtttgatggattcatgacagagacaaaatggttgtctgctggccaggttcctgactcagaggaatacctaagaaatggagttgtcacctcaggagtgccacttgtatttgtacacctgctgttcatgctagggcatgatgtgagccaaaatgcagcagagtttgttgatcacatccctcctgtcatctcctgcccagcaaaaatcttgagactctgggatgacctgggcagtgccaaggtcaatacctttttctcaccatgtcaaacatgctactcccggcccttcaatttctttaatatagataatgtcgttgtcttctgtacatacatcgtctggctactgtatttggtttatactttaagtatgacttacattttttttcatatttacataattttatttctaataatatgaatagttaaacacatgttaaaaatcaacgatgtcatatttattaaaaaccgggggaagtaattactacacacttatacgtagcaaattaatcttattcttctttgaaatcttattctcatgttttaaatcagcgcccacacacacatcaaagcaatatggtatctctgatatcttctctaaggattgtaaaaatataattattttaaaaaaatgtttaaagttgtatgggagattgatctttgctgggcctatcgtgaactgaaaatgtatgaaataaaaattgtaggatgaggcacaagaaggattggacggatcgtacaaggagctatacctcaaggagaacccggggctcgccgctggcgaggcggaggagcacgtgcggcggctgatcgcgggcgagtgggaggagctcaaccgggagtgcttctccgctagccccagtagatcgtcgccggcgacgaccttccccgccggcttcacgcaggcggcgctcaacgccgccaggatggtcggcgtcatgtatggctacgacggcgagcggcggctccccgtcctcgacgactacgtcaggatgctgctcttctgaattcgatcgattgattcgacctgaattttaatttcatccatgtatgaacctcatcatcgtccatgcataatggcgtgtagagattaattgtggattaggtctttgtaaataggattatagttagttgagtgagggagatagtactggtcgattttgtagtaaataaatatgatgaatttttactccctccattatacatattataaggtgttttagtttttttttcctatgataaactaatttcaaattgaatgaatttgggcatgtaatttattgccaaagtttcattttggattactctttaacttatgtttttattttggaccatataattctacattaatttgttgcactttagaccacttcaaaccactttctgtaaccatatatcaactctagcactgtaataaactccctcaccatgctcaagccacaattgataattttgttggcagagtggcgtacatggctagagaaagccttaggatgataaaaaaaacaacaaatgtaaatttacctagtacaaaaatgaaatgattagtcaaagggtggttcagagaaaagacttaacaataaaatgtggtaaaaaagtgccattcactctctttaattttcacagaaaatatagcaatattttttacacaaaacaaatatatatttaatggtgaaatgtagatggtgctatgttttttcataactttgatcgaacttgaaaaaagtttgaagttaaaacaaaccttttcatgccctgcagcatggaacatagagacgcgcaatttttttttctaaaaattatgggcgtgtatttggacaatggatacgaataaaaatcatcaagagccttttgcattcatacgagcgcataataaacttggagtcgaaatactaaaaaatgtgaaaattgaaaacaaaaacatcaatatgaggatgacaagtggggcccaccgggggagggggtcctacatgtcatactggtcacgggccgtgctgccaagctgtcaatcccaaattcacctctcgccgtcacgcgaattccggcggcgacccacctgcccggcggccggctacccccgccacgcaccaccgccggatcaagcctccctgccacaaaccaggagctcttcctcgccggcgctctcctcatccacccgtagcaggtgaccatctctccttcgcgcgctctcctttgcaagggcaaggaagccctaccttgcttggatgacttgaatccaaaccggatctcgcttgtgccgatgtgttttggtttcaatcctctactggtattcgcagctatatttccattcccccaccccgcgtttagtccccatcgcgtctagtatgacgatttttttttttaccatagattgggggtttggaagtagattgtatgttggattccactctgttggattgaaatactctaatcattgtttgcagaacccagattggtgaagtttccctggtgtggaaattttttcattgtgctcttcaatgttgtttgtactatcataaacatcaaaagtagttcagattctctgctgcataattcacactaaatgtcccatcacgaaaatatcctctgcgttgttagtgatacactgataatctgatatacatgtgaataggtatggtatagttatctgcggtagaatactatggaacccatgcctaggcttatttttgtgtatgatttggattttagagaggccctggaaatgtgtgaagtggttagaaattttaggtgtaactgtaattcacaggctaatgttctatgtatgtgtcataatcggcttctgaatcttttcaacactgaatggcaatataaaggtggtgtaattttgactcaccaatcgtgaatcatcatggatttgtgaaccatagcattttttgtcatcttttctgcattccagcctgtgactaacattgtatcttacatggaatttcctggaatgcattactcaatctatgatctgcaaaatgaagcccaacagtttcagttgattttgatatttccaagatgcatttctgttaatatttttttatgatactcagttgacaaaagataatcaatcatattcttttttttgttcaaatttctgtcgatgctgatgtatgattgctttgttattttctgtgtaggaatggagaagtatcacagcaactcccgatttgctcccttcagagatgctccatttgctctccgtggtaagagattttcagtgatttggtatgctatctgtccttctgacgtagttacatgatatcaaacaattacaccacagacacactgaattggtaatattggagacatgcatacatctttttaagtatattcttgtatgtaggaggtaaaactgactgacagttgaggtatcccaaggctggaaactacattagagtgtcagtctgccaaatagtggttcagttgagacaagtctaatactgtgctgatttatcaccatatatagattgtctgcatagctcgagatgatcaaacacagccgtgtagcgctggtcatttattatctgaatgcaaaaggctgttgctggtcatacatgatttatcttttatggggacaagagtttatgcgtgtctgacatgactttgatcacttccggttggatataggtgaataattgatgtgtagttttagtgagaaacagccatctctagtgaatctttagcaagcaactgctaattctgtgtatacatgtatagttcacaatgccttcaatcagatttggtaaaatgcaatcaagaaccccccccccccccaaaagttttttgtgtgctcttgctctatgtatgtttttttttttttttgtttacagttcatttcacacaaccaggaattcctcacatttgttgccaccatactttcaggtgcccttggtagctcaggctcatctttcagcagcatcgacagcctcagacgctcctcaacccttgagcaagctagggggtacacatctcgtcccctaggagctgtgcggccaaagatgctcccatctggatgccgacccctgcacacaagccatcctctgtcggctcctgttgctaaccgccccctgtcaccccaccttcctctgaagaagccacagctgagtgctacattctctatctcgcaccgtatatttggtgctgcgttgggtgctgccattatatccattcctctcgccaccaagttcagcctcatgtttgatgtctgagagagaaatgtggtctgcatgatgagaaagaaatgctatatttctgtgactatctcagcatctgaatttgccttgcaatgcaactgtagctgccgttggaataatatctttgctgtgcttgtagacttgtgaataataaacaaaacatgcaatgaccatactccctgtgagatatgatgttttatgctaagtgttaattttctctaccctttattgttctgctgccttgtggaattccatgattcatttttctcctggcaaaaaatgcttgccatgcgtgcaatttattcactatgagtttgcgttgtttgtataatgctccagttgagctgtagttcttttgctgctgcaaggaagggttggagacaattgaaatgcccaatgagcttatagtgctgaattcaatgtcaatgatcattgccaaaaataaaaataatatattttagtatgtgtaaataatccttgctgaaatctaacataactatttgcacttttttttgtatgtacatcatcattgctaaaatctttaataagtatttacactgttttttttttaaaaaaaagtgtttgtctctgttattagtagggggagcagggtggtagtacctggaaaataaaagttcggtgcaatgaatcgcgcggcgaggtcgaggtcgccggaggacgcgtcggtggcggcggcgcggaagctgcacctcctcctccgctcccgggacctccgcccggcgctctcctacctccgcaccctcccctcgccgctcaccctcctccccaaccacgccctcaacgccctcctccgcgcgctcgccgccgccggccgcgtccgcgccgccgccgccctcttccgccgcatcccttcccccacaccgcactccttcaactccctcctcgccgccctcctccgccgaggccgccgccgcgcggcctccgcgctcttcgccgcgctcctccgctccccctccggctcccccgacgccgccaccctcaacaccctcctccacggcctttccaccggatccccggacccgtccactcccgcgctcctcaggctcttccggttcttgcccgacacctacgccttcgcgccggacgccatctcgtacaactcgctgctctccgctctctgccgcgccggcgacgtgctcaccgcgcgcaagctgttcgacggaatgcgcgtcggaggagaagaaggcagaggagctgtctttcctaacgttatcacatacacgaccatgatcaaggcgtactgcgccaagaggctcgtgaacgaggctctcgcgatcttcaagctaatggttgcggatggtgtggcgccgaacaggatcacatacaacacgatggtgcaggggttctgcgatgccggcaggatggagctagtgaaggaggtgttggagatggactcgtttaggccggacacttgcacattcaacactctggtggccgtgcattgtagggaaggccggatcgaggatgctatgaaggtgtttaatcagatggtggagctccgtgtgagacgtgattctgcaagctatagcatggtcatccgggtgttgtgtgagaatggggaatttgggcaggctgaggagcttgtggatgagctcttggagaaggaggtgctcaagaagagagggggttgcacgccgctcattgcagcgtacaacccggtttttgtgtacttgtgtgagcatgggaagacaaagaaggcaaggatgctgtttgggcagctgctggaccggaggagcaaggtcgatgttcctgcattcaagacattgatccttgggcattgcagagagggtgatttcgaagaagggtatgcattgctgctctcaatgttgaagcgggatcttgtccctgatgatgaatgctacattgccgtgattgaagggttttcacagaggggaaggatgaagtttgcatgggaagccttgcacaggatgttgaatagcggtcttcggccaagcacaagtacttttcactcggttcttttggggcttttgaacaaagatggttgtgcaaaagaagcagctgatttgattgagataatgctagagaggaagattcgccaaaatgttgatctttcgacaaatttggtagatacattgttcaggaacaacctaaatgaccgtgcttacaagattgttacatctctatatgaccatggctattacatcaagatggaaaagttaatcgcaaacctttgcgaggaaaagaagttcatagaagctgcagattttactttgtttagcttggagaagtctcagaattttggtgtagccattccaagcatggttctggatggtctttgcatgactggtagagcttcagaagcattccggctgttctatgaactcattgagaacagaagtgctttggcttctgtcgctgcacctcgtagtttagttgcacttcatcatgcactggaggaatccgggaaaatgaaggaagctgattttattgctagacagatgagacgtgcaagtgccagaataagggaaagaatctagtgggttgctttgtcccaaggagcatttcaatcgcatgccctttgcttctccaaacaggatggactaataagtgtgaacttaaaagaacgaacaggatgcagaaactgtgcctgatccactgccccataagaaatggatcaaccaactgtatgatgttagaatgcagattaattcagcagatatccttttttttttcagggaaactatggcgggtggattagcaccggcctgaacatttattgataaataaagagatagttacaaataaagataatttacatggaggaaggagaagttgcttgagaattcagaaaatacagaggggggaggatggagtttaagaaattcctatgtcactaagattgttcatccaggtgttcagagcggggcgtagatgctccgggcagcggtgtacccataattcagcagatatccttaaaatattggtccaatcaggactttgtatagccaaacaatcaagccaactttctctgtcactatagtatcaccgatctggatcatttcttctcaaggattgatatctttgggaggaaatgaagtgtgggaagaccagatcacaagagtactctgctcctggactttgaagggcagtagttgcgggagaccaaagaatccggctgaaagaaacatattgtgaaaatgtactgctttccccccccccccccccccctaaatgcatgaggcanagctccttgccctttgggctcaaaaaaaaagaggaaaagaagaaaagtggggaatttaactatttgccacttttacatttgacaattaaccaaatacccttcttaagattgtacttaagaatttgccattagagagagaagcttttgtaactttttgccactttttgccctgtggagtgccacatgtgcatgccaacatggaccaacgtgaaaaatgaccaacctaccccttctagctagtggttagtttctcagttgctaagcctgtccgcattgaatcttagtcataattcattcactggaaagataccaagagaaaccagcaacctgcccaatcttcccattttacacttttaaatttataaggcaacaacatcaatggcaccattcatgttacagtcagttcattaactttttgaggctgcattcggatgtcttttttctaacttctactcacagttattaggactgaccagaccggcggttggactggaaaaaaccggaaccagggcctccgccggtctgagttctactccctcatttttttcgcacgtttctttaataactttttaaataaaattaagttactttaaaaatatatattaatctattctttatttattaaaactcaaactaaattagtcatgcgctaattctttgctcagttttacgtgaagagagaaatatttccaaaccatgctatcgcacaccttaattgagctcactccaggtggcaccatcccaacaataccagccaaattggaataccgtttagcagcttgaaaaacgtacacgtgaaaaacgagagagatgagttatgaaagtgaacaaaagaactcaatctaagtatcgttttgaaagtttgttataaccatctcagtggatctattacttcaaatattgatttgttaactgatgtggaggtactcggtctttaatatagtacctcataaaagtgaacagcatccataccgatgcaactgattcgcgaaagcaatttgtccaaatattattcctgactcagcttatattacagacattactaacaagggtagattagtcatttcgtgtgcctggtccatgctggcatgtatatgtggcactgaacagtgcagaaagtggcaaaaaattacaaaagcttctctctccagtggcaaattcttaagtgcaaatctaagaagggtatttggttaattgccaaacctaaaagtggcaaatagttaaatttcccaaaagtgtgaggcaatttctatatcaagcattattattttggaagacaggttggctaacttaccatcagtctgcctatttctttacagaggagtgaccttagctcgactagcaaatattcctaatactttacagaggagtttccttgccagttgccacaagatgtattggttgatgtgtctgaacgtaaagaatcatactacaaaattccaatttcacattgtcgttctcctgttttgatgctgtttgtgagttgtgatagccgtgactcagtttatgtgcatgcattcagatactttgggggctcaccacagaactacacagtatcctgccaactcagttggaaattgaaacactgaaatgtgagaagtaggagatgatcataagaacattatgttccttcacccagttatttagcacagaacacatttaatcctactcggcgcagagaatcaatggaaaacgcgtgatgttcagatctcacagttccaaggaaaccacgaacaggtatataacacgcaatcacatcaaacgttttaagtgttcaacacactcgaaatactgagtgaattccaaggttactaccataacaaacagttctggtatcacgtctctagtactacagagatattcaccaccacaggaaagctgggtaccgccacaggaaagctggattcagcatggtaggcagggagaaacacactatttcgtgaagcagtgtcactcaatagattgcaacactcaagtaatcccctatctgtgaaagaacatagcaaataatcaattgatttttgcctcagaagaatacattgtaataacataatacagctctgacaaatacctggaatcctagctctgcaagagttttagcatcatctccccttccatggccataagagaaggttgaacccaccttcaatcaatatccaattatataagttatcacaaattgaacagttactggtttggaatataaaggaacatgggttgtacaagggaatttactgacatatttagtggtttaatggcacagatagaacttgtaacaagctacgttttagtacagagacaattatcacgatgtgactgaagtggctactggtaagtggtaactacatggggcctagtggtgtaccaatgacatgtgttaggtatgcatacctgagtttgcagaaaagagattttgatgtcattggaagcatgtcatgaatataagcacacaaaatagtaaccataactaaaactaatagcccatgtatagtgaccaaactaatagccaacgtatagtgacagtcaaagcaaaatccaactcattcacgataataacactcattccctattcagattaagaccaacgtgctctgcattttttccatgtttgtgtatcagaggaagaaaaacaggatgagcagaagaatagtcacaatggtcaatggggataaactctcacctctttgacaacgaaacgaccatgcttatcagggtacacgaaagcaaaagaaagccttgcatttctttttcttgctgcaagagcaacctctttcacctgaaacataaccaaaactgtgctgatcagatctccatctaaaaacaacatttagtcaaacgtagtgccaaaccccacttatcatcatcagactagtcaaattttgttgatttctagtttgttaagtagtataaaactaggtaaaatttcattttccccaaagaggacaagaaagcacaatattagaaaaattacaagatcagtgagctctcggagtgtggcatccttccacgtgtatatctgcacttcatctttcggctcctttcctctcacggcaaactcttcattttggtgatggccaccaacctgaaaataaatgaccagtaccacaatcagctttctgtgtcgctgagtgtttactcaagaatctgaagtctgtcctaaatgaatggcttgggatttaattttcaacaacactaccatgagttacttgatcgagttatactgcatagaagtgtgactcaactacaagtgcgatatgaacattacaattccatcaaggcaccagaacctatgattcggtaagattgcacaatgcaaataactagcgcaataaagtttctgactatttatttaacttgtattcaaatgaacatatgctctcctcagtcaaccacactaaacagaagtgtaaatcacataatgtgaacttatcatacatacaggaatacaaatgaacgaagttagcagtaagagagataacaagaggttttacctttgtgaaaacccggagcaggagagggcacgtctgcaaaagaacccgatagtgaacagtaagtaaacaaatcaatcaacatggttaacctagcagaatcgaactggaacacaatgccgtcgaatcgcaaggtagtacgcaatctactgctgttccagcgcatcgattgggaggggggcacggaggaggcctcaccttctcgcgatcgacgggttcgacgcgcgcgcgagccatgggaggaggcccccggtactgcatcggcggccctggccgcacaggcctcatcggcatctcgccccttcccgccatcgcaacgagacctccccctgccctgcccgaggaagaagaaagctagtacgaatcaatctactgctccggaatcaccaatcagcaagcgactgaccttgctcacctgctccgccgccgccgccgccgatcacttcagaaggggatgcgagagaagcaaagaaaaccctagtaaactttttgtagattgcaccctgggttcaaatgaaaatacaattttacaattcagtccacctctaaaaaagggacatttaactccatgccacttttaagatgtagcaattaattattagttattcattgtctatgatacgtgggtctaatggcaaataatttagcaccactagtaagagagtaagggcccgtttagttctcaaaaagtttttcccaaaaacatcacatcgaatctttgcacacatgcatggagtattaaatataaataaaaagaaaaactaattgcacagttatgggagaaatagggagacgaatcttttgagcctaattagtccgtgattagccataagtgctacggtaacccacatgtgctaatgacggcttaattagactcaaaagattcgtctcacggtttcccggcgagttctgaaattagttatttcattcgtgtccgaaaaccccttccgacatccggtcaaacgtccgatgtgacacccaaaaattttcttttccccaactaaacacaccctaacaaaatagttaactattactacctccttccctaaatgtttgatgccattgacttcttttaaacatgtttgaccgtttgtcttattcaaaacttttgtaaaatatgtaaaactatatgtatacataaaaatatatttaacaatgaatgtaggaaaagaattaataattgcttaaatttttttaataaaataaacggtcaaccatgtttaaaaaagtcaacgggttaaacatttagagatggatggagtaccttaaaaaaaagcgttgacttgttgaccacttcgttgaaaaagccaaaaaggaatccgccttcttctccactccacttcactcacgccttcctcgccccgcgtcgcgaaccaccgcgcgccatggtcggcggcgagcccttgcggcggcggcggcatctcgccgacgatggattcttccggttcctcctcccctcgccgaagccggccaccaccaccaccaccacccctcctcccgccgcgctgttcgtcccgccccaccgcctcatcgcgccacccgtgccgctcccccagccaccccgccccgaggagcgcctcttcatcgtgccccccacgcgcccttcctggctcccgcctctctcgatacctccgccggcgacggcgacggccccgccgccgactcgttgccctccgcggcggatgggcaatggtggtggtggttgctttggcggccggagtggggtggtggggtggaggtatggaggtttcgtcgggaatggtggacgtcgtggcttcgagcggcggagggtgggaggaggcttcatcggagcagcgaatgcaggcgaggccaccggcggcgagaggcgggcggtggtgcgtaagagggagaagaaggtgtgggtcgccgtggagaagaagggcgaggactgcggcggcggggatgaggaccaggcggcgatgggcgcgggctatgccggtggagatgagagggacgagcaggtggacgtcgacgacgacgaacaagacgacggcgacggcgatgaccctttcgacgtcgccgccgatcacgacctcctcgccgtcgtcgccgatggcgccggcagcgagaaaccaatggaggtagaggaaaactcgaccgagacttcaccgacgcttcatgctatgaaactcttcaccttgctctccctttcagcagctcggatcgccgccggatcaaccgccgccgccgccgccgcgccagcgagtcggaacgcggcggtggagggtggaacgccgccatgacatcgacgccttcacgcccggattgctctccctctacgaatccctcaatccatcagaggagcacaaggccaagcagaggcagctcatcgaatccctcacgaattctgtgagcaaagagtggcccaacgcccagctgcatctctatggatcgtgtgctaattccttcggaaattcgcatagcgatgtagatgtttgtctccaaattgacactgctgcagaagagaacattgctgagctt

SEQ ID NO: 58873 - DNA, 10112 bp, Oryza sativa
acagtcgccgccttcactggctcacacttgcctagcctgcctgtccgtatgcggcggcagagcgctggggtttttgggctggcccggcgggaaaccggcggaggaggaggcggcgcgagtcgacgagcacggccgcgtggcggagagcagcttttgggctttctttttttccccctttcctctcaactgcggatggatggagcaaggtgtgtggaaactggaaagaatagtgggctttttttctctcttgtgcttcgtccgggtaggctgaaccgagttgcttcccctttttcctcgtgttggaatgtacctacttcctccgtctccagttttaacccttagagtataaatgttataaatgtattgaaagcagataaaaagagaaacaattacattcggatctcacaaagtgaggctattataggtttttgggttttgtatgggtatgtgtagaatgggtgaaaaataaacttattttaatatggagagagcaggaatttctaagtttatgtacatagtgaatctctaagaaaaccttgtgttcaaaaaagggcatacgtgtttttcttttcattgcaaagtagtctgttccattatgatcatagcctaaccaaatgtctaaatttcagcaatgatcaatgcataacattttaggatatggtttcttttgggtatcccatacccaagagaaacccgtcgacagcgaggcgtctgtggtgacttcatcaatcaccagtatttattggcccagtcttcgaagatgctcatagagatagggtttgcgtgcgtgcgtgcgttcttagggatggatgtgcgtgcgttgtgagtgtctgcgttgtactgtgtaattttaaaaaaaatgttatacactgatcattcgtactcatttataccgtaggggttaagtacaccatccgtaatgcttatgtctaactttctcttctctttcataggaaaacaacatcaatagatggcatgctcaagagaggtttcactagcacaactaaatatttaaagatttgatggactcagctagatatagagaaaccatcggatgagtaatgacaagaagaaagaaaaggtccgaattataccgctgaactgttggatgagtacgaattacccctataccaaaaaaaaagctatctttcacccctcttacttaatccggagtggttttagttctatgtaacagtccaatcagtatttaaaaaaaagatccgtggaacccacttgtcagattttctctcttacccctctctctctctaacaagtggatccactgatttttctaaaaaaaaatgggagtagctatatttatggcgtcatatttttcatcaaaaaatagtcggcatgtatttacattgtaagtccctaaattgcgtatgtaattttagtgtatttacaatgtaaattccaaaattacatatgtaagtcctaaaattacatatgtaattctcaaaattacatatgtaagttgatgtaagtcacaaaactatagatttgtgatgacacagatatttagtttttaagattaattagtaatcctgattagcaaataacgttaaaacaaaagaagagaacagaattggagggatatgcgtacacatgcggtgatttctgcatctacatctgatggttgaaacaaccgactgaaatccatcgtaatttgtggcgacatatttttagcaataccgaaaaatattgaccggactactacgtaggatcaaaaccactctagattaaattagggggttcttcatccggtattaagagttgagggtgaaagatgtttggtttttaggtctaggggtgtaatttatactcgcctaatagtttaatggtgtaattcagatctttttaaaaatatcgttttatccaagagagccttattttcctctagaataggtgggaagtatgatatttcattcgtgccattcctttgatccaaacgatgctatagtagttgaatctacaggcatgccaatcttttgttttttccttgcttttcttccaatacaaagaaggcataagtcatatataatccgaagaaataatgtttgtattagaatttagagttctcctgctttgcgtaaatattcacacctctctgtaccaacggcctacctcgccctcaagtttcaacagatgcattttacctggtgtttcacaacttcatttgtgcgcccttttattgatcgattgcgcaagatcaaacacgggttatgttaaaccgaaagggtgccactccataaaagaaaaagaatgatggctaggctagccgcttagctgttcttgaggcttgcgagcatcctgattcctgcagctcgtgtcttgttgctgaaggactggctaaaactagcgttgttttcgcgtaacccaactccgagcccgaggcgcatgtatactcccaacatcttcttgggcctcccattgctaaggctctcgatctccggatatacattattaatcatgtccgaaaacaagaggagactgaaaagtgattagttaaactctccatgaattccagctaattgttcagcatttatatactgctcggaacagggcggtgagccggcgcggattgtggcggcgcagaggctgtgcctgccggccttctgcggcgttgccggcgggatggcctggtcgaccgaccggcaacgtctcgtcggcgcatgcaccggcctgatctctgcatgtagatcgagatgtgtgctgctgtgcatactgaatttttgcaattttgcatcttgcatatatacttcctaaactggcttgataagaaaaaaacagttggttacaagaaatttcatactgaagttcaatttgttgactaatatgtctgaatttcgtcgttttttgccagtttaataatggttttggcgaaaaccagatacggcatgtgactgtgagtggcttttgtccggtaatgagattgtgaacccgacttagatattaatcactgcaagtttcccaagatttaacaattaatggagacttatcagcaagtcttggtcaccatccactgatcgatcgagaggtaaaaaagaagtacagatcttgcagaaagagatgaaaaatgggtcgatcgatcgagagttggaaatgtcctgtacacttgtacaggttgatgacccttattgcacgtagataattccatgcgcgcgtgtaagtatgcgtacatattccccgtgtctaatgctgcaggactcatgcgtgccgacgtgtgtgtggttagtaaaccaccccgtggcaatatgcagcatatacaaatcagaaatttgatttactatatataatccagatctaagaggtgtagtcactgtgtactgcgtacactactattcagatgcagctattacaaaatgtaagcgacgttctaatcgttaaaaagtcgtgttctggaaattgcacttgaggctgaaagcaattgagcaatagagatttgcaaatagcggactccacctagcctattattgaggatttatttatttgtagggaaacatatggataattcagaggattccaatcttataggaaaaattgtaaggaaaatcattgaaacctttttttaaaagaaaaattctatgaaatggataattctataaagattttgaagaaaagttagcaagtgttacaatctcctaaaattttttttgtttgaatctattgctatctctaattcctgaggttttttccccaatggtctatttaaacaaccagtgttttatactcatctgttttacaattgtattatgtaaaaattttatatttttatatttctcctttttttaataatgggtttcaaatgagccttaatcgtactccctccctcgacctatttcattctttggtttttttccaaaagtctaagtcttatttgtagttatcatgtactaaactaaattgttgatcggaatctaagaagtcatcttagtacttattggttacatgtccattgattttatcacatggtgaataaattaattgctccttagtcttggtgcagtaagaaatactccctccttcccaaattgatcatcatataatgaaaattaaattttctcaaattgatcatcatataactacatggacaaagatttcatcagagtacaattaatgcagcacgaaaaaatgtgttcatgttaagggtgtactccctccgtcccataatataagagattttagaaggatgtgacatattctagtattatgaatctagacgaagagtctgtccatactcatagtactaagatatgtcacatctctgcaaaatcccttatattataagatggagggagtaattgtgcattgcgtttttaattgatgcatacattgtgggagaatatgtgcattataattgagtatgcatgacatcttgatcgatgcggtttaaattattcttggtcatggtgcacagatattatatgatcaatttgggatggaggtatgtcttagacttttggatagagggagtattaattgggaaacttaaagcaattgagcaatagtaatttgcaaatcagacattatcttctgggttactttcatcacatcctactacatttcgcacaatgcatagggagcaatactgtaatattgactttgatcgagttaggcgcccatgaaaatgctcgaactcaaagacaaaggtaaaaaagttccaatcacgtcatttctatgcttggacggtagcactagtgcactacagtagtagtacctcgctaaggcattccttaacctcaccttcatgtttgcagtaaagaaaccgagaacgtagcgacgattccatttgggcaaactatgcatttagcctcggttcatgtgaagcatgtactgcctgcattgcattggacttggagttggcagatcagtcaaataagaaaagccaatgacactgtcaaaaactccatgtctgaatctgtcacctgctttgtttttactagcttgtaaccttctcttctgactttttagatcttgcggtgcttgtgtacagtcatatacagagatgcaggtggcatacactgcatatatgcatgaccagaacatcttcaccagaaccgatgcagtacaacatgcatgcatgaagcatgcctggttgattaggatacttgggaagttgggatccgtggtagcagagagtataatatttcaagtcaaaacaattaggaagcaactgttagtgcttgtaaaaaaaatgaacagtaatttagacatggacgagggttcaaattaattttgctctgtgagctagaaagattgagcagttgcacaagattgatccttaagagcaaactgcagctaaccatcaaattttatcggtagaacatcgtgaatcccagctcttgcattataatctagaccatgtactgcttaatttgattgggtaactacgggctctgtttgcccaagtttttttttagataaattctatctgtgataaagggtggatcacatatatgatatccagataaaattgggatcatgtcatcgtaaaaaacggtttcatttaaataccatcatataaatgggtttgaaataccattataaaacatcgcctttatactaagatgcatttactctttcaacggataaaaattgtatgtggcctcggctgtatgcggtggccaaggtgggtcgccatggtcaacgggaaggcggtggaagtagcatgcgaaggctatggcaatgtcaccatgtgaagttagagaaggggctagggacagtggcatcgatgggatgctagcgaaggaggcatggcggctagagagaaggtaagcgttgatggtgtgaaggcccacacactgacataatggaattgacaaagcctcttgcagaggcccgtgaagatggcctagccgatcatacaatgtctcagcaacgatgctagaggataatttattgccgtctgtgtcatactccgttaccgtccttcctcctatccacggtccgccatagcgggagtgcggcaggttaccacacaatcagcaaaaccacaatcgacctatccttgtgctatcgccgccatcgtctcccctacctgtgctcctcttcacacgtgctcgtcttgctcctcatcctatccccatcctcgcctttacctagaaaatcttgaggctcaaggtagaaaagaagacagggatggcgcactaaatgcggactcaagcacataacctcgagacgctaacaggtaacaagtttaataacacaaattctgttgtttcaattccagataagactcttgctgcaaatttttctaaattaggggtttctctaggaaagaatgatttagaaataaaggagtccattaaccagattaaaatttcagaattggatagatttactactctttatagtagtgctgtagcgtctactagtaatgtagataaaaacaacgatgaattgttaaaagtgtcttctctccagcacttatgtagtgaatggctagaagaggttgagagtaatgacgatgagtctatggattctcaggccatacctcgaatgaggaagatttcgaccaaagtcaaacataaagtggtatgtcctcttttgactggtccaaaaaagaaagctaataagtttaagaaatgaaaggaatattttggaatagttgtggctttggtgatgcatctaaatttagatttatatctgaatgtgttaaggagcaaaatttggattttattgccattcttgagactagaaaaccatcattcaccccttcaaatcttaaaaacctttgtggtggaaaagattttctttggcatgagaaacctcctatcgggcgatcaggaggaatacttttagaatttaaatgtttttgatataggtgaaatttcagaaggggacttctatgtgaagtttcttctaagaaataaagaggatggtttcaaatgggttttaatggcagtatatggtgctgctcaacccgagttaaaagaacattttttacggaactagctcagacttgtggtaaggagtcataccctctattggtaggggggactttaatatcattagatcacccgaagaaaagaataataattcttttgaccctcgttggccttttctttttaatgcggtcatcaatagtctcaatttgagagagattgatctttcggggagacaattcacctgggccaataacctcgaaaatccaacttatgagaagttggatagagtgttaatgaacactaactgggagcaaaaatatcctttagttacgtgtcaagccttacctcgagccatttcagaccactctccaattatactgagatccagatcgcatgcacattttggcaatcagctgccatttcgttttgaattaggctggctagagcgggatggattctttgagatggtagccaaagagtggcaaagcataaacaagggaaggaatcctatggaacgttggaaacacaagatcgtccaccttaggcaacatttaagaggttgggcgcgaagtttaagtagcacatataaaaaacaaaaaataaagcttttagctttatttgacacactagacaaaaaagccgaacacataactctctccaacacagagttagcttcgttgaagcaggccaaaaatgatttggcaaaactgttaagggaggaagagttgtattggtaccagcgatctaagacaaatcatttactccaaggggatagtaatactaaatattatcacttgatagccaatggtaaacatcgtaagcagatgattttccagttggaacaagaggacactataataacgggtgatgggaatctcaaataatacatcaccaattattataaaggattatttggtcctccagatcataatcatgtatcatgatagagggatggactgatgatattcctcaagtgtccgacttggaaaatgacatccttactgctgaattttcagaaaaggaagtcaaagaggcaatttttcaaatggatcataactcctccccaggtccatatggctttcctgcagagttttatcaggtcttttgggagattgttaagaatgatctcatggctctatttagagaatttcataaagggacattacccctttataacctaaactttgggatcatcgtgctactgccaaaaaaggctgatgcaaaacaaattcaacaatataggcctatttgcctactgaatgtcagctttaaaatttttacaaaagttggcaccaataggattgcaacggttgctcacaaagtcattcgcccaacccaaacggcgtttttgccagatagaaatatcatggaaggggtggtgattttgcatgagactgtccatgagttacacacaaagaaaatggatggtatcatattcaaaattgactttgaaaaggcttatgacaaagttaaatggcagttccttcagcagacattacgaatgaaagggttttcacaatcgtggtgcaattggatttccaactgggttgaaggaggaactgtaagtgtcaaagtcaatgataatgtaggaaaaaatttccggacatgcaaaggcttgagacaaggggatccaatgtccctaattcttttaacatagtagatgacatgttagccattcttattgaaagagccaaagccgatggccaaattagaggggtaattccacacttagtggatgatggtttgtccattctccaatatgccgacgatacaataatatttcttgaacatgattttgaacaagcaaaaaatatcaaggccattctttgtgtgtttgaacatctctcggggctgaaataaactttcataaaagtgaaattttctgctttgggggagccaaggaaatggaggaccaatatagacaactgtttggttgtaattctggttcctttccattcaaatacttaggaatccccatacactatcgaaaactcagaaattctgattggaaatgtgtggaggataggtttcaaagaaaacttagcacatggaagggcaaaaacaactcctatggtgggagattggttcttcttaactcggttcttttgagtcttcccatgttcatgttattcttttttgaaatacctcgaggtgtacttcaaagactggattactaccgatcgagctttttctggagcagtgatagccagaaaaacaaatataggttaacaaaatgggattatatatgctagccaaaagatcaaggtggactgggtgtcctaaatcttgatatcatgaatagatgtttgttgagcaaatggctattcaagcttcttaatggtgatggcctatggcaaaaccttctgcgcaataagtacttaaagggtaaacccctctcccacatgtcacacaaactaggaacatcccaattttgggctggcctaatgtaagtaaaagatcaattttttcagtatggatcttttaaacctggtaatgggatggaaataagattttgggaagacacatggttgggcttgcaacctctcaaatatcaatatccttctctgtacaatgtggtccgaaaaagacattctactttggcagaggttatgagcacaacaccgttgaatgtttcattccgacgatcaattgtaggaccaaagttagttgagtggaatgatttgatctctcgactagctaacataaccctgtcaaatgaaaaggattgctttatttggtcgctacataaaaatggccatttttcggtcaaatccatgtataatgcgatcatcaattccaatgtaagaatccataagaggatcttatgggaggtaaaggtaccactaaaaatcaaagtatttatgtggtttcttcaaaaaaaagtaatcttgacgaaagataatctcataaagagaaattggaggggaaacaagcaatgttgttttttaatacacaagagaccatccaacatcttttctttgactatcatgttgcacgttttgcttggcgatgtgtcttctttgccttcaacatcccccctccccacaatgcaaaagatatttttggtgactggctaaggggagtgcctagacccacaaaaaaaatgattttgtttggagctagtgctttatgttggtcaatttggcgttgccgtaatgatatagtttttaaccataaaaaaatgcctaacatcatgcaggttatcttcatttttcccaattg

SEQ ID NO: 58874 - DNA, 1406 bp, Oryza sativa
tggcgatgtgtcttctttgccttaaacatcccccctccccacaatgcaaaagatatttttggtgactggctaaggggagtgcctagacccacaaaaaaaatgattttgtttggagctagtgctttatgttggtcaatttggcgttgccgtaatgatatagtttttaaccataaaaaaatgcctaacatcatgcaggttatcttcatttgttccaattggctccactcttggtgtatgatgctttcacaggaacaacagtatactatgcgcaatggtgctacacgcttagaattagtagccaaggaaattttattccagtttggatggcgtagtacctacagaatttcgtgatagaatctacgtgattttgaaaaaaaatattattttagtagatcatatcatcggcagaagttaggggtttgtcccatctcgccttttttaacttttctgttcacgtctgaattttttgactgtgtgcctacgggcagaggccggagatgtaacccatttccattatctaaaaaagcacatatctatatagtcagagtataaaagacttccttatggagccacctctttataatactgactttgatcaaagtcaagctactttaagtttgactaagtttatagacaaatagagtaatatttatattaccaaattaattttattaaattaataattaaatatattttataataaatttatcttgtgccgaaaatattactatttttttcataaactttatcaaacttgaaacagtttgactttaaccaaagttaagacatcttataacctaaaacggagggagtagtaatttgatggagcttgtgaaatggtatttgagtgaagtctctttctacaatgacaaccccaaaattctcttgacctgtgtagggacttctgcagttgcaggcttgcagcttgccttacagaactggtaaagaaaaagaaacaaagtgaacaatgtgttggtataatgtttggacttgcccttcaatttctatacattacagtacatgacacatatgagcatcagagcatctctgctagatgccgtggtggttaccactcgatgccgtagtggtcaccactcacatgggcggagctaccatgattcccgggaatacccaacttttttatcgaaaaacaagtatatttctaatatatacatatgtacacatattagtgcacctaaatcctcaattattcgatccaaacatagccctatacacatgtacatatattagtgcacctaaatcctcaattcttcgatccaaacacagcccaaccggcctatatgacccatcagacatcagttgatccacttagccaccactcttccagacggccccctctcgctctcccttcatgacccatccctccctggctcgggtccctcgcg

SEQ ID NO: 58875 - DNA, 12166 bp, Oryza sativa
acgtcagtgtgtgaccctgtgtgtacgcccactagagctgaatcctgaatggatagtcgactctcgttcactcgcttggactgtcctgcagacaaagcgcgagaccacaacactggcgctgacatgcacagctggaggtatacgcgtatatatctgggctacttacgtacacccctggaccattacacagcacatagcctcatacgagcacgactttacatagcgatgcatgtaagccagtttgcttcatgtacaaaggttatcactagggatggcgacgggtcgggtcgggcacgtgtagagcaaaaccatgcccgaccccatgcccgttatcgcccgccaaaaccgtgcccgtacctatgcccgacgggcacgggtatatccggcgggtacccaatggacctcacatgaataataacttgaaagatatataatttaacaaagagaaataaaatcaataatttactaaattatcagttatcaacaataatttgaattacatcacaacttattattagttagtatcacaaatgaaccaagagaaagtggtataagaattaagagataagttgaaattagggcaggggttacccacagacaaaaaaaaatgaaacccggctgttgctcacgatgtccacgggtttcgggcgggcatgcccatgggtaaaaaatcacacccgcgcccgtgcccattgggtcgggtatctgcggatacccggacccatgggcaaaattgccatccctagttatcaccatttacgtacaattaaaaaaagaaagaaaattgctaaccttttgttggcacaaaaatccatccttaaatcttactcctacaaattttgaatcatcggatgtgcttcacgattcgtgctccaaatccttctcctccacctccggagactttctctttttctctggggccaacgacaacctaaactacaacgggtgacctacaaattaaagcccgggattgaggtgggagtgggaggagggggaagagagagagagaggagttcgacaactttataaggatagccatgggatgcggtggcccaataatgggtgacggaagaggtgaacaacgtgtgtggcgttgataatgcggcgacctagtaatgggtgacggaacaggtggatggtgtacgtggcggtgttaatgccactaaagccgcggagtcggcaacgggcgttggactagtgttcgcaacgaggccgaagcagagctacgagttagaggaggcgatcgggggtagctgatccggcagcggggagctgtcagagactagaaagaccgtgggataggatcacctcgccaccactggctgaaggaggaggagagacagagaagaacgaaggggcatgcagagacctggcgagcctcatcggtgttagagtttgtattaaatatgtatacaaattaagttatagttttgcacggttcgtgcctttccatggtgaggacgagcgactacgctgtggggcggtggcggcaaatgaggttgaggtgggggaattgcaaaggagttggtggcggcagtacttacgttagcgagtgggaacaaggaagggaaagggagagttagggatatgtgtgacgcagaaatctcaaagcagattcaacaatccaaagattacgtgatttgggatgcgcatgattttctgcggtaatttttttattaaacttgtctaaggttaactaatctttgccacactttaataaatctaaaagaatttatcacacatttctgagctattgactacgagaaagttgtgtaatcttaaacgccgtgcaagctttttgctgcaaagtgcaaaccaaacatatgcatgcccgtagtccgttacaactcctgctgctaggagtacgctgtcatccagggggagacggagaaaggacacgctattggagggcgagccgagcgagaagcccgagcagtaaagtagctcatcgaactctagctacgtactggcctactgtgtcgaatggggtaaaggttaaagctgtcgcgtgcatgcagctatggcgggaaatctcgatctctctttctcatttttatttttcaaagaatggtatttttttatccggcctctccatttaaccggatatatacggaatatatatggctattgaaatagggaacttagtcccataaataactcaatctagaatttactcatataaaaatttaaacttagaatttttagaaactactcacgtcactgtaaccgctaagctaagtatctctctctcggccgaagctagacgacgaggaggcaaaggcacgcgaggcaacgcagcgatgcaagcggatcggtggaggaggcggtggaaacgaaatccacgcagttcaagcgcgggccggggggaggaccgcctgactgctgatcgatcgatcgctggatcgattgatcacaagcgaacagtgtggatactgcagggccagcgattcttcaggggagcggccaatgggaatcaggtcctagtggatatagatctctgtaaaagtctctgttactattttatttacaaagtgccatttgcatggatgcgtgtatgcaagggcaacaacttgtcctgatggtttcgtttaaatattttatttcttttttctttgatggtatatataaaaaccgtccttatgaaaatcaatatatcgcaggggattcccttatatattgtttcatggtaaaagaaaagagatattttgttcggaacacattataaatgctgacgcttatatacatgtgtgtacgcttatcatttaaagatacatatgcacatcttaccccccgtaagagcaaggataatagtgagctataagcaagctaaatgcttatgtggaagagagagaaagaaaaatggggagtgttggctctcatgcaagagtgctccacacaaactccaagaaataagcattaaattcatagagagataaagagagaggatgaaaaaaataaagctaaccttatagctaacctattatacatgttagctttaacattggcttataacattggcttatagtaagtagtgggctgtactactaaacttgctctaaacacctctgccatcaacgaaaattgctgtacccctctgtagtttcatggtaaaaaaaatttgagatttcttttcagaacatataacaaacattggcactcgtatacatgcatgtgcacttaattataaaggtagacgcacatcttatctctatgagcacctccgagctgttgatagaaacgtcacctacccctcaaagaaacttagtgcttaatgcgaataaccatgcaaggctgtgttcggttgtggtggttgggaatattttccctctttaaggaaaacgagatagcttattagcacgtatttaattaagtattttctacttttttaaaatagattaatatatttttttacagtaactttactgtacaaaattaagttcttttagaaaaacattgtttcgtagtttggaaaatgtgctcacgagaatttagaaagtagaggttggaaaacttgagttgagaaccacaaacgaggcttaacgatctgtgtatgcacatgcttattggacactaagaacattaacaagagtacacgcataccaaatacaattttaatctgaacatcgcattgatgaaacaaaattaacaattcgatttccttttttctttttgagagagggtttgatacacattggtaggctagagatttgaagtcatacaccttactgcaagactaatatgcaattccacttaatacatacgatgcgtaccttatagcatctctaacagagtgatcaaatgactcttcgaactaaattaaaactaacataaaaaattacccttcaacaaactctctaactaactggccaagccttccggctagccaaacacgtccagtaacaggccaaatttgacaaaccacatctgttggtcaattgtgggccacacacgtctctctcccctcttccttcggtctcgcctcacgcaccggccgttgatgttgcctctgtccccggccacatccggcttggttgccttcgcccccggtgatccgatgctgcctcccgcagcctcctagcgtcggcgtcactcctctctgcctccctgcggcaaggcctatgtccatctagttgcaccgcctccgcctccaccctcggccaaccggcgctgccgtctccatccctaccatccagtgttgcctccccccccccccggcatatgtagtgccgttgcgagggggtggggaaagaaaagagaggagagggagagaataagagtttcgagacagtggcaatgaagagtacggaataaagaatttgttggagtgtgtagcagtatggagagaaatcttttggtgcgttggccaaatggatgaatggagagacaaaaatagtcatgctattggagatgctattaacattcccaaatataggcatagtttgaacgtgtggtacggctggagctgttcgtgactcagaaaaatggaacgtatcattaacacataattaattatgtattaaatattataaatgtgaaatagatttatttgattttttaaaaaaacatttctatatagaattttgttcacagaacgtactatttagcagtttaagaagtatgctaacggaaaacaagaaaaataccatttttagtttctgaaaagaactaagccttaatccgtaggcacctactggcttgcagagagcttgccttcaagctaagttcggttatctagcaatttgatttctaataactcaatttcacatcaataaataaatattgaacctatctatctacttattataaatatcttgaaaataaaacatcacctccgccctaaaggcaacaaattatcatattaatcgaagaaagaatatattagccatatgttcgatcgaccgtgatagatctatagaaattatgatttgagaatatattagccatatgttcgatcgactgtgatagatctatagaaattatgatttgtagattgttataacttcctaacgttgaatctgagctaaaaatatgtaaatattaattatgaacattagatctattagaactagttatgaaattgtacttctttaatgtataatttcataactattaattctagccttcgatttaactctgatatgaataatagtaactctggacttaattttattaatattacatatattcttttaaaaaatgtttgcacgtaaaaaattaagaaacataactgatctaaaataatggtgcacataaatatgtatttgagataaacgataacaaaaattgcacttgcgtggcagagatcagctagctccaaaattgttttacagcattctctgcttgcaattcagtcaaacaataaaaatcatcatctgacttttgaaaaagactacctttttttatctcaaatctaaacatacatataattatcatcactaaaaaaagtaaagaaagcgcccaaaaaaagagtagaaaagcaaaacacgcgtagatgctagctattccggcactccctttgctgtgactacctttgcaaagttcttaatgcttgtatgaaccaaaccgagaaatagtttttcttttttctttgggtgcggagacaaaccgaggaatagttggccaaacatattctcttttcatataatgcaatttcctgaggcatctttttagatggcgagaattttacttatttccacgaaatctgaattgattttgacgaaaactctacatttttttaacaaaaaatacgatgttttatattgatatagcaggaaaaaatacacgaatataatcataggaggctataaccagggaaaaaatagaaaaacacacagccacatgtaaaaactcctaaacacaaaatcaagggaaaagcattagaccgatcgctgctatgcgtgaccggccactgcttgatcaacgaaaacttagatctaggggtgaaaatttttaccgtgtcacatcggatatacggacatacatttgaagtattaaacgtagtctaataacaaaacaaattacagattccgcttgtaaactgcaagacgaatttattaagcctaattaattcatcattagcaaatgtttactgtagcactacattgtcaaatcatggagcaattaggcttaaaagattcgtctcacaatttacacgcaatctatgtaaattagttttttttctgtatttaatacttcatacatgtatccaaacattcgatatacatgctgaaaaaacttgccagagaatgtaagcaggccctaagttccaaatagtcttgaatcttttcaagcaggttagctgatgctgaggtcctgaggaggccggaagtgagctcagtttgatcatatggtcattaaagttttcattatcttaagaaaaaaaaggtggtgttgaggtggagaagaatatatgaaaaaggaaagggataaaagtgcatgcaactaatgctcagactccataaaaaaatacatttaaaagctctattaaaagtgagtagtattactcctccaccagcaaagtacagacaagaaaagaaaagaaaaagagagccaaagtgccatgaaaaaaagagcaatttttttttctagtcagcgtcaccctcctcccttcccgcttcagttggcagctgccctgtttctgcttcatgtcctgcccaaaatgccctcctcctaccctccacgcggctgtgtatacaaagagaacgcatccccccattgctcacttgccccctcctcctctttcacacctcacctcccaccaagataaagagcaagaacagcaagagcaagaagaggaggagggagaccacacaatctatcacaagcttagcaagatttatcagcaaggaaatggcagctctgacgagctacgagatggcggcctccatcttgctctgcgccgaggacagcagcagcgtcctcggcttcggcggcgaggaagaggaagaggaggaggacgtcgtggctgggaagagggccaggtgcgctggtccgccgccgccgccgtgcgtggacgtcgctggcgtggatttcgccgtgccgtcggaggaatgcgtcgcccgcctggtggagacggaggcggaccacatgccgagggaggactacgccgagaggctgcgcgccggcggcggcgacggcgacctggatcttcgcgtcaggatggatgccatcgattggatttggaaggtgggggtgttcttcatcgatgcgagccatatataaatctctctgatttggcattgttcgcgtcgatccagtgattgatccgtctgttcatctcgatctcgacaggttcactcctactacagcttcgctcctcttactgcctgcttggccgtcaactacttggaccgcttcctctcactctaccagcttccggtaagaaaccttatagctgtagtagtactagtactcgctccatactcgtaaagaaagtcgtttagggcagcggtacggtctccaaaacataactttaacttcttgtttctataaaaatatttattgaaaagtgatatatgtatacttttatgaaagtaattttcaaaacaaatctattcatataatttttatattttcaaactcaataacttgagagttttttatggtttatattcccaaggtttgacttaaatattgttctaaatgacttcctttatgagtacggagggattaattaactactgctcggttctcgaagaaaatggtaaatctgggacgtttcagctgttcaggatcagtaattctgtgcacttgtctgcaggatggcaaggattggatgacgcagctgctagcagtagcgtgcttgtcgcttgctgccaagatggaggaaaccgatgtgcctcaatcgctggacctgcaggtgagacttaaattgtgaattgaaacgcataggttttgcattgaacgatgcagatttgcgttgcaccctgcgtccgttttactgtgggatgatcacgttctgatcgtttccgggtcgcgcgtgttaccgtctgccaggtcggggaagaacggtacgtgttcgaggcgaagacgatccagaggatggagctgctggtcctgagcaccctcaaatggaggatgcaggccgtcactcccttctcctacgtcgactacttcctccgcgagctcaacggcggcgatccgccgtcgggacgctcggcgctgctgtcttcagagctcatcttgtgcatagctagaggtacggccagtgtgcatgcaagaaaattctggcacatctccatgcatcacagaagcttctgaaaaaaaatctaacatgaatgtatatgttcacgcaatgcaggaacagaatgcttgggattcaggccgtcggagatcgccgccgcggtcgccgccgccgtggtcggagaagaacacgccgctttctcccatgtaaataaggtgcgtgtgcagggcaagatgaccagtcatgaatgcaacgttccttccaaaattcaatgcgaaacgttacgcgcacagaagccataggctcaaactgtagccatactacccttaacgctacagaaatccgtgaaacgcatttacagccgcgagagagagaaagctgcacgtaaactggttattaatgctctctgtcgccgtggttttttctttgcaggagaggatgtcgcattgccaggaagtgattcaggccatggagttgatacatccaaaaccttcaagccccagcagagtcttcgtctcctcctccattccacggagccctactggcgtgttggatgcagcaggctgcctcagctacaggagtgacgattcagctgttgcctcacactacgcagcaagcagctggggatatgaacatgatagctccccggttagcagcaagaggaggaagattagcagatgatgcagccaatgatggatcaattaaaagtctgtttatatgtgttgcgaaactgatcgtgcatctctctttcttgggaaagtcaaatggttttgattgcaaatgactgtggagcctttcgatgccgtatgggagctagagcctgaaaggcgatgaaggaccaaaagcaaggcattttcgacatggcaacagagcaaagatactgatggataaagagagtctgaggtagacatgtgctccaatattttcatgtgctttagcgttagttgctaggaggcaggcagccacaaaagagtagaggatttgtgggaagagagccgggcgagatgaaaatgagatgaccaaaataaaggcagagacgaggtgacagtggcacaaggcaaagcgagctaggcactgacactccagatgtcctgcgtgtgtttcagttttgcgttgttctgtaatttcccctgcttaattcctttgtgaagaaaaatcataaaaaaggagagaaacaaacaattttggtgtcaaactccaataattcagcataactaaactacaagaagaagctgaagcaaaaaaaaaaaaagaagataaaagtaaaagacatagacaaaacccataagagctggaggagggtttcttctgatcatttctgaggtgttatgaacaatcaacatcacatattcacatatgatcagttcccttttgctttgtgctagtgcttacgactatcttgctgccaccctacattgtttgaccagttgtctgcatggaccatggaattcgcctctttgcccttgaaaggagaagggacattgtctggagaaacctcgggaacacaaacataaaaatagtgctcctactagtgccatacaggagagttgagaatatggctaaagaaattaggttggtcctttctctggagttaaagcttctctgctcccaaactataaaactgctagcaagattattccttcctgagttggatttctttttcaggtgacccattttgcgttgtttaggttgcttgttcgccatatgttccaagtaaggacacttaactactaataatgcaatgcttccagacaagcatggctgtaggcaacaataaagatactgttcagtgcccttttcaagcgggaaagatccgccactttgacataggagtattattgttcaattttgggagatcatagggtttggtttggtttgaggcctatattggccttaccaatatttgacaatttcaatagtgtttattgtctatttggtttggagccaaattttggcatgcctaagaaaataggccatttcaacagttaatttaggctattttggcttcaatccaaacacaattttacttttgccaaaattagccatgtcaaaagttgccaaaatttgacattgacaaaaattggtaaggccaatttaggccacaaaccaaaccaacccatagagtctgtttgtgtatatatcactcttgtgcttaacaaatatcaaatgcccacttgtcatttctattctaaattttagggcgcaatttaacttaacgcagtcttttagatttgctactaccacaaattttccatgcatttcatcatacaacctcatcccaacgagcatctccaacagcctctccaaacacccatttagcaatcttgccaaaaatttggggagtcaaatttgccttttactccaatagcatgcatctctattatcttctccaatctggtagtgggtcccacatgttaatttctaccttcttcccctctcttcctctacagtcacacctttccccttccccacctccacccacccggcgccggtggccctcttcccaaccggcggatgaggaggcggcggcttgaggcgagggggcgggtggatggggagccggcggcggtgccaccgtttcacgcgacgatggccagcgccagacgacgacgacaggcgcatgaggcgacgacgggatctaattctcgctggcctccctcgccgccatgccctccatcccgaccgtcgtgccctcccttcctcgctgtcgatggcgcaaaccgactctcccccggcgaggaggtgattcatcgccatcgtcaacgagaacccgccgcacgtaaactggtccacctgctcgaagtcagcggccgcaaggggcacagcggcgtcggccatgacgagctctgccccggtgttgtttgagagccgtcgagccgccccgtcgtcctcgttgtcgagctgcgccgatggccgacgccgaagaaggaaggcgatggcggcctgcaggggcgacgacggctggcagggaaggcgacggccggtagggtcggcggcgcctgcattgacactgggccggcgggcactaacgaacggcgacaacggatacgagagagaagaagcagagagagaagcagcaggtggcaaaagcacgtggggcccaccattagccagtgacttcgactggtcaaatctggctaggggagggagtgttttggccgccatcccgctagagaagctgttggagaagttttttttttttttttttttgctagagtgactaaaatttggcttggagaagcaattgaagaggctattggatatgctataaggatacaaagtgctgatactgcctaattggttatatttttttgtttttttgcctgcggcttattagccgaagatacaagaccgaaacaacgaaaaataattaatgctaaaacatacatgcacataaaactagcatgcagaggaccagcaactttcatttattttttcttctatcgttattttctactaaacatggagatgaaatcaggacacgcaaaaataagaaaataattagtgcatgattaaataaattttaattattaaaaacatgaaatttaatttatttgatattttaaagaaatttctatatagaaatttttttgcattaaacacaccagataaaaaacgtgctaatagaaatcgaggtaaaatctagtagtatatcttaataagaaaacaacaccaccttttttttttttgcaaagccacactgcctaggacaaacaaaatgcctcaccaagcaaagtgagttactaacttccttatataataattacatttttaccattcaaattttatcaaaaaaaaattatatttctgataagataggaccgaacaaatgtaatgtgtatcccaaccttccttttaattaagtttacttatgtgatgtatgtctcaaccttccttttagtcaagtatgcatatggaatatgcgcatgcagtatagttattaaatacggttattgtggtaaattgtgtttgccgttaatctat

SEQ ID NO: 58876 - DNA, 8555 bp, Oryza sativa
cccgggaaaaaataattcttcataattgatgtatttgaaaaatagcttcttaattgacgcaggttgagactgttcatcttctaatgcctgtcaaattcatgcaggctattaccagtgctcgagttccaattgtgaagattgcagatccaggaagtggcttgtcatgtgatatctgtgtcaacaatctctttgctgttgctaacacaaagcttctcaaggattatgcccagatagatgagaggttgcttcagctggccttcattgtaaagcactgggccaaactaaggggcgttaatgaaacatatcgtggaaccctttcgagctatgcgtgagttaaacgactttgcgttcatgattttcccctttttacagctatatgttatttgttgaaaatcttgaacctgatcttgttcttattaatttgcagatatgtgcttatgtgcattagcttcttgcagcaaagagagcccaagattctaccatgtttgcaggttctataccttactttttatctcaccaatatgtttcattcatatgaactactcgctgaagtactgatactttggatgcacacagtttaggataaaatcacttcacgcttgcttcatctgcatttagactcatgatgctgatacaggttaaacgaatggtctgcacacatttttattttcattttcatttttttatctctaaaatacttaacttctatctcttttatttgctggtggaatcgtcctgatttcgcattctcccttcatatatgcatgattctgttttggatggctcgacattcaactatggttggtcaattttctttcctttcttttcttttttttttcactaatgtagcaggtccattttttattctctttgattgatgttactaagagttgcttgcgtctagaattgttcagatgaaatcaggatctgcaaagttgtatatttcagcttcatctatgaattacttccgtcagttttatcctgatgcaatttgtcctctcaactcactccaattgtaggcgatggagccaacatatactgtggttgtcgatggcactgaatgtgcatacttcgaccaagttgaccagcttaaagattttggtgctgaaaacaaggagagcatcgccgagttactgtgggcattcttccactactgggcattccatcacgattacaggaacgatgtcatctccgtccgcatggggaacacaatcaggtgagaattgccaacgagcgtttctcaaaaaccgactaaacttcaaaaattcgattttgaactaatgtcacatatgcttcaaagaatttcgcgtcctttttaacttggttcgatctctggtcgatcgatagcaagcaggagaagaactggacgactcgcgttggaaacgatcgccatctgatatgcatcgaggatcctttcgagaccagccatgacctcggtcgtgttgtcgacaggcagacaatcagggttctcagggaggagtttgagcgagctgccaccattctgcagtacgacgatgacccttgtgtggctctttttgagccctatgattatgaatcttgattattattattagcacataaattaataactagcctggaaaatccagaaaacagtagctatcctaattctaggtagtagtgaagatccagtagcatgcttaaaacacttggtgaacagaagaacaacagcaggttgcattcaagtatgtcaaatttgatagaaagttggatcttaaaatcaaaagtactatgccaacccaaatttttcggaatgcttcccaagacctgtgaggcgtttcacacattctaagaaagttggatcttagaattcctttgtttttacttacagggcaatcctgaagaccacaaagacaaaatagggctttacttttgaagtggtgcatgcataactgaagagtaaaacaatcttatgctacaaaaaccaaaacaatataaaattcatcaccacgcatttagatggaaaaatgtttgtgtaatatatgaagggggtggctggaaattaactgaggcccggaagaagaggagcgatttgctcccaatgagaggccgggaaacctagaccaggccaggccttttaaagcccacaaggcctctactttctcttccagagtagatgggcctcatttcgacccagcccaagatgaagcagagtctttctcttccctttcttttaagagcaaaagcagtgcatcttatcttaaatctaaaatttgccacaacatgctaagctaaattttacacacgccctagtttttttttttgcggttatttgattggtgccacagttttagctagccacattacttaaatgtaaaatttgatgatttgacactttatttcttgtcactttaatttttaaaattgatactttttaggatgacgtatgggaccatgtaagtcaatgaaaatgaatgttaagtaatcgaaagccagctgagtgaaatatcaaattatcacatctcttagaacacatggctccgcatgtcaaaaactcgatttcttgtatataagaatgcataaaggtatggccaaggtgagttgcactgaagctgtgaattagtgacccgaagaaacaacagctgcattatgtggcgtgcacctcaataatattcattttgtgacgcagagctagtataagatattgacatcttttcgcggagaaagatgtggaaatttttgttcttatctatttttgctttcttctgcgtatgctcaattaactgctctttgacagccttcgtgtttgacagtggaaaacatttccttaccgtagcaataatgttgcttgcaggtataattcctaggacaaaactatatactactacctccgtcccaaaatataacaatttttagctatgaatctggacacacagttgtctatatttatagttaaaaatgcttatattttgggacggagggagtatatcatgacaggagaacgaattctaccctacaacttactgatttttcctggtctaatcttctgggccatcatgtcttgaattccgttccaaagatcatactatgaactaagtgcagcttctgtatgagagctgaggtgccactgatcagcagagattgcagaatgatctttctgggcttatgcaactcttttcatctttgttgtcacctcaggaaaacctataattcatactacttcttatgtggccttcaccttgacatactcatcatgatggttattgaagttttcgttatatagcatgcccgttggagaaagaagccgttgtaaagcacttccaaaccgaccctggaaaatggaaacagtattaaaatgtggccaggaaacatttggagtagcgagacattattatatagtgagaagtaagataatgcaaaaaataaggctcgaaacgatagtctgttatctttggtagggaactaaggatacaaatatgagaaaaagaacttgatatattgaaatggtcagatggccttacccactgaaacaagacaagtatccaccagcatccaggcaaactaccaaatttgttgcgaatgatctgttaagaagaaacgagatcagagaagtcgatcattaggatgtgactattgttatttgaacaacaaagaagattaaaggattttcaaaatacggacttaagttcttttagttgctagacagccatcacagagctttatgaactgagtgacagcattcaaaagtaggaagaagatacaatgttcacagtaccaatgcttttttttttctcaagctcattcaacataattgaagtagggacaaaaactccatctagcatcgatctaaagaacctatatctaacatcagtacctcaccaaaggagaaagaaaggaaacagtcatacggtcataccattagtagaaaggttccaatgccaaagcatgctcccattgattgactcaaaaacctgagatctcttccagcctgagaatagggagaaagtaccaagggatgtcatcacatttttccagcacgtgccatattcgactttgcattaatgtgctatttatctactccaataaaacgtaaaatatgatccccacttcccagtgttaaactgctagaaacctagtgccttgagccatgcttactagggaagtaatggcacttggaacaagtaaattcattttgacaaggttttcccagactccaaatgtactttccaggataattgctttaaaagtcagccaaaacaaatatatcagcttaccaataatgttccttcaagactatgcactgaaggtgtcaccaataatgcacagaaatatggaatcagcactttatgcatctgtcaacagggtaatggactgtcagtaagttctagacaaaatcgaaagcatttgagactgggggtcgtgaaaataaagcataaaactttctgcagatagactgagttaagccaaggccacgtcataggagacatgcgcaataatatgcaagtaaatttattttacaataatatgcaagtaaaattctatttctctatagagcacaggaaactaaatgtatataaattgaaggtaaagtaattatctaagatcataaggaccaccctaactggacctatgagtcagaatcaaccttttataatcatcatccgattcagtgaacagattctgcaagcatttacaaatccatagtgtacacaaatgatacaaccaaagtatcatatagagcagatgatgccaaattagatgactaacatcagatcagatataggagcactgaattttcttttcttaacagtgcaactgagttagattctaaaaggataaacggtactattgatagataagaaatggtagtattgatagtttctggcatagtgagaagcaatcagaatcgaatgcacttccagaacagtatgcagaatattttataagttatagagcaaacctgttggacaaccataaaatcattagtaaagagactaggaaaaagccacggaacaagtgttcctactgcccccacagtcgttccagttattgctccaatcatgacaagtgatttcaatagcatccttgcctggataaaacggtacctttagactttagtgtctttgtagtaatgaacttaaaaatataaatgcactttaatgtagaaaagaattccagtagaagatatgcactatgttagtcaatcaaagcaccatcagtgccgcacaggatgcatcaagtatgtgtaatgatgctgagcgtacaagcacaagcagaagcaactgttactctagtacaggaaaagaaggtatgtgtatggcaagcaaatgtatagaaacccttgatggcaaatgcacaactccgattcaaatatttattttagttcaatggtagttgtaaaccgtaaagatgcctcatgtcctaagaggcagcaaataagtgatgggatcaagcttttgttaatttcaacgaacaggattaatacaagagtctcagttgacctcttgcttttaccttcagccttttaactgtgtatcaaagctataatttttgtccagttaaattcgacctgccttgaccgccaataaagttgatatttatttgtggatagttttgcagcagatgtaattcaagattctaaatgatttaataagcttagtttgtgatatcagcattttatttagaagaaatgtgagaaggagcatgtactgaaaattacactgttgaaggaaactttgcatatcagttcggtttatcctaagttcttgaccagagaaaagcgtaaaaacatataaagtgtgcaagcatacatcatcaagctttacacatgattcctttggattaatatatcactaaggacaataataatgcagtacagaaattcacgtgaaattgagagctttagataggtaccttcatcaaattgcacttagctccatatatcaactctggcatgaatgactgtgcagtttgtgacaggggctcaccccaaacagtgcacatgcataggacattaaccataaccttcacagcatagattattttgtatgttatccacagaagaaagtacatagtagcactgtgttttcatcatgggtaagcataccaaaagttaaaaggtatgaacctggtgggctgcaagtgttattgctcccatagaagttgcagaatacgtaagtaacgcgtaaaatgctacctgaatggtttcaaataattaggtatagtaaagttgaggagaggacatggaatattagaacaaaaaaaaaagcataccttggaggtcattgttatgaaaacaggagctgcaatttcaaaaatctgcagaagctcacttgatgatgggattgtgaatgaaaaagctcgaaatcctctcttatttagattttgcatcatcataaaagctgcaacaatctgagtgtgtgtcaaaaaatagctatttatgaaaataatatgttgtcagaagactcaattgtgtaaataaattggatttttgtttagcataacaagtagctaaatgtctggcatacaagttgagtagacaaatcataaagaaagatcgacatggataataatatataaaattatgagcatgtggttccatcaaaaacataacattttacaatagataagtgattgctttataacttaactaggtagcatatcttactagaagatcaagaaacatttgtttttgttagtaatgtggtgtttcatccgattcaagtttcaaagaaaaatcaggtagtgtttattaaggctaagcattggtggcaatccacatcttgccaagtctaaagaatcatgctcaagtaaagatgtgcaagaagcaaggtatgatgaggtgattggaaagtatgcctacctgtgaaaccatagttgcccaggcagcgccagcaattccatatccacatacagaacagagaagaaggtccccaacaccattgataacactagcagctgccaatgccttcaagggaccccaagaatctttcatgcctagactgagttatagcaaacatacagtataatatgagaagcctccaatcaaggtagttgtaatgtgaaatcaaatagaagagctcaaagtgtttattgttatcagaaacatcacaaccaaataactatgtagcccatgcgagttggttcaaatggcaatatgaatatttcaatgacgaatagacattaagacaactcaaaacagatgcatctgtaatttggcaaaataaaaggtcaaagaaagaagacatgatagatttgaaggcaaaagaaatataacttctccagaacaaaatagatcccgtgcaacagaagaggagaagaatgagcatggtttttacctagcactttgagcaactaagccaaccagaactgcaggccatgcaaagcctctaatctgaaaatgaatgagtatacatattgatctatgtacttcatataaaacatggaagtcaaaaacttacatcctatagcatagtgcatagaattatcctatagtacagaacaaggtatgcaatatgcctgcagtcagaagcatccatggatttgcataggtttctgaaatcaataggtttgcagtcaggatcatcctcgtgtttgtacttcagtgcaggaaatgtaatcagcgtgcctcatcattcagtatccatacagaggtactagaaaatttcatcatgtttccacttccttgtatatgtatagctatagtatagctctatgaggtttagttcatagatagcatgcaattgaacttttagccatatttgtttatcctcaaaatttattgactatttgactgctttatacagttatattcaagaaagaaacaagcaattcaaaattgccagacaaacatgatttctcttggcgctaccccaagcatggcagatgtccttcaagccattgctagtgagggcgccctttggtgcctagcaggagcttctaagcttcgtgatcttttgtctagggctgtagagctagtgcactaggtttgttttgcttcttgtgggtgtgtggtgttggtgttgtacttctgggtgggtggatgtcagagtttatatctaatgccatccaccttttttcctctatcttgatgaaatgatacgcagatttcctgcgtgttcttaaaaaaaacatgatttctcttgctcattcaactagggcaacaatgaaaacaccctaaacagtgaaattaatgagagaatgctgacatgtacaaacctgtgcatatgtattggcagcagaaatgatatcatagttccccgatccagtaaacactgaaaataaaaatagaggttgcagtaaaattaagaaggtaggtggactcagacatgagacatgtgaaactctagatagcatgataaatacaagggcattcaatctgagaagcaaattaaaaggaaaaaacagaaataaggtgcactgccaaacagggagaaaaacagtgaaggagataatccagtggtgaagaaatccaccaggttttctccatcaatatgcagtcaggttcttcaaagtatgataaacaaggttgacagtcagtttcatcttattagcacagtttagtttcaacttaccagttaacacttgagtcccaaaaa

SEQ ID NO: 58877 - DNA, 11924 bp, Oryza sativa
  unsure (1)..(11924): unsure at all n locations
tactcttgcgagtatctacaatgttgtcctcctcaggattttcctcaggcgtttgatcattgtgttctatcggtgcaaagtgctcatggggcatgacagtttctttactagaagtgctaggtgtatgtttcatgggaaattcattatcaaagaatgtagcatctctggactcaagaattgtaccaacatgcatgtcgggtacaccaaagtttactattaagaatctataacccacactgtgaatagcataaccaaggaacacacaatcaacagtatttggtccaagtttccgctttttggctataggtacatttaccttggccaaacagccccatgtttgtaggtatgagagatttaatttcttcctttgccattcctcgaatggtgttacttccttatgcttcattggaattttattcaggacatgacaggcggtcaaaactgcctcaccccaccattccttggaaagccccgcagtgtctaacatagcattcaccatctcaattagagtatggttctttctttcggccatcccatttgattggggtgaatagggaggcgtcctttcatgaataattctaaactcttcgcaaaaagatgcaaactcattggaaaaatactccccacctctatcagacctcaaccgtttgattttcctttcaagttggttttctatctcagctttatagattttaaagtaatgcaatgcctcatcctttgttttcaatagatacacatagcaaaatctagtgcaatcatccatcagtgtcatgaaatatttctttccccttttagtcaacacgccgttcatttcgcacaaatcggaatgaacaagttctagaggtgccaaattcctcgcctcagatgccttgtgaggcttgcgagtttgtttcgattgaacgcaagtatggcacttggaacctttgaccaaagtgaattttggaattcaactcatgttagctaagcgcgtcatacaaccgaaattcacatgacagagtcgcgaatgccacacattagactcatcattctcgctaatatggttcacagcattatgattattacacatgtcattcaaagaaaagcggaacaagcctctgctgtcataaccttttccaacaaaagtcccatatttagatacggcacatttattggactcaaacacaagtctaaaaccttctctacacaatagagagccgctaacaagattcttctttattgaagggacatgctgcacattcttcagctgcacggtctttcccgaagtaaacttcagatcgaccgtaccaacaccatgaacagccgcaagcgacccgtttcccatcaacaaggaggaacctctcccgacctgataagaagaaaacagagaaatgtcagcacatacatgaatattagcaccagtgtccacccaccaatcaggtgagtgaagaacagagagaactgtaggtaatattttaccgtaccctgatgttcctccgccctcgctaatgaccatgttggcagacttcctgtctttgcgctcaggacagtccttggcccaatgcccagacttgccacacacaaagcagtctccctttgactttcccttacctttcttcttaatgttggttgcagccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcagaaacactgaactcttgtctcttgtgctttagagaagtggcaaagtccgaccaagaaggtggcagtttggcaataatgccacccgccacaaacttgtccggcaactcacagttgttgttctcaagttccttagccagcatttgaatctcatgagcttgttctactacagaacggtcatcgaccatcttgtagtcatataactgctccatgacatacagctcactgccagcgtcagaaactctgaacttggcctcaagtgcatcccacatatccttcccggaaggcatgtgcatgtacacgtccactatgttgtcagtgagtacactgatcaatgctccacggaacaggcaatccgaagcctcgaacttagcctcttcctcaggagaaagaggtggttcacttcgtttgccccgtgaaacatagaagcactgcatcgctgtcaaccacagtagtgcacgtgctttccatctcttatagttagaatcatcaaaagcatgtggtttcagtgcagcagcaaagccaactaccaaaaatgacctatcagatttttggattgttggaaatatagtcatgaatcggcatattttaatccaaaatgttaaagcaataatcatggcataagcggtgtagggtgctcttaacataaccagtagcataccatgcgcatcatgaatgtcaggaacaggaacattacagtaacgcaataacatgctagaggcatcatgaatgtcaggaacaggaacatagagcacataacagtaaagcgatagcgctaacaaagggaataggagaaggatatactccgaggatggccctccgctggattgtgaggcagaattgcctccgttgatgttgtcgttcgcggcaccggctccagctcctggcgcaccacctccagctccagctcctggcggcgcaccacctctgccatctcctccagcagcggcggcggcaactccagacatggcgagcagtcgtgcgggaggcactccccaaaagcctgatcacccgcctacccggtgcagatctcaggcgaagatgtggtttcggaggcactgctccttccaatctctcgtgcgcgcaagagatcagaagcgaggaagcgataatagcactggcgcggaggaggaggaactaacaccgggaaagaagcaagtgtccggaacagatcggactcgcggcctccttatctctcaggagagagaggcagtcgtgggaacgtggacgcgctgttgcggagagagtcgtgggaacgtggttagtggctgcaaaagaatagcgacgtgacgcacgcacgccgccgccagccaggcacgccacgcctcgcccacgcccacgcccacggcctcggcctggcgcgcgcgcgcgtgtggcattccgacctccacctcaaccagtcaacagggggcctccaataactccctatttaggttgagatattcctcgcttaaatcctgaggtggtattattatccttaacacttattatgggcctttgagatttaataggataagttgggcctagcccaattattctaacaatccccaccaagtttcaaggctcataagaaatgttctcaatgttgtgcctgtttgatataccagggttttggtggagactgttaagttgaacttccacctaggaaatgagctacatcagaccacaactgaacaatggactatgccttgaattgtcagttttgtgtgatcaggtttcactcagaaccttgactggtactgggctgccgttcgcatcccctctgtttggagcatataagtcaaactccaggcctttcatgagtatctagtgatcgcccaaacctcatagactgtgactagcagttgaactcatataggtgtgttccttctgagatgttctgcaggtcaacatctctgcttggagaagccactcggatcacattaaggcatgagccatcctaccatcctgctcggagtatctgatatttttgaagcagaaaacttcgttctcaaacagagactcaagttccatgaaatttcgtagtctctgtatcatcggactatctgatccaacatcggatactccgacacttagaaaaactcactcaaaagaattttttaaacaaagacagagagtgaagttctgtgaaaaatcggatagtccgatacatcggatagtctgatttcaaatcggatagtctgatgttgctcaagtaaaaatgaaataactttttactccgaactccgatttcgaagatcttggactctatggaaagctagtttcatgggctatcaaacccaacataaaacatggtccaaaaccttcaagagatgttgaaaaacttgcaaagaaacccggtgtaagtgttgtgacaagtgaaaccactcgggattaaaaattttggcttaggtttttcaactcacacaaacatgaagcattttgagcactagtattcaaccaattatatgcatgtggtatccctcttaatagtacggcatcctaaactcaaatttaaaaagtaaagttataccaataggagtaccttcacaccatattgattcttcacttggagggttaccaacgtcaaagtcatttgatcatcaggaagatctcatcttcttgatctttgacagttcatcttccatttctcaaatgattaatgtggataatccatggcttcaaatggcctcgcacggttcatcacgacacagtcttcacttgcccttcaccaccggtttcggttcgtcggcgccaagccccttgcttgcccttcaccaccgcatggtccatcgcaactgagcgtcacttgcgcttcaccgtcttgccataggtagtcacttcatgcccgcatcttcaatatcttctctttaattctcatccatcgataagtccatttcctagtttcttcatcggactaatcacttgcttatacactccataagtgcattagtcccttaatcgtttgtcatcaataaaccaaaacccactaggggcatagatgctctttcaataacttgaaaataaatttatttgcttttttaagttacttttatatagattttttttttaaaaaaatgcattatttaacagtttgaaaaatgtgctaaaggaaaataagaaagttaaattttggagttgaggaaaaaatagacttgtcagggttatggataccacatacctaatagtagttgactaaatctcggcaggacccgccacataccatgtcttatacgaaaacaactttgaatatagaaggagttccgcataaggaatgatgaatagagttctacatgaaaacgacaaggactacttgaattgtatccatattggtttccctagttctacttggacaaggggacatctatgggtataaatacaaggccccctaggaggagaggggacacgaaacaatagatcaagacacaagatcaatatacaagccaatattcgtcaagacaagacgccgaatatcgacttcagagataagcatggctagtcccctacggtgcctacggataccgtcaggagagacataacgctatctttgatctcgccggatgcaaattcgaggaggaaggctaccctgttgtcgactacgaatcagcacttcagaccgccaagtcgacaacagttagataggctaccccaaatattgtactggtatgattatggtgaataagagcaacgaccagcttcggccaataggagtaaggttattacctgacaattcaggggcccgaacctgtataaaaatccttgtccccatcttttttactacaatctcgcatatatgatagtaccaatgatccccatactatgcaaataccggaatcgcgacatcaaacgttgacaagactcttggttgtatcttttagatcacaatggtatgagatgttgtttgatttatgctgtgaggaaaaacatgtaaacacaaggttttttttaataaatggatttagttaatttacctcatgttttataaggtctccctccgcctcttttctacgtctccacttgccatcatcgctagttcatggtcaaaattagcagccttgagctcatggccatcggatccgacagtctagtggtcgggaaagaagaagggcagcaaggaagaggagataaatgacagtggcgacatcgatggcaagaagaggaggacagacgatggcgtctagatttgacatcctcctcgagtttttcctcccagttagtaagaccttgcgacttgcaaaatctagtggccccgagctcactagacgctagtgccatactccctctgtccataaatataagggattttgttcccttggtgtgtccataaatatagtggatttgtctcctcccaaagcaagcaggcactgcctgtcagccatccaccatccatgaatcgttttcaaaaaaaaacataccaatatgatgtacatagaactaaagaaatacaaagaacatctagtactcatactacttcgccccgtctatggctttgtttagattcatgggtgtaaaattttgacgtgtcacatcagatatatggacacatttgaagtattaaatgtagtctaataacaaaacaaattacagaatcctcctgtaaaccgcgagacgaatttattaagcctaattaatccgtcattagcaaatgtttaatgtaataccacattgtcaaatcatggcgcaattaggcttaaaagatttgtgtcgcaatttacacacaatccgtgtaattagttatttttttatttatatttaatactccatgcatgtttccaaatattcgatgtgacagggtgtaaaattttgacaggatctaaacatgccctatgtcaaaaagggaaaaagttacagaaaacatactaatactagtgtactacaaatttgtttattgtgtcaatgatgtacacagatgtactacttactctttcttaatttgtgctcttttaggcataataccttatattcatggacaaagggaatatttggctgtcataggattatggctgctcgctgcagctactcaaagtgagggcgagaggctttacaggtgcagtgatggagacaacaacggattgggtcgatggaaatgagcaaatgaagcggaggcacaaacccctcctagccttttgtatccacacgcccctgcgtaaccccacacctacatgggctcatgcgggatgagttgagctcgattcaagcttttctgctcaacctagctacgaaggcagttttgtaactgctcattctggctcaggtcaatgttcaagcaactaaatatacgacacgctgtatctgatatacgagcaagtgcgagctagataactagcaaaaccttaagatgtttacaacagacagttaccttttgcatgattgaatatggcaaccaatgaacgtctcaagggctatatgctcaaactaagattctcatcggatagctatttcaggcctcatcggatggcatgaagctttggctgatcagccaaatctgccaagttcaatttagccaaagaaaaaccattgtttgggttattttgcttatatggctggtgaaggattttctgtggccggtggttttgggatttttattttttgtgtatggtcactagagagttcacataattagccactgctgatgatccaactcccttgcgggtcccacttgtttggctgaaaagtcttagcccaagcctcaaccaaacaagccatccggtgagacccttgggctgaagattttcagccaaactgccaaagcccatctgagtattttcaaccaagtataagcaggagatccttcatcaaatccatccaaacaaaataagccaaccaatggaattgctttggctgatttggaaaaggtctgtccgagcatgttgattaccaacgaggccctaaaattgtagctctgcttttttccaatgagccgagctatatttctatacgaaagttgcataaaaaataatattaatttattttttttaaaaaaataataaatacttaattaatcatataataattggtgttttgttttgcatgtcggcccgaacacagcctttagtcacgatggaccggggcagttcgcacaccgagccctgtgcgcgagacggcgtggtagctcagggctaagcgagcgctctaggggacggacgcgtgtagctccgccgctcagccccccgctggctgagacagcagcagcagatcgagactccaagagagcagcaacatcgacggacgcaccngtnangtccccccctcccccccaccacccgatcaatcatcacgccttccccctcttcccaagttccaactccccccgccgccgacgcctccctcccccgtccccccctcgaccgttcccctcccacaccgccggccgcgtcgcccctcccctccgcctccgccgctgccgccgccgcctccctgcggccccagtttccgtttcccaagcgagtgtcccaagccgcgttgagggagcgggcggcgctccccccgtcgcccggcgcgtggcatcccgcccggccgcccgcccggatccggccggggcctcccaccgcgggggacggagcgcgtcctccgccgccgccgccgccgccgccatttccggtggtcgacttcgccctgaccgagggagacggtctcgtccctctcttgtctgctgcagcttcctagctcctgggctgcctccccccgcggcttctcgggcgccgcgatgtcggagggcaggggaggtaacggcgcgcgagtgatggtccgggaggcggcctgcaacgccatcgcgggcggttcggctggtaattctgctctcccctgcgtatggttctagccagggttggtgggttttttttggcttcggtctcgggatggtggcgtggggttttgatccttctgattgctcttcgtttggtggctgtgttgggcgcaggtgtgatctccgcaacggtgctgtgcccgctggacgtgatcaagacgcggctgcaggtgtacggcctcccttccaacctctctagcacggcgccacctggtaactagctctcttctcttctgatgcatggtttatacgtaccgtttgcctactttgcactctgtccatacgctttctctgggcttgttgccccatgaaatttgtgagttagcctgttttggtctcgctgtaagatcaatttgtcgcgttgcgatactaaagaacatgatgaaagcctatatgtttgcattataccagttatgctggacaatggtttgattgcaaaagttggcgcttaatggggtggggggctggtctgacgtgttggggttgataaaggggattaggagctcaatgcatgcttgtaactgaagtactactgtcaaaattgaggaatggaagggtaggagtgccaaaatagataatctaataatccatgcttttgtatgcttgaatagttataaattaggcacatgaaattgtgagctaagtctttttccctgcaatgctgcacatgcagtgcgtaatgtagctgctgctgcagaatctcttatagtcaaccaatgcaacatttcatataagattgttttgacattgcactatttcctccatttcacagtatctgtcccattatctctggagtatctgtttcaaaatacttgtccattgcagagatcaagatgtacttcttgcaaattttgcccctacttaaatgcatttcccacctacttaaatatttttgaaaagataaattgtctgtattatgagtatattagggatatccacagtcattttcattatgttttcttagactgtgctttcttggtctgtgtaaagtgggctgtggacaaatattgcaaaatggaaggatgtcttgagtaaaatattataaaatatttccatatattgaatattttgacaaaggcatattagcattcatataaatcatatgattcgctaagtttgaaaagacttgcatgttcatttgtatattctaatgtttttatctgaatctgaaatgaaaaaaaaaacctgttatcctcatcaagtttgcattacaaacatgcacatttctctgtttgaaggggaactatatgtcctgtgcatatgtgtcactccaatggcacaactattaataccataaaacctttcacacttctatagacatcttagtttaacatgctgaacaatatagtgcttatctctgtatgttgatgatcaatctagtacaattataaattaattttggatactcagaaagtattgttctcttgagcatgtattactaatttttaatccttctcaaacagtcttattttatctcttgataattcatctattcatcatatatctgctccatttatctttttttctgacttctgtttctcttccgtattaggtagggtaataatttcaggttttcagcacatattaaaaaatgaaggcctgcctgggttgtatcgtggcctttcaccaacgatagtagcattgtttccaacatgggctgtaagtaatcattaacattatacagtcagtcagtaaacagtagcattatttccaacttaggatgtgagtaatcattaatgtacaaatacagttagtaacattacaggattgttttaatttctttaatccacttttagatgatagcttgctacatgtctataaacaatgagttttgaaaacgcctaatgctgatgttttatgtgatttcactaaattgaatacatgttccgtgcaatgcctaataacagatgtacatctccacgaagcgtgtttgctgtttgaacactttaatgcatttcgcttactatctagatccacttgtgattgcgattcaataaaaaccaatttcaatattacagatctagctatatgtatggacatttatattgattttgaggagtttgttgagattttggctgcagaagtgaatttgttttagtaggttgtgtgggagatactgtcagggttgaactgttggcactcaattgtttaaggggaaacatgagtcggttgttttctcttggcgcttaatagtaatatactccctccgtcccaaaatataaggtattttggagggatgtgacacatcctagtaatatgaatccgggcagtgtcacatccctctaaaatcccttatattatacgacggagggagtagtatcatgtgacttgtggaggaagatctggcaaatttgatgctctcctttttatgataaaaatcagtgattcccatcctcttcaataagtatgtcatcaaatagaatttaatatatgccacgttcagaatgtgatacaggaggttttcaatatatatgtggtctaatccatagtccatactccctatgaacatctaattgtgcttcaaaactgcaggctaaatattgctttatgattgatgcttgtttggtgtgtttgattctgttgactcataatctcataaatatgcatgctcagctattctgactgcgtacactgtagtgaaagaaacaattctgtgcactgaagccatggctcgtgggctgtgtgctgttggcgtttttgtttctattagtggtggctgatcttttgtttagatgctagttaattgattgtttttgctgattccgtgatttatgtttgaaacatgtaacacgtgaaatgtattaacagagaaaacacacaaaatatctgtctgattctcttcatttttgttatctctgcctttgatatatattttttgaatcacaccttatataatgttttgtctgttgcactctgcaggttacgttttcagtttataatcacttgaagggtcttcttcattctcaaggttaaacacaactgtgctttaccaatgttggtctagatttgtcagtttttgtgcttatgtgtaaaatattgaagaaaggtgggcagaagcatcaaatccttatttaagggaatcatgtgttggattagattctattgtgtttccatctttgtttttgttttcagttaactcaagcatctcaaggtcttgagcatttcagggaatgctatggacaattctgacatgccactatattagatatttgtattccttgaaatgctcacaaaagaattagcattaaatcatgtttaacacaacagcttagtgaactataaggaattttcccgaggatctactgtttgcataatgtgtccaactttccctgtatcaggaaatcatttaaagcgcttcagctaaagacttgtta

SEQ ID NO: 58878 - DNA, 30840 bp, Oryza sativa
ccttgtatacaaatgtctatagcagaggcgtttggtgcataatccagagtgtgtagtaggtgttggacagatgaagttgagtggtactgtagtgttgttgttctcttcccttgggttttgtctgtaacgtcgagagggagagatgttgacgctggctgaaagcacaacacaagcagagtgatattatactactactagtaatttacttattagtacctgtgtagtattatctatccattgttggtgtgtgtttatctgtcctcccaagttgtggccagcaatcccaatcccagaaattgaatgaatagtcttctagtggccggcgagggaagggagtttactccagatagcgagagaggctagtgtttgagggaggggaaggggatgagaggaggaaaacgaagcaaatcgtacgtatggaacagtgacggcagttgggcctggcaggaagaggccgtcccccgtgcagtgcagtgcattattgaatgatgatttgcgccttctccttgcccccgtcgctgccgacctccaccggtcgccgcccgcacgcatcgatattggaattggagtagtatatatgatcgagctaggccttcctcccggctagttgtcattaaactctacaacgtacgtatctctcctctcctcctgctcccgagcattccgtccccatggctgttgacgatctaaaccaccacctcatcgccgtcggagtcggagaagaagccgccaccgcccattgtgggctgcgcaccgtgagcaatttcttctttaattaactcactctgtgatcgatcagatcacctgcattaattcgttcatctatctatctatctatcacatacgcgtagtaagtaagaagtatgatttgaaataatagatggcgcatgcagcttgtgcggaatatggcgcagctggtggtgtcgctgggcatattggtcgccgccgacaagttggtggagcaggccttcgcagccgcctccatcaagttccccagcgccctcttcgccatgttctgcgtcttcgccctcctcctcttcctacctccttcgctcgccaacggattcatggctttcttcgaccccgccaccgtcttcatccacaggtggctgcccctcttcttcgtcccctccctcgtcgtcctgccgcttgccgtcagggacgtctcgcctgcttctgccctcaagatcctcttcatcacatgtaataattaactactgtaactaacactactcttcttaatttataattcgttccacgtacgtacagatgatcgacatgactctgctctgctcatgaattttcttcttttaatattaataatttactagttggtggctggtttgcttcactggtggtggctggttacacggcgctgagtgtgagaaggatagtgaagacacagcttataccagctgagcccatgaagagaccgtctcctttcgggccgcttgaattctgggcctgggctgctgtctttgttgcttcctttgctgttgcgtatgtttcccccactgcgcttggtaccaccgcaacaacatgccttcctttcttgcttgcttccactgttttcggttacatccttggttcccggtactactccattttatatttactctctctttattcttgactttaaacataaccttttgttcattaacctcatctcaaaatttagtgcaaatatatgagtcatacataaagtacctataataattaataaaacattgcaccgtgtttctaaattaaaaataaaaaaaaacttctatatctatcttgatagcgattaaaatcccgcactattgaaaaagaaaactactactacctactactacttgagaaaacttcaacatcaactctaagatcaaaattttaaaattcaaattttagcgtgcaacctagtttactccattatattaatttctctaacgttcaatataattctcacaggttaccatctggtgtcaagaaagtgctacacccaatcatctgttgtgcactttctgcagatttggcggcagtagcatatgggtatctctcccggtctggagtggatgcagtgctaggttctaggcttaacccccaaccctgatcgatactcctataatcaaattgcatcaatcgcaaagtcgtgctccctgatcagttttatcctatatatataatgctctcaaatatatatgtatgtatggttgtccaggtgattacctcacagagtctccgtcaaatccaggagctggtgacatcctcatgggatttcttgggtctgtcatcatatcgtttgcattttcaatgttcaatcagagaaaggtaggtacccttctctcagttagtagtattactagtagttagcatatggttatatatgttgtgacatgatcatattcgaagctctctgtttaatttgttgcgagacgagtgtgcctagctgttggctagctaattaaccatgcatccaaccaaggagtaattaattaatgtttttgtgttggataatataatatttcagcttgtaaggaggcatgcagcggaaattttcacatcaatcgctgtggcatcaacattctcgttatattcaactgccatcctaggacgagtggtagagctagagccaatattgaccatatcaatattgcccaggtgtataaccgtggcattagctttgagggtagtttctctctttgaaggtttgtccctcctcgatctgtattagctcctccgtccttgcttcttttgtcactatgaaatgaaatcatcgatatttcaaccattattaacttttagacgatttatctatgattaatgaaaactatatagttgtatttatatcgtaacatgcattactaatatggtgtctgtactttaagtatgtatatatatgtgtgtatttttttttaaaaaaaagacatattatcaaagttaaaaagtgaatagctagtatccaacgacagattaataatgaaatgcatatagattaatattcatctataataatggtgtgttgggtgggcaggtgtaaatacttcagtaaccgcagcggtggttgtcctcacggggctgatcggcgcaaattttgcgcaagcagtgatggacaagcttcgcctcaaagaccccatcgcacgaggaatagggacagcttccaggtaggatcacaatataagagcaacggtaataatacagccgatttattggctataagctcagcgtacccatataatagttagctctttacaattaatatatggctcacttatctttctcatagaattttttggttcttatgttcgaaccggctgtaagtttatagcccgtttctcctctcttctctcctccacctcagcatttagccagcttatagcttactattatacttgctctaaatgtgggttttcacgtccaacatttgacgtgcctcaaagtagtatggagtggattacatggctactacgaccaaatatacgaagatctggtaaaaggagaaattgctaggcgtgtgtttgctttgtgtgacgatggatgtttattgtttaattgcataatacctctctgtttcaggctataagacgttttgattttgatcaaagttaaactgttttaaatttaactaagtttatagacaaatatagtaatatttataacactaaattagttttatcaaattaataattgaatatatttttataataaaattgtcttgggttaaaaatgttgttactttttttttataaacttggtcaaatttaaataagtttgactttaaccaaatttaaaatgtcttgtaacatgaaacagagggaaacggagggagcagtaattgataaataagagggtgatgttaggcgtgcaatctgatccatacatacatgcagtgcccatggactgggaacggcagcggtgtcagccaaggagcctgaagcgttgcccttctgcgccatcgcctacgccctaacgggggtcgtcgcctcgttattttgctctcttccggcgatcaggcacagcttagtcttcatagctggcgatgcctctgcctcacaaacacaacacttttcttactagtattatttggatatatatttgtttgtctgtcactattcatgaaaaacagacccagtacagattgatattgtgattaataatcctacgaccgaataaatactgtatatacagagacacgtatatatggtaggagtaacatggaagggagaactatttgtatatgtaattaatttttgtaagggaggacctggacttggtggaatgaagcagctgattgcagttaaagcgaatgcagcatcatcaaaatcaaattaagcagacaagagtcaacacaagtcaaagtgattttattattattagcagagcagagcagatcaagaaagcagagagaggtgccacactcttgtattcaccgacaactcactctgggcatgggcatggcggattcacatctggatggggtgccggcgatgaggaagacgacggtctccagctccagcagcctcaacatcgccttcctactctccatggttgccaccaacctgctgtccctctaccacctctccacccgcgcatccaccgcaccgccgctcctcttgccggcggcgcaccaggcccaggcccaggacgagcagctcctccgccagctgaccgccatccgcgccaccgtctcccaactcaaccacctccgctcctccacgcccccgcctccgccgccgccaccggagctcctcctctactcccgcctggcgcccctcgcctccgcctgctcagcccacccggacctcctccaccgattcatgtcctacacgcccttctccccctgccccgacgacgccctctccctcgccgagcccctcctcctccgcggctgccacccgctgcccaggcgaaggtgcttctcatcatcttcgatctcgtcttctcacaacctgaataatctgcccaccgatcccttctccccgctcccggactccgccgtccgctggcctccgggggccaaatgcacctccttctcctgcctcccgccctcgctcggcttcgacctcgcgcgcacggaggccgcgcgcttcctgcgggcggaggggcccctcgacctcacggtgccgcagctgctgcgcctggcatcgctcagccgcgcggggcccatccggctggggctggacgtgggcggcgggacggggacgctggcggcgcgcctcaagcgggcggccaacgccaccgtgctcaccaccactatgaacctcggggcgccctactcggaggcggcggcggcgcgcggggtggtgccgctgcacgcgccgctgcagcagcgcttcccggtgggggacgccaccatggacctggtgcgggcggggcacgccgtgaaccgctggatcccggaggcggcgctggagttcctgtggtacgacgcggacagggtgctgcgcccccgcggcctgctctgggtcgaccacttctggtgccgccgccctgacctcgccgccgtctaccaacccatgctgcgccgcctcggctacaagaccctcaagtgggccgtcgccgacaagaccacacccacgcccacggcgccacccggagccaagcatgaccacgtctacctcaccgccctgctgcagaagccctgatcgattcattgccattgccattgtaggtgggatcctggaacaaggctgtcactgaggtgatcaatttaattgtgcaataagctcaaagaggaatgccaatgccaaggctcaacaatgaggatgatgcactgatttgatttgggggtcttttttttaccaaggactgtacgtaacttctctgtggaatcatcattttataaggaaagcctcgcatctgcaaaagaatgcaaatccccttctcactcaaatttgctttgaaagttgacatcttcctgtggcttatgcttcggaataacatcttgatgaaggacaacttcatcaggagagggtggaaagaaaaattagagaggtcaactctacaccgcagatgagatagtgccgcatttttgtttacaaaatgcacactgcctcgatttgtttcgagtgtagcaccttcaattttaggagtgagctcataatattcctcacttgtttgggaaaggaggatatgaggaatttgattgctctaggagtaactgatgtggtgtggtcgattttgataggaaattgctatgcatacagctcaattgtccgactcatgtacgactaaatttgatcaacggttgtaaatggctgcaggcgcatatgaacatactttcatttgattgatctgtggttgtatatctctagttgtacatgagttgtataactaggttctacttatagcagtactcatttggagaacttggaatgaagcttcgttgctggattccctcgcactctcagagatcatcaatggaaagctgcatgtttatatgttaggttctgctacagtaaggaaccagcgagtcttccatcacaacaaaattcccaacgacaacttgggcgcgggcggaagtgaaaagactcgtgaaaatgttaacctagttcctgtgaaactccttttctttttcttctcacactccttgtaaatacttttagtgccactataaacagtgaaattgacattgtcttgtgctggttcgtttagggaaaaaaaattccccttgttcaagacatggaagcacgaaaatcttgctgactttcgttgtgtcgaaagattcagagtctattttaactcgaagagctgatttcaagtctatttgtcaggagttaaaacttccaaatttaactcgaagagctaagttcggaatagagttgtagactagtttaaaccggcttcactactctagttcattttataagagcagtttaacctactccgctatctttttaggttgagttaaaaccgtttggctctgctacagttttgaaatggttggcgcttatgttggcgtgatcctgatgatttgcacacggcaggtattaaattgcgataatgattatcgccgggcgacgggtggagggggtgtgtgtgtgcagaaatcgggcgctccccccacccccgcgcacgcgcgcatgctaggggcgcgtgcgcgtgcactccccttggcccaccatgtgtccacaaataaactctattgcaacaaatcacccacatattttggaaaccctctattaagggaattcgtttcattttttgtttcacaacaaatgtttcacctagtgtactcacaatgtttcactatatatagatctaatgttgcagtgaacgaaacattcttttgcaacaaatcgcccacatattttggaaaccctctattaaagaaattcgttttattttttgttccaccaaaaatgttttacctagtgtattcacaatgtttcactatgaatagatctaatgttgtagtgaactgaaacattcttttgctatctgctgaaacattgtttttatataaggtaaaacaacactcaatttaaacgattgaaacatttccgatatacttagcgaaacaattccgatatacttggtgaaacatcgtgcaacatttaaaaaaaatcaataataagctaatttttttcctcggaatatatctatgtgtggtcttgttttgaagatttaattgcaacaaattaaatggtgtaatcggatcatgatttggataaataatttaagagaaaaattagtttaaatttgttttacacgtatgcgtggcgctgacgtcatcgtccgatttttgccaatccgggcgcccgaccggaaatcgcgtccattgaattgggctgggttatgctgggctggacaaacagtacagtagcgctctgagtggtgggccgtgtggcgtggtctttctatgttggtttgctgggctgtgacgagacgtggcccgtggctaggctagtcgtccgacgccggcgtttgagcgagccttcgctgccgccgccgccgccgacgacgacgacttgcctgcaccaacaataccacgctcttgctttgcaatgcgatccccttgtaatctccccctcgctgcctcctgcttctatgctccacgccacgcgcacgcggacgccgcgcctctctgctgccgccgccgccgccgccttcttcaccaccaggcccaggtcccacccaccgccgccgccgccgcgcctctctccaaggctcgtcgacgccaccgtctcccgatgtccctccgacgccctcgccatcaccttcttcctctggtgcgcccgctgccccgcctacttccaccctccctcctccttcgaccgcctcctccccgctgccgcccgcctcgcctcccgcctccgcaccgcccccgccatccttcaccagctccgcgccctcggctgccccatccgcccccacaccttcctcctcttgctcaggctctactggcgcgggggcatctacccgctcgtgctccagctgttcgaccaaatgcccctctggggcttccaccccaacgccttcgctcgcaacgtcgtccttgacgtcctcctcaggacgcgccaccaccactccgcgctctgcttcctacgggacaatccctcgcccaactaccttacctacgccatcctcctcacccacctttgcaggtccgggaactggccaggggtgcgggcctgcttcttagccatgctgcaccagggttttctccccagcgccgcctctctcaatgcggtttttgcctgctgcactaaacttgctgccacgtccgagctactgcagcttctgggcttcacacttgtatcgggatatcagctcacttcggccatgtggacatgtctcatcgctcgtttgtgccgcgagggaaaactagatgaggctatcaggatgctggcaaagatgctggcttctggttctcctcccacagttgtcacctacacgccgatcgtcagagctctctatcgtgctggaaggcatgacattgccactgagcttttcgcatccatgtcatccaccaattgcagcccagatcttgttctccataatgttctcatggactgcatgaccaaggataagagatatgatgcagccctaggcgtttacttaaatcttcacgagagccagatgaagccagatgcatacactttatctactttagtccgcgcgttgcatttgtcacggaatgtaagccttcttcctaggttatttctggactcagctgatatcccttatgatctcgtggcctgcaattctgtgctgaatgctctgcgcaaatctggatttccatctcaagccgtgcagttcttcatcaatatgattaagtgtgacatcaggcctgacagctacagttatgttggtcttttggacagtctgtgccagttgggaaggattgaccatgcaatcaatgtctaccacagtattgtttcaagtgatcctgattcaaacgcttatgttcatgctgcaatcctctgtggccttgttaaaaagggccacaaccgtatggcgctaatgattttgaatgaggctgtacgtcaaaattatgctctcgacgctgtgtgctacactgttgttctacatggccttctacaagctcatttgattgaagaggcttgcatgttgtttgacaaaatgaagcgttcaggaatggcttccaacacttgcacatacaacataatgcttcgtggactttgtagaaccagggatacacatgcactcaagtggtttttaagagaaatggaatgttctgatgtggagatggatagtatctcatacaatattctggttgtgttcttaatcaagttgcagcatattagttcagccactgctttggtaagagaaatggttaatctaggcatggaacttagtgccaaaacttcctcattgatttctcagtccatgggccatgagtatgttctggaggatgctaacattgctgaaaatgatcattccgactcaactaatgatctgcttgcatgctcagcttcatagtcaattttcaactaaacagccatgctgcttctgtacatcttcagtttggtggtgcataattaaatacagatacacactattaaaggttggtgaaatcttcaatgatttatctccctccattgcctatctaacaaatacctaccatggccactgaaaggctgctcaattacatgccccccgccattatgttggtatatactttctctttccctgtgatatcaccacttagtacattcttatttaaaaagaaggatttgattgcaagaaagaaacaagatccctcctattgcattcatcttatctttgctatagaacattggtcacaattctcactcagtgctgagacacacagaaatgcaaaaaaaatctgcaagtaataaattaaaaagaaagacttacctgctttttgtgtcctgccacataggctcagctagggctgaactaatgggttattgtttttctccaaaatttacattgtgatttaagatgatttaaacattattatggaggcaagcttagggctcaagctctatctgctctaggcttgcctccgtccatggtttgacctgaacagcctgtaaactacatctttatgaatttatgttttgtaacttgaccattttttatcatttggcgggagttcaaagttttgttccacatgtcaaaaagaatgaacactagcaatcagctccaaggcttgacactgctatacgtgctgaatggttttctttcagtaaaaaacaatcttatttgtgttagagagaataaacagatgatttcaataacctttcaaataattcaggaaatcatctccgatatagaaggaaaatatacaaacttcagtactgaacctcgtatatgtatactgataacaaaagctcagatggaattcgtatttaacaaaccctttgattatctacattagggggttgtcaaatgattggagcagagtttgtgtggagatggtgtctgtaaggatgattatttatgtagatcaaacatttacatgtctaatattcaaacaaccaaaaattgcatatgggatttttttttattttgccttgtatgtttttttcatttgtccataccaactgttttagtcaatagagcttgtcagagtaagtatctgacttatggatttagtgtcaactcagtggagaactgaggatatatgatacttatggtaaattgattagtaaggaattttttccttattgttgaaattagttttgctgtaggaatattctaaatggcatacagtggaaccatagaggactcggtggcttaacttgatcttcctgcgattttgaagtagccatagagcttgcgatgaacatgcaaatacttaactggcatcactttaacgacgataagttcaagtaatatgaattgatgttcttggctttataatttgttgctgaccaactgtttctttgcattatcttttctctgaatatatttattctgtacttctataactgcttctgatattgtctgcagcaagctgaaattgctttatcagagttgatccaatcctctccggaggaggctctacatgactacatccttggagtaaatctctggtcaagatcactttacttgaccataagaaaagaatgtcaaacttttcgttccagcttgctttattgaagttatgcaggtccttgcacctgatccaccttttagtgatgaaatatttaaggtatctaacctgatccacctttgacacggatgattgggtattactgatttcttcgactgtttccattactgacatactgatacctgatgaccatttttgaacaggatttctgaaatattaataatgtttgaactttagcaattatatttagtggcagaaaatttgaacaaggaccacactctcattacactttttaactcctttttctcaggagagatgtttaggctctttatcagcacatttgcacaccttgctgaaacaaacagtccatatcttccaagaagatcttgctattggaaaatgtgctgcactcaggtattctgtaattacgtactctctgcttgcttagagtgaccagatatccggttggaggcagttcccctgatttgggggcttgtatctcatctttattttggtcaagaaaaccaactagttttaatggaattttttaagagattatctgacatatctgcagagtaagagtttttgcacgtgatgcagcaaaagcctgttacatggccgtgacatcaggaaatgaaaaaaaagatattcttagtaaggctgcttctttttatctgttcttttgttcagagttctatattggcatcttcatgctgaagttttgatttatttggcagcatcacttgaagagaggttattggattttgatgtcaaagttagaatgcaagctggttttgcatcctgcaatttagggccaaatcaaatctaagatcagttccttctgagctgatattgcaggcagcagagaagccacaaactgttgttatttctcgctactgcaggttctatacagtgcctcacttaaacttttgttttatgtatctctgactgtcagaaagaatctaatgcttatattgctggacctataccgagattactgtaagaaatgctcaaaaggaactgccacgttaacactcactatgaacaaatccctgctaaacttataggtctttgtttcgataaggattgaatcttaaggtttcttctttctaattttgtacattgattatgccatcaattcaactcatgatttctgacctcttctttatggcagggtacaaaacctaagccgttgcggtcaactaactcccgcatcggggaagaagatggcgagggagtgaatgggggagaagaagggcctacccgggaagctccgccaaccaccgactacccgatctgccaccaacggccaccgccggtcctgctactcggccacaccgagcattgccgtgtcgatccccacctctgccgcctcgatccgccattgccacgttgatccccacctccgcccgccttcttagcggtgtcgccgaagagagagagaggggagaggtggcgtcgccggagaaagggaaggtggcgtcaccggagaaagggaaggggaggcggaggaagacggggaggagggacggggtgagcctttatatatgtttgtgatttttggggggcgtactacaaatattggacttatatatgaatagaaaatctgaggatttaaatggaaaatgtaatcgactgacaggtgctgaaatgcaaaaataagatagagctgtggcttatgtaacaagtgtgatttcatcccacttggcatctcctttttcatgagggtatagcttccatcggccatggtcttagtttactttgttcctcaacctttttgacaaaaatagaagaaatattgtcaaacgtgtggtttctttttacagacttaataggaacaggttccaagttccgagcttggatactctagtaacattatattgccgattctctagtaacaatgtattacacctgtgttgatgtcaagtgtcttttctttctcccttttctaggaatgccattcaaatgacaatgagctctaaacaattttagaaaaaaaaatcacaaacaagcaaaaatagtgatctcactcactgtgaagaagcagatctggactggggtgaagtgcagtttgctccatgaagcaaacagactgtgggtgatatgatcatgttccctaggctgcggtagctcgatcgaccagctagcatatgaatgaatcctaagcaagcagatagcagagagacaggtagtctggattgggtgtgtggaatgagaatatatgtatatcaggggaaagagaaggatcctcctagctgtgagttggcttgtgcagaaggaggcttgattgcaatccagagcaaggagatggtgatggcgacgaggccagaccagacgtagacgatggtgggtgtccttcccctcctgcccatgaggcccttggcgaaggggtagagatgcgcgaggacccagaagctgaagaagactccaccgagaagcttgctccactgcgggatggtgctgtagatggtgcggctgaagccgacggcgatggcgacgaggttgatcattatgatggtgagcggcggtatcatgagggacgtccacttgaccgcgtagagctcggcgaactcgtcgtcgacgtcgtcgccgagctgcttggaggtgagggtgaaggagatctcgatgccggcgatgaccttgagaaggccctgcaggacggcggcgaggtgggcgctggttccgccgatgagccagaactgctcgttccgccaccactcctccagcgcgatgccggaccacttgatctccagcatggccaggaggcagagcgtgatggtgatgatgagcaggtaggtgaggaaggtgacgttgagcgtctgcacgatgaactgccccgagaagagggagagcgccgggaggaagcagtagacgatgaggaagacggaggtgaaggggtagatgccaacgttgaggtaagcgatgcgctggagaacctgcaaatgcaatggataattgtttgtttggcggcagcggaagaagaagaagaagaaaaataatcgatcgaatagcaagctaggtaccttcatctttgaggaagcgaagagtgcgttgttgcgtgagaagaagatctcgacggagccagtggcccatcggaggacctggtggaggcggtcggtgaggttgatgggggcggtgccgcggaaggcgtcgcggtgggtgacgcagtagacggacttccacccccggttgtgcatgcggtagccggtgaccacgtcctccgtcaccgacccgtatatccaacccaccctcgtcccccactccgtcttctcctcgtaccagcacgacaccacgctgatcgcctccgccacgatcgacgcgtccagcgtctcccgcgggatcgtcagcgcccccggcggccgcccgttcttcaccgacgggtggtccgccagcggccgtccctggaactccgccaccgggatggagtcgatcaggaagctcgagttgccgaacttcttggggaagctcgccatgttcatcgcgccgtccatgtccatgcggagggccatcgtctcctcctcctcctcctggggctggggctgggatcttgttcggcggcgacgtggcaggcagcaggaccacggggtggtgtggtccttggacctgggcgggtcgaagccgtagagcgcgatgcggcggaagaggcagccagttccgacatagacggggccctggaggccatcgagggcgcgcatgttgacgtcgaagaagacggtgttgtggttggcgtagcggtcggaggggtcgatgccctcgaagcgctgcgggaactggacgtagcagaggcggtcgccgccgcggtccatcatgaagcacatcccctcccggaacgccttggagttgtacacgtagtggtcgcagtccaggttgaggatgaacggcccgttggacatgatcgccgacgcccgcaccagcgcgttcatggcgcccgccttcttgttgtggtcgtaccccggccgcttctcccgcgacacgtacaccagcatcggcagccgggtgtccacgcccgacaaatccaccctcttttccatgtcgccgccgctgctgctgggactgggactgggaggctttagcatcacctgtatgatccccgcgtggtcgcccctcgcgtgctccggcgacgcctgcagccacgtccccggccagtgcgtgccgtccgccatccacgtcgccttggggatctttatcggctccagctgctgctcgtcgccgccggccttcatcttctcccgctgcaggttcatggcctggatctcctcgcgggcgtggtacgcgtcggagcggcggcggatggcgtcggggaggccattgacgcggaccttgaactcgtcgtactcccgcttcacccgccgcctgtccttgacgaagtcgcccttcaccttgttcttgaacgggtccctcttgaggttgaagtagctgtcggggttcctcggctcgatctcgtgcttccggcagaatggcacccacaggttggcgaagctcgccgcctccgccatggcctcgaacgtcagcagcgccccgccgtcgtcggacacgtagcacgccaacttgtcgacggggtagtcggcggccaggatggagaggatggtgttggccgtcaccagcacgggctccttctccgggtcggcggtggagacgaagatgtcgatcccggggaggtcggacttgccggtggggttgctcggcgtgggcgtctcgaacttgtccttgagcacgctcaggtcggtggcgcggttgatggggcacagcttgggcagctggtccagcacccacgacaaggcgaaccacagctcgcacacgatggacatcccccacagccagatggcgtcctcgttctggtgcttgatgcgccacatcaggaacaaccccagcgccaccagccggatcaggaccagcagcctgtacgggctgatcaccgccgcctggatccggagcttgcgggtcagcggccgccatggcttgctcatcagctccttggggtgccccgccacgccgtcgtcctcgggccagattgcgttgccgtagccgtaggtgcccttggtctcgaagagccagcggttgtggtcgaactcgccgggcgcccccccgttctgcttcaccagcgacagccgcctctccatcttggggccatgcccgtgcccgtgcggcagcgacagcgccctgttgatggcgtcgtggttggacgccgacaccacctcctcccactccgcgtgcttgtacggctccttgcaccccgggcacacgccgccgccgcccttgacggcgtcggtgaagcagtccacgcagatcttgaagtcgcactcgcaggggaggatgtcggcgccgcgcccgttgcgcatgatcttggacccgcacccctgcaccatgcacgccgacaccgtcgccctcgccgacgacgcctgcttctccatcacgtgcgcgcgtgtcacgctgttgaacccgccggtgaagagcgagctggacacgtactgctgctcgtcgccggcggcagggtccatgggctggttgtccggcgtcatggggatgtggacgtggtagtcctggaagtccacgctgctgatctccgagtcaaggtcgtcgcgggagtagctgatgaatcgccccgagtccgtccgccgaccgaacaccaccgtgggcgccgccgacgatggcgccgtcggcggcttaccgccgttcttgaggatgcccttcgacgccatgatcgaacacctagctcccctgctctgctatgtttctctcttctcttgtgttggtatggtattggtaacaacaacaagaagagagtatagctagctagcttgtctcgccgccgatcaacgtgatgcagctagctagctagaaaatatgaataggaatgaattgaatcaagcatcagcaattcaggcatcaagcatattttgggtggctttgacccgaccccagtaatggcgatccaaaatcatcagtcctaataataggaaaaatgtgactctgcttcttaaatggaaatggaaacaaattagatgcaggcgggttgaaaacttgcagtaatttactggccgaattggtacattcctattttgcatgcaacattataatagccccctgagaatcgatcgaggattactaacattacatacagtatcaagctagtttaatttgtagtggcaattgatcgaccaaaacatgaacaaatcaggtgaagaagaagaagaatcaatcgatacctgttggtcctcttcaggtggggcaatgcattgcaggtggacgagtttaatttgggtagtctgagagagagaaacagcagataggtccaagaaagaaagaattcagtggaagccgcagtgcaagagaagaggagagatgtcgaaagaaatcagagggcgtagtgttatttgaaggtccaaaggcagcaagcgtgtgttggtgctcccttcatggcctccctcctgctcgatcgtttgcttccttaattcttcttagttgttccatcatcggttgagtttagttggtggcgcgcacgatgggattatcggtctcgctcgtgtcgattgccactgcaagcaaagccatgcagatttcttggaaattgctgctgttttccccccatcgtgaatggattcgtggtcagtcagacttcatactcacacacaacaacacaaggaatccaaatcaagatcgtcgtgctcgcgactacctccctcccggtcggtcttgaaatgtctgtctgtcaaaaaccaaaataatgccacgcgacgcaatccaacctccctattgtatactactgtatttgtatgacaacatgcgcagatacatgcatacaagcatttgatgccaaattatcttctgaccaatcaatcaataaactagtgtcccttcaagggggcgggagatgacttttttgtgaaagttcgaggtcaggcatgacatgtgtctccctctctctactctttcaaaccatttccaaataaatttcttatccttcttcgctgctataaataagtttagttagtccaaaacaaacagtaaatccagccgctcgaccctgtcaacttgattactacttcagtggtggtgttattggttttcgactttcttcagacgaccttccagaggtcaactccatccaaaatccaacccatggatggatattaacaagctgatgggttcactgattgtgctcatcatgccatagcattactagactgactccgcatgttccctcttaacttgcatgcacgatcaatcttgctttcagctagctaatttatccaggttttttataaagacaaaggacctaccttattctggatatatatctgatacaacagttcagacaaaaggttataacctgacaaatcaatagttgtatataaaccagattactcagttattcctgataccaatcttatatgtattcgcaaaaatcagcacctagtcatgccaatataaaagcctcaggatcaagaggacttttacggtacattctactgctagtatatactagcagtatatacaagggtaattttggtattaggtaagagtctgaaaagggctttttggtcatttaaattagagaattaatttcagccggattaattttccttcgttagtttttcctggggatgtcgtcatctgtttcttctcgtcacatctcgcgtctccggcgtcgctgcccctggtgcacatcgctcccgcgccgatgcctctcgcgtctccggcgtcgctgcccctggcgcacatcgctcccgcgccgatgcctccgtaccgattcctccggcgccgagagaagccgaacctccacgcgcccggtgtctccctcgccccggcgccttgcctccagccctagcctattctctcccgcatccgacctcccacagcttgtgctttgcccaaaccacggcggtgagagtgcactcgtcgagccggcagcctccccacgcctcccatctccgtcctggttgccctgcctgccctgcagccactggagtgctcctggtaagaagctgacctaaatttggtactattgtattgattaatttatgcaatggttgttttgttctgcaatttttgttgtgcttaaccttaatgtcgatatgaaaatttactatctcattatgaaaaagaggtgagattttatcttgttgattgactttgttttggacgatctgccttagaacactaggttgtatttgatgagacaagtaggatgaaaatctgcattctgcaactagaatcgcattaatcctaggtatatagctagatgagtgtgctatgtaaaattaatgtagcagaggtgcaaattttgcaacttaaatttggtttaaattaaggtattatccatatatgtaataaagctggttccatcgaacgtttatatcacaggttatcataaatcatttgttttaatatttgccaacagtctatcaagcctttattactttgtaatttgcaggatgtttttcgcaaagttgtatcacttttatcattattcttacatgcaattttcgaattgtgttgtgatctgtgtgtgaaaaatctcatctttgtagatacttgatttatgtgaagacttgcaaatttgtaaagatttttgttagtgatgtatgaaacgcaagatgttaacctatattttaattatgctgatatggttcttctctttgtgtatttttactgtgtattaacagtgttgcacaatggacgaggacgaagttagcttggaggagatggaggagtataacatggttgctagtaagctttttagaagcgaggaagatggttacaagttttacaatgaatatgcaaggtgtaaaggttttagcattagaagggacaaagtgaagcgatttagtggtaccgagctagtgttctggaggcgattttattgctcatgtgaaggttacaggacgttgaagaactttgagagaaccaataggaaaagggagccacgtgcgttgacccgctgtgggtgtaaggcaatgcttgaaattgagctcaatggagagacaggaatgtggtttgtatcaggttttgaagctagacattcacatagacttgctaaccttgacctggtagctttcttaagatctcatcgtgaggtaaatgatgctcaaaaagctgaggccgtggagcttggagttggcgggcttcgaacatgtcaaataatggaagtaatggagaataataatggtgggtatgataaggttgggttcgtaacgcgagacttgtacaatttttttgcccggtacaagaagaagagaattgaaggtagggacgctgatctcgtggtgaaccatctgatggctcagcaagaacaagacccagattttttctttagatacagtatagatgaaaagggtcgtctgaggaatttattttgggccgacagtcaatcccagcttgactatgaagcattcagtgacgtggtaatatttgatagtacataccgtgtgaaccggtacaatcttccatttgttccttttgttggagctaaccatcatcgaagtacagttatttttgggtgtggtatattgtcaaatgagtctgtttcttcatatgtttggctgctgcaaactcttttggaggcaatgcaccaaaaacatccgaaatcattgatcactgatggggatgcatcaatggcgaaggcaattaggaaggttatgcccaatactgatcatagattgtgtagttggcacattgaggagaacatgaaacgtcacctccgtcggcaaaagcttgcagattttaagaaattcctttatgatgctatggatgttgatgactttgagagatgttgggttgagtataaagcgaagtatggattcaatgaaaataacttatggataagcatgatgtacgagcactattttggaccagctaacgtgaatgagttattatgtactagattgttgacgacatcacacttgctatagaatgctccaaatcctcacaaatccaaaaagataaggtaatcattttattcatctctacgtactttgaattatacatcacaacacatggtttaatatccattaaatatgatatttcatcatagaatgtccaagacattacaagagacagcgaggagagcaaacaatcagaatcatgcatccctactgataaggtaatcaaataattcatctgtacttacattcaattatacatcactacgcaaggtttaatatccattacatatgatatttcatcgtaggatgtccaagacataacgagtgacagcaagaagagcaaacaatcagagtcatgcatccatactgataaggtaatcgtttcatttaattgtacttgcattaattatacatcacaacgcatggtttaatatccattaaaaatgtcatttcatcatagaatgtccaagacataccaagtgacagcgacataaaaacatcagaaaaacgcgtcgacagcacaacacatgccacttcacacaaggtagtcaaaaaattatacttttgttactatttatttgaattacaacagcatatgtctcaaaacttaacaaacacatattatgcaggataggccagaaactgagtcactgacccgaaaactaatcatgctgatagaagagcaaggaaaggagatgaaggagatgaagcagaatcaacagtccatgcataaccaaattcaatcactcaccaacataatagctgcattcaaagaggaaaagacaataccaacttccaagaactctaagccaaatgtttgcaaaagtttcgacaaagaaacacatataattaaaaaaaaggtaagacaacatcttacttcttcagtgtctgtcaaatttaatactaattatttttaaaatgccaattgaatagcagaaaccaaacccaccaactcaaacgcccgtcattgccaagtcactttcaggatcaacatgaagattgcgtaaatcaacaattaaatcaaattctgatttcatctacaatttaggggctacaaagaagaaaccaaagaatgcgcaagcaaagaatttaatatccaatggtaaaagtcctataattatcatcacatcctactctgcttaatttttgtgttgcagttcacttacagatttaacttcaatggcagagttcaagtgcaccgcagaagatgaggaaaccattaaaagtataatgagtgcaccagaatcacaactagtggtgcatatcgatgatgtctcaatttcccaaaaaacaatgcaaattctgactaatccagtgactgaatcaagtacgagctatttggatgatcacgtaagtttactaacccgtgaaactattctctcatgcaactactagcacaatcataacctgccattttcctctacttttaaataatcgatgcatacgttacttgtctacgtgagaaagatatgaaggaaggtacagggactagggcagaaggtacggtgttcctagagaaaccgttaataacaaggttgctacaaagagatggcgaacactatgtttccaaagacatcatcgatcgggcaatggctaaagcaacggcaaatagatatctaaagcatgatatggtaatatttatgccacaatactatcaaattttcagcaagtttatactactaatatatcctacaaatgatttctttgtacagattttcctccccatgaacataaaagaaaaacatcggtacctggcagtcatacacgccaaacgccgcatcatccaagtgcttgactccatggcgaattcatccacacaacgcaaggaactaagaaaagttgtaagtattctacttagaaataaaccaaaaaggacatgaacataccgcagtaatgacgttttctcacaaaacagctagaaggattacaacaatattttcagctgttggaaccagaagaaaagcacatagcaacacaatggcctgaccatcatattacttcctgggaagtcacggtcatacagaatttgccattacaaggagatctgtatgttatgcagccactacaataatagtttttttcactacctaaatgtatgttatcacttctctaatataattcaattcttccagcgtctcatgtgggctctttgtactaaaaaacatggagcactggcaaggcaataggttgtcgaaggaatacacgcatgtaagatgcactaaatatttttgcatcttctttacaagtcctcaattgattgtttctatctaacaaatacctttatgaattttgcaggaagatataaaatattttagaaggaagttagctgcaattttggggggtgctcagaagaaggataaaaagataaactaatggatgttacaccttccaagatactagtcgaaatcaatgactttgttctaattcctttaatataaggagttagtattttcaatagtctgtccagagcaattgagcgtgtaccattttgtgcaacatactctagtatcagcggtgttattttagactaatcaaaactccacaaacaattacacaactgcaagttcaataataaatttaaacctttctatttggaatgttctgaaattctcaaaaaaaatgtacctctgttgtgctgcagctatgacattgctttcttccatcggcagcttcggtatagggcctgttcacgctgtgacatagctagagccagagccatagcatgcaacaagagggtctgcctcgcgacagccatggcctgctgctgctgcggcatgctgccctgccgctgccacctaccgccggccggctgcccctgccgatgcggcagtcaaggtccccagcaggcctcgccctcccgtagacccagcagccggcgacctcccgtagacccagcagccggcgccgatttggggatttttttggaagagatagggttttcggtggccggaaaatacacgagaggaggaaaggagagaaatcgaatcgatttcgatggcggcggcgccgattttggctcccggtggcggcagcgactgtggctgtcgacggcgagggcggcgccgacagaagacagcggtggcggtcgcccatgcgagccgagcggattcggtttgagtcgatgcggtgaaatgtgaaacggatctgactaagtgagctcgtgttaatttacaaaaataccccccatgaaaaaagataaaaagacaaatataccctattcaatttatactgcagtataattaggagggaaatcagataaatttacaccgtcaaatcaaatatactggtagtatatactagcagtagaatgtaccataaaaaaactcagcatcaaacccttcaccgagcgtacagcaagtaatgaaacctctgacactgatagtagtcatgagccaaaatctgactggcttgacacagtaagggggactgctacatctatctattcctgtacagcaagaaactagtcatgcccaagacattaaaccaaacaaaatccctgggatacattcaagcaagatgggcatatcacacaaatccatatcaagtgtctccctgcggccctgctgtatctggatctggtggtcagaaactgatgaaatcgtccttttgttccttcctgtcctgctgagatgaggtgccgcccttcttgccaaatatcatgtcgtcaagatcctgaagcaactcatcagcaccagaacctgctcgcttccctacagtgccatctttagtgcggggggagttctctggctccacggtgactggaatcatggctggctctgcctcaggctctgcaacaacaggttccttgagttctttatacttggagagaaccttctcaagttcatcgtggacactcaatgcctcaaagagctgagcctcgttgtcaccagccgtctcaatgattctctggatggtgcgctgacactgttggcattgctgaaccagggtggtagtcaggtcatcctgcatgcatttgaggtgcaaccagaagtttagaacactaacacgataacagaacactagcaattttatttattggatggaaggcctataaaattaacatatggtagagtaatgttatccagtaactgtaagttaacttcagatattgctacaaaccaaaacttagatgtatatatataatttaccaaactcagatgaccatttatcaaggggaaaaaagagagagagcaggctcaccttgagagcctctttttgtggagaagaagaaagcaccgtggaaagaagttcaacgctattacgagccacctcaaaagcttcattgacttgcacagcaggaacaacgtggactggcgcaaaactttcatctggaatttcttgatacccttcctgtgctgcagcagaatatggttcagctgaaggtgctgaacggggaggagtaaatattggtgccagactctcatcatcacgcccaggaaagcgaattccccttgatcttaagctctgcgaagaatattgaatgtaaactgaataagcctggctaacagaaacccacagtaatagtgtccagatgtaacgattacttcagcctttcagacacaactatgtatgtggtcaacgaatgaagtccgatcgacatacatcagatttctttatcgaatatataaaagcagcaagtttatatgaataatccaccaaatgcgtaaggagaataatagttgcatttgttcttggtagatcgttcataagcattattgtttcaggttaaagtgcactaaattgatgtaagcagaaatcattacttgttatgtaccttgtaagtctcttcatacaccggaaggtagcggagctcatctcctgactctccccatgcttcaataagcataagtgccttgtttctgttgttgactacagtctgtggatcatcgatcagttttaccatctcatcaaggacccgctcagcagcaatctcagagaaagccttctcgcagtttttcacaacggtctcaaggaggacaagagcaagatattgcactcgtggattcttcaacatgatgcgtctcttgatggcacggatcagctcaatgctgttgacatttccagtgttaaccatatcacatatctcaagattggtggcccaatcaggagcatccatggtctccagcgtggcctcatcgactatcttgtccgccatgttctggccttggaagaattctttcatcttgaaactcatgttactgacaccagctgacatcttccggctaacttctgccccacttaccttgagccgctcacccaaggcattgaccttatccatcagattgtcacccatgttgatgtcaatggagggagggctttatctgcagcagcatagagaggccgcatcaagatgaggtaatgaagaagaaaatatttgtctcgtgtgctactagagctatgacaaggctagccaacacaagagaaacatgcaagtagatgaacaaagtgaagaatatgaattccgatctattaacccccaaaaaaaggaatatagtgtgtaattcatagatgagccttgaaataatagacatgatctttgtgtaatactacagcacacatacaactagaaagagtgtactgtgtctgtgtggtctgcccaaatacagagatacaagatgtgggcagcggagcgattttctttgagagaatacagtagatgatacaggtgcacccaagaaattactcctactcgtcaagacatggcatgaactcaagtatcgtagagatggttaaacaaagaaaaggagaagtggaaatttggggatagggttttaggcttagcatcatatgggggcatggattaagcggtaattagtaacctggatcgaacattcgaacccgggggcaacagtaattaattaatctcgaacgagtctatctatgtctctcctcgtaggaggagatggagatggagatggagatgaggcgcgatggatgagatgatcggcaaagaaagagcgcgactaacctggcgtccgccgcgcttcttcgccggcgcaagcgcaacccgcgagcgctgttccactttcccttcgctttggtcccaactccaacgcaagaggacgacgactagtagtcgatggattccttcttctgtatttcccccttgcctagtcttctttgctttcctcgcatctatctaaaagttactggtataagtaggagtattatcgattttggattttatggaaaccctcacgttctctaatacttcagttattattatcaactagaaaaaatacccgtgcattacaacacgggtgaaatatattttaatcttactattattatatggtttagttaagataaaatttattgtgagagtttgcttagatatatatatttttataaaatcatgagctgcagttaggaatccgatcgtctcaggttagcatgcgagttttttaaacatatttcttatatgatttcttatgtattactaaaagtgaacgatcttaataaccgactcaagtacggatatgtatttccaaaaacaaacgaacttaaaaacctactgtgatacacggatgacataccaaaatactagcaaaaacatcttcaatttttataatagtagagataagataaaattccaatagtaatcatacggagggcaatgccacatcttattagggttttcctttcttaaaacctcaccaatatgcatagggatttttgccttgttttttaatcaaattccatcaaagacaccaaaagagtttttccttggatagatcattatcgtaatcatcaaataatctgaattccacatttcgcaaatattttatttatgtctaatgtgacagattaacttccccgcaaaaaaaaatgttacagattaactgtaagattaataaatatgactgaggtttggggttttcattctaaatttagccctaacactaacagttttcttaatataataaatataaatctacaataacaatgtagtagtaacacatttcgagagtcctaatagctgtcgtgtgcatatgtgagtattttacatactaaaaggattttatttttcacatctcgcacatacacaaaatagcgaacgagtatagtacgattattacaacatctgagttgattacatggttattacatactcctgtactccgtatataacaccacccttagccttagaaaatcccatttttcagaactcagagttcagctaaaaaactctttgaattcagagcttgcggtcgcagggacggacgggttcaaagccaatgactcgcttgtttgacagtaatggcctttggcctggattctcaacttcacacgctttctattgctcaatctatttttcagcacccagcttacaagtcccattcatttattactccttttgttatttctcctgtcaccctcgcatatcaacattttcactgttctacacagcccatctttgtcataatatattgatcatcactaaggtgccaacagtgttaacaaccaatttcgcaatagtagttttagatcactgaactagtaatttatccccagaaacaacataaatgaataacttaaagacagcagctctattttatcaacatccaagcaccatattggcgtcaggaagttcagaaacgagtaacatcatcagaatatcagtcagacatgttgcgcccgagtataacttcgaggcaacaaactaagagactatcataacactttgaccattgtatctccaaacctggagatcaaaatcgaatatatatacatggaacaaaaggaaaacaggaaaaaaattaaccgcaaaaaacaaaatcccacatgttgggcttcttctgttaacaagcatgcaccccatagacaacatgccagattgagtgcccaggccgcgttgctgtgcagttctgacccaaagaatactcatatgacgcaataatatttgtgtgcaaacaatgaacgaacgcatcatgtgtggctgggattcagctgggtaaaatcatcatactaggcctgtcaacaatcacagggattttatcagttattgctacatataactcaagtgtgtaccaaatgataccgtgaagagccacctgaccagggccttcaataactcacaagatttgcatgacagtaacagcctccccttcatgattagtatgggttaggataccgaagtttaaaaggttctgccaggaaaaattgcaatgtcggcagcagttcatctgctgtgtcgaaaagaaatgaaggtaacttcattgagaaatccagacctgaaaaataaaaggagtagcacatttgttatgtcattcatcagatagttcctgttgttgagcaaatcacctttggaacagtacatcacaggaggcagtaaatgaggaaaaaaaacatgaaaaaaggtaatttcttgcggctataatgcttgcttcataataataattaataaactacaaaaccagatgtatcgtacagaaacaaggaatcaccatgtgcaaagattttttaagtcaaagtgtattgtgcattatgtggcgcaaccacatgcaatgatgcaaggtatgctctagcatggtaccagctatatctatgttcagctgattttattttaaatgtaagttgtactccatccgaaactcatccaccatgtaacaaaaccaatgaactatacacatgcatgtaaccaataaatactaagattgcttcttaggttccagtcaacaatttaatttaacacagagattacaaataggtcttagacttttggaaaaaccaaaaaatgaaataggtcttagacttttggatggagagagtatatagcaagcttctatagaaattattatgatgtctgctgtatatgctgatcaactagaacctggctccatgaaatcaaaacacggtaaggaagtagaagagttaaggctttaatgaactcaaaacccagtaaacggaacatagtaggtgccaccatgcgtcagtgcaacaaagaaaaaatagaagggaaagaagctcaggtcagtacagaacaaaactgagaaagcggagtttcatcgccatggttgtgagagtgagatggcactgtccgatgaatctgctcctcgacctctaaagatagcagatttgagcgcattatactgatcaacgactgagttgtacaatgactctgagaatttctctctgcactgtaaaaacaagaagaaccaaagacattcaacttcacaaataaaaaaaggaaggcttaaacagatgaggcaatatcaataagtaacactatcagtgagcaagtctgaaagttcaaagttctgtaaactgtttacaaaataagaaaggttcttagcctaaaccctggagacaaggggcctacaagagtaacagcaatgagaattttcaaatccaactaccaatctcaagctagcatgggtgaatatcatatgcaaaagtggaatataaactgagctgcacaatgatgaa

SEQ ID NO: 58879 - DNA, 20311 bp, Oryza sativa
agttagagttcgtttagtgctcatatatgcgtggtggacgaaaccgagatctcgagtcagtctcagtcgtcgtggtcataatcaatcatgcgtattcaggagaaaataaaaaagaaaaaaaaggaccagctgatggactgccgctaccctctctttagtcccggttgataacaccaaccgggactaaagatctttagtcctggattggtagtcccggttttatctcggtttgaaaaccaggactacagagggttatgaaccgggactaaaaagcacttctccaccagttataagtgccgtgctacttacgtgtcagggtctcagggacgactaatatggcgacgtcgatggagctggcgcccggcgacgcgcggttcgcgaagctggcaaaagagctcgacgacaaggcgccgcccaaggccgcggccgcgccaccggcagcatcagaagaccaagcagcagcgagctccgggaagcccaagtacaagcacgacttctacaacggcgcgagcgaggtggtggtgacggtgttcgccaagagcgtggcggcggagcacgtgtccgtggacttcggcgagcagatgctgagcgtctccgtcgaggtccccggcgaggcgccgtaccacctccagccacggctgtcgggcgcaaggtcgtcccggccaagtgccgctacagcatcctcccatcgaagatcgaggtgcgtctcgccaaggcggatgagcaagtgacatggacgtcgctggagtacacgagcaaggccaacaacaagctcgcggcgacggcgacgacaacgacgaggaagaaggtagactgggacaagctggaagccgaggtgaagaaggaggaggaggaggaggaggtggacacggcgacgccggtggtgaacaggttcttccagcagatgtacggcaacggcgacgaggacatgcggcgagccatcatgaagtcctacgtggagtcctacgtgctgtccacggactggaaggacgtcggctctaagaagattgaggccagcgcgccggaaggcatggagctgccaagtgggagtattgatagtgttattattatatatatagtcgggctaattaggaatggatattgtccgtgagttgcaatgagattttattttaaaaatatttttaatccagtattagcattattttctatatacatcatatatactgtttcttacttatatgtggatgttctaaactctgcggggtaatttttaccttttcatataaagtagggagttgatagtgggggtggttgacatatagaccctctgaccctacatgtcttttcttttctaaaaagtagggagttagtggtgtcttttcttttctaaaaagtagggagttagtggtggaaatggtgacagattcacttttcttttctaaaaagtagggagttggtggtagaagtggtgacagattcacctatcactaattcaccaccatcattactctcttttataggtattataggtatataattcttgttatttgtaaccttatataatttttgttatttgtaaccttttctgtcagtatccttaaaaatgtggtactgtcttattaaggtatcattatacacatagtagtacatgttctttgttgggcgtgttactaatgtgctacaagtttaataaactcagttggaacttttattatgtgtaagttagcgattacggtggcagagtcgtgccagctactcgtggtagatggcaaagctcctgcctgcatgcctgaatggaccagaccaaatcatttaacatattgttaagtataattcaaggcgataatacatattgataagtgaaaatattgagtttgttctggtccattgcaaaacttaggttaaaaagtgaccctaagtgaaatttattttaaaattattgagcggataaattggatattttagaaaatatacttagctgatagcttaaaataagtgttctaagtaatgtaatgtagtgggaaaaaagggaaactatttatgatccctcgatgagatatctcctcgtttacttaaaatccatccaacagttatgaaaaattcttaaaagaaaaattgacaacactcatacaacatatacaactccacaagatcttaggtccaaactcaactcacatattgagatataaaaaagacaaattcagcatatgaatagcaacgtactgtttacatatgaatctatctttttgtttttcaatgtgtagggcgagtttgaacttaatttttggtggaccagtagataatacgatactcttcaatgtcatttttagaatttttcacaaccatttgtatcgaatatggaaggaaaaggtacatgaggggacatccccacaggagattagaatccactcctgggaaaatggatttttgagacaacattttctttaaaaaaaacataaagcacatagtttcgataattcgatgaataatctaaaaataacaagggctaaaaaattgctctcccccctccccaagataatatttttttttcgaggggacaaacagggagctcctgcaatttcactatagaagaagagagttgattcagtttgtaaggaaaaccggacctaaaaatcttacaacggcacggtttattaaaggaaaaccggcaaaaacctcgacattgacaaactgaacctaagtacaaccgtccaacaagaggaaagctcctaaaacgaagccttcaagaaggttacgccgacagaacagcgacatcatccgatcctaatgaatctaggttttcacccggagaaatctcttgaagtggagttgaatgagggctccagtagcaacgccttcaagaaggtgaacggcgcccaagggcgtcgccgttgctagcaccgagagcggagcaaggctttcgccttggagcacccatcaaccatagcatctacgacgggagccaccaaatgttacctgcacaccgagggtacctgcaatattcccatccccacccgaggacgcgccggatctgggcaagagagccagatccggccgttctcctcaccaccaatgccagccgacgccaaaggagtgccggagaacgccagtggcagccgcgggatgcctgcgtgcgctgcccaccgccggccgccacgccgccgccggatctgtggcctccaccaccgccgctccatcgccatcgccattcccgccggccatcacccacaactccacccagcgcaactcacctcgaccgcctccatcacccgtccccaccgccaccgtccttgcggccgcgcggctttgccggcggtgtggagattgtgggtacccaatacccacacggcatggttatccgactagttataggggataacttatatctatagaatatgtaacagatcatgacttgggtattatgtttccttgtatattacggaacggcctaaagtcctggtttgataatattgtaaagtagatttaggaaaccgataccgtattggttaaggtttctatcttgtaattctgccccccaccctatataaggtgggcatgaggccctctagggggcatgagcacatatgatcgtcagatctatactacacccggcagattcaaatccccaaacaggagtagggtattacctctcatcgagagggcctgaacctgtctaaatcctttgtctccgcatccatccacttttaggtctcgtgtgctaccccgttttattattgccaaattcatgtttcgacatttggcgcattaggtaggggtgcgtcgagtttcccgtcgaaaagtgtgatggaatcaacttgatgagtagctcgcttcgtcttcgctttgggagctttttgcttcctcgctgccgacgactacaacaaactctcgctctttgacttggattcaaaccagtcgggagagattcaatctagctaaggaggagatgcaacttccgtatcatcttcatcaacagcatcacgcctcgccaccgatcgatctccctccgatcataggaggccacatccacatctcccgccagcatcatccacaatgacagcaggccaagctgcagacggtggtcggccttgtcgccatcctctacggcacggacgcctgaccttgccgatctccccgatgcccatgcgcacgtgacccgcgcatgacgcccaagcgcgagcgtcgcctctgtgccatgcatggcttatggctgggagatccaatccttacactatagaccatggcaacatggccgaccaatgaggtgaagacacatcatcgccaggctataggaccatacaacaccttgcaacaggatcttggctaggagtgctttgcacgccttaattttttcatctacacatatacatatgctttaatctatgattgcttataagattgatttctccttttttgcatgtacactcggggaacggcgccgcacgcccgggggcttcatcctttgcgtggctgacgcggcccgactacccccgtggcacatgcgtccaaggcatcacgtcgcatgcccgggggcttcaccaaccggcttgctttcaccgccaccgactggtgttttcgcctatatggttggcggacttcgccgccgctgttgggcgtctacgacttcaccgccggtctgcctccgtcgccgccgactggtgtcctcgcctatatggttggttggtcacaccaccgttcatgggcgccatatcttcaccgaccagctggcctttagcgccgccaactggtgttttcgcttgcacggctggcctattatgccgacactgttgggcgtctacgacttcaccgccagcctgcctctgtcgccgccgactggtgtcctcgcctatacggttggttggtcacaccaccgttcatgggcgtccacatcttcaccgaccgactggccttcaccgccgccaactggtgttttcgcttgcacggctggtctattatgccgctgctgttgggcgtctacgatttcaccgcggcctgcctccgtcgccgccgactggtgtcctcgcctatacggttggttggtcacaccaccgttcatgggcgtccacatcttcaccgaccggctggccttcaccgccgccaactggtgttttcgcttgcacggctggcctattatgccgccgctgttgggcgtctacgacttcaccgccgaccgcgtagactgcctccaagacggtcgttggttgccatattcaatcatgcaaaaggtaactgtctgttgtaaacatcttaaggttttgctagttatctagctcgcgtctgctcgtataacatatatgatatgatattttccttttcctctgcctcactccatcaactggttctccgttgagttgttagtcgggggctatagacgttatgtcatattttttcaacaattttcataatatttatcttgatttgctcgcgacataatctgagtacaaaagtgcctatcgagttatggagttccatcttcctatgctttccgtttggtttgccaatggatagttgcctttgggccgattcctagcacccggaggctcgttggatggaccgagtaacgcaaggtgctaagtattactcggaagaaatcaaaagcataaagataagataatttattttctactcttaacaattgcaaaagtacccgagtagtaaattccaattcgtgaaacttcgttccattaatgacaaactcatgtcactcatatgcatgtttgggaagtgcctaggccgactcccgatgcttgggggctatgactagtcggacagagtgtttaaacgtaaggagtcatccgctcggggaaatcaaaatgcaaaagaagaaatacatatttataaatattttaaaatacttgaattttcctcgagtattatatttacatcagatactactcatcctatatatttgttctgcaggatccagatccagatatgcataaaagggattcatggctttaagcttatctcttacgctccaggaatggatcagtcagaacatcaccaccggcttgccgtcgtcgccgccgactggtgtcttcgcctatatagttggttgatcacaccatcgttgttatgtgtctacatcttcaccgccggcttgccttcgtcgccgccaactggtgtcttcgcctatacggttggttggtcacaccaccattgttaggcgtctacatcttcaccgccggcttgccttcgccgccactgactcgtgtcatcgcctgcacggctggcctattatgccgccgttgttgggtgtctacatcttcaccgccggcttgccttcgtcgccaccgactggtgtcttcgcctatacggttggttggtcacaccaccgttgttaggcgtctacatctttactgccggtttgccttcgccgccgccgactggtgtcaccgcctgcacggctggcctattatgccgctgttgttgggtgtctatgtcttcaccaaccggccgccttgtccgccgccgactagtgtctccgtctgcacggctggcctattatgccgccgttgtcggacgtctacatcttcaccgaccggccgcttcatatgacgccaattgatgctatcgtcttcacggctggccacgttgccgccaccacaaataggcgtcatcaccttcaactcaagttgtctatgtctgcagccgactggtttcttcacttccttgaatgcatgattctgccactagttattggccttattgtcttcaccgccggtcgtctcgtctgctgttgactgctgtgcaactttgtcaccatggtggagctacttcatatttattattttcgacatcggcaaactctatagcctatactttgcatgatttgccacttcaccaaccacgatgtctacaagagcgagcatctcggcatgtgtcacgaaatattatgccgtgttattttactacaacaagtggtgttccaatctccaatatttctactcggacatcttcaacacgtatcttcactcaagcaatgactattcgacgacaagaagctacagttctcgactctatgttcagttgtttctcaactaaccaaagagtcgggagctacacaaatacaagactctcaaaattcgacaagccttatgtcaagatgaagcaatcaatcaatcaacgaatcaattcggggagttattatcttcgtcttcgcttcagagccgacatttaatttcagcgactccaattattacatcggcaattttggcttcttcatgccgccacaatctactccaaatttcttaagtttgagatttaatttacatgtctgggagtttggagtcatcaaccaatcaactcagatcagatccaatgagttgaacaacagtttctactttcattcaagtgaagcatctacattagctataacactaagttttgcagtcatcttcgtaaatcaagaagctttgcatcagtcttctttatgcacacactcgaatcaaggaaactactcgagttttgatatcttctcaacaatttgatggattattgtcactgacatcatcaccagcacctctacttcatcggccctgacatctctaccgttgctaatggatgactacgttttcacctccggctgcttctgtcattgccgactagttatttcgccttcatggttgacctactatgcaaatgctgatgagtgtcttcgtcattatcattggttgctacactgctattgactggatcaccgacatcgtcatcttcatcatgtcggttgcgtttgtcgtcgtcgactatttttcttcatcttcatgattggtggatttcgtcatcgcctttgatctgcctcgtctgtcactgactgattatttcgctgccatggctacacaactttatcgctaggcgccttcatcttcattgatggctgacctgactgctgccgactggtttcttcgcctccacggctatgcaacttcatcacttttgattggtatcactatcttcactaccaccaatatttttgccacctctgctgggcaatattatctctatattggtcgtcttgtctctatgccaactgcgtcagctaccatcaatgaacaattgtgactacgtgcttagggcttactagctcaaacacaagtatcataccttcaatttggacttgctccgaatacatgcaacatgaattcatgatcatgggtctattttctatgctcaaagactggactatttattattccccataagggttatcaaccgaatacttgcgccagtcgggattcaattattatatctattttggagtatcccataagggataatcactcagatcagaaactattgatatgagctacacttggtctatatcacccggaagatgtattactcgggagcatgttatatgcgtcatcctttaaagggtgtcgaaggcatattttttggcctaggcctaatatgtctgcagcccatattttcaggtgtggcctgtcacgttcttttagggacttaggcatttttgttaggccaaagtgcgcgtgatcaaagtgtcctaataccttaaaatcattttataccgcagttactcaactttttaggagttagtacaatgcatcttaaaaggtgtcaaacagtaaagctttatatagctgcctcgctgacttttttatatagtcaaggcactgtttgggtttatcaagcaattgattggatacaatatcgttgctttttgccacgtaagtgtgcatttttattgactaatattatggcttaggctgattatacattgtggtcattttccaggcggttggtaaatcatttatgagtttatttactcagattttacaccacatatgccatatatttccaggtatggtgaaaccatgtgttttttagggacttaagcacatctgttaaagcagtgtgcgcatggcgtatgcccaatactttggaaatttctttattcgcagcattcaagcttctttatagctgttttgctatgtgaatttttaatgatgtaggcaactttaggttgtactcatcatagtttacaaagcagtcggtatatcacttggatcatgttattcggggattcacatcgcatatgctatatattgatatcaagtcatttggtttattacaattatcaaaaccactcagttagttagattatttattccttgactatatgcttggtttgttcaactaatcacatggtcggaggctacacctattaggtgcatatactcgatgcacctaaatttacattcaattatttttcagccctccacagtcttcatatttggtaaaagtactcgggagaccatggcaaagatgattgaagcacttggctttggagtaatctggttcgagagaagattatcttttcgtctgttaaggtcttaggggctactgtggagattatgggtacccatacccacacgtaggattgcaagtgggacgggttgcgggccgtcccgccccgccccacaaccatgccatgtgggccacacggcatggttatccgactagttatagggaataagttatatctatggaatatgtaacagatcatgacttgggtattacgtttccttgtatattacggaacggcctaaagtcctggtttgataatattgtaaagtagatttaggaaaccgataccgtatttggttaaggtttctatcttataatcctgccccccaccctatataaggtgggcaggaggccctctagggggtatgagcacatatgatcatcagatctatactacacccggcggatttaaatccccaaacaggagtagggtattatctcccatcgagagggcctgaacctgtctaaatactttgtctccgcatccatccacttttaggtctcgtgtgctaccccgttttattattgccgaattcatgtttcgacaggcggaagccgtgtggccgctcaagtgacggcgaggcagagagggaaggtgggggagagggtcggctaggtcgtcgcctcccgagccgcgggagagcgacgcgagagatatctatgacccaagataatattgaccttgcgcatctgcaacagcaaaggaggggtgctgtccagcaacgacgctgatcaacttgcacaagacgatagatgactagcgaagaggcgattgacagttaattccgccgcatcaacaacaattcattagttgattggctactcgaaactcttgtgctagacagcgccaccagtggcgtaacaatatctcgcatggtttcgcctttcacaagacctttttttttgcttggccttcacaagttaatcaggttaggatcactggcatatccttcggcaatggattatcgtgtaaaaaagaagagcaggagaaaaaaagaagagaacgcaagaataggatattccattagcaataaaggcaccgataagttacaaataaagaataatcggactatcatactcaactcgcgagaggcaagctgcagttagttcatgcacctacaagagaaaaatggagacatactctattcactcgcttcacattttcctttccccaatactacttacaacacggcggctagttcctcacataataaattaaaatgcaacctaaaattatccgaatcgcctaaaatcgagagagagaaaaattgtaacacaaagagcgctcacaattgaaaaagaaggtgagtttgcgggagctacaatggtggctgattgcaagtgatatcatagaaccttgacgccacttggtcgtttaccttccatggcatccttcttgtcgcggcaatcggaacaaaggaaagggccttcccatggcttagaggagctggaagagaagattgaaccagcatggactgatataccttcacttggttcaaggtccacctggcagatggcacatgtaaacaagcttgatgatgttctccgaccacttgagtcattgcctaacctgcgtagtaaaaagcatatgaaatcagaaaatatattctaaagtgcacgtcttatggacagaaagcataagatctctgcaaagaaagatagtgaacgaatattagaaataaaaattgcaaacaacccgagctgaagagaaatttgtacatcacattacaaaaaacatatggttgcattattcttatgtgtagcacagtatagtaccaagctaacagtcaaaatagtcagcaagaagggtggtaaatcagcagttacatggacttttgccaacatatagactaagcataagctgatctatatatataaagcagcaagcaaacaagctcaaaagagcttgttcaagttattcatgcagattagggaaatcaaccaagacgaacagctgattcaatcaaaacgaacaagttaaaatgctaaagcattataatctttatgtgcatgacattactaaccactcccaaaacattggatttgtctcacacaaggcttgtacaaaccaacttgtggtcctttcaattaaaggatgaatgaagagggtattcctctaagctgtacaaaataaattgtgatctaagtgctcaaacagaataatgtacacccccccaccacccccacaaaaaaaatgtagcttatctatttccaattctccatgttcctcatctcattcccacgttgaaaggaagactctaagcattttggcaacttggtggaccagccaacagggttcctccaatcctcccttatatacgagaatacgaaggggacaaaggaatggttgattgtgtacacatacaaagaattgttttaatagtggactgagagcaccatgttagcaagacaactcagtataagttcagcttggtggctatctcaatggtgaaaactagtttacccttgtatacctatttgagaatagaacaagctgaccgctttatcagggggtgggccctgcattattcaagggtattcagatgtatacccaagatttttagcaaaaaactaacatatatctatgtatttggtatatgtgttaaaaaatagaaaaaagacctcaatcagcccatagaacaaacaagccacgttactaggccgtgtccctcctcccctatcttttggcccattcgctagcctaggcccaacttttcccccactcccaaacagccaaacaggccggccaggcccacccaccaccaaggcacccacataaaccaaaccctagctagggcagggacagtgggtggcggtggcgtgggcatggcatgggtggctggtggctgagcagcggcaatcgggtgacggcggcgcgccaccacgcgggctgcggtggccgggcggtgctgcaggggcggccgagggcgctgggcggaaacaaggcaggggcaacgggtggcggtggctggcggtgtggcacaggctgctagtggctgattggcgacgaccggcaatggcagcacgcctcacgcgtgctacggctgcacgatgttagtggcaaggaggtatgcacagtggccgagcggcataggtgcaggcgccgagcagtgacagggcaaggggtcgggctggacggtgtgctaggcggcaagccagtgaggccacaagggtgattgggttgggtgagctcggctgacaactattgctactcatctgctctgccttctaaaatctcaagcagaagttagtgaatttttctgaatagttgatttgctctactcatctgagttattcacaatttcacacttaggatttagccatttagggaagtaggaacttgtgcttgtggaatggctttagatgcttactgtatatataccaggatttagacttgtgcaatggcttaatttctaagaatagaagtacagttggctattaaattctaggtccaaaaatgaagagggacaaggggctattagcacttctatatgttgaacaatttcaagtaatgatcaattctatgaaaatgtgaatttagcctcaattttgtgttatatatatgttagatatcgtacaaacactagtgtttgatgttatagaagccaattattaggcatttgggtgtttaaaagaacttacattacccttcatattttgaacgcccaacctctaaatcctgggcacgcccctgcgctttatcattgtcttttggcatgaacaagtatgcgatcgactggctaggaaatgactggataattttatcatgatgtttttctaactagagatatagggggacaaatagtgttttcacgataaggattgccatctgtcttgcccacatggcacataaggtgggcccaagggtcatattgacccaaaaggtaaagttaaatgactggtttggacaaaatcaaatttcaaggaccaaagcgaccctggaatggaacttgatggaccaaattggcctattttcccaaaccaaaaatgctatttatctaagcagtccattttcaagcatcctcaccttgttctagataagcatgaagcatgcaatgtccacctataagatcagctcaagttgtttgtatttgctcattattacttgatcgttacttaccaaggtagtaatagttactgtctaactctcccagagctaatattaaataataagaacaatactaatgccagggctcaatgagctcatcccatctgacaagtgtgtcaccacatcggaacatattgctcaagtattgtgcttgcaggaagtaagttgcgccaatcttgggccaacataatatagtaccatcagagaactgagtaagcaataaatgtgcactccaaaattaggagtacaatggaccagaaaatcataggtgagcagactaggattattgtgttctgttatcatctgaattgaaccaaaaaaaagtaagatctgggagggaatgagatggataagaaattgaaacaaaaacgcagccaatgagccaagacgaagcacaattttaaacaatgtgttcaaaccaaggtctaactattatctgaaaaagaaagggtctaactggcactgtgtcagtggccaatatgtatcaaatattaattggatcttgtttccagtgctttcacacgggggctgtgatcactaatttattccttttgactatgataaccactgatgtgaacttttgcatagtttgaacacacttattgcttagtcaaactgaactaatggtgacagtgtgacactaaaccaattgggtgtgacttgcaagaaaacaaaatcgatctggtatggtttcaaccagagttgtcactgtcaggatagggatcgtaggcatagtttaaagaactgaaccagatgttagcctgtgaataactcactttagtggttccccaataggaacacaggtttaccagttcaaccgactgttcaaagaattaataaaacaagtcattgtcggtatggcatagaaaacaggccttacagtacatgtttccctcctaaggcaataccatcgtgcgctagttggttaaatgggttgtagaacatagactagtcgggttccacagagagaccttattggcttcaacttcatccaactgctccagtaataatgtcagttcagcacaaaaccagcccttcacagtggtcactagctcagggagactcccttgctgaaacagtcttggctcaaaaccggaccagactgtgctagttcctgatcactgctgatagacaatagaggacaagatgatagtgaacctgaactaactagctacaaatgtcagttaacacctccattacttgctatctccacccccttgccatcactgcttgctagattcatcactggcaaagttgctgatcaccatcatcacggcttgctagcttgagagaagagaacatgagaaaagaggatggcggacaacgactcatactccattcacattcatggcaccagcggcctgtgtagttgcaatatatccataaaccctccgtgtttgtttgtgtttttaaatccaaaaaaaagcctttatgggctgttaggctacaggagtggtcaatgctgctcagatggattattaggctcaaggagaacagcttcttttttttttcctatatgtgggttgtactatgataaatagctttgtacttcattgaccttcaacaagaataccacggccaagtttatggactcaatcaacctgtgttaatggtcttggtcaagcaagagactgggtcatggcgatccaatctgactgggtatataatccacagggtgtcatggcgtcatgctatacttaaaacaggactactggactaacatagtggttagttagctcaagaaaataaactactgatgtatatacacataaacactgatgtatggttgactatgaatccagctgcttacacccaagaacagggagctagcagtgaaacacttagaaagttcataaacactcttagaggagagctacaactgacctctctgatagcattgctgaaccttcttcgaataactcttccaccatacccgctgctgacagctgcttagtcagtttattaggatggtcttttgtcttttttctaaagattaaagacttcaacttgtttatcttttttggtggagatggatgacgtattgtttgatcaggtgggatcatgtcaacaacgatgcaggtcgtatcatcttttagccctcttgtcctgagcgcctcctaaaaaattagggaaacaactcatttataaggaaacatgtctgatgatgcaacattagtaatttggtacccattcgaggcacaataactagttttacagcaggattgctaagaatttagagaacactagatagtttcttaccttaacaacttgcttagcagcaagctcagcaggcaaacctctgcaacactttgcagctgcctctgatgacaaggcatcccaaatgccatctgatgcaataataagcctccctccagcattcgacaactacggaaaataacaataaattaataaagaaggcagttagctatcttccaccaataacataggacatcgagcaggaacatgtgttcttgtctctttgttgttgggctgtcaaaaatatattattgccaaacagaaacctaggaggaattccaggcgtctatttgcaaagtgtcaaagttttaccttcacttgcttgacatagggaacaggaactataaattctccaacatcgatatctccaatggatcttgatagacataaacctcctggccagcatctcagtggaccaatctgataaaagggtgatacagcttgttagcattgttttgtaatccttccaaaactaagcacatgtatccaatggagctatcttacatagcatagcaagctatgtttgcaaccatatcgttgtaagttgtaacagaaaggcagtgaaacacacctctgccccaccaacaacactaagccttccaacttcacctccactcgcagtgacacgttccctcctacaatcattttatatagaaggttggttaaagcttacaagttacttttctattcagcagtcaaccaaaaaaaaaaaacatgctattgctcagggacaaaggaacttaacagaaaaatataaaacaacaaatcacttggagttgtgtaagactacgagtctaaatgaaaatcaagaatacagcaaatggacacattttcactccataccgtttaattgttgatctgaggaactattttagtagtaagtacaactccagtaattgtagtagcatggtccacttaatttgtgtgcaaatagaaacaggatatcattttttttattgaagggagaagtagcagttgcatgaagacatatgaacattctaaatagaaattgaatagaacaatacaaataactaattagataatatatggaaaacagtcatgcaagatattctagttaaccctttcatattccatttgcaaagcaaagaatatgcaatgcatgctgacttgcagagcctctaaataaaataccatattaatggtaagcgacagatactcactcctccacattttcttctagtctgtgatccacagtaagcaaagaaacagcgccaccctgagcatccaaaatacaccgggaatcaccaacggaagcaacggtgatagtccatccgtcaatgatcacgaatgtggcagttgtgccagatgtttggcctggtgcatagccaaaaaggaaaattgcctcaacgtttggcataacttatacatagaggtaaatcccaaacaccaaatacaggatcatgcctttgtgttggaattctttgtcagtcttaacaaaccctgcgacaagcgcacgtgggagcgcatgcaaccactcctccctggagagtcctcttggcattgcgctaaggacatgattgagcagattgtccctggtgtatattgcggcggcattaccattatggccatcaagaacctacagacagagaaacacccaattagtgaattgtgaaaacagtccaatcccggcactcacaactcaaagcatctccatacaatggttacatgcgtagttgcaatttccaaggtctcactagcatgcctaaagccatacaaagaactagcataccaagatctgaaactatataacatatacatagcacagcatagcaatttagcaaccacacaccccataaacgggagcgaaatccaagcttcgcatgccacggctgatggtaataccccactagctggctatttagctactcaggagcacaaacccaaggaccggaaggggaaaattcgaagcaggcaccccgaaatgccaaatcgagccgcactgccatacacacactcacgaacacgaacacgaacacgacggtggagcacacaaactcacggcgaagacggcgaaggtgtggggaggcgaggacgccaaggaggaggaggacgacgacgaggtggagggccgggcgcagtcggtcctgaggaggaagaagtcttcccccttcttcgactgcgccgcgcacccgtaccgcagcagcggcctccgccaccgccgccccccctcggcgccgccgccgccgccgccgtcctcctcgtcgcgcgcgcagatcctgctcccgctgcccatcggccgctccgcgcgggcctcctccttgatgagcgcggcgagcggcacgagcccgctcccccccgcggcgcccgcatgctggcgccgttggtggtggtggtggtgcgccgccgccgcctccgatgacggcgacggcgacgacattaccccgcttcccccgatcggatcgaggcggaggggagggcgcagggcagggggcggggcggggccgaaggggcggacaggcacgcggaaaggtgggggaggaggaagatggcgaggcgaggggcgagacgagacgagacgcggttttgtctcgtttttattacgcccttcttttttttttttctattagcggagtccagcccagttgctgctctccccctttttttttttttttttggttttaatttcatcgccatccacctggacctttggtacctcatgctcgcctcactcacgacgtgttcaccgggatggtgtcacgcctcgggtgtggtaaactcgattgtcacctagctactcttcatggaccatggcttaggccccgtctagttctctaaaaaaaattttcaaaaaacatcatatcgaatctttggacacatgcataaagcattaaatatagataaataaaaaaactaattacataattagagaggaaattacaagacgaatcttttgagtctaattagtctataattagccataagtgctacattaacctacatgtgctaatgatagattaattaggctcaaaagattcgtctcacggcttccaggcgagttatgaaattatttttttcattcgtatccgaaaaacccttccgacattcggtcaaacatatgatgtgacacctaaaaattttcttttcgcgaactaaacaggccattatcgtgccaatgctagagaatattttcttttatcttctctcaaaaaaatattttttttatttataaacctttctaaaattatttccaaataagattttagaaaaaaaaatacttttattggcaagtggcttcaaatagcttggcaacccgtaagaacagaagaagccacagaattagagagtgtatgatttgtgtaccatatataataaggttaattggatctatgttattataactcttgtcaaattgaaaatcactattattcacaattcggttgtgtgtcattagtattttataacatttgaactatgctactatatatgtcttggacacagtttgattgggtttttcataacgtgttttcgtatgcaccaaaatactttcaacccttagaggttgacaagtggcacccataagtcagacttatcttcttccccaactcttcctctagcttagcaaggccggcggtggtagggcgacatctacagcagtggtggaggggtcgtcggcggtggcagtggtaaagggtcggcgttggggctcgttgggatgacgagacgaggagccaccgctgccactggggttgctgctactactgctcctcattgccctgatctggtccacttgccccgatctagctgtcacgccatcaggaagctagcggtgggggtgtcatgagaggaacatccgtcagctccctcgagcttcgtgacagttaggtgatcaaggggtcatcgctagggcttgctaagcgaccacaagaagaggagcgaccgtgattgccaaggctgactagggctactgctgctgcagctcgacactcgagctcaagtgcaccgccgatggggctactgctgttgttccttgctgccacgatctcgcctccacaatgtcggaaagccagccacggcccacgggggcattgtcaatctagcggtttcacgtaagctgaccaattttcgtgaaattccatcggtttttgaaccctggttttcactggcaagccccaacgccgatgtcacgccccgattttctttcggggattaaaaatcatttaataatgcatttctagattttacattaaatgttaaagcaatttatcaagtaaagttaatgtgggaaataaaatttcctttagaaatcatgacggtgaatatttttttaatattctccatgccctaaaatactctctggaattttccatgaatttttagagctcaacaagtaattttaataatacaaacatcattacaaacaagaaatgtttcatgccagtccactctttctccctcgtcctcggcctcggcttcattctactccccacgagcccaatccaattcctcatgcctagcctagctcgcctcctcccccattgcgaagtctactacacctccctcctcccttgagcgccgacaagtagggcccacctatcagctccaaaccctaacctctagccgctcgggccgacaccgccgaccacttcccccacgtcgccatatctcccgcaagctcacgagccccctcccccctcccct

SEQ ID NO: 58880 - DNA, 58381 bp, Oryza sativa
agctgatcctgtgtatgcgtgcaggaggagtggagagtctagatgctgtcgctgcatgtgtttgtttgtttgtctatttgggcacgtagacgaagtgggagctacgtgggctggagcgcggctacgcatcggcgagcttcgaccttggcatccgcgggtcgctctacaccgatagaagagtgcgcgactaagactgatgggagaaaagagtgcgcggccggccggtgaccctttcccccgcacgcgtcacgacctgcgacccctcctaggcgcgtcggttggccactccgcccccacgtgctgctgtaaggtgagagaagaggtagaggaaagagagaggtggagaggtaaggaagaatatagatggaggaggttgctgacaggtgggaggtggggcacacaagctgattcagtcaacggggtcaaaactgccacgtcgacgaaaccacctttctaaccgctgaaagaggcgatttgcactggtttttaaagatgggggagtcgctatacccggttttatgattgagggaagttatttaactagagcaagagttgagggaagcagtatggacttattctacttagaaaagagccacatatagcccccagcccaactaactaatccctagctcggtagctcccgaccccggcggccgccggcgctcctgtctccggcaggtagcaggccgcaggtggaagcgcgcggcgctggcggcggtgagcaggcaagcagcggagtacgggacggcgtgtccgcgcgacttcgcgagcgcgagcagcagcagcagcaggccagcagtcagcagaggccagcgcgagcaggagggagctgagcaggttgcagacaggcggcccgcggccggccgccggcgccagcgacgccacgggaggtcgggtgcgtgcatactgcctgcagtctgcagcagaccagcagcaggccggcggctgcaacctgccaatctgcaaaacaactaaacaaggtatgcttatcacttatcagtttatgcaaatatgcaattgtgattacctaagtggaaatttggaatggctcaatccattagcaatttagcacagtttcatcttgtgaagttgtgatgtatttctcattatttctctatttctatatgaaacttctttagaatacaacataatactatggtattataatattgtatgagacatgatgtgtttatgccgacgtttccctcaatttttcattcctggattcacccctgcttttcaagatgcattcatttggccatttaggcccagatagtctaagttaaatcaacagaacatggctcagatcagttacaggccaagttttcactacccaataaacaaggccagtttaacttacatagccattttactacagatcttcatagcatactatgtcacatacaataaaattactaaattcttggacttcctcatcagtttcccatttttaagttttaacaatgcaaaagtgccttactgtcatgcggtgagtctccttgattcaatatacgcatcacatacttgataggtgtatactggcagcaaaacttttagctatttactccaagagctgatgataaaccaacaatggtcatggaattttagctctcttcttcagattcttccacttatcctactccaaccacagcacgtagatcgatgcggtggcactaccttctatgtgtgttaggctcccatctttttgccaaatatggaaaatacgtcatatggcgtattagcaaaataataataatttgtaggtaaaacatatatatatatatatatatatgttcttagcgacttaaacgacaatcttcgacgaaaaaaaacttcaaaaccaagttttaaaatttaaattttggcatcggttgatgctgaatagagtaaacgatgggcgcgagggagagatggctgcgccgccgccgtgcacggatgggaggcggccatggtgtgattcgaaccggattctagcaggaggaagacgaaatgggccgatacgaaatttcggcaataataaaagggggtggctatcaagctaggaaagtggatgggtttggagacaaggaattttatacaggttcatgccttcttattcaagaagtaataccctactcctgtccggggatgattccgccgagtgtgttattgattgtatgattgggagaaaaagaatcgtcccgagaggaacccggacccctccttatataggggaaggggtccgtattacaaagtacagtccatatcctaacggaatatgggattacagataaaatacaatcgtaaccgactaggatcccgggtattttcttgacatacaagtttagaatctaacccaagtcctcataaagatattctatctatatttggtaccatatatccaactggaatataacctccatgtagatatggggtaaccataatctccacagtggcccccgagaccttcgcagttgaccaaaataatctccaaaaaacaataatccaagtgcttcaattcaacttgctccggcttgccgagtgctaaaagactgtgaagggcgaaaataaaacatggtgcatcgagtagatgcacctaattaggtgtagccctcgactatgtgattagttgaaaaactaaacatatagtcaagaaccgagtgattttatatcgaagcatgcatggtactcaataaaatacccagccgactgcttctcacttgaatatatcaaggataaaaaatatgaaaagggccgaatgataaacactcaaaaggtctaaaaatagatatatttggtaggaatccgagtaagaaactcttaaaatgatcctaggccataacccttaccataatcaaaataagcatataacatgctaggagaatgactactaataaaccagtcatctcaaattaacccaacagcttttgcagcctaaaaaagcttacaaaaatggtataacacctctctgtcgggcaccttttcatgtgcatcataataattccaaagaattattaaatcgcgttaaaaagaattttaacagcatcgggccgcatcattgtgagcacatattgccaaagcaaaaagcgcctaagtccctagggatcacaacgggccacgctgaaaacataattgggctgaagtactgtacaggcccaggcccattagtactcccgataccctaaaaataccgaagtccaaacgtcgtttcgtcttccccgccgagactctcgccattccccactccatgctacagtacagaaccgcgccgacgaagctagggttcatcaatctgctccaacccaccctcaaaaacttcacaaaatttctccccgcgtccaccgctccgattccccattcctctccagccatatctcggaccaaatttaaccatccagttcacattcatggcggaagaaagagaaagcttcgagagtcagtgggcgccctccgatgtgacagaagataatctgaaggagatggtggcgcacggcgttctcccagcgaaggagattatcgggtggcgaccggcgtccggcgaagcattcccgaccccggacacacacgaaatcatggtatttgctcatttcttctatggcggattttctcttccaaccttaagattcttccgggggattctgaacttctacaggattagcttgcatcacttgaatccaaactccatagtgcatattgccaatttcatccatgcctgcgaagcttttctgggcattaggcctcatttcgccttgttccgccgcatcttcttcctcaagccccagccaaacaaaagcaaaccatgcgtcgttgcgggagctggtttccaactcagaggaaccttgagccaaaaatatttctccatgcccttcaaaacctcaaacaaaggctggcatgcaaactggttctatgttcagaatcctgagcccgcagtccccgagtactgctgtcttcctccggtttaccaggatacatggaactcattgcctatgggagatgaagctgctcaagcagtagaactgatggagaggatgataaagctgaaagaatagggccttcaaggagaacagatcacccggcactttaccaagtgtcggttagctccaatcaaagaaagatctcgcacagccttcgaatttgacggcaagcatgacccaaaccgtgaagatccggattctcttgacttcaaggtcatgaaggaaaggatgtataagatcttctcaaacgccatcgttgtcagctactcacacttgctgccagtcgtaccgttcaatgcattcaatcctcctccaccggtgcgtattcatatacttcaacctttctcaaaatatgatcttgttttcttgttgaatcatttaacaatgaaggatattacacccaggaatttgctttgatgaagtcggatcccccaatcgctcaacgccgatctccccgccaccaaactgggcaagggagcggaagaccaagaattcggtatgaaactcaaccaagtgcttctgatccagtcggccagtcagattctcgaaagaggaagctggttctaagtgacgacgaagccgatgataccaccaggaggcctgtagaccgagagacgaccaagaaactaccaaaacaggctactccaaggaagaaaacatccagtcgtcctgtgccaaagatcaggaagtcttctaggtgcaactcatataacgatctctcttgtattgatgcgcacccattgcggcaataatactgataatcaaatttgcaggaaaccatctgatatagacccgtctgggaaagactctgacccaactaacatggacacaagtttttccaaagaaaccgggccaacagcagagaatcgtccgagtgacaaacaaccggcaaccgataatgtagaacccagcaacgagcccccgactgggaaccagtcgactgaagctgaagtcggtgctaaccaggagcccccgactggaaaccagtcggatgcagggccaagccaaaagattcccgaggttgaagctcaaacgaacagtcctctcgggaaggatgctgacaatgaatcagaaaccaggtctcctgtgaagacaccaaagtctactcgtccccgaccgggaatcatcacaggtagacacgctatctgaaatcgttttgatccaacagactttatttggctgcttcatcttcattcatggatacactagggccaataattggtgatgaagaagaaatcctccggatacaagcagctgaggattcactccctccgattctggtcaagtggtgggatgacaacatgcagcctcaagggatcgtgataaataagcaaaaagaggacgaggagctatgtctactgaagaaggcactaggtcaggcaacccgcattgtaaatgtaagccctctggtacctgatctcaaccatcttgtttgccatttaattcatgcgctaattaaactgttttgtagaggatttgtaacaccctgaaaattctcccaacgaaatcaaaacaccaaaaatacagattttcaaaaactttttaagtaataaattgcatcatgccgattttattcgcctatttcattggattttgatctcggaatttattaatcgcgaataatgaataactaactaggaataaaccttaaaaatcaagctggctaaataaataattaaaatataaattaaaataaagattaggtgggattggaaataaataaaatattatcgcgaccatattagcaataattaaattttagtacgatggaatgagaattaaccctaattaaaaattcaaataaattatataaacaaaatatgagtgatattaaattagggtgaatttttagttagtataaaacaaatatggagtaaacttcatttatgcaaaagttagaatttataggactatatttaaatagaaaatgggctaaaatcgggataaataggaaaagttactgttcattgcgtcataggtgttcgatcgtggtccccctggccccgcccccttccctgccgcgtgcgccgcgtcgcccgcccgtcgcgcgcgccgccgccgctgccgcgccgtcaccgtcgcgtcgccgtcggcctcgcgccttgtgccgccgcgcgcccgtcccctcgcgcctgcgccccgccgcgcggcgtcccctcgccggtcaccctgcgccgctgccgcgccgcccattccatcgcgccgagccctatgccgccgcgcgcgtcgcgtcgccccgcctgtcacgccgctcgctcgccacctgccgcgtcgccgacccatcgccgcgcgccgtcaccatcgccgcgtcgagccccacgccacccgtcgcgtcgcccttctcgagccccgcaccgtcgcccgtcgcatcgctgctccgagccccgcgccgccatcgcgtcgccgccctcgcgtcgccgtcgtcccgccctgagcgccgccgtcgcggtcgcatttaccgccgcccgcccttccccttctccttctcccctctctacaaaaaccccccctctctccattttcccccaccccatctcacccttcctcccctcttccctctccactgcgccgccgctctcgtgccgccgcgccgccgctcccgtgccgctgcgccgccgctcccgtgccgccgcgcgccgttcccgtgccgccgtgcgccaccgtcgctgccgccgtcgtcgccgccgctgccgccggtgagccgccctccttccccctcgtgtccaccgccgccgccgctcgggtgggtgagagccgagagagagagggagaggaaaacagaggccggcagagagaaagagagaaagagagaaaagaaagaaaaagagagagagagaaaagaaggaaaaagaaagaaaaagagaagagagaatggagaaaaagaaaaggaaaaataaatagaaaattaggaagaaattaaggaggttaatagtttaagaaaatctaaaataattagaatttaattatagattaattatggtcatagaattgcaaaatttaatataaattatagattattcttggtaatttctacaagaaatcaattcgcggtactagtttaaatgtaattaagaactaaacgattagatgaattcttatagactattatagattattttgggtaatctctataagtaattgattcatggtagaaattcggacttaatcactaggaattttagacgtatattatatttagtcgtttagtcctagactaaaattaaatcgtataatattataagataatttttggattccgtccgatatttagcttgcaatagaaatttccaacctattatatggatataacgctcgggtagattaaattaaaaacttatgataacaaaatatttatacccacaaaatagtttaggatatataaatcgaaattgggtttgccctagtacgcgaatagtaaagttaatataaaagaatcgactttcgtgtttgacttccatttggatttatttggatttttattttgaattctaatcgaatccaaatcaattttcgcacgtaactatagagcccgagggagttgcggatccaagtgaaggccaagacccccaagaccttgagcaaggcaagtcatcactattccttgaacatgttgatcccaattgagaaattattttgtttataaataaaattgcatgcaatgatgaatatcctacttgtgattatgccatgccttgattattgtttatcccttattccttcgtaaccatgtttacgtatgagtccctagtcaattatgacaattgcttagaaatgctattctaggatcatgcatactcatatttatcaaatgctaaatgcttgggcaattacctttgggaaggtaattgagatgcggcatgtggagacatgagcgccacattgccatgaaattgataacatgatttgtgaaaggaaaataaagcgaaaacaactgttttcgactggggcggacggatgatttgggtggtatctggaaaaggctagtagcgtccccagtcaattaaggaccgagccatgaagttaagcttgaaacgacccccgtacaaccgtacttctcaaatgggtatagacctagcggattagatagccgagcggaggcagtatccctgcatagatggttcacccctgagtgaggcaggtgcgctacgatgggacagccgttgaggtagggccgagaagcgtgccctacatcggtgtcgccattggtaggactgccatgagtatgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacctgtgtgggatgggatattgcatgatgatttttatgctgatggagccacttcctgagaggagggaaggtggacgtcctcagaaaaccatgacgactcaatggcgggaagctatccttgggatcacaatggatggtggacagaaccgtcgttgtttaatgtgaacactggtattaaaacttgatcagtctatgctaggtcttaggtttgtgaaaagaattacaaaactggcttagcgcaaaagagccatagccatcctttgaaataccccttttcatctgcattgttgctgtggtggcttgctgagtacggttggtactcacccttgcaaatataaaattaatcagaagcgggagatgaagcttcggaggatccctatgcctactaccaggagggagatgaagacgatgacgctcagtaggtcttagtacggtcgttgcctgtggcaatggcatgccgctgccttatctatttctgtttttggatgtattccggaccgctcggtccgattatttaagacaatgcctgcgggcttatgatgtaataattagcactagactctcgtgtatgtgcttttggtatttcagctatgaactcgtgtgtaccagactacttgatccagggaaatggtactgtttacacgaatgattcctgttataaaaacgggggtccacaggattcatcttaggaacgaagccaaaacgacaaccttagagaggttagtccctcatctcggaaccctcgaaaccaccaggaatcaactgcacgaagcgaaagaacttgccaggaagaatgaacatgatctgagggatcggatcgctgagctcaaggaatcaaattttgaactgagtggctcatcaaaaggtacgcacaaactctgctcaactgactcatactgttatctttgcaatcttgattaaccgtaatcaatgaagtgcaagctgccaagatatctcagttggagaagcagattcaaattctggaaaatgacaaggcagaactggcaagacaaagagacctggctttaaaggaagttgaaggtatcaacaatcaatacctcaaaagccattatcctccatatgttgacttattaatgtgaatctgttgatgcagaccgcaagatcaaatctcaagctcaattcgacgtccttgttggcaagatcaaaaaacttgaaggagcccgggatgaggttgctaacgctgctgccccaattgttcaagcaatgttctttaataacaacggcccgagtgcacttgatgcttctgaaattttcgataagctgagagttgctccggatacatatttcaagaacatcaaataagctggaagtatgggagcaagtctggcgttggcgatgaccaaatctctttatccaagggttgatatagatgccattgatggctttgcagacgggacgagcgaagaagctgctcttgacctcatcagcgatgcgcaaaaagccgctgacaagattgctgctgatgtagttgagagattccaggacaccgatcttcgaccgactggtcctgataattctgatgatgaaaagactgactgactaatgtaccaatgattttgatgattaatgatgatggaggcacaatttgtacaatactgatgaatttatgcggtgcttgatatcttaacttagttcctgatttcttaaaagtttttgtcaaaccttgttgagcctaaaacctgcaaaagttgttaaaaaactttcagtcctcattgactaagccaagaaatcaaacaaggcaatgatacatcaagtaaacaaattgaattgataaaaatcacactccattattattatagtagccccctgactgaaaacttcaaagaaaaacttaaagttagcagtcaaagaggaaagatacaaacgaaatgcctaagcgtaaaatcggcgaaggtgttcaatattccaagaattgttgatgagagtaccgtcttcgcgcttgagtcggtaagaacccggccgagtgacttcagcaattatgaacggtccttcccataagggagataatttatgccgatcctgtgttgtttgaattttcctcagaaccaggtcaccgactaaaaaggcttgtgatcgaacattccgattatgataacggcacaacccttgcaaatatcgagtcgactgaattagagctgcttctcgggattcttctagtcggttgatgtcgtctactcggccctcttcatagccctcctcgttgaagttccgaaatagtagtgattcaaattccacttcactcggcaacattgcttctgcgccgtaaaccaaaaagaacggcgactggccggtagcccgactaggagtagtgcgtaaagtcaaagtacggacggcagctgatctacccacttaccagcatagggacgtagtcggtcaaaaacgcgtgctttgatcccttgaagtatcatgccgttagcgcgctcgacttgtccgttactcatagggtgtgccacggaggcgtaacaaatgccgaagtcttcacaaaagtctttaaatgctccgccagtgaattgagtgccattatcagtgatgatccgattaggtaccccaaaccgatgcacaatgttgatgaaaaaatctctagctttatctgctgtgatcgtgatgaccggtttagcctcaatccacttggagaatttgtcgatagccacaaagagatgcgtgtaaccgccgactgcccttttaaacgggccgaccatgtcaagcccccagaccgcaaatggccaggacaacgggatggtttgcaactcttgggctggcaaatgagtttgtctggcaaaaaattgacaaccttcgcatgtccgctcaatcttgtccgcttcggacacagttgtaggccagaaaaaaccttgccagtaagctttgccgacaatagtccgtgcagcagcatgattaccacaaataccagaatgtatatccttcagcaattgtctcccttcctccaaagatacacagcgctgcagtattcctgacggacttttcttatacagttcagcttcatgaataatgtaaagtctgctgcgtctggaaatccgctcggcttcatttttgtcttgagggagttcttgtttgctcaaaaattttataaacggttctctccagtcagcttcaatcatgcttacgccttgagcatccatggcttcgactgtctcttttctaggcacggtcggttcataaagatgttcgacgaacacaactgaaggagctgcttcccgttttgaaccaaaattggccagtctatcggctgcctcattgttatgtcgaaggacatgggtgagctcgagtccatcgaatttatcttccagcttgcgtacctcttgtcggtaagcggtcatattatcatctagacatgaccactctttcatgacttgattaacaaccaactgagaatctccacggacgattaatcggcgaatgcctaaagagattgcaatccttaatccatggagtagcgcctcgtattccgccacgttatgggacgcagaaaaatgtttccacaatacatagctcaatctttctccagtcggggaaatcaagacgaccccagctccagtgcctgtgagcctcttcgacccatcaaaatgcatagtccaatactccatcttttcctctggcatgtcttcttggcactcggtccactcggcaaggaaatcagctaaagcttgtgatttgatcgaagttcgtggcttgaacgatatatccaaagacatcaactctaaggcccaattcgcaatccgtccatttgcttcgcgattgtgaagtatatctccgagtggaaacgatgtgtccaccgtgaccgagttactttgaaagtagtgagataatttcctgacggtaattaagacaccatataataacttttgaacctgaggatatcttgtcttggagtcggctaaaacttcgctaacgaaataaattggacgttggacttttttaatatggccttcctcttcatgctcgacaaccaggaccgtactcacaacttgggaggttgccgacacatttaacagtagcggctcttgtggatgtggcgaggccaaaactggtggagtggtgagaagtttcttgaagtcttcaaaggctttctgtgcttcgggtccccactagaaattgtcagtcttcttcagcaacttgaagaagggcatcccccgctcgccgagtcgtgagacgaaccggctgagtgccgccatgcaaccagtcagcttttggacgtctttttgggagcttggcggtttcatgttgaggatggcgttgattttcttcgggttgggctgtatgcctctttgagataccataaatccgagcaacttccctgacggtactccgaagatgcacttttccgggtttagtttcatcttgaaagcacgaatgcttgtaaaagtttcttctaaatccgcaatcaggtcatccttctgcttggtcttgacgactatatcatcaacataagcttcgacattgcgaccgatctgaattgaaaaacatctttgaatcatgcgctgataggttgctcctgcgttcttcaatccaaagggcattgtgatgtagcagtaggccccaaagggcgtaataaacgaggtcttcaagcagtcggattcttttagtcggatctgatgatatcccgagtaacagtccaagaagctgagtaactcgcagccggccgttgagtcaaccacctggtcaatgcgaggtaacccaaaagggtctttgggacaagatttgttgaggtcggtataatcgacacacatgcgccattgccccgtctttttccgaaccagaactgggttagccagccagtcgggatgaaggacttccttaataaagcctgctgctaacagcttggttaattcctccttgatcgcatcctttctgtcctgtgcaaaacggcggagtcgttgcttgatgggtttggcgtcttccttaacatgtaaagagtgctcaatcacctctctggggataccaggcatatcggatggtttccacacaaaaatatctttattatcctcaacatgatccgagaggtcgaacttaattgctatctctgaccaccgaagatattggggcgtgttaggctgaaccgcattgatctcccgttctgttagcttctgttttctcttagactcataagccaggggtccgccgaagatgtgattaagttctttgcgatgatcttgaaaaccagtcggggcatcgtcttcatcatctttcttctttgatgtgccttgatctccgtctgaaggtttacgtgcgttcttgacgtattgctccgcgaactgtttgtagacgaagcaatctttggccacgaggttggagttgggatgatgcgggcattgggagttcattatcttgtcgaaggtgttgacgcgggaacgttgtcggggaagatggagaggtggtcgccacaagttcttcgggcttacgcttgcgatccttgtggttgttacttccactccctcctgcggtcggcgtgtccttctttggcttccaagtggtgcccgactgtttggacgcggtaatagcatattcggctttggcatactcgtgggctttttcaaacatctgcttaaccgtcctgggaggtttacgcccgaacttgccgactaggtcctcgtggcgaatgcctttagtgaaggcggcgatgatgatgtcgtcggtgatgtcggagatcttgttgcgttgttcggagaagcgtcggatgtaatctcgaagggattctccagacttctgaacgacattgtagagatcaaactgtgtgccagggcgttcaaaggtgccctggaagttggcgatgaagtgatcacgaagttccgcccatgatccgattgtgccacggggtagtccgtggagccaggatcgggcggagttcgctagggccacaggtagatagtttgccatggccttgctgtctcctcctgctgcgcggattgcgagtccgtagacggtgagccaagactccggattagtggtgccgtcatacttctcgattccagtcggcttaaagccggctggccaatccactcgacgcaggtcattagtgaaggcagctactccatccacgtcgtcgtcgtagcgatttggtgaatggcggtgacctcgtgctgcacggcgctggttgatcgtgtcgcgaaggtcgacgggacgctggtgaggtggagagcgaggccgttcgactcggcgctccctgtgacgttcgggaggcgagtgaatagatcgttcgtcatgacccctgctcctgcgactagatcctgtgccgatgatgctgaggcttggctgatgataatcatgagatcggaggtgagggactcggctatcagtcggggtgcgggtgcttgcggagttggctggaaccgaggcagcgatcatggtcttcgtctggttcaagatgttgacaacatgatcaacttggttgagtgcgtcttccttgaggagggtgtcgaggagagtgattgctgcaaccgcgttctgctgggggtgcgaaagaccgctgttccatcgacgtcttgttgcccaatgagctctctcgctcggcgcccagattccaaggcgcgttgccgtcgatcttcagcctcctttgcaatccgttcgtgatcttgttgctcgcgctgtagtcgttctcgctcctgtcgctgtcgctcttcctccagtcggcgacgttcagcttcttgccgtgcgcgatcttggtccgcttctcgggcttggcgctgttcctccgtttcgttgtcagccatgaatacgccgaagaagaggagcgtgtaattatcctcatagctgtcgtcgaagttgtcgaggtcgccgtggtcatagtggtagccgaaatcgtcgtagtcgaggatctcggttggtcgagaactgacgccgggggagctaaggtaaccatccaactcttccgtcgagactgtcccaagaggttggagtataacgccaacctctctagatctagattggatcggggccgaagccggagctcgcctagatcttcgagtgggagatgtcttggcagtgaagacagcggccaaatcatcaggaagtttcatcaggattgagggataggacccgtcgtcttgatctggtcgcggaagagtagattggatctcgtccgagtggtttgaagccgactcgggagagatgctcttggagtaggcctcggccgagttcggaataccgaatggcacggggacctggtctctccccgactggttcgggtccgagtcaaggagagagatcttgccgaagtcgttggtgatgaagttgaggctgccgaaccggaacgcctgcccgggagggaaggcgaagtcgtcgatgccagaaacgaaacccatcgcacttagtcggcgagaacttgacgctacccctacctggcgcgccaactatcgaaacaagatttcgacaataataaaagggggtggctatcaagctaggaaagtggatgggtttggagacaaggaattttatacaggttcaggccttcttattcaagaagtaataccctactcctgtccggggatgattccgccgagtgtgttattgattgtatgattgggagaaaaagaatcgtcccgagaggaacccggacccctccttatataggggaaggggtccgtattacagagtacagtctatatcctaacggaatatgggattacagataaaatacaatcgtaaccgactaggatcccgggtattttcttgacatacaagtttagaatctaacccgagtcctcataaagatattctatctatatttggtaccatatatccagctggaatataaccgccatgtagatatggggtaaccataatctccacagtaaaacttatatatatgtgttcttagcgacttaaacgacaatcttcgacgaaaaaaaacttcagaaccaagttttaaaatttaaattttggcatcggttgatgctgaatagagtaaacgatgggcgcgagggagagatggctgcgccgccgccgtgcacggacgggaggcggccatggtgtgattcgaaccggattctagcaggaggaagacgaaatgggccgatacgaaatttgggcttggatgtgtgggagctgaaagtcacttatgctatcagccatggcccataccactagctggcacgctgcaggctgctgcgtcactgaaattccccacccacgcatcgcaccgcacgtcgccggcggcgggttgccctccccttctccgtccccgtctctggccatcctccccatccatccgccgtgctgctgcctgctatagcgcccctaggccggcagcccgccaaacgctgccccagctgggcagccacgcaaccagccgtctagcccactccgctcccagcgatagggccggagccggtcacctacacctccctctcgctcttatcctttgcatacttcgttctgcatctcgtctgatcgatcttctcctttgtcatctttcttacagttgcaagttgcttcttcaatggcaggttcggaggatttgagcggtttggcagcttcacttggagagttacacgtggaatcatctgttagatggatctccctccccttgagcccaacggctcaagggggccttgacccgcgccctgatcgggggcgcccagcccaatggctggtgggcccccgtcacactgtgccatataaagaggggtggaggacgggacggcataacgacacaaggaacgaggttcgtcgccgccgccactccaccccataaaccctaaccgatcgagggggcgcagccagtgacgggaagtccaccgccgcgccacgcctcgtcgtcgacaccgtcgctgctgcaaccgcatcaccgccatcggaaccgagcacatcgtcgccgccgtccacgtcaagcccgcgacgacaacgacgatggccggccggacttcctcttcctcaacaacgactggtcacaaccctaaatcctctcactccctctttgttcattcatctattgttgttcatccattgcaaatagaaccacccgactagatctaaacctaggtgatccaatagacaaccctatcaatggtatcagagccatcctagcgtttagtttggttcggggatagacatccacagagaagaaagaaatccaaagagaaaagcaaacgatccaacggatcaaaaagatcgaaaccctaaccctaatcttacctcgtcgccggccgtcgatgacgccggccacggagggggggaggggcaaagaggcaccgccgaggagccactcgacggccgcgcgcgcacccgcgggtgcacgcgcgcgccggcgagggggcccgcggcggcgccgccatctccgtttttcggccgccgctctctctcacacggtgggggctagagacggtggagggagcggagaagagaaaaggaagagggcgcaagggccgctggcagcggcgacgccgctccgctcggccgctccgcccggcggcgcgctagagaaaaagtgggcgagcggcagcgcgaggtcgccggccatggcgcggcggcgcaagggtcgccggcgtagatgacgccactcggcgcggccgcacccgcccgcaagagagaagaggctagggtttcggccggccggcggctggggtcgggtttttgtccctccgatcttagcgcccggccgtccgatcgaaaccctagcgatcggacggccgacggcggccgggccgaaagcggcccaagtggggagcgcgcggcggcggctttcccggcccaggcccaggttgcggcctgggggaggggagggggcgctcgcccgtgcgcaaggtggccatggaccgaccggcaaaggccggaaaagttcaatttaggtccctcggggccgaaagaaaaagaaaagaagagtttaataataggtcctctcagaagctttttcaattatgtataattattgtgattatttctaagcaatttgaaccaacgtgaaaattgtttagagaatagataaatgtgagaaatgcttctgaacatgtattttgtatattttcatgcaaattacaatagaattttgaattgtttttgcatgttttacctctgtttaaatttgaaccaacgggagaattttacagagagtaaataacagagttttgttattgtttatacgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatctcaggtggctactccttgatgggttacattaaagatattccgaccctgaaaggagataactacgaagaatggaaaagagaactcgaccttgcctttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacgattgagccaaccatattgggctcaatcccagagtatgacactgtctctaaatacctcgaaagtataaagagccagtttactggttcttcaaagttttatgcgacacagctgataaagcagctttttacagagaggtaccatggaggtggtgtaaaagaccacattcttaggatgagcaacatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaacaacagtttacagttgagacaagatcagtgtctacactgcaagaagacaagacattccaagaaagatcatcctgacttcctgacagtgatcatggcaaagaaaggtgagaacattattacatttgtaaagaatctcattatgattggttattctagatccacatggtggatttattctggagcaactattcatgtgtgtaattgtttaaagggattccgttcaatgaggactacgcaaagaagtgaaagatccattagagttgctaatggagttgaagcaaaagttgaagctgttggagattttcgcctagaactcgcgaatggcttcacacttttacttccagatgtttttatgtccattctttgcaaagaaacttgataataagtgtatccaaattggattctgatagatatgaaatggcaaatgtgaactatggtataataatgaatgtattggtcttgtgttgcaagatcagctttatttgttatctctttctgagaatgtgaatgttgtgtcctcgttgacaaaagaaaagaaaagcgaacttctgatgtctcatcgaaattatggcactgttgtttatgccatatttcgagggggagaattgagagactggttaagaatgtagttcttcctccattggagttctcagttttagaacgatgcatacaatgtatagaatgcatcggtgcccaaaacaccgtatgagctatgaatcctccgtgtgtggggaagtcctgcaaaggataaagtatttaacccaaaacagtaagctgccattttattggttattctgaaagatcaaagggtcatcgtttctactgtctaaacagttatacaaagtttgtagaaacgagacacgccgtcttcttggaagacgaaatgattagggggagctcggtaatttgagaaattgatcttgaggagaggcgggtgtctgtacccgctccgtcgactcaggaacctttcttctctctacctgctaatgttgtgccagcaatgcatgccgttgcggtaccaacacctgttgttatctctcctgtggcaacaatgaatgaaagtgaggaatctgttctacaggattcaacagaaattattgccacatcagaggaggagctgcaacagcctcaaacagataatgtgccagaataggaggcccctagaaggcctgaaagagtcgcatatggaggatgatcccatctcatatgaagaggccatgagaagccatgaaagatgaaatgaaatcaatgaaattaaatgatgtctgggatttagaagaaattcctaaaggagccaaaacagtaggctgtaaatgggtctacaaaaccaaatatgactccagagggaatatagaaaagtttaaagtgcgacttgtggcaaaagttttcacgcaaagagaaggcattgattacaatgagacttttctccagtctcttgtaaagattcctttatgattataatggcactagtggcacattatgatttggaattacatcagatggatgtaaaaatggaatttctaaatggtgatttgaagaaaaaaagtatacatggcacaaccgaaaggtttcgtcatgaaatgaaacgaaaatatgggatgccgtataaagagatccatttatgggttaaagcaaagcttcgagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgaaagacctcggtgaggcttcatatgttttgggcatagagattcaccgaaatagaacaaagtatgcattgggattttctcaaaaggcatatatatagaaaaggtgttgaagaaattcaatatgtacatatgcagtgctacacctgctcctatagtcaaaggcgaaaagtatggggcatcacaatgtcctagaaatcagtatgagctcaatgaaatgaaaataaagccatatgcgtcaactgtaggaagcctacagtacgctcaagtgtgcacacgacctgacttggcatttgttaccgggttatttggcagattgcaaagtaatccaggcctagagcactggaattagtaaagattatttgcaaagaacaaaagcctcatgctgtcttacagaaaatcagaatcgctccacatagtggggtattcgaattctgactttgcaaaagataatacaaagttaacatcgggggatacatgtttaccctggcagtaggagctatttcatggaaaagctcaaaacatactaccactgcagggtctaccatgtatgccgagtttatagcatgccatgaggctacggggcaggtgaactggctaatgaagttcatacccggttttaaaggtggttgatagtattgagaaaccactaaagttatactgcgataaagaacccacagtaatgtactctcacaacaattagtcaagtggtgctgccaaacacattgacataaagtactatgttgtgaaagacaaagtccgggatcaaacaatcagtctcgagcacataagaacagaaaggatgctcgcggatccgctcatgaaaggcctacctcccaacatgttcaaggaacatgtagcatgcatgggttttaagggaagccttatgaatcctggactatagggcccaaaagttaaagtatctgtttctgaatagagatgtgtatagtggctgtcgaatccatcggtaattaaccgtgacgatgaaacatgctctatatgtaaatctgtgatggaatagaaaaagctaaaggaaatagtgagatcaagggggagaatgttagatggatctccctccccttgagcccaacggctcaagggggccttgacccgcgccctgatcgggggcgcccagcccaatggctggtgggcccccgtcacactgtgccatataaagaggggtggaggacgggacggcataacgacacaaggaacgaggttcgtcgccgccgccactccaccccataaaccctaaccgatcgagggggcgcagccagtgacgggaagtccaccgccgcgccacgcctcgtcgtcgacaccgtcgctgctgcaaccgcatcaccgccatcggaaccgagcacatcgtcgccgccgtccacgtcaagcccgcgacgacaacgacgatggccggccggacttcctcttcctcaacaacgactggtcacaaccctaaatcctctcactccctctttgttcattcatctattgttgttcatccattgcaaatagaaccacccgactagatctaaacctaggtgatccaatagacaaccctatcatcatcagcttcgaaggacagtgaaatctctcagcctgattcgtgtcactgcacatgttatcttagcctacttgttagttgtcattgcttgggatgtacacactagaattgcatcctgctatcatgtagctctgtttatatatttgaactgcttacaaagcaacctgtgatcaaatgatggttgtgcttgttgataatacaaagcaaaggtactacaataagttgatttgcgtgtgttttgttcaggcaattcggttgatgatgatgctattgctgatgatgatgtatgggatgatgtttcggattctcctggtcatggatccacattagacagagagtgggttcacaggcagaaccagtttcataaggtataaacctaaggcagcaatttgattatgggaactttgccctattcctaaaggaatctgtgaaattgttatgttccatttaaatcatctttactgcaatatatttctttagttatgatttgtgaaacttgtgtttggaccagaatgtgtaaagtaatctttccatttttcctttagatgggatacagggatggtatagcagaaggacagaaggacatcgcccaagaggggttcaatgttgggtttgggcaatctgtgcatgttggctataagtggggtcttgttcgtgggattaccaggttaaaatggatatttgccattccaagtatagttcttgtacgcagccgcttgtagcatccttattgattctgttttctgtttattgtccttaaaacagtgcattagctagtctccctgacagcttgaaagaaaaattgttgcccaatgtccagtgcagaggacaactccaagaactgaataattctgtgcaagaaatttcagcagaagacgcacttcagatgtttcatgagagcattcttcagagtagccattcatcagaggaaccagatgcaacattatagagagctacagattccagtaggttgcaaagcctctcaaaggatcttgtgattttgttgcatgaatgctcagatgtgaaagttagcgaagaactgagaggaggttcataaacaagttggcggaattgtgagcactaccaaccctatgtctggcctagttgctacttgcgtcgaatttcagtttgctgaacatcgaggaagatggtgattcaggggtgttgttggagatggaagcgattcaattccttgatctcacaaccatgatttgctgtttcgaactcaaaaggcttaagcctcaaagaccaagaaattaataagaatgtaattgtaaatcttgtaactaagatttcactgatcatataagcctttccttttcctgctagatataaccggtttcgtatctgtaactcgcagcatgcacacacacacacacacgcatttcattagaactttggcagctgctaagatgataacttcctgaatatcttctgcagaaagtctggtgtatgacagttgcattgtaactttgcatcttctggttccaggaagtgtactcacttttttatcaattgagaaggttcgagccactcctgaatgtttgctactgccctacttatgtaatgttgaatgttgatatgatgaatggcccttggtaatttcagtttgacagctcatgtcagtaagtggcccgcttctattacatgtggttggtgcgattggtgcatcaagctcagcacctcttttcgacatgtaccaggttggtgagaacatcaacacttctatccgttgcatgttgtgagtgttggttttcaatattaatgtcattcattcatgaatattcatgattgatctggttggagcgttcattgatattttatacagtacagttatcttgaatctgaactatgattgatctggtctcttggcttggttgctcctgactcctgaattgaatgaaatactcctgacatcccaatcggttgattggcacttctgacggtacatgttattctgaatagattcagtttattggattggaggttctttttttacccaatcctgtcgttaaatctacatcagaacctatagcaacagagtttttccttccctatttcttgttacatgacatgtattcaggttacatgctcgcatatcaattctgatttcttgttcccagcaagtttggcaccgtcttattgtcaacacgcttgcacagagactggcagactgctgtcacatatccaattctgatttctggttcccagcaagttcaggcccatcactctcctagcggtattctgaaaagctacttaaacttgccatcacttatcagtcaagttagatcacagctcagaacttattaagatggcgaaagatatgcatcttctgttagtgattacaggagatataggagagattgaatggataataatagttctgtacccatagataatcaagacatgctattgtagggagaacaaatgctgtcaataagagttttattgatctttgcccaaggaatacatcccaacactcttgccacttcgcaagtctcgtacacttacacattaatctatcttatatttttattaaaaaatcataattatttagttgatatacaagaaattggtgtacgtctacttaagagattagaatccatttaagagattagaatccatcctcgatgtcatggccatattttttttttgcttgtaacgataagaagatgaagatgacgtaggctgcctgtttattatcaaccaacatatcagctaacgagaaacatcggttattttgtagtatacacaaaacgtgttcactatcatgcacacgctgctgatgcacactcttttttaattatatgggctctccatacatatatgtgtgtatataaaaagtgtacgtacgagtagtatgtagtacgtagaaatcttaattagtctatggatggatggatggatgattggatggaatcaggagtgcatcatctgattattattattgtcgtcgtcgtcgtcgttggccggatgggttccggcagggtgcatctccgtctcgtgtagctggcggtagcgcttctcagcctcgggcatggcgcccatgatggcgcggaggcggaggttgacgtcgtcgaggcggtcgtacacagcgtcgttggtgaacatgccggcgcagaccttggtgatggtggtccagctctcggccaccggcagaaggatgatgacgaccgagcccacagtcccccacgcgatcgccaccgcggcccacagcgtgaagtagccaaggctgtacctcctcgccggcagagacagcgcaggccacgccacgacgatgacggcggtgaagacgaggccccacctgacgatccaacgcttggcgtgcaccaggcgctcctccttgagctcgtcgtccagcgcggcatgcacgctctccaccgtggtgatcatctcccggctggtcccccagtcgtagtgctgcgggcgcagcaggctgcacgccgcgtgcaccgccccgcccaccaggatggacaccaggttgcccgccagcatcggcgcgttccgacctgtggtgtccaggttcacgcgcccgtactgcaccttggccaccgtgagccacacggccacgcccagcgcgcagccggacaccgcgccgcccatggcgcccaccgcgttggccttgctccacagcagcagcagggcgatggggatgactgcggatcccacaatgactcccatggccaggtacatccaccccagggacacccccgccacgttgagcaccacggcgaggacccccatgaagcagccgaagccgagcacgacggccctcgacacgcggagtatctgcttgccggaggcgcccgggttgaggtacgtccggtagatgtcgtaggtgcagagggaggagacggccaccagctcggcggagccggcggatgtgacggccatgaagagcatggtgagtagcaggacggagccggacttgcccatgagcgctgttgcggtggccgggggcaccaggcccttggctgcctcggcggcggtgagcgggaggtccagggcgagcgcgccgaggccgagcgaggtggccagcgagaagggaacggcgaaccacacgaggccgcccagcaggtagcccttgtgggtggaggatggccgggcggcgatggcgctcatccagtagccctgcagcaaattaaattacttgtaattaattgacgatccaagataattattagtactacgtacgtttgggtacgtacgttgtctacgaacaccgttccaaagttgccgacgatgttgatgatgccgaagacgagcccccccgagctgagcatggtgaggtaggagcccttgaagttgccggcgacggggccgcacgcctggccgttgcgcgagaggtcggcggagcagtcgcgcgcggcgctggcgacggccatgaggcgatcatacaccacacgcgggctcccgagtttggagctggaggtgtagacgaggaagacgaagacgacgagcaccgcgtgcacgacgacggagtggatgtagctggcgaggaaggtggccttgaggccgccggcgagtgtgtagacgacgacgccgagcgggatgaggaagctggcggcgtagacgttgactccggtgagggcgttgacgacggcggagccgccaaggaggagcatggcggtgacgatgacgttggtgaggaggcagaaggtgaggaagacgaggtgggcgggggtgccccatcgggcgcggacgatctcgcagacggtgtgggcgttgggggccttgcgcttgatctcgatggccatcacgccgaagaggagcacctggatggtggcgccgctggcgtaccagaatggcccgctcaccccgtactgccatgccacgttcgagctctgcaggatggtggcggcccaggtccactgcgacacgatcacgctggcgatcagacccgtcttcacgctgcgccccgccgtgttgaaccactccgacgtgtgctgcgacccgacgtaacgcttctcaagccacacctatatatatatgcatacgtacgtaggtagtagccacaaattaattaatcatatctctgcgatcgatcgatcgatcgatctcaagagaggagaggccgaaggatcggaggctaaccaggaaggaggtgaagagcgcgaagaaggcgccgaagccgagcacgacggcgtacccgacggcctgcgtgagcaccggccttccgccgaagtagctgccggcgcggctgcacaccccgttcaccaccgagtagtactccgccccgaaccccagctccgcaggagggcacacgccgctcgccatcgccagcttcaatccaatcgatcgatcctaattaaatggggaatttttactctaacagacggatagatggatatgtactgtactagctagcagatcagagatgtgtgcctagcctattaggcgcgtatttatacacgtataatgaccatatatgcgatgcaagcaaagatacactctccagtcatagatgcgatgcgatgcgagcttaatttggagtgattgggtagttgagcacggaatcttctcttcttttgacccagtcatccactagctagctatattccagctgcatgcgtacatcatagagtagtacagtatattatacacactcgtcgttttctctgatggcgaccagattatacaaaactccatttatttcgttttcgcaaagtccaacttagtttactcacttatatataacaccaaacaagggcgcttcacttgtcaacaacacgtactgcacgctatcagaatcgatagctacacttccgtcgattctctctgcttcctcctccgataggccaggtttaagggaaatggcactaattaacaagccactaggatccagttgtaacgataacaatccaaggtcaaaatcgcccgcacacaactcgctacataattagttgctccagttgcgcatgaatgccatgtccatgtttctgtttgtcaacgcacaccgcttgcacccattctatttgtggagcaaactctgttttttttaaaaaaaaagcgttctcacaagtcatcgaatatgcaatgtcaacggcttacattaagtatggcagaaaatctttttaatcccctctaaagacgcagccgcggcctctccacatctgcatcatcgtggaggctgcctaggccgcgggacggcgggaggcgtggccttcgcttctggtccgcacctctattggatggatggatccattctctctagtgaagtttgatgaaacgcatgaaaatttccttacttgtgtctctgttctttaaggataaagcgacaacgttgccgcaacaggaattgcaacggttaactgctacattattttttaacgcatctgcctgtaaacactatataaataatatattttttggcttcctaaaggaagtagcacaaatagttgatagttattgttaccttccctcacaatggatattgcaaaacaggatgtgagcttttattgcttattcattgctttaatcctataccgtggacaactaaaaagagattggatagacctgaaagccttttgtgtgtatgcggagtcctgcggaaagcgaacatgcccgtacctatagtctacctaggatcgatctaatcctaggggaatatgtgactcatagtggaattagttgaacattgaaattcaaactttggtaggcaacccgtatagtctattgtgtacgggcattgagtattgcctttaaaaaaagggtatatgagactgccaaataatcgttcgatgaggtttaatgggatttcagacactttatgctgctcattgatctagggtttcctttgtagtttcttaaggagatgtttgtagtaccttgagaatcaggatgggaatggctagggtcaatccacttataaattgaatcgatccttaaatttactctaatgaatctttagaatcactccaaaatgtaaacggatcaaaccattagaacttgcacaatcctagcaacaggcgtccaattagtaattccggagtgccgcagccatggcgatggttgcgcacatgacctccctagctccaagctgcgcactgctacactgtgggcctcacatgtattggacggagggagtgtattatccaatggatacaggtaacccattatgggccccacatgctttgtataataaatcgttcctataaaatccaataagtttttatagtgtgagcacgagttttaaaaaaattgtatgtccgagttttacctacatgtaatacgaattttttggtctattagtaatgcagatgatccatttgggtgttcatggataatctatcgatataatgaactcgtagtggattgaccttgttagaccatggatccataaactcagtggaaatggtttaggcacgattcatatcctaaccattcccatcctgacttggcatactccaaaaagccgttgaagtgaggcctaaaatcttgaaaatggaagttggagattttgatcaatggtgtctccatcatcgccaaccacagtaaacaactaatgttcttgattacatttcataatgttcactgtagatggtcgtatggaatttgacggaggctaagatgacatggtaacaagattacaagactatggcggtgtcttatgggcagttttatggatggggcaagcacaagggacaacaaaaaagcaacatgttaggaggtggtatggctacctgtgtggtagggtaagcaaggaaaaactaccaaagaggaataaataggcattataggaaatgtggacattcatgttggtgacttgtacaagtgatatgtatagaaggaggtgcacataaatcttgattggtggagactctggttagggtaccatatgatgcagaggtgaaggtccccatgtggcagatatggtagggtggcctagctactaggcttcccttcttgcttgtcctggtaggcctttgttgctgacggcgtcaaggcttgacacaacaccccaaaaggttggatcccttgcctctcagcagcctatttgcttaaccttgtctcctttgccctctcatgaatgcagcctctgagaccaaagccatgcacgaagtcaaccttagcatcatcgcccaccgccgcgccactccttgagcccattaaccactgtccatttcgttgccttcttgcatgtggcctcggcagccgaccccccatgcgttccatggaggaggaggaggaggaggaggaggaggagggataacatgagagacgaggggacgggcaggtggcgcaacatccctagcactcacaaggcacgaccaaggctgcaacgatgacaatttagtagtggtagcgtcaccggctcctatagatagaaccaaggataaaggtatgtcctctaattggtgcaacacaggcctagatggaaagaagaaaatggtagcaaaaggtaatgagcttatttaattggaattagttaggtggcccgcacaattgtgcgctagcacctatacaaaatgatctaactttttacacatggttttattaaaaaaatgttaaatagccatttagttgccttagtctttcaaaagatcgatcctatcatcattttttgtttttagttttatatttttaaaagtcacaccagccaccactctctactctttcgccacactttttttttctgttgcccgacctcccactgcttctaatcatcatccttgtgacctttaaaaattcaacctgatatgcacacactagttttttacatgcaatgaacagtagcttcttctctctctttgtatagggccaaatttgccttaatttctagcaccaaaatgttgaggtgtgtctcattcattagattctgcttcgatcagtataaattcattttggatgcaacaaatagtagctttcctattttgtagtttattaatttttcccaattttgcaattttcatatgattttcgaatgaaaatttacaccaaatttaagacgatactagtttggacctttcaagtgtgagcgtattttggctttacgccttcgtgtggagtaaacgccctttctgttgggcgggttcggctggatcttttgttcccccttttcctttcttctccggcagcggcggcggcgatgggggacggccgcgtcggaggtggaacgaatcggccggcatggctgcagcaatacgaactagtgggcaagattggcgaggggacctacggcctcgtcttcctcgctcgcctcaaacaatcgcatccccacgctgccgctggcgttggccgccgtggctctcccatcgccatcaagaagttcaagcagtccaaggagggcgacggtgtctcgcccaccgccatcagagagatcatggtaccttcctcagggagatccgctttccctactcctccctgccataccaaaccctaactaatcactagtcttctcctcttgcagcttctgcgtgagatcaaccacgagaatgttgtcaagctcgtcaatgttcacatcaaccacgccgacatgtccctctacctcgccttcgattacgccgagcacgatctctatgtaagcagcaacgcccatctccaatcttctctcttatctattggacagtagtaatcatttgtttactccagttaacagctaatgaacctatgaaacatatcacaggagattatcaggcatcacagagagaagcttaacctccccataaatccctacacagtcaaatctttgctctggcaactgctcaatggtctcaactatctccataggtatcgtttacttcttaagttatcatgatgagtgatatgtaaaaactggagcctaacctagcacatggaactttttttgctgggatcctagcttattctgattttgtctccaaaaagaaatctaaaaattgatttcccttcctcagtaactggattatccatcgagatctcaagccttctaatatactggtatgttgtcatatgctaccttttgatgtacaactctgtcaatcttgcttttcctggctcaccggattaggatgatgtgccccaataggtcatgggagaaggagaagaacatggaattataaagattgctgattttggactcgctaggatatatcaagctccattaaagccattaagtgataacggggttagtacatccatctgtgtgcccattagcatgtttgctgctgtcttgtgtttatttcaaggcatataagggcaaaaaatggtagttatttgtaaaactactgcttgtttcctcttttttgtgatgaaccttcatatgctcatctgttcctttccttttttgtggaagcatttaatgtgttatcaatacccacaagtatatggctaaccaataatttccaggttgttgttaccatctggtatcgggctccagagttgttacttggggcaaagcactacacaagtgctgttggtatccttgctggagattgaaatgatatctttcgaccatcttttttcgctttattcacttcagctatttccttaatcaactctagatatgtgggcagttggttgcatttttgctgaattgcttacactcaaaccactgttccaaggtgttgaagccaaagctactccaaacccgtttcaagtatgggcattcacactcaagtaattgctatcgttaccttgtattcagaatcaattactagatactagactaagactgcgacattttacgttttctatgtgatgcttaatttcaagtaaagatattatcactcttgcctggaaccttcctaaaagtaaataggcagttgataattgtatgttgttgcattttatatatcctgctgtattacattttgtagaatatccatgctatgtatgccattcatttgccatttatttttatctcacagttgatttgcccatgtcttgtagcttgatcaactagacaagatttttaaggtcttaggtatggatgactcatttctcattctgactatttgattgtgtactcttcctgagataatatatgctctaggataataatataattattctccaggtcatcctaccgttgagaaatggcctaccctcgctaatcttccatgctggcaaaacgatcaacaacacattcaagggcataagtagtatgtcatgcattgttaagctgcttttaaaaacctgtgaaaatagcatttatctttccttgaggaaatagtttctcccttgcagtgagaacacaggacttcataatattgttcacttgcctcagaagagtcctgcgtttgatcttctctcaaaaatgctcgagtatgtaactggccttttggcctgctataaatccaacataaccttggatgattatcatttcttacattcatcttttgtactactaaatgttgttttaataaccttatatattcctgtttcaggtatgatcctcgaaagcgtataacagctgcgcaagctttggaacatgagtaagtaactacatccctccatttattcattattccttttttgcctagttggatacttcttatgttctcagtgtacagcaagtgcgatctggagttctaattgcttccctgaatctagtttagcaaccatgcaagaaaaacagttatgctttatttgcacgaggttttgatacttggacgaggtcttgatggtcctcagttggagctgattttgtggggtgggctggagtggtggtggtagtggtgtggcttaaagggtgtaaaattgccaagaccatctgtttagagtggctaacggtcaatttttccttgtaaatatttgtgcatcctaaaccttatatattttactttaaaaatataaatatatgcaatccttagtttgattcgctatacttctaaatgttttcatctctagtggcttggatgaaggtttaatgctgaaaactcgaggaaatactactttcgttgtggtgctattgtttattactccctctgtttctttttgtaaggctataggccctctgtttctttttgtaaggctatagtcttccctcttcctctgtttctttttgaaaggcctagagttttttcaatcattttgcaaaatataaggcttgcatgttggtattgaatttttttttctttatgtgcccacaattattacatagtctctctcccacatttataagaagcatcttactaaccatctccacacctattcttgaggtattttagtatggtggcatggtcatttgaactcttctttctcttggttttccaccctccctaatcatttttgcccactcagaataagacttgtaattttaaatggagggagtatgatttactacagcaatccttctgaacaacccttttctgttgataggtactttcgaatggatcctctgcctggacggaagtaagttatgtgtaatcagggtcttaatatactttccctaacttgcaactcttaaacatttggctttacatttcctccacaaatgaagatgactaaaatctttctctggtcagtgcacttttaccatcgcaggctggagagaaaattgtgcaatatcctgtgcgtccagttgataccacaactgattttgaaggaacaacaagccttcaaccaactcaagcggtaatggatttctgtccctgtgccacctttttaccaagacttatcagtattacttagtattgggaagcgatatacagaatatgcattttctttggtcaattatctaagttctttatacagttggcaaaaatatcgtgctttagggcatattcaattggtcaaaacaagtcgatacatggttttcaatgccatcaaagatttggtccagtgtgatttaaggaacccaactccatgttggcacattttcttgcagaattgattcgggttgctttatgaggtgcatttttataatgttgtacatttgtatttcagccatcagggaacgcagctcctggcaaccagtctgtggtaccgagacccattccgaggcaaatgcaacaacccatggtcggtatgtcgagaatgggtggtacaaacatggcggcctttggtgcagctccgcaaggaggcatagctgggatgaatcctggtaatattccaatgcagaggggcgctggagcccaatctcatccgcatcaggtaaaaactgctgccttggaagtaaatgttgcttggaaaaaggcctgtgacaaatgcaacatttgattggcttttgatatgtgcaacagttgagaaggaaagctgatcaagggatggggatgcagaaccccggttatcctactcaacagaagaggcggttctgaccgactgaatttgtaattgtatatctatttggtgtgttacttgtgagcacgcttagcttttgcggtggttgctcctagtcgtacagtgagaattgtatctgttctgttgtaattgaacgccatcacaaccaacacctctactagttagttactagagtgactacgcagacagggccaggttgccgatgatgccatcaccaatggagacaggcatacccagccagagtttcgccaatactctgccccctgaacccaaccaatgaatgaattggcatcgtacgatctatttcacatccatgctctcataatgatacaaagccatttttcgtcagaagagaaatgcatcgagtgccctttcctactaaaggaaaaaaaatatacacacaactcttcgaatctgaaaattcacgaatacaactggttcaagagcaaccacaattatatcagtacagtagcagcttcatatatttacaaccactcccgcttccacgaaaagatgaactttcagtaagtaaaccaaccactcctcccaagtgcaagtgcatcactgtcacctgtctttcgtaacactacagttttgcctgaatcaaagctttactaaaaagcctcgcccagttcacgaccaatagctacaacaggagaggaggaaatcaaatggaaaagaaagcaagatgcaggcatcaagtcaatccacatagcgcaaggatcaactatcccttgttattcttcatgacgatgatgttgaagttatccgccctgaagctcgcatctcatccagagttgttgctaaccagtccaatccttcatagaggccatcgcctttgagagcacaggttccttggatatgccatatacggttgttcaggtcatatagaccaaggccctcgcatacttccatcggagtcattgcgcccctctacactagcagatacattacatgggtgagcaacaattcagtggcaaataataaagccattaagttatctagtgcagagtcatactattccaatggtttcataagtgaatgcacaatgccaacaaaatttagcatcatcataccataagcatggaaacatgccaacaattaattcatcatctgcaaactcaacaaaagatagaagtgcatcaaccatgaatggcagcaatctcacatagtgacatgggcgatgggaaacacaagttacatggatgtgaacttcaataacaaatgatttttttcatgtactacccagatgatgaatttacatatacaggaaacaattatatattggaaaaaggtaatatagtcatctgaacaagctagatgatgttaaagtagctgccataagaaatacaggttctggaaaaagaaaaagagacaagttgagcataccatgtcttgcttgttagcaaacaccaatagaacactattaagcataaaagggtcattaataatggcctgaaagacagattaccacacagtaagttagagcaacaaggcaacaaatgtcagtgcagaagcaaacacttgctgcctcataataaattatttatacatatatgtaaacctgaaattcagctctggctctcccaatcctctctctatccagggaatcaactacgtagatctgcgagtttacaaaagaagagaggaatttacaacgcaagaaaagtgtttctgaaaccaaaatgtgcgtgctaattaaataaagcaacgtggatctgtaacataaaaggtccttgtaggcaatcttgagcaaaagattattaggagctgtaatgctatttggcatagcaattgttgctcttggtgggattgatgtggtttttgataagcaagagaaataaagtcacaaagtgaattgcttgttcaaaggaggtacgttatgtgtaagaaatgtttccctatgccgctggataaaagaagaggggaaaaaaagagtgaccagagcatcggtgttgttgaagtagtgcctccataagggcctcaatttttcctggccaccaacatcccacacagtgaacaccacattcttgtattgaactttctccacgttgaagcctgcatgatgatgatgatgatgatgttaggttgggtttggatttggctcaaaacaaaataaaagattcgatgaggcggagggagggagggatgagagtgaacctacctatagtggggacggtggagagaacttcgccgatgtgcagcttatagagtatggtggtcttccccgcggcatctagcccaagcatcaccacctgccagccaaaaccaccatcatccatgatccgtccaaaacccaatctgagacgagacagacaagagtggaaaagcttggggtacccgcatctccttgttgccgaagaaggcgtcgaagagcttgcggaaggcctgccccatcccttcttcgccgatcgtagcggccggatctagaagcttccagaagattccgcggcgagcgaggaggaggaggcgggtactcggctggagcctggagcggagccaaagccaagggagccaggggggagacacgagagaggagacgacctacctgccctgccctgcccgtcgtggattccagatgccgagccgaataatctgggccgtccgatctgtgcggggcccacctctagttgagtgcattacctttcccttttttattcatttcatatactttgaaatcaactttctagtaatattcatccattgggcctagaggtagcaagtggcaacggcttgcaatttgtagtgtgtaaagtagtaccgtaaagcgctttgttacgtgaattacttaaaaaggtttttaatattttttcaacaattaagctagaagcaaaagagcaaaatgaaattaaggaaatgtcacagttcattaatactaatcgtgaaaaagacaaatgatatccatgctttgatgcagaatatattgataaatatatattaagtattatagatatgatagatatatatgttaaaatattgtggcttgtggaaaagatgtgaaggatgatgattgaatatgtttgcatttcggtttgtagaattcaataaatcatagatgaggttgtatgcttgaatgaggtttgatgtgtaattattgctagtggataatgatatggtatggttacatattaagttttagacttagtgggttgtaattttatatatggtatacatattaagttttagacttagtgggttgtaattttatatatggtatagattatatgactaatgtactactgacatgttaagaacatcaaaaattgataatgtgtatagtactgctgcaaattagtacacaagttatatgtgcatagtagtactgacatgataagaggtgcatcgtaatacttaattagtgtgttcaataattatttgtcgattttcttaaataaccattatttgttgactaaatatgtctttcaccatctttgtgcctttggaggttcatggcttgcaccaatttgattgatatcatttttttatttatatgggctttaatcccgtgactatgtaaccctttttaattggtaaatagagaatcgatcattgtacaatgcttagcaagtgatcggttaccccgtagcaacgagcgagggtatgtgatgaggatgttactagctcgggtatggttataaccatacttatattacacatcaacaatctaaaagtgcatatattttatataaggtttacttattatatgtttgaacaaatgttactatatcatgagttttatatcttctcatatgcagtaggaattgaaccctgtatacgaaaatataatcaaatattatcaaggaaagttttctccatagacttaatgtgacacccaaaagtttccactataaaataatatggcattgcataaatatagagcaaataaggtaacaaatatttattaaaatatgaagaaatctaacctagcttctcaaatcaacgaaaagatatagctcaatatttttctaataaaacagtaaaattatatttctaattttttatcaattaataataatagaactaattatacactttacttttctggagacttacaataagcaaaactacattcatatataactataaccagtatggaatggctttaaaaagacaaaaaaaagtcattaggcaaaagaaaaacagttctagagcattgggctagaaaaaaaaaatcccattcaactgatcacctcaaatatataattatgtacatctagaatagataaggctaaagattttatcctatatatgataaatatatatattttttccaattcccataagaaaatccgagttcgtttcaggaatgcttctgtccgattcctatttcgacagacagtgatctaaccgtattcgtttccatttttgattcgaagaaaaaaaatgggaatatgtttgtttgaaaaaatttatgcccgacacttttcattttcaaaagcaggtgaaattttccaaacagttttcatcactacccctaaccctcaaaatcgtagtcttggtgccaccagcccaccacgcgacgcgatggccgttgtcttgacttgctcgcgctcgctctccggcctcgaccctcctggcctggcctcccctcgtcaaggtcacttgctcgtcgccagcaagaggtacaatgcaggaggtgggggcttcatgccgttggatggatcccgcgattggtgcggtgttttcgacggtactgtatgttaccaatcatatacggggtaaagaaaatactactttttacattgcgtggtccccgccttccaccttcttttacagaaaatactgtactacttttgtggctggtgtgttccaggacatgccgtccctggtgttccccctttctcccccgcgcccctccgcccccaccccccgcttagcctcgccgacacggcggcgatggcgtccacgccgcagactaaccggaagctggctgttctacaccatgccatcggcgatggatgcacagcggcagatgaggttggtgtgtcgagcaacaagcccgctcaagaagagcttgcgagctcaatgtcctatacatatctcatcctgagttgcggctcgtcgtccggatctcccatggtcggattcgcgtaagcgtcctctgccccgtgctctttggatgattgcccttatcagctagctgtgtctcttttttttttctttgtccagtcttggtggtgagccgataggcgatagccctgttttttctttgttcagtggagattgcccgtatagctacttgatggagattgtggaacagcaagcagcgaatgtggggggcgtcgtgcagagtgatcttactggcgtgtgcgaacaacaaaaacatacctattctgaccaggagaattgctatgcagagaatgcgagtgagccgcctgagtccagcaatccttcgtggtgagtttgttgtttgtcatcattttgcgaaacagaaaatggtattgcgagttcgcgttctgcgtttcgtaaaactctttttttttttgccaaaacaaaatagtgatgcatattatgactatgttgtctcttcagattgggttgtttcttcggatcaggctgtagatgatgatatactgtcctttggatcaagctgacggaaggtttgtttttttgaatccgtctctgcattttgaagtttttttccggaacaccacttgtggaatggtaaaaaaaaaagagcatcttttttgcctgcagtgcttattggttgccaacattgaaagagagcactcctggcgccgcaatgctaattgatgagatggagctgaggcaagctgatgagcagcatccaggcgttcacgccccgcaaagtccagcagccgtgtccggtgtcacccgacgagctccggactgaccgcggcctgctcgagcgctgcgacaatctgctcggcagcatccttcccctgcccaaacactacgattttcattcgtactgtgagcggacgccggcgagccgagacgaaggaacaacacgagcttcttggaggtccttctccatccgttcattggcagacgctgagacgaggcaggagcacgcattcttcgtcgccgccacgcaagaactccagggcttttaaagtttcaattttttttagcaataatggtgaacgaatttgtccatggttgcttgtttttcccatacattttgttggacgaaagaaagaaacctacagcacatttgtttttgcacattctgattactgagatgttgtttaaaaattattgattataattaagaccaagcgagccaatttttgggatgaccaaaattgattcgaacttaaataaaatcttttttttatctgagcttatttgttattgggacatctaggagcacacctatatgtgtattgctctctgggcttggtacagtacctgcttcctctgctggcaaaggaagatagcaagatgaagttgagagagtgagacttcaaaccaaaagacctcgcttcttttttggatgtaacttcatttttaaattttatgatgtttttttttctctctcgaatacttttaaattgacgtgtgacgaaggtgttggtccaaggtaattaggtctccgtgcatttttttccatgtcttttttgctcctggttagccaagcgtggtgtcatgttagctgcaaattgtaaaaaatgtaaccgtcggagtaggagtcgagggagaccggactccgttgtgcttgttggaggggatgatggcgccattggaggggatgacaggtgtgtactgcgcgcgcatggccagcacacagcgcagtgagagcgccaactttatgctgaagagcataatgcctagaaactccaccttgaaccgtttcatcgagcagtttgcaaagctccagtttgatagagagagtgatgatgccaacgctgagaaggctaacaaacaggtattgtgtttaaatctaaaaaaaccttccttctcgattttgtaaaaattttgagcccacaatagttaacctgacaaaagaaatattgcatcgtgttgcagaagaggttgtggttgaagccaacgttccctgtagacggagaactaggggaatccacccagtacgttgtcaccggtcatgtggatggagttggtgctttgagggtaaggccgtgtttagttcacccctaactaccccaaacttctaaatttttatcacactatatcacatcacacataaacttccaacttttttttccaaatctttcaatttttcctaaactttcaactttttttttaggatctaaacacactaaggtacttcgatgcagcccgcaggaagtcatggtgcagagttgaatttgaggtacatgttgatatgtggagcagaagttttttttttttattttcaaccaatgtaatttatgaataaaaatgaaccacacaaatctataaggcatgtggcgcccattttcttccaatgctgatgtacattgcgtacaaacccagctgataccgtagacgggtgtctccccatgcttcggccgccccgcaagcgtgtcagcatccatcttagcttctggtcaaacattgctaattttggctcgacgttttgtggaatgctcagctccccctcgaacgcggcattgtccaggtaaaggatctaaagaaaaaaataaaacacggtggatgagtgatgaataacggtgcttgtttgtgttagcgattcatgacggcgccacgctgaacttacctgcaaaagcagtgagcatcccgccttgttcgccaccttatctttatgcttgatgtcgtgctgtgccttcggtgcaacgtcaataaggtggtcgatgacgtatttcgcccaattgtagttcttgatttcttccacattaaggagtgccccccagaagtcgttcgatccagatttgtgcgacatcttcggtgcaagaaacatgccgacaatccacacaacaaatgtggtcctaaaatggtcctgagcccaattgttcatggcgctgggaaatatcctcttaattacttcctcagcacccttcagtgcgttggactcgaagccaggagcactgatataatattgcacaaaagagtctttctccttttttgtgttgtgcggcattggacacacctccatgccctcaaatggaatgccaagcactctgttaacattcctaggactgattttcaactccaagtgtttcgatgaactcctgctggttgcccctcgagcttcccagccggctgtgttctgcaccggcaggtccgtgggtcccctgcgatggcaggatccccttacattgaatctgactcgagagcgtgtccagtgcctggagcccatgatacagttttagccctccgatccatcagtcatatgctgtggataggcaaaaagaaaaaaaatagtatgaattaaacacacagctacacaaatgcttatggattcacaggaaaaaaattgctaacgtgatggaaaaagaaacaaaaattaacaacaaagctacgcactgcttgtgcattttcacggaaaaaatacaaatgctaatgtgatgaaaaaagaaatgaacacatccatgcatgtgctggtactgtgcgtcgcggtatctgaatggactaatgtggcatcaggggatgggggtggaggggaaattcctgagtggtcttttacggtgcttggaaggtaccctaggtacctctttaacgaactgttatccaccgttaatcttcaaagggtaatttaggaacaaaaatttttattaacaagggtagcttagtaattacttaattctcaccccgtcgagtgcctaaccaatcggccatccacgatgtcatgcaggtggcgagcggctcacctcaatcgatcttcagaatatgtacgtagtgatcaaatagccaaattaggcgcagaaactagcaggggattggatgcgcagcgcagggcattgttgatttgtttttgctggcaaaatcgatcctcagaacctggaatacaactactggatgcatgaaggcctgacgacaaagaacgagcaaggaactagcagagcagacagcagcccggggattcgtgcggcggtggtgatggcgacctgctgctgcgtacctcagctgcgaccggcgggcgctacgggcgcgtgtgacggcggcggtgacggtatccggctgctgctttcgtacgctaggaccggagggcgtgtacagcggcggcgagcggcaggcttttacggcagcgacgacgaccaacaggtagttcatgtaggttcctctcgcacgcgttcttattcttcctctcttttttttcttcctcctgctgaaatgtttgtagcttctctcgcttttgcccttcaccgaaaaataatttaatgaaaatcaattaccattttaccctttcaccttacatacctagcccatacttttaaaacctttctccaggtactttctctctctatccgttagatcattgctgatcaagggtcctaattaattctaagcattgaagaagatcttacctgatggactcccttggacattcgtcggccggatactcgacgagaccggacggtgcgccgattccgccgacggaagatgcaatggagatgcggggcggcagccactacagcttccaggaggatgcgagtagtgcgtggggccggtggggcgggggacggcgccggtgggcggctggcgaccggcggcggtgggtgtgggttcggtcatggtggctctcagacgatggagagagatgaaaactggaaagggatagaatgtatcgaacggatatgtggcggaggatacatggggtcgtactccgtacacacgagctggtcccgcgtactacccttccacagggagtctgggaatcttacggtgggtcaggctgtatttgagcgagcaataaaaaaaaacaaataccatgctagcccatacatatactatctgatactgtaaaagtgtgcacgaatcttcaagccatcgtgtggttgtcagcctaggtgccgcagcacctaggtgctaaaaggactttccggtacaatgcaatgctgccctggtcgtatatctattgggcttgggcttctctgtttctgcccttttttttgacaaattgaccctattggaaaacttatttcgaaactaacccctgccaaaaacttcaaccaaaaataggccgtcgcctcagcgccaaacacattggcgctgagattggcagtgtcagcgccaacgggactggcgctgacattgtgccactgtggcggccgggccgatcccccagctgacgtggcagctacttcagcgccaacctgcctgacgctgaggtgggacttggccacaacgaccaaggtccagaccagcaagccttctggatggcttgcgggctgggacctcagcgccagccataatggcgctgaccgtgggaagctcagtgccaaccggcctggcgctgaggtgggacttggccgtttcggccatggcccagcccagcaagccttctggatggctgggctgggaactcagagccaggtgcactggcgctgaggttggacatgtcagcgccatttatcctggcattgaggtcccagccttgctaaactttagcaaaactttgcacacaacacaggcaaacatcaaatcacataaattcacaggcagtaatatatccagagaaccatacagaacatacatccatccatcaatcccaacatcattccatacatccatagaaccatgcatcaagtccatccatctatcgaaccatgcatcaagtccatccatctatccatccaaccatccatctatccatccatccattgaaccatgcactcacctcctcctacctctagtgcgaggacgaggcacgtcgggggtgtacctccagtcctgcgaaggagcccaccggcgtcgtggttgagacgggccgggctgcgagagatccggctgtgacgactctggtgcgtcctctagctgcgagggaccgagctcatccgcctcctcttcttcgtccccctcctcttcttcctcctcatccccttcttcctcctgatctccttcctccgcctctttgtcttgctcgccctcctcgtcacccacctccccttcttcatccccctcttggtgggcatgagcatgttcaaccacatcagtcgacctgcagccgagccttgctgccaacttccgacatcgctgccgtagtctctgcataaaaaataatccatgttaagttatcgcttttggaagaaaacaccgtaatttcatctctttccaacgattacctgtagggcgttgcggagggtgccgccctctccttcggagccaggagccgtgcctagcgccactcccgcatcgttgacggtccgcaagagctctcgagcctgtaggattgaaatgaagtaagtcacaacatatatggcattgaaatgaaataatatacaatattaatgctagaaactaaccactctgtcgcgaacaggtcccgtctcgaccgtggtacctagacgggtacgagtatcgtactcgttctgctcctcaacatcctcggggtcatccgctatgtcggctagtgtccaggccggacgtaggacaagacggtagggcctgtggagccacgccaagtacaagtcgaactccgtcccgttgtgctgaccctggtctggtactccattctcctcgaacttctcccattgcgtgatatgatcctgatggtagtaagcccaatcagtcaccttcttgttcttccgacggtcaaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgctgcatcacgcggtggcacatctggaactccactgcatagaagcagatcagtgggcaccgtagggtcttcaacgcatcctctatatggcacatgggattcagttctagctcgagcgcttcctgtgcctgatatggcatccacaccacctgcagcaacaaaaataaaacccattgaagcacatttagtactatatagtaagaaaccatcttcatgtgtgatagaaccccgaatagcttacatgttctggctgtaggtagtccatctcttttgtgtagtggtagtacgccaaattcctgcggcctactactggagatgggaccgattcccacaggtgagctacagagggacgtcggtctgcatcctggtgcggccaagcctgatgggtcctccacatgggccgaccaactggaagcctcatccacatccaaacctgcgtcacatacgttagcttccaacatgttagcaagaaattgaaatgttacgaaacataacatgcgtgaacttacctgtagcaaccaaacacagcatgctaggttcacgtccccgccttgccttcggcaagcatcacagagttgccgttacaaccaggctagggcagccgacccccagctgaaggtacccgcctcgtcccagtccgcgagcaacggcagccacatccaagaagccatgtctccaccagagtcagggaacagaatactgccgaagatgtatagcacatacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtgaccggaaattaaatggaatcattagtaattgcaaaaaaattaacaaatgaataggaagactcattagtaattccccgatgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgtgccatggtcacgaacgccaagagcttcgcccgctgtaggtacgggacgtaccagtcgtcgaatagtatgtgcgccgtgtgacctcttactcgaagggtcttcaagcgctgcatcaatagacaaacataataacataaagttagcgacaatatatcatatacaagggttgtggaaaatacatcatgcaactaggaactttaattttgggattgagcaagaaaactgaaaagaagatctgtgtgtttacatgttctgctttgaggctcttgaatcatgatctctctctctatgtacagtgtaaaaaaacaacaatatttcataactggttaattcggagtattcatttttctttctttcaaaaaattatccccttcagtcatagttgtttgatgtttatgacagaattcgattaaacttttaaaattatggaaaaaacttatcttaaacatcaaatatttatagttgtagtattattctgcatatgcacaaatgaacagggcaaagctagcaaatattaacaggatagcatatgcatatgcaacagcaacagggcattgggccaacttcaaatattttgtgtgtgttttatttgagatatctctatgatggatgatctatctgtacaaactaaaatcatagaagaaaaaataaattcgatcataaaaaaattccatattgttgatgctaacctctccgctggcaatctgtggggcccggtgcttctcctcgtagaaatcctccaaccccggaaagtgctccatcctgcaaatgaaaatggaatcattagtaattgaaaaaatattaaatggaaaaatcacaatgagaacggaaaggaggacaacagaaagtaaacattgaagcaacaatatgaacttaacaaatgaatgacatccaatcccacctgtgtgctaccctcaccacctccccccgtcctacggcgctttttcggtcgatccttagacatgtctcgcttcgggcacctagttttcttatggcctagttcgtggcatagcgagtatctattttgcatgaccggctctgaatttgtattgttcggcttttgtgaccgtcggttggctgagcctttgtatgctttgtccatgtcgttcttgaaccttcttgtccttcttcttcctcgtgtgttgttctttaacgacaagtcgggcacgaagaactctccatcataacttggccactgcgatggatctaggtaaggttcaaacctaggggagtacgagtcctgcacagccttattggaagcttcataacacattcggggggccacctccacatccaaacctcgcaacttacaaacggttatcatgtgggggcatggcaagtgatggagctgagggaactgacaactacatgtgttatctcgagcaaccacgacgtagtgacgtccaccccattgaaccccagccgccgtgactccgccttgctcgctgacctcatacttcatcgaagggaaatcaaaacatgctgctctttgccccaaggttcgtctttgttgctcctccaacatgtccttaacttttgtgggccacttctttccactcaggatatctacagttgcctctttgtgtctatcgacaaaccaactattgcacttcgaaaatgtgtatgccacaatagctgtaaccggcagtttccgaatgcctctcaatacattattgaaactctcggccatattactagtcatgatgctatggcgacgcccgttggtatcaaatgctcttgcccatttgaccttaagtggcatgtggtcttctagccacttctttggcctctctccgaccacacccatgaggcgttttatctcatctaggaaaaatgctttctcatttatttgacatatgcgctcaagatctttcatctgatcagtcgtagctccagctgtgtagaagttagcacagaagtgcctcatgcaccacctgtggtgaatggttaggtgatgaggcatgatgtggatgatggagttcaaaatgccagggtgtctatcagaaattatacacacttctctattaggaccgatcagcttgtttctcaacatgttgatgaaccactcccagttggatgtattctccttctctaccagagcaaacgccaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgtctctgtactccatccaccatcctggacttctcggggtgagcctcaacacggaaatgcatggtagggttctttgctttgatggcacgcatcagtgtaggcaagcgaacatacgcctcgtcccaatctccccaaatgaccttcatagcatcttgcttagcacgccatgctttgccatacgtaggccgatagtgctatatttgctcaactgcctcgacaatcgctgctggagataaagtaggttcagctcgcacaaatgcatgtaacctatttccaataaaccttgaagtaagttgcaaatgcttgccggttacttccgcactacagcatgtgtggtcttcgcccaccctagtcacccgccacctatctcctccactcttccttgcattaatctgccatttgcaatggcgatcgagacaagccacagtatactttactgacgcgttagattccttcacatggtacggccggtggacacggatagaataactctgtagccatattttcagatcatccatcgatcgaaactccaaccccttccttggttcatcacacattggttcgaaggcaccgtcatattgtggatccccatcagcaattgctagcccggatctggtaagattctcgaattgtgttatttccgggtttctacccaccagtttcgcaaacacagtcctttcatgctctgacatcttacgcactagacgatcatcatcggagtcggaagcggattcatccaattcatcctctgtatcatactccaaccagcctgggttcaatccactgcgtatcatagcctcctcacactcctctcgggtatagaatttcagcctagccaactcccttaggcccatacttacattcttagcattcgcttcttcctcaggcaactccacatcatctcctacctcccgaccatcctcaacatctccttcctctcttaccagcacattctcctccacattaactttctcccttaacggcacattatcctctgcatgtacttcctcccttaacggcacattctcctctgcatgtacttcctcccttaccgggtcattctcctccctgacctccacatccgccatatcatttactccctcgcccccctccacgtcttcctcaatcaatttttccttcctactacacctctccgacagttcgtgacagttaatgggtgattctatgagtagactttcattaaggtctataagttctttcttccctatcctaccatctttcttccatgcaaacacctcaagagatttgaaatgtgaccccaatactatatctatatatgtttgccattcgatctctccattcaagtctaacataaacttatgtgacatgacaccgccgcccacatcgtatctcccttgcataccaaccgactcgtcactccaatccaattcatgcttgatgcgagacattaactcctcaaaggtaggtttcacagaaaacactaattgtctaactgtcattccctcaaattggcttccatgtgtactttcatctaccacacaaccaccataatgaagccggaccaatctatccatctacaatttttaacccatgcataaaaattacttacttgaaaataatatgtaattaccattgcaataccaatacttcaaaagctaacaacatgtctaatttttccaataaataagtaccttactcaaatactacacattattgataaaaaaaactctactcctacaaattacctacccttcaccacacatcaacccctttcaaaccctctcaatcaccacaaatacatcccacatcctaggccatcaccacacatccatctcccatcaaaccctagtgcatcaccaaacattcatcccaaatatattttgtcaaatgtatcaacaacaaccaaatggataaagatatgccacctccacacttcatccccacccacattatccatctaataatccatccttagccaactattatcaaaccacgtctacaaccaaaacaatacaaaatatccaataaaactttggggaacttagggtttatagaggggtttaccttctcttccgatcccaaactcaatgccacacaaatcaccttcgattagagaggtttttgggggagattgggcgaggagaacgcggtggcgaccgaaccctaggcgggcggctggggaaaaacagaggactaactggctggggcggcctcggccgggctcaaagtagccaagatcagcgccaacgtacttggcgctgatgttgggcacctcagcgccgaagcggttggcgctgaggtagctgccacgtcagctgggggatcggcccggccgccacggtggcacaatgtcagcgccagtcccgttggcgctgacacggccaacctcagcgccaatgcgcttggcgctgagccgacggcctagttttagttgaagtttttagcaggggttagtttcgaaataagtttttgaaaagggtcaatttgtcaaaaaaacggctgtttctgcccaaaagctaccaattcgatcgtatgcagaaaagtttgtcgtcagttcaattccctggattccgatgttaaattcagaagcaaactataggctataggtagaaagatacaagatgcactgctgcagactatgtatgatccatcttacagatgagatgagatatgcgtgcgtatatatggtatgtctatgatgatgatggatgaacaattaatggtggaggaagaagaaggagatgatagtggtagtggctagggatgagaagaagaatgcggtggcgagggcttcttggacttgtagcgggcggcgagcagcaggtagagggcgaggttggcgaggctgatgagggcccagagccagaagtagtagtcgaggtgggccgtgtccaggtccggcgccagccagccgccggagccgtcgctcctcttggtgaccgccgccacgatggtgacgacgagcgagttgacgtagaagccgagggagagggcgaggaaggagaaagcggagcagatgctgcgcatggacccgggcgcctcgccgtagaagaactccagctgcgcgatgccgctgaacacgtcggatccagccagcaccacgaactgtggcacctgccacaagatgctcatcgaccgcttctcccctcgcagcctccgcctctccaccagagcagccgtcgccatggccaccaccaccagcacacgccccacgcccatccgctgcagctgcgtcagaccacccgagcgccaccacctcctcgccaccggcatcaccaccacgtcgtggagcagcacccacagcagcatgaacaccacctccaccgacaccagcgacgccaccggcacccggaacctccccccgaacaccctcgtgtccatggccatcccctgctggatgaaggtggtggtcatctgccccagcgacgccgcgtacagcacgcacgtcacccagatgggcactatccgcgccagcaccttcacgcgctccacctcgctcaccgtgcacacctcccacacgccgcccccgtccaccctcacggcggccttgtccagccaccgtaacccctcggtgtgcgccagcttctcatcatcgccgccgttcttgttcttgtcgtcgtcgacttcgtacaggccatcgccgtcggcgtcgggaggcagcgtccgggtcctgttcctgaaggcggccaccagcaccctgaggatggccttgatgggggtgtcccccgtggggaggcgcaccctgtagcagggcgtggctgccaggaacgccgccgacgcgatgagcaggcagagcgtggcgatgccgaagcccagcgcccacgacacgttctgctccacccacgatacaagcgtcccggccacgaagatgccgaggttgatggcgccgaagaaccagctgaagaaggattgcttcgtcttctccggggccggggcgccctcctgatcagtgtcgtggtcgtcgcgctcgtactgctctgccccgaaggggagcagcgcagacttgacgccgcctgttccgatggaggtgaggtagagcgcgaggaagaagacggagaactgggtcccggtggccggtgagcatgggacgccggtgcacggcgccgggcgcagggaggggacagcggcggagacggtgaggagcacaaggccctgcacaaggcccgccctggtacgttatccatctccatgctgcatgtatggatcggatcgagtatgaaagagcgaatgacttacggcgaggtagaagaggagggaggcgaggatggtcctgtactttccccagtaggagtcggcgaggaaagccccgatgacggggacgatgaaggtggtgccattccaggtgtcgacatgggcggcgttgaaggcgagggtgccgtgaaggacggtggccaggtacaccaccaggttcagcgccacgccggagaaggcgatgctctccagcagctcgaaccccaggatggtggccggcccaagcttccacttccacctcttcttcttctcatccctgcccctgctacgacttggtggactacccatcatattattcatgctcatgccgcccgccccggatctatcccctaccaccacctttctagctagtatctcatttcacgatacgaggcagcgaggtcgtaggctcgtagctaccaatatatggattctgtactaatcctcagctgctcctgctcgatcgtatatcatcatcaacaacaactgtccggtttaattagtttgattcgataccatcatcttcttcatcatcatcatacatatcgatatatatatatacactcgactccagactccagtactagtatatatgcgcgcgcgcgatgacaaagtcaaagcaccgcgctggctagctggagaaaactgtctatcgtcttaatctggcaggacatgaacctgattgagaatggaaagccgatatctaactcaactaattacaaaaatgctagctcgtgaatgataacaataaatagtaattcttttagcccgcgcaccattttaaacctattaagagatttaaaacatggcgatgagctcctttttacgctaatttatgtcacgtcgaacatgttttcagtatcaactaaagtggcgttgagaaattttagctgaacgccatcgggattgacggcgtttggaattagtttttgacatagtttatttttaaaaaacggtcaatttatcaaaattacggtagtcataactaaccgatacgtgtatgtgaagaattaagagaagcagccacaaccatccatgtatccagcttgccaaccaccacctccgttacatttttggataaagatcacctccagtacatgcgtatacatgtgcaacgatacaagatagcatagcaaagcaactactactccacacccacacagtggtcaattcatggtggtagttgagcgatccatccatcttgccatcccagctgcagctgcagctaacttggttaatttgcctttgcgtggctagattgcttcccttcaattcaagctatctatctatctatgtattgtatatagcagcaacctaacaacccaaaatgcatttcgatcgaaccaatttggcagcatggcactggcatgcggcttaattcaattaccagcagctgctaccacctgaaactatgaacaaccctttccctttcagactgaataatcgcgtccaactcccagagaaattaagctggcctacagctgactatatttatctacaattaatcctacttgtaaaataaataatactacgtctactgctctgttttaagtcatggggtaagacttgtagttaagatcgaataccactagtattagtatacgaggatagttagtcaggcacgttggattcggccagcagccaagcatcaggccaatagcaatatactccatagtactccagtagtgtatacacacagacgacgacccaaccgcactcagtcagtcagtagattaattgattgatcgatccatttgattagattaatgagggcagcaccgttcgctaggctcgatcgatcgactaaaactaatcacaggcaaggcaaagcacccaacttaatttgtcgttaggacttcttttctccaacgatctattctgacttcctactggagtaggactatacatcaaaaataaatttgcattggccgcttaattacattactagtggtagttaattataataattaaattgcttctctgaagtctggaactagaaacctcaatattattcaggggagagaccatgtgagccacgtgaagtgcaaacgtactctctactgtaatcacctgcttagttgcctaccaaaatatctcttagtcaactggaactgctggaattgaatggattaaaaaaaattgcacgtcgcatgcactagttgggattgaatctctacctctaaaattgatagaagttcatatgtccgtgtcgagcttgcttccgtacgtgtggaccgtgtgaaaatggcataacggagaacccaaattcatagtggctatgttcggcagccatataagctacagctactgcatcataaattcgctgtaaactacagcaattcttaactacttcctccgttcgattttaattttttatttgtactgtttgatcacttatcttattcaaaaaatttgtgtaaatataaaaaacgaaaagttatgcttaaagtattttggataataaagtaagccacaaataaaataaataaaaattttaaattttttttgaataagacgagtagtcaaacagtgcaagcaaaaagttaaaatcccttatattatacttcctccgtttcacaatgtaagtcattctagcatttcccacattcatattgacgctaatgagattcattagc

SEQ ID NO: 58881 - DNA, 10082 bp, Oryza sativa
aaaaaatgaggtgaaagtaaagtgaccgtagctcaactggttagctaggttccttgtggtggaaccaacccacccaagttcaaatactagatttgacatgggtgctcgcatttacagctaattactctttcagtggtaggcaacgtaaccgtcgatagcgaggcgcctgtggtgacttcgtcaatctcaagacatgccggcccagtcttctggagaagctcataggggtagctagaggcgcctgcggtgacttcgtcaatctcaagacatgccggcccagtcttccagaggagcttataggggtagagtgtgagcgcctgcgtttgtactgtgtttctaaaaaaaatgggtgaaagccaatgaaaattttccctaggaagggagggagtaaatgacaagaggcaacacaattagagcaggtacaataacagactattagccagctataaacatattttaatgagataaaaaatgagagagaagagcagcgggctacagatctgtagccaactgcagcgcggactccaagacgcaatgtgtgtatgacatgtgggaccatatattaatagtatattaattaactattgtatgaattggctattagtttggtgaattggagctagtagtgggctatactattaaacttgctcttaggtgaccttgagaacattatgaatttaggctcagttttggcagcccaggtttccaacgcaaacagtcgacatggaaaacggagcggtccattaacgcatgattaattaagtattagctaatttattttcaaaaatggattaatttgatttttttaagcaactttcgtatagaaattttttgtaaaaaatgcatcgtttagcagtttaaaaagcgtgcgcgcggaaaacgagggagaggggatgggaaaatggggtaccgaacattagtaacaaaagcaagagtgctatcttctaatattgatcttgcattccaaacacccgtctatataattgttcatatgttttttttccaatcttgcactatatattttcttttcctacgtttttattgttgtgttttgttcctttgatccaaacatctgccacctctctagctatctctatccggtcatgtgttgtcttttgtcagaacaaaccctctacaaaatatacagataaaaaaatgttaccttgagtgaaattgtcaattaatttccagatggacttattgctgaaatgcagttgtgaatttattgacgcagcattcaatatcgagtgcatcatgaactgcccagaagaattacgagaccaacaaaaagggtcccaagctggatacatttctacatgagaaagactacaaccaattagaccatgcattccaaactagtagtagaaggtatggaccaaatgtcccttctgaaagagtcaaagagatactatgagttttggagctggtaacttgttcttaaatgtcatacagtatattgtaacactattagatggagggagcaacttactacaaaatcatggacatgcaaatctacttttttttgagtgggacatgcaaatatactgaaacataaatctagtgaattatgttttgacaatgcaaatatatggccatatgcagtaaacatatacattgtcaatctgatagtcaaaacttacgaattaagttccaatcctgaaatacatatggccctaaaaatttggatggagagagatcacgtgaaaaagaatctgaactgtaaacataatggactgtaccatagtatgatccagactcgcgtgctcatggcaaaacagtgaacttgcactaatttggatctcagttttggcgcgcgtgcgagaccaatcttagcaaggattctgcaagatccacttcattgaggccatcacatgcacgtatttatggccttcgtcggcattgtataacgaggttttgatcgatctccagttcacacatcagtacctaacccctcttggtcaagccttggatgaatacattaacttttagtctatcagaccgataagtttttctatctctggctttctaacaaattgagtagcgtttgaataatcttctctgctaagtatttttcaaagacattgccacacagtgacaagatcaagcaattttatttttctgaagtgtaatcggttaattatcccagctacgtcgaagagataccgtttcagaacagtagtaccacacaccttccatccgtggatgcaagtacgccccacgagacatcaaagaacttattcttctcatatggctctcacgcgtctcgagattcgcgtcaaaccgcgacagttcaatccactttggctgtaaaattcgtcagaaaaaggctcacgaccacctgctcggatcaacaaccgaacaacgcacaggggataaatgcatctatacactgcgcgcagaagcagaacaaaacagaacgccgaaaaagcagatgcgaatgcgacgcccagttgccggccggccgatcgatcgatcgatgcatcgacggatcaattcacttttttcttgccccggccactgccaggggaataaacgcacgtcgcgccatgccgtgccagctcgaaactgtaacaaaaacgtttcatccccccctcactgcgcagtagcggcagtacactagcactagtataattcagaagcggtagccgtgcccggccaaaaggacgctgcagtagtaaaacctggctgggtcgcgagatgggatcacgcgacgatagcgagaccggtctcgtcgtcttgctcgtcgtcttggacgtacgtacgcgtcgtccccgccacggcgccacggcagacggtgggtctcgccggccggcatgcagcgtggtcaaatacgttgccgggggtagcagtatagtggccggtagggtagaggcaggcccagtgttcgtttggccccagggagaatataattgactacacagatgatggcatcgatcgtctcgatcaggtcagagcatgctgatcaatcggacaattgtttggtcatcatgggacacgaaattttcggggcctttggggaccgaccctttggtctgaggagacctcgaaagttgcaccctttggtgaaacaatggactcggcagcagccacaggcacaaaaatggcaggctcgcccaatgacagcaacatcagcgtaccgagtgccgagtgtgttcctttcacgtcgtccattgctatctggttgaatcgtacggccgacaatgggatggatgatgtggatagagtgaacgactgcaaaacacagcactgtacttttcacctttttatccttttagaaaattaactctacaaatagattcctaaaaaacttattctaagaataactattttcgcgataccaacgttactgatgccatggtccaacatgatggcgccaatagcgttggcatcgtccccctaacccctagttaaagctaagccactaatgtgaaggggaacgatgccaatgtcgttggcactgagagtctatatatatatatatatatatatatattaaaaaacccatttgtaataaaaaaaatatttacaaataaatcctcatcatcaacgtagttgacattgaggacctatttataaatagttttattttcaaataggtccattttcgctacaaatagttttttttattttctaacaaatatgtcctcggcgcaaacgatattgtcgccgtccccctcacattgttgacttagctttcacaggaggcaagggggtatggtgccgtcatatcggaccacggcgccgatgatgttggcacagcaaaaagggatcaatcctagcataagttttttaggatctatttgtataataagcttttcaaaagaaccaaaaggtgaaaaatttaggaacacagcacacagaagggcacaaggggcatcgtgtatgcatggtggctgtcgcgttggtgtagcggtgtagtcacgtctcaggactttgactttgtagtgttgagtaacaaagggagcacagctgcacaggtgatcatcacccgagaatagaggtgaaaatggtcggaatcggtagcatatcttcggaaacgacggtcgatcgaccggtaattaaccatattaatcatttaaagtatatcgtgtcaacattaatacaatgcaaaaaaaatagaaaaaacaaaatttataaatagccaaaaacagtgcccctgaaaacggcgctcggtcgatcgagaatttccgtgactgttttcacccctaccaaggaagaacgtggataaatacacttgtagattaaatttgaccatgtgtctttggccctgttcggctggcagtgtagtcaactacaatagcaagtagcacagccatgcacaacatgcatcgcaacctcagtgctgccacaaagatgtctaccgaacacactccttttttccaaaaaaaaaaaacaactatatgaatggccagaatttcatgatcttctttctaatttatgggaatgctaacggatgggatctcatccccagcatcgcacgcggtatcatcaggatcctttgcactactaaagcattatccgaaccccatgaccatgttccctatgtggcagcgtggcaggagacgtcgatggtgagttgaggcaacgacaaagcagccttatgatgatggccatgaggttgtcctatgtggtcctcgtatgcccctacggcacaacacacacgaacatgacttggcaatcgagcgcctccttcatggtgatctccactaagctactgtggtggatctcgccgcccactgcgtcgtcacagattaatcggcccaagtacacggcaagctcctcaggaggaaaattgagataggaagaagcagcaagagggttagggaaggaacaaggggcgtggtcaccggtgcatggctgggtggaggaagttggggagagacgggggctcacagcacctcaccacaaaggagcaccacaattcgcccactgacacgcatcctgagctggcctagagtgagtaaccgatgcggggaatcaattcaatggaaagggatacatagattgtactgcagggcgcaggtatttgtcttggtatcccaaaagtattaggcgggtacctccatagtatcagatttgggaaccgtaaatacgagatttgataagaaaatactacataacaatatcccgtttggacaggatgataactcgtatcatgtcctcatacctctgaggtatcatatcctgacataatttttacctataaattatttttatcgttaataagagtataatctaactatagacaaatcgatgggtcgactgagtccacttcatgcgaccatattgttcttcggcgctatatatttgaggaaatgacctgattgtatcggaaaaggtcagaaaggttgaaggtagtaacagaaaggaactctggttgaaaaccacttgggattgattaaatttgagccctttaggctctgggcttgtttgcaatcagtaggccgcaaaggaagtgggctgcccggttggtggccttctagcaaagagagaaattatataaatttaattagtatgtgtagtgtttattgacagtcatgatcactttggtaatcacttttagctgcctcaggtacgatgctttttgtcacaaatatgaacacatgttgtgcagagtactgaagagaggtctttagaagcttctttttttcaatttttatgaaagatatatatgacttcctaattaattaattaattaatacgtcataattaattaatacgtcatcagtttaagtgaaaatcgatggaaaaatattttttattaaaaatagtatactttttagtacatatttgaccgtacgtcttataaaaaaactttcatgaaatatgtaaaattatatgtatacatataagtatatttaacaatgaatcaaatgataggaaaagaattaataattacttaaatattttgaataagacgaacggtcaaacatatttaaaaaaatcaacggcgtcaaatatttagaaacggagggagtataaattagttaatatagatcataaattgataattaatggtataaaatgtagttgtgtaacctttattttaaaccgtgtgtttttaaaaataatggttctaaataaaattatgttatattgttaatataatgggtaaaataatagattccaaaaaaattttatttccaaagattatggatctaatttatttacgtatatattgtgatatatatataatctatgtttataaagttatagttctttaaaatttaatatcactaattatagttacgatctcatctatatatgcatagagaaaagaggggaggagatggaagcgaatgtaatttttaatgatatatgtaatatatatttatttgtttttaatcgtacgttgcattacagttgtatatgtattttttttggctttttgtgagcagtatgtaagtacctttctctagtcagtgcgctgagagagattaggtgtgaggttattaatagatttaatttaatgatctgagataacagatatactaatttaaataaaaatcgatgagaagttgttttacttttttcctcatattttcttgaattttttttctaatctattaaagtgcattttagaacttaaaatattaacagttaatatgtgtattaaattattaatttggttttctatctcatctaaccaagaagaagggaaaaaaggttaaaaaaaaaagagagtactatgtatgtatgtgcacgtatatggaacagtggaacattttttttacgtgcaaatctttcacaggtaaacatagttagaaaatctgaagatagatataggtgttagctaaaaaataggagtagttaccgagaaaataggagagagaggccggagggagggaggtatagcacgaacctgcacatgccgcatatatgcacgatggggatgagggctaccggatttttgtttcttaagaggtctaatgattaaaatatatgggtccaccgatttaacggaaaatcaatggctatatgtttattaaattttttatgatattctatatttaataaaagtgccacgtggcaactcgaaagtgtttatagggtgacacatggcggtttaaaaccgtttgtaaaaagtttaatagacttttagtatataatagataccaaatatttaattaatcatccattaatagatgttttgttttgcgtgccggggagaagccatggaagctacaggttttgtaccaccacctttgccaaaagtcgtcgcgcgacggcaacgaggaccggcgcggcctttgtccgcaacgttgcattccctccaccagcgccaaaactttcctttttctaatgaggcgaagccgtgccgtgccgtgtagttcctgcccgacccagccgtccagcctgcgttcccgtcacgtggcaccagaaaacttccccctccgctccgcacgctacggactcccgacaccgacaagaaacgaaccaaccgcgtgcgacacacaccggcgcccgcacgtacgtacgtgcgcaacccggcaaccgtaggagactaggaggaccggtgcaacagaagcgcttacaaaaaacgggcaggttaggtgactcgtcccgttccggtaaattatattctgtcgaacgctacgagctgagctgttcgcgttgccagaagccccatttgtttcgcgatacgcgcgaaacaaatcggcagatacgaagggaacattccaacctcctcccacacggctccaccaagaggcgcggcccgctcgatccgctgattcaccagcgtcggtctggtcgccgagtggcaacggaggccaacccctacgcgatgccgtcgtcgagtacgtccccggcgcggcgctcttggtcaaacagagctttgctacccgctgcgtggcttacacagttcggttgattgctgcggtgcaggcaggacggagacggtgaagaacgcgctgtcgcggtgggcgcggagagtcggcgagacgaccaggaaggccgaggacctgtcgcgcaacacatggcagcaccgtgagtaccgtttcgtgttccctcgtcgtcaatggacgaaatttgtcatagtcgttatcgattgatttccctttgtgattatcgatggcctgcattgctccatcgattctgcagtgaggacggcgccgagcatcggggaggcggccgtggggaggatcgcccaggggaccaaggtcctggccgagggcggccacgacaggatattccggcaggcgttcagcgcgccgcccgacgagcagctccgcaagtcctacgcgtgctacctttccacctccgccggcccggtgatgggcatcctgtacctctccacggccagggtcgccttctgcagcgacagcccactctcctacgaggccggcggcggcagcaaaaagtggagctactacaaggttcgtacagggtatataaacatgtactaactgtgcgtgtgaatcgtgatgataataatacagtacggtactccgttgttaatggtgagtgatggcctgatgggcaggtggcgattcctctgcacaggctgaggtcggcgagcccgtcggccagcaagcagaggcccgcggagaagttcatccagctcgtgtcggtggaccgccatgagttctggttgatgggctttgtgaactacgacagcgcggtcaagcacttgcaggaggctctcagcggcttccaccacctgcaagcgtgagtgcgtgacaggcggcatcggcatttgcccgcgctaatcttcgttgttcgctgattgacacggcgtgatttgtgtcttggggtgtttgtgctctagttcttcttgctgaggatatgtttatgagtgcatcggtcacttgagattgtttgggattgcggatatcttcgattgtttggagatacatgtcacacatctaagattcctgaagctcttcacttaaaatcttataggttttggaaactgtggttgccttattttttttttttgagagaatagccaacatgatccttgaagttttgctccatgatcaatttggtccctaaccttttatattgtccaaacgagtccttatataatttgtcatgtgggctaatatagtccttagttccacttaaattgccacatgagcatgccatgttatgctctcatgcaaaatatatggtaaaatgtccaatttacccttccatgtaccataaaaaataatgaaaagaatttacaaactttattcaatgtgactggatatatggcaaacttttttcattggattatgctaatacaaagttaaattagctacaaccactaaatatataattatcatgccaaataaatttcatgtaagtagttgcatttcaatgttaaaactctaacggatatttaatatgcaggatcacctacttctttattattattatttttctccttttctttctctcttttttccctatgacgatacgtgtaagggaaaattgggtatgtcatcatatatttgcattggaagatgacatggcatgtccacatggcaattttcgatgggccaaggactgtatatgtccacatgataaagtttaagggcttgcttggataatttgaaaagtcaggcactaaaatgatctcaaagcgaaacttcagggaccatagtggctattctccctttttttaaaaaatactccgatgaacctacgaacaaactccttttcaggcagatgccaatgaggacgagtggaatgaggcaccgaacacaaccgaacgacaagggtacgcctaataggcaggtaatcgctgggagtgatcacccgccctcccctatattgtcgctccctcctcccccctccccctttctccttccctttttatcttcatactacatcataaatatttaaatttaaattcagaattgaaacggttatgtaaatttttgacttataaactttgggtctataaactaatatttgaattcaaattcaaatttgaatcgggtatgtaaacttttgacttataaactttgggtctataaacattagatgtataaactttagatgtatagaaagactatatataaaaaatatttgaattcaaattcaaatttgaatcagatataattcaaattcaaattcaaatttgaattggg

SEQ ID NO: 58882 - DNA, 15281 bp, Oryza sativa
cccccctccccctttctcctcccctttttatcttcatactacatcataaatatttaaatttaaattcagaattgaacggtttatgtaaatttttgacttataaactttgggtctataaactaatatttgaattcaaattcaaatttgaatcgggtatgtaaacttttgacttataaactttgggtctataaacattagatgtataaactttagatgtatagaaagactatatataaaaaatatttgaattcaaattcaaatttgaatcagatataattcaaattcaaattcaaatttgaattgggtacgtaaacttttgacttataaactttgggtctataaactttaggtgtataaactttagatgtatctaaatactatatataaaaaatatttgaattcaaattcaaatttgaatcgaatatatttcaaattcaaatttgaatcgggtatataaacttttgatttataaactttgggtctataaactttaggtgtataaactttagatgtatagaaatactatatataaaaaatatttgaattcaaatttaaatttgaatcggatatataaacttttgatttataaactttgggtctataaactttaggtgtataaattttatgtgcataaatttactaaaataggaaaataatgcggtgtcaaaaaaggaaacgtggagggagggagaggggaggggtggcgattagcgatcgatcgcgcattagagtttccggaacggcaacctatgttgggctgaagcagattattggccattgactgggctatgctgtttatggtccagtttggcactacgtagtctagtttaggtaataagtctaattagcatcccacatctttgctcccaattgaattgcctccctgaactataaaaccggatatgacgtctcttccaactacgaaacccgatgcaaatcgactccttcagtggtttgagaagtggtttttactaacatggcaagtttactcgctgagtcaacaagggaacccacatgtaagcaattctcctctcttcccttctctcttagggatcacttatacatttgtcgacaaatttccttttaaaaatttgacaaatgtaattatggtacaatcgggatgtaattatactaacttgcgtgtaactacaatataacttgtatgtgactttcaaaaatctctccgtaacatgctattttggtgaaacggaggttgtggaaatgaattctcttacatgtgtgcgtgatgtgacattttctccttcctcacttgcacaaatcttgaaataaatctaacgattcaaaattatgtgaaagttacatacaagttacattgcggttgcatgcaagttacagtgtaattacactacgattatactataattacatctatgaaatttttaggagcaaatttgtcgacaaatatatagcaaaattgtctctcttaaagacagttttagtaggtgggatccactcgctaagttactaaggccagttttagttgacgtatcacctatgtaaaagtggcactggaagaaaataaaaaaagaacaaaaaaacataaatgagacccacctgtcatgtaaaaataaaacaaatatgatgggcttaagaaatctgatattgtgtcattgtcacaagtgggttttgttgaaatgtcacttcataaaaatatcattcttaagccatggctggattatgtttcttatgccactcatggatcctcacgcgtactagtattatctacatgctttaattaggcccaactcatttatgtgccaaaacgtccattgctggctattctagttcttctcaagaaaaaaataatgaaaaaaaaatcacatatgaaaattacactgagagaataaaatatacaatctttatatggagggaaaaatgtacagacacgaaagcatatagaaatcataaatatcttaataagaaagttgatgtacaacattggtagttgtttcaaaaacttttaaatataactacttcctccgttttatttatattataagataccttaacttttttctggatcaaactttctaagtttgattgtatttataaaaaaaattagtaactctataacaccaaatcaatttcattaaacctaacatttaatttattttgatactatattttttatgttaaaaagtatctatatatttttctataaatttgatcaaagttaaaaacatttgactttgaaaataagtgaaaacattttataatataaaacatatagagtataatataattggagtgtatagttaaaatttaacttccatataactcatctgcagctagacaaaatatttgtgtagctttttggcatagttttaaatctctgaatatagctatttgagaagagtctagctattttctttcattgttttggtagcattaattacgagccttcattaacctagttgcgcgttgaaccgccctctccaaagcgcgattgcaaaatttgtcgattgttttctagcaattttgatttgaagtaaagtcgaattaccttgtcccattgcttccattttttttaaacaccttttaccttcgtgtgcttccccacaaacagtgcaatatactgtttgatcacaaagtgcaagctaaggagccctgttagtctgccggatcaaggaaccttaccatgaaacacaaaacctaacaatttgatctggtgcagcagataacttcatggcgctactattccttcaaacggacgaacagttcattgattggaaccactaggctaaccagattgaaccagattgtcatgcgcacgaccgttcgtacagggaccccctgacttgcgctgacgctctaccagcccgatctgtcagtcctcttcccgcacgtacggttgcgggcttgcggcgcggtggccataggcctaaaggccagtgaccacaattgcccgtaccgttccacacgatacgccggaccacacaacgaacacagcccataaatcgatcggcgcacggggccctggtgggtctcgcgcacacgcacccgcgccctatcaaagcaaccgcaacgcgtgcaagcacagccgtaccgtgcgcgacgtcgtactggccggcaacccgacgccgcacgactcggcgaagaaagcccaaagcaacggctcgcggccgggaaacgccggcgcacgcgtcacggtcgtttcgtccctttcacccgcgcctttccgcgcgcgtcgcgcggactcgcgcgcgggcggcggcacgtacgcctcgccgtgatctggtatatggtctgctgttgcgtgccttcgtgcgtgctcgcatgtgttggtgttggtttgcctttgccacggtgtgtgttggtctcgcgtcgcggggcgcttttttcggtccgttcgacgaataacaatcatgagtggtggcgaccccgggaggaaagagagattcttctgtgtctaccgacaaatcttgccgactccggtcaatggcgcagtcgttgcacgaccgaacgagtaggtggtgatctagagcacacgacaacggtaggtatatgctgcatctgcatgcaacgaaggtcgtcgcaatgtaccatctttcctacggcggtaagaaagcatcatgtcttctttgtcgtcaattttacccggaccttttgggcacactctgctagctagtgctccgatcagagctctgatgaagctacgaagcaggctagagagtagagagagagcaaggaggccgggttattgcacacctgcagtcgcgtgcacggacgcatatgggcaaatggctgagcccatcctgagcccgtgtgtgctttatacgtgctctccaactttctctcggctcactttccatgagatgcacctgcactcgcggcatcaatgtgcagcagttagcatgcaagttgcaggacgggccggggagggagaaggcgctcatgattcaaggacgtgcacgcaccattgccgcatgcatgcattgtccgtgacagtgtcgccctctctgccctcacttttgcaccgtacccacgtaggccaaaaaggaagagaggcctacagtcttgcactgacaaaggcccccggctctctgcatttgtcgcctccgtctcagcttaaacttagctagctggtgtcatgtgtacctgttttcgtgaaatttgattacaaaaccagcaatggaaaataaggtagacgcggagttaactagctagtgcgctgatgggttgtacttagcggaaaacgtttctgtttttaatctgaaaaaaaagcatgcttaccaacaagcatcccacatgcaatctatttgggaaacgtctcatgaacactcacatcacgtacgtctggtcgtgattagtagggcctacgattagatatctcaaaccatcacctcagtgttgcattatccacacaccatcataagctaaacagggcatgcacaagggttgacttctttttttccctcctaccatgcatgcatggtcaaagtcaagtgtaccgaaaagctaggcctggtttctgtgtggtcgatcggtgtcattgttttttctcctttccccccttgagatagagagagtgagatcagagactgatcagtttgagctttcactgcacagtaccagctaaggtctgagccatatgttgtgatcacgcctacgccaaagttgcagctacgcgtgaatgatcaagtgcgtgacccgctgttaccaatttaatcgtgcatgccttgtccctgcagggtcccacccccggcacagtgtctttgactggatcccttaactctgtcgagtcattgtcagcaagaaggcgacgagagtgcaacagtatggtgattagtacaagctaagcaagcaataagcccttcactcctttcgcttgcatttggagcaagccgactgatcgctacatgcatgagatctagactgattgggattttgtggttgaacttaccattgcatggtggttactactgttcatcagaccgaaaggaaagccccagcagaatgcatgatccctgtatatacaggtacagcgagctctcttgattaattggctgactcctgcggtcgttgtagagtcttattcagatatataattcatatacactactatactaaagtcgcaaacatgcatgcaaaccgggaccatgtgtctctgatagaatttaaacgaggtttggtgagccaatggggatatatgtatcagtgctgacaaacacatgcattgcacgctcagatttcagaatcggatcagcaaagtacgtactacaactgtttgtaagatgttaatttggcaaaaaaggacacgctgagggcctcatgaaatgtaggagtatacagttgtcggcttggcgggacgacagtgaatttctgtttactgatcatgtagggtgaaaatggcagcactgattaatcaaccccaccggcagaattgcacggccggtgtgaatgattaattgcctatagttcaaacagtcctgggcaattatgtaactagctagcataccatgctttattttgaatctgatctgtttttttatagggtttgaaagaagcaaaacgcctggctaatttgtttcatacctagagcaagatttgcaacaaatatatatccgatttttattgctatagcttctgcaacggttggatgaaaatactaacgatgccaagcaatgttgttgccatttagtaccacgtcatggaacatctttaatttttgacaacgacatgaacatctctgtttaacaacagcttgctgattgtgcatgatcatctgcatgatttgtcatgctgatagcagataaagacttctgctggagttctaaacaaccaagcaaccgtattacaaaacaaagaaatctactcgtactaaacagtagggatgaaaacaatagccaagaaaaagctatccctacctgtcccaaaacggaaatggtacatggtccggattcggcttgttgccgtgttggtggtatacagggcaaagcagcgtggcaatatattgacgatgcagtactgtagcatgggattcagaatgcaaaccaacctcctcatctgaaaaaacagtgacatatttgattttcctaaaccaaagtgttcaagggaccacaggtgttttgtgttcataaatgccgtctccaatgtgcacactaccgagtaggcagtgaaaccacacaccacctgggcatgcatacacgcacttgggcagcaacttggaccaggcgtccaaatgaccatagctgagtatatgttgttgcgttctcttttccctgtaggcaccacaccactgcatacttccatggcaccaggtcagcacctgggctagccgggcccacctgccagagtgccagtggccagcctgggcagtttctgtgtttgagaacaaaactttgcaaccttcaatcagattctgctactacctgcccctgccaccgcccagtggccacgcctagcctataatcctagtagttgcacaacatgctatagcctagctgcctctttgatctgcatcatggcatggacatgtctccggccggtccggccgtacagtcaggcatccacgagacgccggcccggccggccggccagcttccatttctccaagcctgcaagcgatgaagccaaccactactagctcctagtatagtacatcacgaggaggaagagacggcgagagaaacgggggaaacccggaaaagtcactgtatttttcggtgacctgctgcggtgctgttccgtcgctgctgctcccgttaatttctctggctacgcatagccaccggcatggctgcctcatcttctcttcgcagtgtgcactgcggggcaagtatccaatacaacgatgtgaaaatcgaccgagggactcgtcttaaatttgtccgcggtccatggctcgccgtaataaatgcaacaaccgcatccatgtagcatttggccaagacggggagagtaaattaaagcgtaaagctctagtggcagggagcgagagaagagacgagacggcagtggcgctgcatgcgctgggtgcacagagcatcatcagagagtgtatatctctgaaatactactgaaactgtcgccagttcgtcacacccttagcttgctgcgtgtcaagaaaatgaaacctggacggatggatggacaatgctcgcggaatgggggaggagttaatgcggtatagagaaggagcaaacggttgcgcgcattaatgcaagatcaaaaaggagcgaaaaaaatgggaagaaaacaacaaaggatcacgtcatggagtagacctggccagtgcaagcatcaaactgaacaccgatcaaagcagtagtagtaattggtaaaacgtcatggttgtttcgagatttggaagttgttaggcactagcattaatccgatcgagcacagttaataaactcatgccctgatggagaacatattaccacaagcgtccgggaacgagttcggaaatgttgtaaatgaaaagatgaagaagaagaagacaagttgggagagaaggaatgcaacagtggcctatcttttttaggagtggcagtactccgtagtagccaacaaactattgctactagcaaacctagacgaatggcccgacccatgggtaaaattatcccagcgcgcaggtcccaaccacaaaaaatataagagcacatacactgaatccatgcagctactctagctagccccaatccccagacacaattcctcacctgcgctgatcgatcacttgaaacatcaggtacattcccaagaagaaccaaatcggcaaatggccaagccatgcataggaattaaacagcacgagcaacagttaaaatgaaaagaagaaagaaccacctactagagccgagaacgaatgctctctcagtctctcttgctacagattaacctaagccaccaattaattaagtccaactctaaataaataaggttcaggtacctaccataccggggtccgggtggctaagccacggccggtcgatcagctcagctagcttgggatggacatggatgcatgcgtcgtcccacaacttggtcatgcatgccgacgatgagatcaaatgcatttgctcccggtcatggcagcttcttgcccagggtgtgcttgttgttgtgcatccacaccttgagcacgtggcgcttgacgccgacctcgtcacagaactgctgcacggcggcctcgtcgtgcttctggatgcgccacccgacgcgctcggcgaacgccagcatcttgtccttctgctcctgggtgaacttggtgcggaaccgcttcttgccggagccggagccggacgggccggcgccgagggacatgccgctgagcggccccaccgccgacatgggccccaccatcccggacaggtcgtcgccgtcgtcgcggccgctgtgggaggtggacgggagcgcgaggggccgctgcgggtagccgccggctgcggcggcggcggccgcggctgccgcggccatgtggtgctggtggtggtggaggtaaccggcaggggtgcggtagtacggggagaactggtggtgcggcgtggcgccgtaggggacgacggcggccgggagaagggcgagccctcgccggcaagcgactcggactccttccggtggaagttgcggtggcagttgcacgcggcgcagcggagcgcgtcgatggtgccctcctcgccggccgccatgaactcgccgcagccgtccacggcgtggccgccgatgccaaccgcgtggttcttgaggcactcgcggtacctgccgccaccgcagctggggcccttcacacggctgccaatctcaccaggaggcttgggcgccatcccaccgccggcaaggccatgctgcggcggagtctcgtagctcgagctcaccggcatcggcggcatctcctcgtcgccgtcgtcatggtcatcgaagtccatggtcgccgtcgccggccggccggccggcaagcttgtctagctagctagctacctagctaggaaaacacttagctttactgtcctagctgctttgtctagtctttggtttgtgtgtgttgctgagcatggaaggaggctaagagaagctttagcgaggttaagaccgagatgaagggataagagatgcagcagagtgtggacaccatctggctgccagttttgacgcgccgctagctagcagcggcagccaggcaagccgctgctggctgcagcaagcagcagcgcctaggtgatgatgtaactttgtttctctcgctctctctctctctctctatctacagtatctctctctagatagcaaactcgctttctccatttctcctcctctgttcaccgcttccctcaagagtcaagccgaaatgcgctagagcttgtctctgaaccatgtatcgtgttgtggagtatgtgcttttgcttcgccgcgagcgcgcgttcatgtctttgctgtccctttctctacgctcttctcttttcaagtggtttggctccaacgccttttaaattgcggtttagaatatttgatcgtgacatttggtctttcttttttttttcgccttttactcgaatcaatgtgtggcacgcattttttcacaaatataattttggtcaaatacatatatacttgaagtaaaacgagtgtttcccatgtttcttacaaaacaaatcgatttttagttaactatgaacttgaatatgtctatgtccaaacttacggagtatagttaggaactgggttcttcttgacaagggcgtgtgacgcatgcaaagtacattgcaccacattgaattcaatttgttcaaggtaccgcaaactacaaagccgaccaaactgatctttattaacagttgtcgtatctgctactagtactgtaccaaatcattttttcccctaaaaataacattcagatgttcaacgtactgtgctgtacgtagtaatgtcctagccagctgctttcaagggatgtaaatcacgccctccatgcatgtttctgtagtttacatttcagctggagtgatgcatcaaagtcaataatcagctactttaatttcaactggagtaatgccagcaacgttaacatcgaatcgtggaaggcatcattttcagggcctagttgacgaaagcaaaaaaacaacaaccaggcctgcatgcaaacaaaattctccacagtaacaacgggaaactgttacagccacgcgccgtacatttctatatagtatgcatgaatcggctggatacgttggtgtgcgccactgaaaaaggttcatatttgtcgatcaactatagccttgttttatatcattttcccttcaaatacgaaaaggtttattttggtctcttagctacaaaatcgcaccatgtttaaatcaggatgctgttttgatgacattgcgagccacgtggtgttatagttaacaatttaaaatagatcatatacataaaatatacttcctccattacatataataaattttttttgacttttttcctagtcataccttttctattttgataaagtttgtagaaaaatgtagcaacattttcaacacaaaacaaacatattatcaaaatatatttaataaaattaatttggttttgtagatgttgttaattcttttataaactttaatcaaacctaaaaaaattgataaaaagtaaagtcaaagtacttatacctgaaacaaagggaataggagaaaaagagtaaaatgagatgatgtgaaaaaaatgataaaatgcagataaattgaagatgtttttttttttggtgtgaagttggagcatccaacaacaagcccgaaaagatgaccgttttgtgaagtcaaatatgttgtgttgcttatgcggtaagcttgacaatgatatgatgctatgtatttgagctccgttattgtttgttgtttggtgggtggggtgaattctgcccttattcataatggcctacttttttgctagactattcccgtctagttgtttttctcttttcttataatctgttcgatttttatttttattaaaatataaataacagtccttatgctggtatatttttttaaaaaaataagggacgaatagtaaacgatctcatgccatgacatttagatatttaagtaaaactggcccacatagggtcaaacagtcagcgacgaactgaattgactggaaaagatggaggaataaacgcacacccatgcgtccaaatttacagtgtttttgacggttccaaggtgtgtggccggctgatcgataggaaaagcgttggaaatgagaacaaacaggctagtacccctccctacgcacgaccggctccatcgctacatgcgcccatgatctggtccccggccgatgagctcaagccctccattccatcacaaactcgacaatcttgtggcgtgcttacctcgtcacaataacgcccggccgttcatgccttcatggtgtggacttacacgcaacgtacacaccctgacacgcactacgcatggttgatctagctttctttcggtggctaagcggctaatggtctccaattccggccggacttaatagcccccatttaagccatggtttgtcccatccaggggcgcccatgtcacgcacgcggataagctctgctcccctagctaagcaagcaacattagctacgtacgtcctacgtgatgcatgcatctatctcgcgcgccgctctctcgatcgccaggtgggttcacggccaaaccacgtgtttatgcccttgggcttgggcgactgcatgggcggcagcaccgtgtctcccgcgccgctccaccaacgtcaacggcagaaattgggatattctaacgtaaagttagattttttttttcgcaagcgtctaaaaggatcacacgcttatatattagattaacgtaaaattagaggaatatagttatttacatataaacctcaactacggatccacatgttagtgacggtttacgttagaggacgtgttttccacctgtgagtgctagagattatgaacgaaatcaaggcggcagaggccttatctgctgtgataaggagtgtgagagttaagcaccacaggtccacaggctgctaatctggctaatcctctggctcgatcgatcacggcggacggggaggtatcttcggtcgatcgatcgctagctcgcgcatcgccatggtccacgcgcgcgtggcgtcgttggaggcgtggagcagccggccagttgctgtcgatagcggcgtatacgtggacgcggccgccgcgcgccccagtgcggtggttgtaccggtatactccgtattgtacttaaatatttgcgtcctatttcaacaacaaattcatagatttttttatttattaaagaatatatatattatccattaaatatgatgtatatgtgtacgtttataggggtgagtgtgtacatgttttaagtgcctacatttgtattgtatttgtaaaaacaattaatccacatagctgatagaacttcgattaatttgatcactaagggcaagtaaaaaggtagagaccgttagttaaagaatatcatgttacaatagttaagacaatacggtctctaactattaatgtaccaaaatacttttttactagtcatctttcctttattagactcagggcatgtacaaaggcattaattagtgggctctctttattgccatgtaaacatatttaattaggtggaagagagagaaaagagaaaggagatgcatcgatgttttgcatgccatcggcttgacatcggctctcatcgagataaacacgagcacacgagataaacaacgagcgttgtatggtccatcttcaagaaaagtcgcttatttagattcaaagtgcagaaaatcacgtaatcattgctactagaatttaattactgcatatcagtggagagacgataaaaaaaaagccagcctttacatatctatgagcccgtagcgggctcaaccgttgaacgtgccctcagtgcagcaaaaaatttcctaataaatgctaagaatcgactctaaggtgttgtcttgcgtagcaaccatctttctctctccttcttcctctctcttccacgtcatccaatatgcttgcatgacaataaagagagaccgctaataaagacctttgtatatgtcctaatatgatgatgctggtgtttgaaactgaaaaggtgtatagtaccgaccaagtatcaacggaaaacggaaggacatcttgtctacctgtgccgtgggtcccgcggttattgttgcgtccgatttgcttggggcttcatatgcgcgatccggaccgaatccagtttgcgattttcttggtgggcctatgacagcgtcgtcgcatattgctagataactttggtttgtcacgatccatacatcacaacggcgctgcagcatatggaagcgttgctccgttactaagtgcgaatgcacgtgaaccaggttatacggagatgagagttcctggaacaggtttacatgaccaaatattaaattttcacttcacgacaatcgataactatttgaggttctctactatgtatcattccaatctagagatgtttatgttgttaatagtccaaagaatggaaaaaaataataatcaaaggtatatactccctccgtctcataatataagggttttgactttttacttacactgtttaaccacttgtcttagtcaaaaaatttgtgcaaatataaaaaacgaaaattgtgtttaaagtactatggataataaagtaagttataaataaaataaataataattctaattttttttaataagacgaatgatcaaacagtgtaatgaaaaagtcaaaatccggacggagggagtatatatatatatatatatatatatatatatatatatatatatatatatatatctcctatgggactatatttcagtcgcctaaaactacacaatgctatgctgaaattgtagtgctttgcaatgtgtaattctatttcattttaactgcaatatgtcgttatatattgttgtacttaatttttgtgttttttttacagaattttgtaaattttaatgacttttttgtaagttagaataatttattgttcagccattaggtagtaataataaataacaagggaagtgataataatcattgtataggagttgtataacaaattcaattctatattcattttgctctgtgcaaaattgaacgaggaattcaactccattgttttgatataatccactagaataaatctgaatgatcaacgaacatattcaatatacgattaaaattttagcatatatatatatatatatatatatatatatatatatatatatatatatatatatatatatatatatatatataatatatatataatcatcaataacaaacagtaaaacctattacttggtgacaatatgatgaactttagatcgtgcaaaactgtgctggaaatgcactatacaactggagaagggctcatctcccggtttgcaaccccctttatttcctctcgggtattgaaccgggagggagaattcaggactaaagatgacggtctttagtcccggttcaaatacccgggagaaaagccacatatttagtccctgttggtgttaccaaccgtgactaaacagagggtagcgacagcccctccaggtcacctttttctttttttttcttttttttcattgttgatttattactggctagagttaatccctgtattttctcccaaatcgagtgggatacatatccccaaatcaagtaacatcccaaatcattcacaacacaaatcctaagttacttatacacacaaatcaaatacatcacaaatcctaaaaaaaattacacacaaattaaatacatcacatattatacatctcagatccatgcaatgaatcacaaattctagaaattatacatccagtgaatcacaaattatattaaaaaaatggagaacgcagccgccactcgccacggccgccgccgtgcggccgccgcctgcccacgcgcggccgtgccggccgcctgctcgccctcacccacgcgggccgcctgccctcgctcgcctgcgcagagggggagggggagggggagtttaggaataagatctgaggggaggaggagagggacataaccgatcttatctaaatatctcatctgtgacttaaccaatcaaatacggagagaaatatttactcccggttggtaactccaaccgggactaaagataaatctttactcccagttggttaatagtaccaactgggactaaagtggtaatctttagtcccggttggtagtatcaaccgggactaagatccttggccccctgat

SEQ ID NO: 58883 - DNA, 3829 bp, Oryza sativa
caaacatgtaagaaaaaatcaacggcgtcatctattaaaaaacggagggagtattggttaatggtataatgtttaatggactttaatttggtactagtatataaattatgggtagttttagtcaatactacaaattataattttagcacggctagccccttgctccttttagcatgttcatcagaccattgaaatggattattttcattttatccacgttttgaaaaatatgttttcttaaaaaaaatcttcatttttattgcttgcatgtaccactttagactttttgttaatttttaaggatttccttatccctataatcaaatcaataagccgctataataatccaaatcaaactatgctagctagatagttcttttagcgagtgagggattttttcctctatgggtaatagactatattagaagacctatttactccctaaaaatatagcaatttttgccgcatttatatttgttcaaaaacattgcaattttccttatatcttatttaatttcttgacagctttctctgttctctccttaaatccttatgaaactatataaagtgtttatgttttgggatgaggctagtagatcaatttagttggacatttaactattgtcccgcttttaagagtgacatttaacaatctgtcaataacatgtgagctgtgtctataacatgtaaattcagtgacaaattattaaacatcacattacatttaagagtgtcaaatactcctacgtcccaatataagtgccacatacccccttcgtccaaaaaaaaccaagtcctgtatacaaacctgacatatgcgtgtccaagttcgttattagtttatctttttttgatacatgagtcattaatacggatgtgatatattctataactatgaatatggagagctgtctgttcagattcaaatcctatgatatatgaaatatgtactatgttgtatatgttgtatttatactgggataagatatgtaattaaatatctcctatatttagctgctggatgtggatggaccacgtacctgccggatctgctgtttctgcccgaccgtaccgtatggatctacgcaccgtaagcgactagagtacacgcaccagggggccgcacaactgcgcaagcgtagctagcgcgtacaccagcggcacgccggcatatacgtgtgtactgaatgtttctttgaaaagtcgcctctgcacgagttgctatttccctcgtgactagctagtgaccaataagagtgggaaaagaaaaatagaaacacgtacgggggggcaaactaaagggcgtacgtgcatacaggctacagcagcaaggtaccgtgtcgaagaattgatgtgcatacggcaagcgacgtacgaacggacggaaacgtgcatgctgatgcatgcatggagccagcccggaggcaggcaggtgcatgcgcagcggcgcagagcagggcgagctagctagccggccggccgcgcggcccggggcggcacgatcaggtggcggtgccaggagggggacaagggaggaagagaacaaaagcgcggcacaaacacggcccctcccattggcaaacggcgctcgcaggcgacgacgacgacgcatgcatgcatgctagctagccacgaccatgtcgcgctgcgctgcgattgctgcgtaatgcatgcatggcagcgccatcgcaggtcggtcggtgtgggggagaaagaggtagtagcagcgtagcagccatgcatccgatccgccgatccatgtacacagcggttggcgacgggtgcgggccggtgcgtgcgtgcatggttgccgcgccacacggcactgggctcgagctgcagcctgcagggcgcatgcaggggctggggcagggcatgcagccggccgtcagcctcgtcacgtgctgcgcctgcctacctgtggtggccatgccgtctcgggcgtattaggcatggctttagttcccaaaagttttcccaaaaatataatctttaacatatgtatggagcattaaaatacagattaaaaaaattgcacggttagggaggaaatcgcgagacaaatcttttgagtctaattagtctatgattagtcataagtgctacagtaacccacatgtgctaatgatagattaattaggctcaaaagatccatctcgcggtttccaggttatgaaattagttttttcattcatgtccgaaagccccttctaatatccgatcaaacatccgatgtgacaactaaaaattttcttttcgcggactaaacaggcccttagacatttgtgatctttgcatttatatatatgatcctaaaccagtgtgaatagataagttattagtatctgatctcaacgtataagctaggagtaggagccagccaagaaacctcgaatgacaatgttactggaacagtgacattgacttttctctctgtttttttttaaagttgtttggacactgctttccttcgtggtatatatgaagcaaaataatggcgctcgaaagttaatttggccaacacccagacatgtcgggttgtacgcggtcttgtgcatgcatgcgctcgcttgtacatgcggccacagccggccagcagggtcccatctaattaaggggcttagggctcgatcgatgatcagtgtaatagttcatcacgttacgtggtttttggtggtgtgggtcatttgagttgatgtttcttgtgtcagcaacagggcgcaaaacgttagccgacgtgactagcccttcggctccctccatgtccacgcgatcgaatgcacacccctctgatcatcacatgcgtggggttacgtgtacacacacccactgcaactttcgaatccaaaccttaacaatggatggatggatgtaccccgtgtacagtacctgcgtggtcgatcgtgtgcctcgtctaatcgatggctcatttttcgattttaccgttgcagggtgttgtcgcctggcgtatggtgcttaccggcccctgggtgccatgaatgtagctagtcgtgcgagtcgaccggccggactacttgcccgtgcatggccgatcgacgacgagcgcggactggctggcccggctccgtccgtgtgatctggccattttccaggactgcgaaacgcacgaccggcgcccatccccttccctttccccctccagctacagaggtcatcatgttcagaaccacccaaagtgagacagagagagagaggtgcagtaaagaagaggacaaaaccatcggtatgcctgtattatggggatggtgcagtaaagtacgttacgtacgtgtggccatgaaggggggccaatgcggcccctgcaacgctgcagcgcgcccatgggctcacgaaagaaaggaggttcaccaccaccagcagctatagctgtacccgagaggccgagacctgcctgcccaacgtccgttcgttcgtttcgttggcatgcgctaagctttagcctgtatcacctgtaggtatgggcgtcgcaggtaggggtggaaaaaaaaaagctcgggctcgtgagctcagctcgggcttggctcaagcttggttggcttggctcgactcgtaagcccaacgagccaagcccaagctttctttttagctcgttgctgaaatgagccgagccgagctagctcgcgagcagcttgttttggctcgcaagcctaggctatcgtgcgtttatattgattattttactttatattacgttattatttgtcaacttgaaatttattattaagattttgaagtattgaatatataaacttatttaaattttacatgttgatgatttaggggatcttttttaaaattacaaaataat

SEQ ID NO: 58884 - DNA, 3810 bp, Oryza sativa
tgctgtcttaatcaagtcattatttcctccaagcaatcgaatgcatgcacgtcccaagcgcgctctctcgtgcggaactacgaaatactagtactccacttttgaacttttgatgggtcatggactcatggtactgtacgtagtaaggtatgtactcgaggagagcgttaaaagtaggatgacagcgtgtgtgatagcattgccatacacgagaaatttacgtgccattttggctcttttttttactacttccgttccaaaatattattgtctaaaataagatttaacctatcgtagaacaataaatgtgaacacagtaaatcctgattcattgtctttgaatttagatagtaatatttgggacaggaaagtactgtatttaaataataaaacaagctaaaacgaaataaataatacttaatattttcaactaatgcttaattgagcagcatcttatgatatttaaaaaaccgaggtgtcgaccgtgtcgtacatatattgttacggcgtacggatcagtcagtcagtttgtcccttgtcgtgtattgtacatgtgttccaccattcaaagtttttctttttttttctctttcgttattatgctcgatcgtttaatttcttttatttttcttctcccggtgtctcttggctcctttggcgagggcatgatcgctgaaacggaggcacgggcgggagggagcacggcgacagggagcacctgttagctttgttgccatcagttcgataggctggtgacaagatgacaagtgacaagcgagcgcgagatgggaagccaacaacacatgcaattgactaatcatatgattcctggcctggagcaacacgatcagctataggctagctcgtccatggccgtgtcaccatcttctctactgctcctctttactcccgtgcaagcgtgcaacccagttccgagcaagagtactcccgtgcaacttaaatccaaacaggcaccgtatattcactagcagtgacgagggctcgctctctctctctctctctctctctctctctctctctctctctctctctctctctctctctaacaaatcatatgccacgtccgatcccctgccatcactggctcatataggattccatttttgtttcttttttgattttttttctcctacgaaaaaaatgacgtgttggtaaccccctgtagtcccggttttctaatcgggagtaagaatccgggactaaagatcgatcagctattttctactattataaaaactgaatatgtttttaccggtactttgatacattatccgtgtataaatcggtttttaagttcgtttacttttagaaatagagaaggagtcgtataaaaaatctctttaaaaaactcgcatgctaacttaatatgattagagttctaattgcatctcatgattttctaaaaaaatactcattccgtcccaaaataagtgcagttttgtactattcacgttcaacatttgatcgttcgtctaatttgaaaaatttttatgattagtatttttattgctattagatgacaaaacatgaatagtactttatgtgtgactaaatatttttaattttttcataaattttttaaataagacggacggtcaaacgttgggcacggatatccacagctgcacttattttgggacggaggtagtatatctaagcaaattctcacagtgaatttcatcttaactaaaccgtataataataagataaaatagacttcacccgttgcaatgcatgggtattttttctagtttagaaaaaaactcgcatttgcatggaacagtgcaaatatccttgaaccacatgacactccgttgtattttatccgaaaaatccccgctttatatctaggagtaaagtaatactcaatcgtcaacatttacttatagctctagcaaatcttaatcattttaattacatggcttaccttcattaattatatcctaacaatatttttcaatgtaaacattaaaattctttgtgaggagtatgcgctagtactaatatttcttcattggtggtggataaaaaaacgcacgtctaacagctctttgaaatgttagaacgataattattttgataaccaaaaattttgaatgataggacaacaagaaattgaaatggaggcgataacattttagagagaaaatatagtacgtaggcttcatagatcgtagtgcttgtagaagatcgatcttaacttcttctatagcttactccctccccccttccaaaattcttcgacattttaggcttggaatcgaaggatactaattgttgaagttttgggctccgcccgatcatcttggacttgtttgccgaattagggataattaattgctgaatttgacgcatgatcattgaatgcttcgaccaaattactccctccgtttcaggttataagactttctagcattgtctacatacatatatatatagtttcattaacatctaaatgaatatggacaatgctagaaagtattacattgtgaaacggaggaagtagatattaataaacctagtcacacatataaggcagattcattcattcattcatatatatatatatatgacactcatatggggcaccatggtgcccgggcaccatggtatcaaatgcacaaaatcactcaaattcaaaattttcaaattgtgagtatatacctagttataataattcgattcatacctatacctatcaacaaaacaactcaaatttaactttatttcacaatccatgattacatacctaactaattatatgtatggatatgctatatacctagaatcaaaatctaacaaaaacaagttcaaattcagttcaaacttgctttgaactagttagtaaagtagttaatgttaatacctaagtaattgaaaaagtttcatactcatttgaattgggtatatactctattttaacaatggtgcccgggcaccatggagcaccaaacaaattatatatatatatatatatatatatatatatatatatatatatatatatatatatatatatatctgtgtgtgtgtgtgtgtgtgtgtgtgtgtgtgtgtgtgtggggggggggataatgatagaaagtcttataatataaaacagagaaaatacttttctttaaaattaaatccacatgaccgtaattaatttaaataaccaattgaaaataaaaagtaagtttagaccccatttgtatttcatactgaggcccaaatttctgtagacggtcctgcgaatggagtatgacacaaatcctctagaacaaagctacttagcaccttgcataaggtggaagaggatgttctaacttagttttctttaactttgggctacataagagtaactaagtaggagtacatctatctattatatactaaaagtccattaaactttttacaaacgctctcaagccgccatgtggcactcctaaaaacactcctaggccgccacgtggcgatttgataaatcctaaaaattctaaagaaaagcaaaacatctagccgtttattttcatttaatctggtggacccattattttcaaccattagatctatcttacaaaattgccaaatcaacaaccattagatctatcttagtacaaaattagcaaatcaattatctctcttaaaatatccttcggtccgtgtacctgtacagcatgtacgtttgtacgtacatatgatcctaccatacttctttttcttttttttctcatttagattagatggaaaacgaaaacaaataattcaagtccatatcacaaccattgattttcctttaaacatggt

SEQ ID NO: 58885 - DNA, 4679 bp, Oryza sativa
tagctagatagtacgtagaaggagttaagaataatgcatatagagagagtggaagaaggcacaatgtgcttagcttcgccttacctttttagcaatagggaatattaaataggagcagcaagaggaccatatagccacaaacaatatatatactagaatgtgaaaaaaaattgaaagaatttatttggttgttggaacacaaagactttctagggtctctttttaaaattttatggcaattggatcggatatgcattgtgggcttcacataaagcattatgtaatttaaattttattaattcataccaagtgaaggccagctaaaaaaatagagagtgattggtttcgatcacacaattcctaatatttcataagaaattttatagaaatatttaaatcatggaagcattagtaatacattacattccaaaaaacaatattgcatgcatgtattgttatatttaattagccatcaaatcatattcacaatggttgagtagagccacagacactatatatgaaacgttcccaaataaattatctatcatataatgcaaatatattggagtatacaagcccgtgaatttaccgtagccgtatgtccatacaattcatttattaataaacaatgagaatctataccaatcttacttccttatggataaaaaacttttaaaaaaattgacgcacagggtgtaatgctgtcactatttatgatatcataaatttgaactcaaaataatttttgtataaaataaaacaaaagtgtaaattgaaccaattgtagaaaatcttataatttcttagaaccattgtggttcttaatttcccttaaattgagacaaccatacataaccactgcatgatttttaagtgactacatatcaatagacttccctctattctatgccatagcagaagatagctggttttaaatattatatttcttactagtaaatttgggttttaacactcaagttgactaaatgtatttaaaaatatatataagtcacacataatataggaagcaaggtctagaatatatctactctatttttgttaattcatatgtaagtacgtataacaaattatatcaaatgtgaaccaactaaaagaaggaataaaacacatttattagaaataaccttttttgagattcgttaaaaataagagcccaaaacatttaattaaaaagaaaaacaacaccttacttttgatttagacttaaagacctacgtcttcttaaatgatgaagaagaataactttatagattgttgcttatatagatgaattaaatattacatattataaactaacaaatatcttaaaagaaatatttaagctatgaatgcgcgaatgcgcgggctaccatcatagttatcttttaaaaaaagagttaagtagtatagagaattttatccagctagggtagtagcttggctgtgacatgggggcaactagaaattatggcaatgatgaggaagagcgaatgaagacaaggcaggatgtctttatgccatgcatcgagaatagagtttgtgggggcactgaaatctgccacggcccctgtttgtgcacgagtaaataattactggtcggtctaccactgtatcatcactgtacttgtctctactccattctctttttaccgtgcaaaacattgctgtcaaattgtcataggagattaacgctgcctcgagatggccttgatcctccttcacaaataggagtacatgtttctaggttatttaacgggattaaaatttagaataaaagatcttggtgtccctcgtttgaagtattgctacaagggattgatagcgtgaaaaggtggttagcaatagagatagaaaaagaaataagagtactacatatttaaagttgatgtaccataaactacaaattgaacgataaatttatcataaaactatactatgttttaggttaaatatcataaaactatatatttaataataaatttatcacaaaactacaaaattgggggtttaagcactaatattatgtttgaattataaatgttcaagttttatatctaaattgatactaaacctgtagtttttttatagctttgttataaaatttatagttttacgatacttcgccttaaatctgtagttctatgattaatttaatattaaatatgtgatatatcaccttgaatatattgttttattataatttgaccaaagtatctgtaattttataaaatttactaaaaaattaaactatattccattcatcctaaaataacaacttagaaccggattagagagatcctattaaacacgtcttgcctaatactaagaacatcgcaatatagagaattggataaaatgtaactatctaggaataggatcggatgtgtctaatccaatcttaaattgttatattttaaagcagatggataataatagatgattgatggacaaatactattttagaacgcctatatgtctagacaaactttaaagggtaattttatcttttctaatgtaaaatttgatacatctaggtaataagaatctcaaggtattaaacattataatgtaaaatttagttaccttaatgtactttctcaacgattgtaaaatttttcaactttaaatgcttgaaatacttataattatgaacacggagagagtatcaaatttgaggtgaaatctaaatgagagatggttgtgattggataagataatacaataaataaaagataaatgagatattgtttgtggttggttgagataagcatctaggtcaaaaaataaaagagaaattagtgtggttaatttagatgatgaaataggcgaggaaagaactactatattttagaaaaaatgctaaagatactcttatcctatctaaaatgtaataatttatagcgttcaatattgcttatttctaaaatataataacttccctcccaaccctcattttaactgaccacgatcatttctcatttcatctttccatctactttcgcatctcagctgatcagaagcaccctcttatttagttccaactactatctttttccaaactctataaattccagggttggatctacggtataagggccgatgtcaggcgacacggatgatttgttatgatgccaacaaatagattttctggatccgccactaattaaatcctcatattttgtgacggtgggaatagctcataggagtactttctaacgggggagtagtgcatctggtgatctgtactgaaacattcgcaaatgcaggattagatagacgacgcacatgcgtcgttgctcattatcctctgcccattgttctgtctctggaaatgtgttctgaagatctctgcacagaaagacgaggataaaacaaaagaagcagacacctattgacatattactattgagcactcgataggtttgctcctggaacacagcactataatgtgatatctgaccattcattacacttgcttggagtactccagcagtccagctcgccaaatgcttgtttagatcgggagcaacttgctcttgctgcataatgattccggagattattgctactgtggcgccactttgtttgtagacaaaacgtacgggtgttgccttttcttatctcgcttcgacgttgagggcatggagagttggagacatttggtcagcgcactattctgccgttgtgaagaagttgtttgctctcacatgctcttgttttctttgtagggtcatcgagataaaaaggtgtggtacgagtaatttttactatttcgttgtgacgtactcctagttgaatttcacctaactaatgcatagtgcagaaatgcactagaagctccagaagatctcaagcagaagcaagtatagcggatcattgatgatttggaggttagagttgataggggtaagtgatgaattcgacatcacagagagcagagtttcctataactccgaagcaaatattacccgagagtatcaagctaggtcagatggatatggagttcttctctacagctgaaaccctgcttgaaaggtagcagatcagaccgacattctgctgaagtagtgattttgaactaatcacaacatttttttttacctccattgtgcttaaagcagtaactgcgaaatgcaaactgctacaaaagtaaaaggtattctcaagctcctgttgctcccaataatgtctcagagagttacagtacatgtgtttgattctgtcattcgcagctcacactacaacatggagtttgttctcgatctgactaaaggaaccaaagtcccaaacaagtaggagtacacattacagcaaagcccagttaatttgagcccataaagaccgatgtctattggaccactagtcatactggtatggaaaaagtatacttttcactccctcaactattgtccgagtatgattcatgtcctccaaccacaaaaccgggtatcctccaattatcaataccggagtaaacaatatccctcggtggttttggagatagttttagctgacatggcgcctacgtggcggtgtcctacgtggcattagaataaaaaattaaaaaatatgtgggacccatatgtcattaaaaaaaggattatgggacccactgacatatgggacccacatgtcatcatccctctccttcccttcttcctcctcctctctttccttct

SEQ ID NO: 58886 - DNA, 3715 bp, Oryza sativa
gcctctccccaccgctgtcgtcccaagaagggaaaggccggggggagagagagacacgggagagagagggggagaaagaagagaagaaaagggaggatgacatgtgggtcccacaatatattttttttaatgacatatgagtccccacatatatttttatttttttatcctaatgccacgtaagcgccacgtaggataaagacttggtcaataccgccacgtaggcaccacatcagccaaaccaccgagggatattgtttgcaccggttttaatagttggaggagtcgatatacccggttttatggttggaggacatgaatcataatcgggcgatagttgagagagtcaaagtatactttttcctactggtattgatccaattgaaactaaagcccaaacagatcaaatcttacggatgactaggggaccgcctattcatcactcgggtgttttgagaaaaaatcacccagatttttttcttcccttggatttgcatccaacggactacaaaataaaataactaatacaaatttacttacacaatatttttatcaaaattacagtgcacttacatgtcatatcaactaaatttacatatgtaattttagttatataggactgtaattttatatttgaaatcaaataattaatgtaaatttacttacacaatatttttatcaaaattacagtgcacttacacgtcatatcaactaaatttacatatgttattttagttatataagactgtaattagaaaataataagtacatatttacttacacattatttttatcaaaattacagtgcatttacatgtcaaatcaactgaatttagttatataggactgtaattttatattttaaagaaaataataagtacatatttacttacacattattttttatcaaatgcatcgcgtgctgcggcggtgcgggtgctggccacggacccggatccaagcggcgtcgtgtgtgcgatgtgatgtgaacggggaacgagtgcgggcgtggtcgtgtggggcagtgagtggaccgggattggagttagcaatcagggttaggcatgatgatgggctgctgggctgttcgtgggcttctatgccttgtgcaaagatcatgtggcaaaaaaacgtcaaatgccaggaaaaaaatcacgcgggagatgtttagcaaaatcgctagcgctaagcctctcttttattagagccatacgagagcccacaaacatgtacaacaccctatcttgtgtccgttctcatgtctgctcactcactttagactttgttgaaatgctaggttcaataattcatttagttattagttactagcagtactatattcacaaacaattgctggattagtgactgcagttctgatcagtagtcaaggcacatgaagagagcattacaaacaaagtcactgactaaattgtcttagcagtgaagaaattgttaatttaacattaggtaccgaataaactgaagcgattcacattgtgtgagtaaagctgtacaaatatatagagtcaaaactaatcgattagtcgtgaactcgtgataggcataaatgatatagtaagtgcaacgagtatagatttattctttccgaattagatttatgcaaatgggaggtgaaatggaaaacttttaatgatcttacatgcttatgatgatgaaaatgttgatttgtcaccatgaatggtgtaagtgtgaagatgatgcttatgatctctatgcttcatactcacatgagctcgaactgtttcgctatctttataaaattaaagaaaaatgaaaatagagcaattatcttttgtccacctaaaaaaatgctcggatcaagagttacagttgcatttttcaggttgcttattcagatacaagtatatataaggtataacccaatattaatcagaccattgaattatcatccctggctccctgcatgccaccagcgtgcacgtaaagcttcacgaatcacgacccaatgcaacttgatcattaactgatcatacttcagttagctgcactggcacgtcggcgcttctcgtcgccgcgtggacgccggcgagccgccggccttgcgctccttggccgccgcgaacaccctggccgcccactgcgcgaagtaggcctcgtcgtggccgatctggcggttcttgtagcagctgaggatgtccggcgagccggggcacggctcgccgtggggatcccaccacgagccctcgtgccgcatccccgacctgtccgcgccccaccggtacacgaactgcccgcctcccgccctctctcgccaccccttggggtagaactccatgatgctgctgttcctgtccatgaacaccagattcgtcatctgcgccccgtgcgacgagatcagcacgtccgtcccgctcatcaacttcacctgcgagaaaaaaacggagagaaaacacgcgtgttacattacactgctcgttcgtccatgcgtgcatatgcatggagcgagctgggggtacgtacctggtcgcagaaggtcaggttgtcggagcgcgccgtggtgagcgcgcagccggcgacgcgcgcgcactcgctcttgaagacgcgcgtgactgcggcctgtccttgaacgcccgcgcgcccgtgcggaacaggatggtgacgcgcacggcggcggagtcggggtcggagacgtccgccaccacgccgcactgcgccctggccttgcaccgcatgaagtcgaacgccgcgagaagcagctcccgggtcatcccggccatgatcggcctgaacaccaccgcctcctggaagcacacggggacgttggacgcgttgaacgtctcgacaaccattcccacgccggtggtcgccttggccaacgacgtcagccacggggttatcccgagcctcacctccccgtggtggaacaagggccacctcgggggcctcgccctgcacccgctcctcgcgtgccacgacgcgaacgggatgagcgccgagatgccgtgccacaggttgctgtggtcgtacgccgtctcggacacgtacgcgaggcccggcctgagctccgcgccgcccgggagcgcgtcgcgccacgcgagcgcgtaggcgttcctggtgccgtcacggcgtgacggcgccgacatgcagaggaggcggccggcggaggccgcggacgggaagacgatgttcttggcctcgccctccggctccgacgtgtcgtcgagcgtgctgatgaaccacgtctcggcccactcccgcgtgtccttcagcgggaggaacgtggccgaggctcgcagtcggtcgacgtagtcgtcgccgccgccgccgccggcggactggccaccgcaccggaagatcggggagaagaggcccagcgtctggaactgcaggtagaagaacaccgcgagaagtagaggcgggacgaggcagagcgaacccttgacatgcttcaggttaccttctctgctcttcttcatggctgtcgagcataatttcacacgacgacgctcattgtctcgtgcaaatgggcacgccgtatgtatagattgatacacagatctcactgcagtgattctgcaatctacggaggccaaatcagacgttgacacttgacatatatcatgtacaatttacgtgtaagtaaagacgtgaattggagttacgacgacgagccataggatggggtggtttgatcttttctgtgatataataatttgggtaccgagctcgaatt

SEQ ID NO: 58887 - DNA, 8171 bp, Oryza sativa
tgcataggatatgttgccctcttatatatacctaactacctaaagtgtctggtgatcctgaccagatatggatcattttctctcaaatgtggttgccttctatctgtagatttcacaattcacatccccaaacaaatcaaggaaagtactaagtgcagatgtccatgcaattacactaaagaaaccaagagaattaagttgaatcaaactaggaaagactaattgagtcatgtggaactgtggattctattagatctatcaggtgtatattttggtgcattaatatgatccgataactcatatatgctctccatcctgtattataagttcatttttatgaaaaatgcatgctttcacaactcaagccattgtggaagtcaagtactctgtagttattgcagcatttgcggtctatatctctgctttatttgtagttattgcattatttcagtctactctttatttcctttttcgaagatgtagtacaaactgaggttaaattgttatttagacatgtatataaggtgtaaaatgggtttttctagtttgttacttcatgaagagcatatatgtaacagttaatatatttacaactaaggactgttataggataggagacaaaactatgggcaaactagatcatgatcctatattttataattttgctggaaacttaacagggtgcagagtgtgcttgggggtcatttattgtttcgtgcaattatagttgtaaaatcatggaaatgagaaacttcgattgagagtccgatgactttatgcacataagcaaatgaggagttaagcctcatctctatacctgtcttgtgcgcacatgcgcgcacacataatcctaaattctactcaataccataggcttattaataactaaggctctaccctacagaggtgggaacataattttttcatggacaaagataacaatgctatatctaccagtacgtgcttgttatggtaatttattggtttaattgcactgactgcttttgctagtggttgctgacaattacaaaactcaattacttcgtctttttttgtcctattacatactccgtattttgcactgtctttctgcgcctgtggttcttacgtgttaacattattgtcctttagttggcactagtatatatacatatgtccaaataaaactgcctctttctgtcagttgttaaataaagttacttctttctgtcagtagccacctcccgtttctcttaactagtccttatagtcctacagctgcagatgtcttctagttttgatttatggtcatagttatgcttttaattcagggatgattacttatattaataacatatatttgatgcatcaactgttgtctgcatgccttgtcataattttgttaatgtagagaatcatagtacaaactccggtaccaattcctaatcatttatgttcattatgcaggtgataacactggcgaattgtctgtccaagcaaatattctagctgcttcatgtgccgggattgcaacagctgttgcaactaatccattgtgggttgtgaagactaggctacaagtaagctatatcgtagtaacttatatctgtttatttttccctatatggtatttattttcaaaacaactttctatagatttgtgactttgcaattttattaccttacttttgggggtgggggtgcggctatggttcttcttgagatgagagactaataaatatccggcaagtttgtagaagatggtgatacaacttggctcacagtagtatatactgcttatacgttgtatttgctacttgcttggtacatgatggatatatgtattaggccttacttgtgaatcctaggggcagatatgaggatgcttgatgttgctagttagaacttaagatttttatgagaacagaacttaggtgttccatggggtgtcaacaacattgtgaaggtggctgcgccaatcatcagagaaatgcttacaaatttacaatgttccagggttttgatcatgtgccagaatctgtatttcttaccatcctagagacctgaaatgcgtgaaatgccatacatttgtttgggttaatatgatatgactatatatgagctgttgagctgcagcatttcctgtgtaagacatttattaactaattcttccatgcatggagaacttcaaaatgatgatgttcccgatggaatttgagaacgactgtattcaacacattttgttaacatttttcttgggccacatattgggcatgcaattctatcttgggtagttctcgattctgagacttcaatgcatcaacactagtgcagtagatgtaaccatggttccagaaatcagcgctagtcagtcagtcagtcagtcagtaactaacaacttggctagagagggagaaactgggattaactaacatcatgaagggatttggttttccttcccccatcccctccttaattttcaagtgtgaggatttggaacatatgttattaataactaataggtgcacattttaatagcaaagagattgcatttgtgtgttatcacaagcaatatggttctaagaaacaaggaggttacaggccagcctggcagctacgccaagccatcgtaggagatgttttgctgtgtttgcaccattcaataaactagactagaactttttttagacaagcatgcataaaagccttcttggggtattcaattataccccttagttctcatgaacaagctgccagtcttctcttgctttgttatagaagatgtcatgcttggttagtaggtacaccaactgcacttttcttgtcaaattgtggcacgcagtctctagcgaacaaattgatcccttgcaactgtcccatcgttatggatatgacttgttggacatgtgaaggatgtttagtatatgacaactgtgacaacaaaacctaataatagccattgaaactcatatttcatgtgattgtggaagtgtggcaatgggccatataattccctttttttgggaaaattgtaactgtgccattataattttacaaaatttgagatatgccatcctgacccacatgtcattgactcacgtgggtcctacatgtcattgagctttttatttttgatgttgtcttgatcagaaacttcccttagattgaagagtcaaacctcattcctagacaactaactcacaagtgagagacagggttggctaatcatttagttaatatgagtccattcaaaattagtaaaaataaccacctgtttgaagcatgttttctgtctagaaatcattactctgagaatagggtgaattctagttactttgtcattacatgaacgctgttatcaatgattcaacataattaaaataaatctgagaatgctgcccactaaactattgaaatctttgtgaattgcatgaatgtttataaccaatgattgaaaaactatttggcatagtatattttgacctgataattacagcctgacgtgaccctgcttgtttctttaatcatttttgcataattttgggcataggatcttatttatagcaattgttacatgtatatatgtgtcacgttggatgatgtttaaaattatttatgtactctatttacatcttgtagacacaagggatgaggacaggtgtggtaccttacacaagcatttggtctgctttacggcggattgcagaagaagaaggtatccgtggattgtataggtaggttcaccttaatcatattgcatactgtcttggtcagttcgtttctcgttcttttcattaaaatatatgttgtctatttgatctctgttttatatgatgatagtggtcttcttccttctctagctggggttactcatgtggccatccagctcccagtctacgagaatgtgaagctttactttgctaaaagaggtaaaaaatcttttttactatacgaagtttgagtaaaagactgagtcttcatggcttgaagatttacaaagatgtgcacatgcttttcagacaacactacagtcgataagctcagcccaggaaaattagctatttgttcatcaggatctaaagtagcggcctcaataataacatacccccatgaggtatttttgttggtcctatgtttttcgtaataccttttcttttgagtactaaatggttttctgttgaatacatgtgtctcctgctacagatacctgaatagacacattgatctcttctgaagttgacactttatttctttcaatttggtcacatgttttggtatctatattttggattggtgaaatgtttgttaaaatgggaaagtgagttgggttgttgctaaaataggaaagcaaggaatgttgttgcttaaaatgtcaaatctattctaaagtgaataaataagcagagaggcagagaggcgtagatgaataaataacctccttcagacactatttagtgaaagagaagatgaactaacctaatgaagaaaagatcactttctagtggaatttacttgacttctttttggagcaccagtagctaggaacttgaaaaaccccttacgttttattttcagttatagtaattggcttatattggcaggttgtacgatctaaattgcaagaacaaggtcgtgctcgtcatggtgctgtgcactacaccggtgtaatcgactgtatcaagcaagtgtatcagaaggagggaattcccggcttctacagaggttgtgctacgaatttgctaaggacaaccccgaatgctgtcattacgttcaccagttatgagatgattaatcgactcatgcaccagttgctgcctcactaagcaaaagcttaaaaaccagcatatctccactgagcttgtaatgctggctgagactatcttcgacatagcttgggtgtaatggttggtgatcatggttgcattgccatttgcccattattgaagagaaggcggctgttaagcacagattttggtgaaagagatcggcatacgcagaaatttatgttttggtgcgaggttaaaatatttcccttgtttcatgtgttctaaattgttgataggagccaattgttgcctccttatatgctgacctgctaattgtctcatttgtttcgatttaaacctttctgaagaatactgaccggctgttatagctgaccaatgaccatatattgtcagatgcgcctagagttttacaagaaacaaggcctagccatcgggatcggatacaatgttttgtatatccctttgttatgtattcccagtgttaccgttgactatattattcaaccagctaattgctcgtttgttgctgtggtcttctgaaaaaacgattgtttgcttctatggataccggtacagcaaaaataagtgtttttatgtagatgcaccttttgccctagcagcaagcatggtttggagttgatgtgatcttacatagttggggaaacatactaggaatcgaagattaagatggccatatggccatacaaaccaaatacggtgtatagctatgtgatcaatagaattgtaggtactgttttttttttcttgcgccgatcacattggttgggaggcaaagataagttggggctgaccgccagcatctgtcagtttcacatctcttgaggaaaagattgttaggttagatagccataatacaaatttttttataagctaagcaaaatctgagagatgtaagacaatcactcatgagggacctctaaaagcaagtgaaaggggtggcgcccccggccggcctgccaactgggaggcagcggtgggcgcccaactgccaccggcgatgaccaaaggtgcggcggcgggcacgggagacggtggaaaggaaggggaaaaaagggaggggatctcactgagcgtgggcgggcaaagtgacaaagggagcatgtcggcggagaggattggcagcgatgcttcgggacaccgatgaagacggcgctcccgcggaggtcaacaagcggggagcggtgaccggggacgcacaagacctaggaaaggttgggaggggttagggagaaggggatgcctggtaactacaataagtgatggctggagtccgacgatgttggtattttgttacggtcatagataaatccgcaaccgcatgaatatcgctgtagcacttcacattggaatattctaaggatatcgaatcacaaggaacatgtgagtacaatctaagaacatgattcaactaaggaaaacaattaaatggtaggcttacgatagagatgattcttatggattaattatcttaattaatttaaggtacaattctatcagttgctttgggcaccgactttcctttggttttcaggctgagtccgacttatagctctatgatgtacccaaacgtggagtaacacgaagggtggaaatgactatcatcacttgccgcctgtctcactttctgtggagcacacaataaatgaaggtaatgtctaacctagacaccacatctacgttatcgattactactctagcctcgaccaagaatttcctttttcatccagagtcttagtactagagtgctcagtataaatacgaagcgacgagcccacaatgatgagaagctaccttacttaaataagaaaagtaaataccataaagaaatctcaaatacttattttattgaagaaaacatccatcgaggtacaagtcgaaggagagagtgccgacagctccagcactcctccgggactccacttgagagttgagagagtgtcgacatctctggcactcatcggaactcccccgaagagtactgtgacaaccggagcactcctttcaaagcttcccctcactctcctcctacattctaactctacaagaaagtagcctaaatatgaaagtaagttgtactccactcaagttgtgtaatttgagagtgagagtttctcctccttatatagtgtcaagtggttgttactatggtggttgtgaggtcggttcacccacaaccgctatagggaaacaatcaccatcctccaagtggaaggtgtggatgaatgggcacaagggtggtttggctgacccttggcaccgccattcaccctctctttcggttgggtcactgtccagtgggccctcatgacagtgcacgatggttatcctcaaatatgtcagttttgctatggtttgtgaacccttcaatccatgtactcgcttctaattggccagaggtatgtttcttcgcatggtgggtggtttttgttcataattcacctttatacaaatattcaccaagacttatggaaatggttagtaataaccactacctctaagtttgatatctattttatattctttcatttgcttttatgcatgaattcacaatcagatctggtacttaaggactgttaacaacacccccacacttagcttttactcgtcactgagtaaagatcatggatcacaacaaagatatgattctctttgtaatgatacctgcataataattattccaagccatacttgtacttgtgaatcttgaagtatctaccacgtcatcttgggtgattgaagaacggaacggtcttgattcaagttacctccactcctcctgatgagtacattgggtttttcgttttgctcataaaaacataactctactttattccttaattgtttgtctcggatcactcaatgtgtataattcttcaccaaggtattgattttgcgttttttttcttatcctacttctaataaggattatgtggagctcagggtaggggaaagaacaaaacattacttacatcacatatctatactttctatatagttagtacccactaactcctaaagctcaacatgcaagtgtgccacatcatcaccgactaacaattattatctagagtattttagatctcatgctaacatgacatatcatttgtaattttgttgtatgtttagaactcagcatgcaagcaatgtcaaatcaccatcttcacatcattttcacattatttaaacatatactcgatcatttttataatgtataacatgcattcatccacatattccacagcaaagcgcgtggtatcaattagtattgcaaaatcaaagagtcaatccatggagaaaacaagacatacaaacttgatcaagatgtgcatagtgtatggatatgtggtggtaagtggcactctaattttgttgctctctcatttt

SEQ ID NO: 58888 - DNA, 33427 bp, Oryza sativa
caccaccaccctgcgctgagccacgaggtccacgaggagtcggctggcagccatgaccacgacgacgacgaccatgtggacgacggtgacaacaacgacatggccatcgccgacgtgacgccgccgcgggcgggatcggaggataccgaggtcgagaccggctcacacgtgagccaggccgagcagagccccgtgccggtggagcacgaagagggggaggaggaggaggtcgggctggagctcacgctcgggttccagccgctcgtcgtgcgcgcctcgaggaggccttcgtcggcggaggcgcgctgcgaccttagcggcttgagcgcggagtcgagtcgcatcggcctgcggctcgagctgccagcgtgagaagcggcgtcgcgagccgcgagctttcttttagctgatagtagacagttttggtttcgtgccagaagtgaaacaagaacagaggaaaacatcattattagttttctttttttttttcacaccttttctttttgcttgctctgcatcgttgtaggattcccatgttcctcctgtcatgtacttgtgtgatgtctgcctgtacagactttctcagattcggctgtgacaaaacttgttcaaaatcgatagaacaatccagatttctggagtgaaaaaagaagttgaaatccgattattctccaaagaattgtgatataatttatctttggttatttccttgtttcgcaccttattttaacttgtgcgatattcgtcctaagaactgcaagcttgttaaacttgattggatattaaattactccattggaacttttatttgtgattcgttgcaagtcaggccaggaaggattggaagcattaatcccagcaaataaccaagaaggtcacagtcccatagtccaaacattcagtgagatcgacaaagttgctgatactctgtcgcagccttattgttcatttcatccactcctcgcaaaccagagaactttttcctgagaatgagaagcaattggatgacttcaatcccaacaacaagactccaccttcccaacatccagtcagaccaatacaattgagaggattcatgaaatgattttgcttagacctgattcagataggcaataaaaatcatggggatacatggcagtatgggtcgtatggcctgcagtaccaggttttccatgacctgaataattgggcattcgatgatccaaggaccacagtccacaggagaagagcactaacaggacctatcacctaaccacatgaagatcggcgttttggagaacatagcaaaagctgaaactttaagatgcttaaatcatgactggaagcagcgaagtcattctaacaccatggagcatatgagatcaaccttgcatgctgtcttcctccactagtgaaatacatttacatatgtaaagcacaacagtagggttgtgagacaaatttcttctctatgtccatcttatttcttgtagtccaattagtcgaaacaaaaactgcaaaagaagaagaagaagaagaagaagaagaagaagaagaaaagtctgaattgatagtttccacaccccaagcatgagaatcggggatgccactccatccaaacccagaggctaatgaccatccaaatctacctgatgaacaacaaaaatttgtgtccccggcatcttttcttgagtttcttgaattttattgtgaaagagaagttgcaagaagatcttaactttagatgggttctacagtgccgaagtttttcaaactatttactcaccctctagatgaaataattttgtatgagttggatacacattgatgattttgagtttacttctgaaccacttggccctattgcccaggagtttgtgaaggagttggacattgaaggagtttgtgaaggtcggatctcaccttcaaaagggaagagatactcttggtggaaggagtagtgcatttgtgcagcctcagaggatagggtcagaaaagactcggctcattgtgagctcttcaaaggagagtagaatcccctcaagaatttgaactttggtaacacatcgacttgcaagaatcccggtgatatctctctcacactcttatagctttgctatttggtgctgctagtagtttaattgttgtttgaacaatcctttccctacatgtgtggctatcccattgtgcttgccttgctaacttgcttgaaaatatgagattttcggaatatccgaaaatattccgaaatatccgaacaaattctaggatatctaaaaagtttagcttctgcattttattaaaaattttaaatgcctattcatccctcctctaggcagcatcaaggtcctttcacaaactcttgaaatctacagtcttggaaataattcagtcaggttgaaaaccatttcagggtgtgaagaaactcccattctgttttgaaaagaattaaaaaatagagaagtcttatgttggtgagaagacaccaacgttactctttcatcattgatttgagcaattatatcatccaaatctttttgtagccattgcatggaagaacttcgtgttttctcccccaactcgatccgtctattagtgcatctccttttccaatataatcttctaaaaagatagagctttgagatttgtttcttgaccacttctctaaaattccattttaggatagtgagacttctgcgttcttctatcagatatagaaagtctaaacccttattatagatagagattaactgaagtagcttggagagacccttactcaattattttaagaattttctcagtagctccggcttatagatgatacatctagcagggtcaataaaacctggatcaatgttccatatccaagcaccatgataaaaaaaacccttccatatcaacccaataattctcaaaatgaaagacattggatatggggatagaagagtattttaatcatttgaactgatattgctcttgttagggtaagaacataggactttggatatcttagtgtccaagcattggaagttaaaagctagtcaagctgctctaacaagaggttagcttgtatattactacaagtaaaagattttccttttataggaaattccactaagcctaaagaacttataatatcagtgaaaatgataatatcattcatgtcaactccaagtttgttcctattcttggtggatctataaaaattgaaattcccttggaggatccaagcttcatcactttgcatatgaaaatttctcaagtagtcaacaaaattgtctctttcctgtcctctacatgggccataaatggaagccataaaccaagactcagaattatgctttgagacagaattcaagcataaagaataattattagcaagaactaaagaacccacaaaatattttcacatcatagagccactagaggcccccatagaaggtatgatctgaaaacaattaaatctcttagggaccacttttttgaggaaatttatgtcaattgattctctcttagtttcctgcaagcatatgacctgacatttgctatcatcaatgcattgtttcaaagcatctcacttgtcctctgagttcatccctcttatgttccagcacaaaatattccaactacgaacttgatggatattcattgataaacagttagttaaagagaagcacataacaagcaaagcaggtctgaataaaactagactagcacattacaataaaagtcttaaatcctctgaacatatttagaggcacgacataaatagattcacaaaaggaggaccactgcaaacacattatctttaagacaactgccattaacataatgaacatttgctactcatcatcctcagttggccttgggagtttttccatcttgtctccacccagtttgccctcagccacctcgtcaggagataggccacacatattaactcccatcttttgcagaaacaagatagaacaataagaagaggaggaatcaacatcagagtaaaaatcacaatcaaaatcagattctgtatggatactgctagaagattatgcaaaatacctactagttccttaagttttttggccgacattcccctaggctttccaatacccattcttggatcttgctcaagataactttcagaagaagccctcacccttgcactctgcctcctctctaggttaaagagtatagtcttaccatccctctttttaactggagttcctgggaggataagggccaatatgttactctgatacggggatacggatacggatacgcgatacggggatacgaggacacgtcattttcttaaaaacactgatacagggatacgtctatatatatttaaaaaaataaaaaatacaaatgaaaaacataacacataaataactataagcctgcaaatagagttatacaaattacatgacatcattagagataattagaataaaactttttctggatatcaagctcaactcaatagaagttcaagagctgcttgcattcatagcaagcgatgtggctgaaagagctacatcccagacatgtcccatgcaccagatcttttagtagtactatcccaggagatcaagctcatcatgtagcttgcccctcgtaaataatatgctcccatgcctggtcacaagtgatcctgatgaatttgtagccgcgctagcagtacatactagtgctagataagtggttaagcttctaattccaaaattcaccggatctaaatgacaaggaaaaacacataacaaaacaaccagtgcagatcgagacttaaaaggggaaagaaccaaatagccggtgatgatggactgtacgcgttgggcttggtagccggcggagaagctgcgcctggtgacggagatgccgcgactaccgacggcggaggccctgcgcctaggggaccaggggtggcgacgcgacgcacggcgggcggtggaggccctgctcctcaggtggcgagtggcggcggaacccggtggccaactggtggaggccttgtgcagtgtgcccctggtagcgatgcaagcagcgctacaggaggattggatctgcccttctgtgctgcgagcgtgggtttgtgagttcagacgcatggggaatgtatcggagaagtatccgagtaattttcttttttttatatcatggtgattagggatacgtatccgtatccaatacggatacgtggcttgtgagccgtatctgggtatcctaggggccaactgagttgatttgtggaagtgaagaaggctgctgttgtatagcctagagctgcaaatgtatgactaggaccgattctttagtcactggtggcaaaatagccaggggagttggtggctctatcaagaggtcttaagtcatcatgacgtcatccacaataagctggcttgtttgcacggcccaactagaggcctcatccaaatggtctgttttaaaaactagcgggaggatcagaaggagcattcctctttgggtacaaaagctgaatgaaaggggttgcaatctgagttggctttgaacactaccccttccaccctatccacaaagttgtttcaaaagttgtgttttaagcaccaactcttcaatttttccctgcatgtcttcagagatagaagattgaggaagtgtgagctgttgttctggggtttcatctgcatacataattatgtgcttgtgaccctcattggcatcatgagagctcacaccagattcaccagttgcctgctggttttctgcttggtgattccaattgccccaaccttcatcttgctgtggtggctcctcttggtcatcccaggttgaaccctaatgaggaggttgttccggaggtggaggtggagcacccaaagttggcaaatcttcatcttgcgcttgtgtatccacaaaatcattataaaggacaaaaacacaaaaggtccaagattctccttgccctcgctgagtcgggatttgcttaaaaacaatcctcctaggaacctgatcaacatcatcaaagaaagccctcatcataactttgtcgggaataacgtcaacttcctgccaatagtccaaccagccaaagagcccaactcctctagatatataacttgtagtgtgaaaatcaagtgggcagccaggaacatgatccacccaaccctatctacatacgctgccctccaattgagcctctgtcatgatttctaaatttgaccacattaaccccattgtaatggaaaccaaaagcctctaccagggtatctctggttaaagttgatctaacaatgaaaaaaccaaccccaaaaggatgaggagagcaatgggtaaccataacacctaattcattttgcagatgattgcgaatctgaagcagatgaccatccaaatcatcttttggaacccatggctctatgtctgcaagcatgtaagactcatgctacctttgagttatacacgtccccggcgcctcctccataccgttataccatccgatccgacacaggtctcctcctcgcctcgctggaagaaggtagtagtagcctctgctctgctcctctctctctagtttctctctctagccccgacacattgtaataagggcacccgcaatggttatctataggctctctacaagagatccatgtcagcatattttcctacttggaagagattaaatgaagagagagagagtatagctatctactaatctggagatagtctatagagaaaaacgagacaatagattagagagctatagatatccatgtagacataccattgaagtgatttactattaatttagtctattgctgagatgtacatgttttatagatagcactttacattaacattgcgggtgctctaagtgatcaaatatagtaacctttttcgttttagcaagaaaacttggtttctaagagcgggtacaatagtgctattaggaacgctccaaaacttgttaatcagtctaaaacgagattaaggaaagaaaatcagtgattgagaaagaagccgtcgcttgttctggcgccggcgcttgtacagcgctccacgctgtatcggccaggagatacaataaaaaaatttgtttgtgggttctactgcttgttaattcgtttgaaccaaggtagtttatagctaacttgtagttagcttgttgtatgagatgctttttaagttagctctacttgagacatgataaaattttagagcctactactagctgcactattgaccttgctctaatggccgcgcacacgccgactgcttaactcgggcaacgcccccctctcccacaccctgcgcgcgattagtgcaagacgcccgccgctaattatagtcattagtgataattacagtaattactgttaattatcataattagcatttttcaaaatacataaataattttaaatttgagttaattttttttaaattttgatatggaagttttcattaagttttcagttagaaatgaaaatttagaattttgagttaaaagttttacatttttgcgatgaaaatttttaattgtgagttgaaagtttttgaaatttgaattgaaagttttcaaaatttgagtcaaagttttgatttttgagttaaaagttttgaaattggagttaaaaattttcgaaacttgattcgaaagttttcaaatttgaatcaattttgagttgaacgtttcaaaatttaagttgaatgtttcgaaaaataaaaaaacgataaggaaacgagtggagtcgaaaataaggaaacatagcacgtggatttgtgggccgaaaatcatggcgaaaaaaggaaacaacaagtaggctggtgggccgaaaatcacgggaaaatgtgaaaacagcacgtgggctggtgggctgatgcgcgaccatactgacgcgtgtgcggcagataagaatttcgcaagtaaacaccctagagagaagtatataaccaattgctccctaagctaggaatatatcctacgaagtagttttctattttacgagaaattcttgattcacaaacgtttcccagccacactcggtcaaatcctcttctcgtcggctccggcgtgcatgccagcggcggcggcggcggcgagaaacgctggcgaggaggcagcggcgagcgcttagatgctagcgaaccagcgaagagggcactgcagcagtggcggataggcggaggctagaagggagcagtacggccagagagctagggtttgggtaatttggcgagcgaggagcgaggggaggcgaagggagaagaggggggggggggggggggaggagaaagagcgggggagggatgagcatagtgcccaaagagacgattgaggtgatcgggcagagcgtcggcatcgccaacctccccgccgatgtctccgccgcgctcgcccccgacgtggagtaccgcctccgcgagatcatgcaggtccgtcccccccgcgctcccgaatctctcgcttcccttcggttttagtttcgtgcactttgggggactaggaggcaacttccaccattcccttcgtaggaaaattgcctgcccccccgaggcgtggatttgtagtttctgggtgatttgggaccgcagggagcaattgcttgctctttgttcttcgttctctcaattgattgctatgctcaaccattgtgctaagttgtgtggtggaatatttgcgatagacctattccaatgggttttgagtttgctggacgagatgcgtttccatcttgttgtttgaacatgctggttcacactgactgcttaactgtgtcctgctcaatatatgttcactgggtttttgtagcaatgcaatatattggacggtcttcatagcaatgcaatatattggacggtcttcatagcaatgcaatatattggacggaagatggttgttttttttgttcactattgtctcttcaaaagcattgaagcacaccattacagagtttctggactgttcaatcttctctcattcgattgcatgctatagcttactggtaacatatgttggggttttgttcctgttttatcaccattttttttaatttgtatatatttagtgaggtagtgagtctaagaatttgcgttctatccactatttacacgataaattcatcatttgaggttttctttactgaatcttggaaatatgttattcctatctgatctttactcataaattttggaaaactatcattgacaaactacagagttgtcacaaaaaatacaaatttaacactgcattaccagaaaaatacatatttgagccatatcacacaattatcgatttagcaccgattttatcatgaaactacaaattttacaggtttcatctatcgtgatgaacttttcataaattgtagttttctcataaagtccgtgctttatctgtagatctataatctcgttgcttaagttataaatttggtgttacatctgttgttttgcgataattttctggaagtatatgttgatctgcaaaatttgtatgtaagcatataaatattcagtcacagaaatgccattccattttctcctaggcactatatgtattttattatgctgtggattgtgacaggaggccatcaagtgtatgcggcatgcaaagaggacagtcctgactgccgatgatgttgatagtgctctcagcctcaggaatgttgaggtagtttctatttcgttgacaatattttttaggactactaaataaaggttttgtagatctagtaactgttgtatgcttgaatgcatcaaacttctgagttggatagctaaatagtcgagctcagtatttctcggaatcagctcattattaagctaaaagtataaatgtttaagaaacttagagttgacgatcttttcatggagacatgttagccataaataaggcaaactctatgcctgtatctgtttttggtatgtctgttccctgacatataaatgccattgcaatcatctcttgtttgaaaactgatactgcaattggtagaggcttttggtgtctgggtgtattcggtggtttcttcccctctcttcttctttaatacaaatatacaatccttctgttccatttgagaacacagctctcctgtgtgttcgagaaaacaaataatgtctttaaagcttgacatgtaattcctcaagggaacagctgaactgagcataggggagaaaccatatccttccattcagccccctatttctctgacacccactagttgtgaggttactgcagtccagtaggatgctgattttactttgcgtggaactgaatgagagaaagctgaataagtaggatgaagcccaatagtgtacgctgggtaagatgggggaaataatccatgtgaaaatacaaaataaaatatgagatatgtattcatgtcaaatggggtgtgctaagctaaatgcactttatgttagaatttgatgattatgttttttgtttcaaatcaaggactgagaactatgtattaaacattgccaatgtgtttatatgctgttgtatatgacttcgtatgtaaaagtttcctactttgcttacaagtaacataatgcccctttgccacgctcaatgttagaactgggaaaatgtgaaactgtttttcttttaatttcagattaagaactgagaagtatatattaaacattgccaatgtgtttatatgttttgtatgactccatatataggcgtttcctccttttttgagtaacataatgtcctttttggcactctcaatattatcactgggttggtttagcgtgctaggttggtttctttgatgttacttttgctacatattttcgttattttggttaaaatgttactgtagtggagtttaggtgggacatgattgccttcagtgtctaagacacaagctaaaaataatagcattgtattggatcataatctattaccacaaaaactgatgcatatgcagcaccgctggtaggaaatttgttgacattagtttttatggtggttctatgttatggtgaagttggcattaaaaagtattgtttcagtgcatttatttaattgctttgaattttcacacagcctgtatatggatttgcttccggtgaccccttgcggtttaagagagctgtgggacacaaggatctcttctatattgatgacagggaggtagacttcaaagaggtaggggctctactaatggatgaatcaaataacttttgtacttattttattatagggatcaatttgaaaattttcttattcattggctctgtgcagattattgaggcccctctacctaaagctcctcttgatacagcagttgtagctcactggctagccattgagggagtccagcctgcaattccagagaatcctcctgtagatggttagctcatatatcttatcttattttactctttaaaagagggagttggggggttatgctaggttctacacccacccccacgttgatcttttgtggctgtaaatatgtaggtatgtgttattcgtgagatttttatagaaaaatattgaatctttgaatatgagtatacgaggtggttagttggtgttcaattggaggatagttaattacctgttgcattttatattctagaactaacatttagttaggatatttggatccattccaacacaaataccttctagttatctgtatatggatttgcttccggtgaccccttgcggtttaagttatcttcacaaaacttacatcatattgttacctgctttatgtatacaatgttccttgggtgaggaagagattagttgtgggatctattaacagaccttagtgtgattaaatccgtgtttataatgttccttgcttgttcattatttgtagattttggtattatctgacaattagtgtttcacttcagctatcgtagcaccaacagagaataaaaggacagagcatgggaaagatgatggacttcctgttgacatcaagcttcctgttaagcatgtgttatctagagaactccaggtattgtggttactgtatattgttagagccttacataagatttatattcttctttactggtttcgtttgcagatgtattttgataaaatagcagagcttacaatgagtagatctgaaacctcagtttttagagaagcattagtgagcttatcaagagactcaggccttcatccgttggttccttacttttcctacttcatcgccgatgaggttgttatcttgctcttagagtctatattgtgcgagctggcattgccttacaatgtatatccttataatttcaggttacccggagtttaggtgatcttcctgttttatttgctctcatgcgtgtagtccaaagcctcctacacaatccccacattcatattgaaccatatgtaagtggttgatcagtcaactttgatgcttctactttctagttgttttgtttttagcattgcacacttatgtttgcagcatatttctgctaaagaaacaaaatttctcttgattgccagttgcatcagttgatgccgtcaattatcacctgcatggttgcgaaaaggcttgggcataggctttcagacaaccattgggagcttagagacttctctgctaatttggttggttcagtatgtcgaaggtgagtgaacacgaagagtactactcaaatacctatgcatcgcaatgggcttcaaatagacatataataagtaataaaaaatatgaaaaaggcgtatatatttcgtgaattaatcttgttacaagccatacaagcgaatgatcaaatagtccacagaatatgaaaatatcccactaactcaggatgttaccactactaggttcaaaaatatatatcataaattttaaatttttagaagttttaaagctgcatgcacaaggatctacttgtagagaaactcaactggagaaggacgagaagaaagacttgagtagcttcttttatcagatagtaatatgtgctatctaacctcattctactcagatccaagaatgttatcagaatctaatctgttcttgatggttacagtttctagacataatctttagaatcatttccacaccattatcatagttcttcatttcttctattccctccattctcttatacatgacatttgttatttcatttttggatgaatggtgtacggactctctgcactgacttctggatgaatgggaagtcaatagtggtttgacctccatttcctactgtgtcagttatttatttctaggataagtccattttatccccctcaattcttgcctttgtaacacacccccaaacttccaataccatacaatttacccgcttggaaattcggggggggggggggggggggttgcaaaatacctggttttgaagttcagtggtgtgttttagacaaaggcaagtagaatggacttatccctttatttcttggcgagacaagaacaattaccatcagttatggaaccgtttcctcacttgcataattctactaataaatagaatgttaggtagtatttgttttatgttacattgatttttgcatttttctaggccatgtagactaaaagctccacgctttatctcgatgcatatatttagttggcggtgactttgtctcatgtgaagtccccttagagaaacgataggggagaaccccacttagaaatatagcatacagtagataataaagcacaaaaaatttcaagacccaacaagaacaaggtctacaagatcataaaagctaggaaactggacactggagagtgttaatacagatggaaactaataaccaaacatatttccatgtggggcaggaacttgcttgaggcttattccttacggatttactatgtgtgatagcacctcttcttagatttatgtttagttggaggagctttgtcacaattactaggggtgggcgttcggtttcctcggtttaattggatcgggtttttcgggttgcttggaattcggttttcgtaaaatgtaaaccgaaggaagttctagaaaaatatcaaccgagcaaaataaaccgaagaagatcggttcggttttttcggggttcagtttttaccgagaaagatctatgccacagaccgcggttgacttcacgcgagtacgcacggcctgcccagctttgcccgagggcgtgtgcttgatttggagagggaacaggatttgtggatctattagctgtcatgtatttgagtgcttatgttaacacacttctgttatgaagtccctgcgaatggttgaacattacttaagttgctctgtggctagaggttaattggtttctgctgcttgtgctgattgattgccttttgatgttgctttcattgaaatacaaacatttctttttgtaggtttggtcatgcgtatcacaacatccaaacccgggtgacaaggacgttggtccagggatttcttgatcctcagaaatcattgacacaacactatggtgcgattcaagggatatctgcattggggcccagtgcagtaagtcctgttcaagctaatctaattttatatttcagcaaaattttgctcacaatttttgttctttaccagattaggcttctgcttttgcccaacctcgagacatacatgcagcttttagagccggaattacaacttgataagcagaaaaatgagatgaaaagaaaggaagcatggcgtgtttatggtgccctgctggttagattacaagctttcaatgaatacatgttatctatttttatgcaccagcttcttacctgtggaatgtatttttcagtgtgctgcaggaaaatgcttatatgatcggctcaagttgtttcctaatttgctttctccatcaacacggcctcttttgaggagtaataagagagtcgtgactaacaacccaagtaagttggtacttctatataatatatgtgttgctacttgcttggcaacgcacaacaaataaaaatggttattttatcggctgaacaatttcttctcagatacataatactgcaaaatgttgaaattattaaggtgtgaaagtaaggctatggtcaattcaaatttcagataaacggaagtctagtacagatctctccacatcccagccacctctgaagaagatgacaacagatggtgcgatgaattctatgacttcagctcccatgccaggaaccatggatggcttctccacccaattacccaaccctagcatgacgcaaacttcatcctctgggcaattggtggaaagcaccgcatcaggtgtgattcggagggatcagggaagcaaccacacgcaaagagtttccacagtgctgaggctagcctggaaggaggaccaaaatgctgggcatctgttgagttcattgtacgaggtattcggtgaagccatcttctcctttgttcaaccaccagagatatcgttctttttgtaggaagcaaatgcatagtgttcagagctatgtaatatgcattgtaccattaggctggtcttgtggaattcttgaaactgaaattgacgtctaggaatcttgtagtgatctctgatgctagatttaatcgcttggtgacttgctgctgcaatattttatgtgctgatttcttgaagttttatgtttattgtagtaattttatctaatgtaaacattttattacgctctactggtgcgccattttatggcatatgtacatttttgaaccttactgattaagcagagttgtcgttgacatgtgctaatgccaatgtattatttgcgttgatgaaggttgcataaaacgagagaaaaaaatcacccatatgagacttacctttttttaaatactttttaattttcagggtttagctaggtcacatacacaactcatgatatttttttttcctacataagttagcagctgcagaaccgaacaaaacaatagggatgcagagtgggagcagcaacagctgcagaggccttctctgtgttttgacatttttaacaacagtctgttgaacatttaaactttgttgtgaatttatttttttagcctttaactaaaagaactatacctttttacttccaagttttctttttttaggtaagacctcacaaaaataactaccgaatatagctatcaaaattacattcttcctttaaaatatggttgatgtaggccaatggaactgacagccaattcgatgtttcgcccatcacgcatccttccttgcctatcaagtgagcagctttatatgctgatcgtcacaccaattggaccttcatttcccggaacgattttaacctgctatcgaggttttggattattgtcccatacatagaacagtttactccaacctgtgttagcatccccaccacctccaaattatctattttaattatcactctatccaccccttctccatagtcagttctgtggcttgcctacatgccaacacttccgtctgtggcatttgctacctgtgaataaaaactagttgttgcagccacaaaattcccaaagcattcctcatgtccacccctgatgctcccttatgtttatttgatgaaaatgcaccatccgcattcagtggcggaggacggaaaaaaaattaggtgtggcggtgtggcccatgatcttctgcttaagatgcacaactagtgcccgggtttcagtaactcttcaaatctgcaaaatacattacacaaatgcaattttagtatcaaatttgtatacttcaaacccacaaaaatattctgaaattgttaacatttgaagaatatgtacatctttgtgaagccaatgcttttccttttctctttctatccattttttggttgataagttgattgcttggctagttggctgcttgcctgcttctgcctgactgcttgccttcttcctgctggctgctgcggtgctgcctgccgcctgccttgcctcctgctgccgcggtgttgcctgcctgcctggccgccggcccgccgcgccgctgccctgcgcagccgtgccgccgcgcgctgcctcgcgtcgccggctcgccgcgccgccgcagcgccggcgctcgccctgtcggccgtcgcccgcagcgccgcctctcgcctgctctgccgatgaggatggatcggggattggggattagagaaatttgggttagggtttcatggtaaagagcctaatttacacaagaaaacaagccgcacacggctttggcatctcgaaggtcgcagcgttgttcagcctgcgctctatcgccgtctcgcggtcgtcgcggtctctgcgtctcgcactctgcagacctgaactcccgggggtaggcgggaggagaaggtatggcgagcgccatacctcgccctaccgagccctccgcccctgtccgcatttacccatttggtggcttcgtccacccctgtgccggacttggaatggtgaggttcttctgctccctcaggttcgcccactcttccagctggaacaacaccctttccgccacagttgagggatggtccggagttttaatactccagcacataatggttccgggttacttcctccatcccaaaatgtaagcatttttgaggctggcacgggtattaagaaagtaggtgagaataattgaagaaggtgtgtgattggttgaaaagagaatgtaggtgaaaaagaatggttgtgattggttgagaggagaaggtaggtagaaaaatagcttcattttgggacaaagtactgtgctaaaaatagctacattttgggacggaggtagtaactagcagtctccacccctgacgagccagcagagcttgattgaaatcatgtaaatcccgaaatcccgatccaccatttctcttcgttcgacacgtacgttgccattctatccagtgcgtcttcctttgtcctttctttgcaccccaccaaaaatctgagatcattgaatgtaagtccgtatctgagaacataggcctttggagatctgaaacacactcagagtacttcctcagtccaaaaaaagtcaacgaatcttgacaacgaatcttgacatactctatgtccagattcgttgtagtacgaggttggtttttttacagagaaaggacgtcggtatcgtcaatagtacaaattttatcaaattctccttccctgacttcgacaaaccctgccacttaagagtcgaaattttctcccacatcttttacttgatgttcttaaaagcaccttcttttgatctaccaaccagtgttggcagtccaagatatttatgatatttttagaatttgacaaaaccacatgtgggatatttttttaatagaagtacttgactactaccataaaggaatactccctgagttccaaaatataagggattttgatcggatgggacatatcctagtactacatatctggactgtccaaattctcccattcgatcaaaatcccttatattttggcacaaagggagtagtttactgtgttacgtgtgttttaaaaactgaagaaaaataacatatttgctaaatgacatttgacaaaaaaagaatcaatgcaaatcttactattttgtgagcttcatacatactccacaatttgtatgccatgacctccttctctagtctaacattatcatttggagggtgggcatctccagcgagtggttaggtgacaatggacagtggcagtagatttgacggctggagttggcggagacaagagagaatgacagtgtgggagaatcttcccagagttggagaagaagaggccggaaaagaaagtggcaatagatagaggacagcacatcgtccggctcattctaggcataagtggacatggcacggagcagtcaacgattgcctctgaaattgaggcaggaggcttggtgggaggtagataggaactagggttgattgtaggttggaaagagaagtatgtggattgtgggatctcaatctaatataggaaaaaatttgactaatatggaatggggatttcacgcaaaaataataatgtagaatcgatgaccattgaccaattctgtagttaaatacgaaagggatttgaaataaagttttaagggccaaaaaatgaactttgttaatataaatcaccaatgattttgaaatattttcatgaaaaatgatttttgaaataattatttctaaaatgttagcacttgatatatttgattttccttaaaaatttaatttcaaaaatttattagatttgtgtaattattccacataaaattgtgataaaaattcacctcaaaaactgtgaaaaaagacataatttcttactttgaaggcatttattctgaagttttatgtaatttactcaaagataaagtgatatccgtttaggagtgtctatttcactacctaatacatttgttggcaggggcggatccagcatgagggcggcggggtctcgagctcccaatactgccgtgaagactatgagagaacccacgaagagcccactaaatttttttaccataggtagataggaggagggactgcaactctatctagctagtttgctcagaccccactgctatttctttctagatccgtcactgtttgttagttgcacaaatcttcaacataaggaaccttgtttagtgatatagaatccggatggttttaaacaaaagtaggggttttagaatgcaatatagctcaggctcgtcttggctcgcatagtcgcatgccaaatgagccgaagtcgctagcagctcagtggctcactctggcgcttttctttaaaactcatgaactttattgaagattagattaaaagcatattacatgagcgatgattacatctcccaaagggagtgttgaaaggattcccaaaatgggactgcttggaggataataagcatgtatgtctattgttatgacaattcagatcagtttaaagttggctttgagatttctagccttttttgcaaggctatcagcgtgcttgtttgcttctcttggaatccatttgataatgatttgtgttgagttttactggaagtatagtcatcctgttgcaaagtttgaacaatgatcccgcaatcggaaaggaataccgtggttcccatagaaagtgcagagcatatctgataggccatgattattcctacaagttcagcaagcaaagacgaaatatagtttttggaatatgcttttatcagataaaaaattccaaatcatgcttcattgtccttccaatatgtgtaaacatagcaacgggtacctgtaggtaagggctgaacagaatgtataagtgtttggtcttgattgattacctgttgctcttgttgtcggttttgcataatgtgttcataagtttttgccatagcttctgctgcgttacagacctaaaaaagcttacaagtttttgaattgaaaatatggtcatttctagctttctagattttccatagtaaaactgaaatttttaaaagaggtttggcattagtgaagttgctactacctccatcccaaaatatagcaatttttggccatgaatctgaacatatagccagaaatacttatattttgggacgaagggaatagaagataagacaatgtctcaaatagcgtgtaaatggttaagggcatctgctttgagttgaaaatcatagatgaaccaaataagcctgctgaaataataatgaaaacgcagttggaagttttcggacataggagcttacacgagtaagtttacttaccgcacctatttcactaggtcaataaaatttgagagaatcccttatataccactctaaattaaccggctcccttatatgccacttcaaatcggcttctcccttttatgccaccggttcaagtttctcctcccttttatgccattgccgtcagtccacagtcagttgaccgttaacttcattgtaaaaagacgcatttgccctttagaattagtatgcaaccaataataggtattttagtactaatatagctaccagatacaacatatgaaaattgattttttctgcatcacattcaattttagccattaccatcacaaataaattttcaatgtaagcatgaaacatgcagttttccaacaatatttttaatataaagagcatttttcactggttctgacaaaattttgttcactaaaaaaggatttaaaataaattagttatgatttttttgaagtttacacttttttagttgagagggcatattggccatttacggaaaaaaactaacctttgactaatagtcaactgtgggagtcgcttaaaagggtgaaaaaacttgaattagtggcatataagggagaagccaattttgagtggcatataaggaaactggtcaaattctagtggcatataagggattctctcataaaatttgccctacggaagagaacatacatgatttgggcggcccttaaatgtaagttcttttttattggtagtgaataaccgatgttagacatcggatcgccttgagaagtttgggatgtcacacccggatgtttgccatctttgtgatcaacaggaggagacagtacctacgttacccagatacggggatacggatacggatacgcgatacgtcgatacggggatacgcttatatatatatacatatatacatatatatatatatatatacatatatacatatatacatatatatacatatatatatatatatatatacatatatacatatatacatatatatacatatatatatatacatatacatatatattaaaaacacacaaaaaattaaggaaattgtatttatatatattaaaaatacaaaaaaatcaaggaacttttgtaaagaaatagtgatataatactagtattagtgtagccgattccatatcaatattctgcaattttctcttctataggcaattcaaattaagaagcgattaagatccccaaaaccaaagattaatagttcaatcatatatttcttgatgactttgcatcaacattaacagccgcactaaccagtaaccactaggattgctagatgcactaccacttgtaactaacaaaaacggtagtactttgtcctaaggaaaacaagaaaggcgcagcagattcaagcatgaaacttttgaagagaatggattacccggccaggcggtcaagcgaagaaagaaaaagttctgctgtcgaggttggcggcgaaagaggtgcgccgccgcccagcagcggcggctctgtcgtctcgcggaggggacgttgtggccccatgcacggcagcgacgcgcgcggctgcagccggcgtccggcggcaacgccgggcatgcacgagagacatcagccatcaagttgggccaaagctcgtgcggtggcgcatcccagatgcgagcgaagacagaggaaggtcgtgggcgtatcgctggcgtatcttgatttatttatttttttgcaaatcacaaatatgtgggatacgtacgggatacgtattggagcgtatccgatacgtatccgtatccgttgccgtatccgacacggatacgtgactatacaagcatatcagggtaacccacaacacatccttgtgtcttacatccgtcccataatcattgtatttctaggattctctaacttcctcaaggcgattctctaactgatgatcccaagtggtcagaggtgtttctaagaaagctaagaaatggctaaactctctaattatcttagtggcttggaaaatttggaaacactgaatgattgtgtctttaacaatgccacacctagtactgctgccgtattggatgctgtgccaagagagtttattatggtgtactgctagagcctattcattaactcttggtccggtcactccccatgtaggagcttagctcctaatggagttgttgcgcatcgcttcggtgaagccctttatcttttttttagagtgttcttattgaagttgttggtcatatgggtccggggtacccatgctgaggggaaaaagtcctttcccccagccacgtggccgagcggcccggatcccccctcagggggtcagacgcgtgggtaataaatagccaagaggcgcccgagtccgcctagggggctcggggtatcctgtcgcaccccgaggccctcactcggttgccacgtggcggtcgagtgggcggagataggggcgttgccaggcgtatttacgggcggcgccccaaccgccccccgtcgcatttaatgcggtgtggctggtcgtgcgccgcccagtgattgacgtgcatcaatttccttgaccgggctctgaccggccaccggcagatgggacaggcggcatcgcacccacgtcctaccctgtgtcaggcggcgtggggcaaggtatgccccgtctcatcaacggcagaggatcgatgttcgaccggtgcatcccatgcgcatgtacccacaaaagtctacaggaatttatgaaggaatgacagggatgtcccccgtgtcaggcgaaggacgacgctggggcccacctgaggacgagcggccaccttactttcggcctaaggcatgggcggtagctcgacccaggttgatgtgggcccctctctaggaaggagatgtgtagaggcggtgcatgtggtatccccttgaactataaaagaaggaccttgcccaccgagcaagagggtgactattgggagcttgagccttaggagaagactagccaaccgtctctcttgggtttgagatctcttgtaatagcgtaaacagaaatccacacaaaggagtagggtattacgcttcccagcggcccgaacctggataatctctcgtcgtcctcttgatcgccatccaccacgctagcctaatccacggcgaggttacgctcttgatcatcgtgccctatcccctggccgaactcacaaagaggggtctcacgtcctcccgctctttgttgtacaaactttctattctcttctaagaaataaaacaatgagcaatattttttgggtcagttgtaacctgtccattcatgggggttcctaacgcgcgcgtatgcgccgcgagcataagtcatgcacacccgctgacgcgtacgctgtgccccgtcgctaaccatgtgattagcactaatgatgatgtgattagtgattagtgctaatcataattagtgcctacaagaactttttattttttctaatagattgaaaactttaagttagatttgaaaactttcgacttaagatttaaactttgaagtcaaattttgaaatctttcaactcaaatattgaaaattttcaactcaaatttaaatttgcaatataaaatttgaaaactttcaactcgagatttggaaacttacaactcgagatttgaaaactttcaactcaaatttgaaactttcagctcgagatttgaaaactttcaactcagattttttgaattataaaaagtattttccattaaaaatatcttacttcctccgttttatattataagattttctaacattgcccacatttatatatatgttaatgaatctagacatatatatatatatatatatatatatatgaatgtggacaatgctagaaagtcttataacctgaaacagagatagtataatagaaatttttaactttcactacatcctaaattaattaagatgaaaacattaaaataaaagattatgcatgcatgcgtgtgtagggacatgcatgtgtgggaccaaggtggatgcgcagttgatctgccgtgtgcatgcgagataagcatatggcgcatctgcgcgaattagcaaaaccgccattgatgaggatacttcaaatattttttctccctttcctatttagaactgcttgttgaaaaaaaaaggtgtttctatctaaaatctcgcacggttgcacccaatatttctgcgggccagccacacgcagtcacgcacgcatcgccgcatcagtaaacgagctggtctgctatgttagccgagccaaagccaggctcggctcggctctccgcagagcagatgacgatatgagctactagcagcagcagcatccaacgacagaaagggaagagattttcccttatcctcttgatggagctcctcctgcgtccctcccctccgccgccgtgggcgattccacggcggagctctggcgagagaaccaaaccctgccgctcccgctcccgctcccgcacgggaacctctagtgcgtgcccatttccttctccctttccgtttcttggaagcatttcttggatgatctttcgagctgtttattgcgatgcgagctcgtaggaatttgctggattactttgaacatgtatgtatttgtgtgagcatctttgttgaaaattgagggtactttgtttttttttctgagcttttgcttgccactttttcctacgacaaacatgctggttccgtttctattttggtaacatttatttttcaactgaaataagataataaatccttcacaatttggagttctaccattcaaggtttgttttgtggaattataggtgcaggaagcttacctgagttagcccatatataattttttatgcttaacacaacaagctaacttgtcaaataggaaatgccaatttatgtgtttcaccctactttggttgattctctgataatgctaagctaactttgttgcagtggtttgaatacataagctgcggagctttcttgctttcttgtttttcttgcttgcaatattagtacacatggtaaacaggaacccaagttcacagttcatgtagttgggattgatcatagaattcactgtagcgaattttatatgattgataatggagtggccgcctggccggtggacactcatgttgcgccgtataaatatcaaatagaaacttacacattctgaagagcgaacaattgttttgaatctttctgacatgtgctaccacttgttttgcagagcaaacatttcctgtccctttactggttggcaaggttggaagacgtccgtttcctgtgcagtgttctatagttcgatgctgcttgtcatcaactgatgccatccattctacaagtgatgacatccatgaagataatggacacggccattttcttatgaagtctacatctgaccttcaggtatgatggtgagtcccatgatatatatatatttttatcctgttatgtttcacctgattcttaattatataatgctgtaaaatacccctttattcatttgcattatttttcttaaaatagtattgtatcatctcgatttttagtacaagtcaatctttactccttgggctaatgtttactgataacatcaaaacatcttttttcttttcagaaagtgatatcttcctgttttgggaaagcatgtcttctcagttctgtcatgcttgttctaccacccagttgtttcgcagaaccgtgtgagccagagtactctctacctaacatgcctttgctttttgcaattgccatgattggagctaccgttggaggtaagatcattacaatatgaagtacagaaatgatggaggcatgtagaaacatgttgtggatagcaaactggatataacattcagccttccagtacacaattttcttatatatctacggcatgatacttattgtgcagaatggtttgaagaagattaaggtaatagaagagagtgagagacaaattggaatgagagaattagaagtattgagatatagcaaattgaagaagagaaatagttattatttcttaaccatcatccttgtattgaggatgttgctatgaacacatagaccatatctccaaatatccattactcaagtctccctgaaggttgttttggcctcttgttagtccctcccatccagccatggtgtcctaaccctcctttttattgtgtttatccccataagtccactgtggtgcgtacaatcctttcactttttgaaaaacacatacctggtacaccaaatgtacattaatgaaaatttcaataaaataattccaaaggagttcatatgtacagtacacaactaaaagctaatactttcaaattaactgttcatatttgattggttgattggttaatatttaaagtacaggcatacccactttacctaatgtttgacatgtaatcccgtatagtacacagaatagaccgattcatatggttatcatttacacacatcctaagttccaaacatccaatcttgttttgtttcttcaatatattgttatttacaattgtaaaaaaaaagcagtaaataacacaactctaggcttgaggcatttcacgacccttagagaaatattaataagtgcatgtgctgagaatgtgaattgtcgctcacaatgtgggcatatgctaaaaaaaagagtttaatcctattttttaataaaattgcaaaatatgcattatagatgcctcaaagcctcaaaacccagagttttgtgaatttgactgtaaaaaatatcatctatctgtgtgtattctagatgtcttgcctcatatatctttttagcttattgttgcttttattcatttctgatccagtaccagttataaagtcttaaactggaagtgtgatatcatcagattattcaattcgcatgtttccatttatctatgcaactatgtgggccagtatagttggtacatcatactacttcatcctctttaagttggttttactatttcttaatatgttgaaaaatttagatatcctgtagggctccttgcaagacaacggagaggggagcttaaacgattgaatgatcagctacgtcagataaatgcagcactgagaagacaagccaagattgaatcttatgctccttctttgagctatgcaccggttggtagtaagatacctgaatcagaagtcattgttgatccccagaaggatcgcttaatttcatatctgagggctgggaagaactatctgagaaaccaagcccctgataaggcatttcctgagtttaaggctgcttttgatcttgcacaatccttgggtgatcacgtcgaagagaagaaggcggcacgtggattaggtttgcttcccatcaataatttactttcatgcctttttccatgcacgtttgaaactggatgttataatagccaccttgattgttgtagaatcccctatagattgctttttttatgaatgaacgtttttgaaatgctcgataatgagacacatgttcatatttatgctgattcctgaaggatcttttttccatgttcaataaaaattcaagaaatgcgacctgcaaaaatgaaaacagcaaacaatctactgatgttcgttttttatttgcattctttaggagcatctttgcagagacaaggcaagtacaaggaagctataaagtaccactccatggtgttgaacatctctaagctgaccggagaggacgcaggtgttacagaagcctacggtgcgatcgccgactgctacactgagcttggtgagctcgagaaagcaggcaagttctacgacaagtacatcgcaagactggagaatgactgaacagatttaaagaaccgtgtgtgcaacctttgagagctcaagtagggctgtgtcccatcttttgccttctttggcctgtcttgtagcaacgtttttgtagtggacgctcagttcatggctgtaactgaggcacatgccatctttcaagttatttctactaaatagtgtcatcagattttttttttctttgtctggtcaagatcggcaccatgttgtgtaaaatttctccatctgttccaagttataagcatggctatgtatctggctatgcttgtcctgaatcaggaatgcttatgttttgaaacagaggggagtagttgtagcagcaggaaggcttgttcttaaccttgttttagataaaaggtttgcaaaaaataatagctttaattgttttagataaaatattcgcttgagattttggggagtgacggatgacaccgttacctatgttatgcagttttttccccctaaaaaatggttataggttttctgtgagtttgaaataattggcctagccaatcatcctttcagcgatacaaattcatcgttctggaaaataataggttatatagctgctagtttatgtcccactaaggatgcttggatttgatatgattttgcccggaaattcttgagcaattcaatcacaatactacatggagattttccaacattgcaacgtcaaacactacatatgaagtcacctaaccgaatttggtttagtataagttataaccaaggacgcatatactgtgcacgccagagaaacttggaggtcaaagatatcttcttatctgttgaatgaacatgtacgcatgtgcatactctaaataaatacggactaaataacacaccttcgtagaaattttgccatcaagggtaaatatttcttgagttcacaaacccacatgacgctttaagtgggccaagggaccattttagactaaaagataaacttaaaaaggaatcttttgaataaaattaaaacatgaagggtgccaatctacagaagggctccctccctacaagtttcaagttggtccaggacatttcagtttttcatcagtaactcagccaaagcctgttaacattccattcaaaatgctgcaaactcagccaaagtcgctccctatacacgaaacttcagggggaaaaaatcaggcaggattgttagagctgaaatatcacaaaaattcgaaaccatatggattacccacttgcccaacaaccagcatactggaatctgggcattcgtcagtctagggtcacagtgtacactacattagtaagctaggatcttgctcattttcttggagggtgagatttctattcctgtacaagtgatccactttagtattcatcaaatggaacgcagaaataacatggcagcagatctctcagaaggaaaaaaaaaaagcaagcgctgcatcagccgtcaatgacattcaaaacggtgatcaggtaaactgaagtgtggtcagctacgaggccaacccccaccagaagagcctagctgtcggtacgggtattgtggaacccctcgtgcactgtagtttgtatcctctaaaggtggagcatacttgtccataaccgagcttccagatgcacttggaaccagggcgtacatgtccataactgagcttctttgtgcacttggagccaagaatccaggagcatacttgtccataatgctatatggtgtactcgtaccggggagtccatatgaagatgtttgctgaccatatgtagcacctgaagatccaagggagtattgacttgtctgtaagtaaccatcagcatgtccaacatgcgttcttggatgtgcctgctcatgcaatgttgatgggaccctactggtttgtagataattatcatcaccaacttgtcgactgtaccttgtggggtgtccatgcaaaggtgcatcaccagttgtgctctcaagagaattagtgttcctgtcttctgagcgctgcgtcctataaaacctgtcactatctcttagagattgcaaactgtacacgttgccagttggggcagtgaaatgctgcctgttcacttcgaagtcagtaccagggctgaacttcctggagatatcatcgatattggtatgaaatggaggatcaatcttcccttcaaatgcattgttgcattcattattgcttgctaaatatctgccctgataagtagcctgcttagagacaagatgttcttttggaggataactaataaaactatctcgacctgtactcttatcagcagggtgtccaattggaataaaaggggaaccgcttctggatttgttttgagcattactggagtcagaggatgacatgctcatgtcagagttcgcttgttctgtgaatttggcacccataatctctgatcctctatgagcatttaatctgtctcctgcatctagttgtttttcttggtgagtactcttcttgataggaatagccattctttcctcataagcaacttccacttgtttttctggagggaggctcccatcaacctgatcaggggttcttttcctgctcctgttatgagtgctattgctttcatccatgctatgctctttctcctttcctgattgagagatttgctggtaattagtctcagcttgtttcttcacaggaaggctatcggatctatggtactctttagctttcacttgtccatatccagcttgtgtcttcacaggacgatcatctgatagaataacctctctgacatcgcatgatgtcttctctgtagtctctttctctttgcctggtccaacatttcgtttgttgccagcttcagcctgtctcctcacagggagatctgatagattggtccctttgagattgcatgaagtttgtcctgcattctcctctttccctgatctagagttatgtataccataagattcagtttctttcatcatagggaggttatctgatagattatcttcttcaacatgggaagcgatcctccctatgctagtgtggttatgctcctcagctactttcctgtgcttccttgtccaatcaggatggctccataaatggagaggtggtgcagaggcattccacccttcaactactttatcattaacatcaacagaaccaggcaaataaaatgcctaaattacaagaaaaatgttaggaagaacgggtatatgataaaaaggggaagtttaaacttcaataaattttcctgacggtctttacctttcccgaaagacaatcactatcctcccaaatcaaatcataaggtgtcttcttttgatccaacctgatggccaaagagtggagacagatatggaagtaaggaacatacgttacaccaaaataagtgatattatgtcattatgtgaaagcaatatcaggtgaaatctattttttttaaaaaaaacatagttaaaatccaatcagccccaatttggcccaggcgatcagatgcttcacattaaatactttagatcttcacctgatattttgccatgtgttagtaagacaagttcaactcaattttctaaggaatgggtacgtgttggttacctttttgtttcctttgggacaatcaatataacgagcttaggcttaaaggtcaatgccttgtcaataaatttgttcgcaagagatgctttgactccaaaaggaggattaagccccattatctaatcaagaagcaatcagatgttataattattttaaattagcaaatttgagttaaataatgtccaaattaaacatactagtttggatccatgaggcaattcttttggccgtacagtcatccaatctttcctttcgaaggcgaagcaattctgcaaaacacatacacaatgcatgcttatcagaatgtgcatgatgacctgttaaatgctaatagacttcactttctggctatgataatagagtttggaactggctgagttctaacgcatttgcattgaggagttctatttaatataaaagaaagcaatggcattccaaaggatcataaaactcagattttttttccccagaaggaaaattgaatgaaaaatgattgatggcctccattttacctgcggctggataagatcataattcttgaaatgacacttcttctggactttgtcaagtttttctttcatcaatcggctgaaatcatttgcaccacagcagaagtccactatctacagttaattaaatttaaaatgatcaaggactggtgtaaaacacagcattggactagtaatgttatatatctgtttcagtcaagggataatttttttttaattagaacaatattttcagaccaaagaccatatggtccagcttctattaaaagctgcaaggaacaagtttcttttgcacgggacaccagcttacagtggcaggctgaaagcacagggacctatttggggacaaccatccatacaccattcgaaagacccaacagaagaactcagagataacccagctcgatttttatgagaacagtaaaggtgagccatactcaaatatttatatcaatataaaggtgtacaattatcatatgataccagatacaaacgtatcaaaattgaatattgatatggataaaagctctaatcattccttaaagagcaccaactaagataacctgccaaattagacagatcactactactatagaagtgcaggcactactggtagcttattaggccacagccattttattgtattacactcatcatatggaggatgtaatctaccaatgaataaacatgtgattcttgtactaaaaaatacataccgtgtcaccaggttccacgtagcaatgaagcttatcaacaatctataccaagaaacaagaaaagtaaagttacaactatattacccaatcaagagaaataacacataaacaagaaaattacataaaccacatgctaaaggttatgttagcagaacaccgcagatttattggctaatggcactcatccccaaggtattgcattcggttggttttactatggatcaatgaacgttgtcaacaaatttgtccctgcctccaacaaaatcctact

SEQ ID NO: 58889 - DNA, 1067 bp, Oryza sativa
aggagcacgcccagaagacggttaaggtattaagggaccgaatcgctcagctccaggattcaaactatgagctgagtggttcatcaaaaggtaatccctagatccgtttcatcggtttaaactggcataactgtatcctcaaccatctgaatttcaaacagcgcaagccgccaggatggaacagatggcgaagcaaattgaagccctggagagagacaagacagaactggctgcgcaaagggactcagccttaaaggaagttgaaggtaccgctagcagacaatctgagcttctctctttataatgcaataaatcctcatcataaatgtgttttgtagatcgcaaaataaaatcgcaagcccaatttgacgtcttggttggtaagatcaagaggcttgaaggagcaagggataacgtcgccaatgccgctgcaccaataatccaagccatgttcctcaataatggtggtccgagtgcactcgacgcaaccgaaatatttgacaagctgagtgttgctccgaaagtatatttcaagaatatcaagaaagctgaaagtatgggagctggcatggccttggcgatgacaaaatccttgtacccgagaattgaagtcgacaccattgatggatttgcagacgggacaagtgaagaagctgcccttgatcttatcagcagtgcgcaaaatgcggctgacaaaattgcgagcgatgttgtagagcaatttcgcaacaacgacctccagccgagtaatgaagactctgatgatgaaaggactgattctgactgagtttgaatgtaatacatggaggctcaatttgtacaatactggtgtatttacccaaaattttcaaaccggccaaattacccccctaagtcaatccggggtggttttggtttgacgtggcgcacacgtggcactagtttgattgatgtggcagtccaacatggaaataacaataataaaaatggtgggccctaccagtcaggcacctattctgattatacgagagagtgagagagggcagaaggggtgtgggcggcggagctcaaggctagagggtaccgag

SEQ ID NO: 58890 - DNA, 1147 bp, Oryza sativa
ccagcgccagcgccgtcgtcctcaacctcgcgccggcggcggcgtgaggagtacgagaagcaaagcggcgcgagcagcagcggccagccggcggtctggagaaggctggagagccacttgcggttgccgccgcggaggaagtaggcgcggaggaggagcggcccgcacgccgagccgaccaccatgaggacgaagttgacgacgaggagcgggctcctgaacagtctaccggtgctcagctgctgctgctgctgctgctgctgcttggtggtgatcgcgttcttgcatggctgtcgctgcgtcgtcgccgcttccacctccatgatcaacaaagtgagcccgagaatgagatattgcgaggatgatgagtgtgcacggcgacacggcggtttatatggaaaactcaattcattccctggggatatccctcatttatacatgtcattttaaaagttattaaattttttttaaaaaaattagtatgatagatcaatattcctatgtgatatgtcactttacaaacatgtaaattcaaattcaatttatacaagtatataaaaaataacaaatttaactatgaatagaatacgtaattcacggtcaaatttgtttttttttcgaattgtataagtcaaattttaactcgcatatttgcgaaaagatataccatatatggatctatcttgacaattttttttatttttttatatctttgtaaacgacatgcacagaaacaagaggatgtctctttgagggacaaaaatccacttccggtttatatggcatacgggtgcaccgtgctgtgtaccgtgtacgtcccgtgcaaaaatgatttcggcagctgaggttgtcacgacacacgaacctgacagctgaggttgtcagcttccggcgacgtccgctcggtcacctctcggtgatggtacactgccaccaccaccaccgcaacagcccatgtcgagaacactaacgcgcgcccaggtgaccaggtccagttgcacctagctaggctcgtagcgcgaatgtgccttttctcattgtcaaggcccaattaatggcttggcacaaatcgttctaccatctcggtgcccgagagattgcttggcacaagagattcgattgagacccatgcatttgagagctatcc

SEQ ID NO: 58891 - DNA, 11364 bp, Oryza sativa
atggacaactttgttcccacattggtcacctctgccatcatctaggggaatattacaaagctaagtcatcatttatttcattctttatatgatattttccttttcctttgcctcactacatcaactgattcaccgttgactagtgagtcgggggctacagatgttatcatattttttcaacaattttcataatatttatcttgattgcttgcgaaataatccgagtaacaataaagtgcctatcgagttatggagttctatcttcctatgcttttcgtttggtttgtcaatggatagttgcctttgggccgattcctagcacctgggggctcggtggatggaccgagtaacgcaaggtgctaagtattattcggaataaatcaaaagcacagagataagataaatttattttctgctcttaacaattgcaaaagtactcgagtagtaaattctgattcgtgaaactttgttccattaatgacgagctcatgtcactcatatgcatgtttgggaagtgcctaggccgactcccgatgcttgggggctatgactagtcggacagagtgtttaaacgtacggagtcatctgctcggggaaatcaaaattgacaagaggagaaatatatatttataaatattttaaaatacttgaatctttctcaagtactgtatttacatcagatactactcatcctatatgtttgttctgcaggatccagatccagatatgcataaaagggattaatggctttaagcttatctcttacgctctaggaatggatcagtcagaacatcaccaccggcttgctttcgcagccgccgactggtgtcaccgcctgcacggctggcctattatgccaccgttgttgggcgtcaacgtcttcaccgaccggccgcctcgtccacctccgactggtgtttccgcctgcacggctggcctattatgccaccgttgttgggcgtctacgccttcaccgaccggccgcctcgtccgccgccgactggtgtttccgcctgcacggctggcctattatgccgccgttgttgggcgtctacgtcttcaccgaccggccgcctcgtccgccgccgactggtgtttccgcttgcacggctggcctattatgccgccgttgttgggcgtctacgtcttcaccgaccggccgcctcgtccgccgctgactggtgtttccgccttgatagctggcttattatgctattactgatggacacctttgttttcaccgtctggtttttgccatcgccgactggtgtttctatcttcacgactatgcgtcttcgccaccggtttgcttccgctgcctccgactcgtgttcacttcatcacggcaatgcaactttttcatcatggtggagcgacttcatctttattatcttcggcaccggcaaactctattgctgctacttcgcaagttttgctacttcaccaaccacgacgtctttgtgaacctcgatatcttggcatgcgatgccgtgttattttactacaacaagtggctctccaatattcaggatttcttcttagacatcttcaacacatatcttcaatcaagcaatgactattcgacgacaagaagctacagttcttgactctatgttcagttgtttcccaactaatcaaagagtcgggggctacacaaatacaaggcttaaaatttgacaaattttatgtcaagctgaagaaatcaattaatcaaccaacgagtcaactccaggagtcattatcttcatctttgcttcggagcagacattctacttcaacaacttcaaatatttcggtttagacgagttggacaacagtatcaactctcctccaagtgaagcatctacaacagctataacattaatttgatggattattgtcactgacatcatcaccagcacctctgcttcatcggccctgacatctccgctgttgctaatggatgactatgtcttcgccgacttattatttcaccttcacggttgacctactacgcaaacgctgataagcgtctttgtcattattatcggctgctacaccgctattgactggatcgccgacatcgtcatcttcatcaacatcctgtcaagcctcttaagcatagcctacactgctgccgttgatgggcaacttcgtcatcatagccggctatctctgttgctgttaatcatcattaccgtcggatgcgtttgccgccgccgactattttcttcatcttcatgattggtggatttcgccatcactgttgatgcgcctctacatcttcatcacttttgattggtatcactatcttcactaccaccaatatttttgccacctctggtgggcaatattatttctatattggtcgtcttgtctctatgccaactacgtcagctaccatcaatggacaattgtgactacgtgcttaggggcttactagctcaaacacaagtatcataccttcaagttggattttgttttgatattattttctatgctcgaagactggaccaatcattactccccgtaagggttatcaaccgtatatttgcaccagtcaggattcaatttttgtatctattttggagtatcccataagggataatcactcagatcagaagctattcatatgagctacacttggtctatattacccggaagatttattactcgggagtatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttgttcaactttttaggagttggtacaatgcatcttaaaaggtgtcaaacagtaaagctttatatagctatcccgctgacttttttatataagtcaaggtgctgtttgggtttttaagcaattgattggatacaacatcattgctttttaccacgtaagtgtgcatttttattaaccaatattatagcttaggctgattatatatatcttggtcatttttcaggcggttggtaaatcctttatgagtttatttactcggatgttataccacatatgccatatatttccaggtgtggtgaaactatgtatcttttagggacttaagcacatctgttaaagcagtgtgcgcatggtgtatgcccaatactttggaaatttctttattcacaacatcaagctcttctttatagctgttttgctatgtgaattttcaaatatgttgtcaactttaggttgcacgcatcatattctgcaaagcagtcagtatatcacctggatcatattattcggggattcacaccgtatatgctatgtattggtatcaagtcacttggttgactataattatcaaaaaccactcagttggttggattatttattccctgacttatgcttggtttattcaattaaccccatggtcgggggctacacctattaggtgcatctagtcgatgcacctaagtttatatttaattatttttcagccctccacagtcttcagatttggtaaaagtagttgggagaccatggcaaagatgattgaagcactcggctttggagtaatctggtttgagagaagattatcttttcgactgtgaaggtcttaggggctactgtggagattatgggtaccctatacccacacggcatggttatccgactagtcttaggggatagcttatatctatggaatatgtaacagatcatgacttgggtattacgtttccttttatattatggagcggcctaaagtcctgatttgataatattgtagaatatatttaggaaaccgataccgtattggttaagatttctatcttgtaatcctgccccccatcctatataaggtgggcaggaggccctctagggggcatgagacacaactagatcgtcagatctatactacacccggcggattcaaatccccaaacaggagtagggtattacctctcatcgagagggcctgaacctgtctaaatcctttgtctccgcatccatccacttctaggtctcgtgcactaccccttttattattgctgaattcatgtttggacacaatccatacaagctaaaagttaatctaacgtgcctcaccctgacaacacctacatacattagcatttgttttgcaaaagaaaacacaaaaaataacaccagactctgagagtgctcaaggatgcatttttctagtaagttgcctaaaaacgatttgcaacataattattactccctccgttttataataaatgacgccattgacttttgaatacatgtttgatcattcgtcttattcaaaaattttacgcaaatatataagagataaatcatacttaaagtaatttaagtgataaaataacttaaaaaaataaattataattacataatttttctgaatgagatgaatggttaaatatgtgacaaaaagtcaacgacgttatcaattaaaacacaaaatctaaaccgagaagcctctcggtttaatcagctccaataaataaagaaactcatttgttctttccattggtattgggactcgggctcacaactatagtgacaatacaaatcaatcggtttttatctctattattataaaaattgaagatgtttttgctggtactttcatagatcattcgtgtttgagtcggttttaagcttcattcgcatttagaaatatatacccgcttttgactccgtttctaagttggtccgcttttgaaaatacaaaaacagtcatatagaaatctctttaaaaaaactcacatactcctaactgcagctcataattttctaagaaaatatatattcaagtgaattcccacagtgaatttcacttttaactaatatgtataaaaataacaaaattaaaatatgttttccagtcaacttaaaagaataaactgatttttttaatttttaattattcgtattttatttgttttcattggtttctataatgattccaagaaatccgatgatatcgcttgtgcggttattttggtctctgattaggccatacatgacgttttggattcgtattaagattttacgcttcgttacatgtagatgtaaatgtatgtttgcattcgatcacccagcgaatcaaagtaggattaactgtataataactaaaaatttaataaaaaataatattaataatggttagagttatatcatattataaaaataatttaggaatatcttcgcttgtagaaaaatatctttatgtattcatttatcatccatcatcagtccgaatgcggatcataaggatttctttttatcttggggtggattttgatatatgagaatctgaacaaattttaaatgaggaaagactggtcaaaaaagtaatttgaaaggtaaaaaagttggattcactttcaaatttctgaattgagtttgagaaaatttttggaaaatgtcaaagtacagatctaatgtttatcaaaattttagtttatcctgttgcaacgcacggacactttttccgagttatacaaaacgtaaagaactaattatggaattggaagggaggggataaggctaagctaatccttggggactttgcggtgaggatcgaatacaagctaggccagcacgcgtacacgcgcgccgccgaccgcggacgatggccacgcatcaccatggcgctaatccaccaccacctcgccgttccagtggctcccgctcctcctcctcggggtctcggtccggccaccgccgcccggcggctgacccttcaccgccgccgccgtaggagtggcgccgccgccggcaggatgacagtcacagcttcgtcgatggtggagccggcaagtggggaggagacggcggcgcgttcggcggcggacgtggtgagggcgttctacgacggcgtgaaccggcgggacctggcggcggtggagccgctcatcgcggaggggtgcgtctacgaggacctcgtcttccccaaccccttcgtcggccgcgccgagatactcggcttcttcgccggattcatgggctccgtcagctccgacctccgcttcgtcatcgacgacatctccgccggcgacgactcccgcgccgtcggcgtcacctggcacctcggtacacacatatctctacgtctagcgaattgagccattgataagatttgaggggatgaatggattcatctctccagtttttcttgctttcaaattcaatgcaaatggttattaaatatctttttaaaaaatatatacatattttacagtatagagagatatgccatctaacacttcaccaaaatttaatttcaaattcgagaaacacaatagtgagaaacaaaagaacagtaccactatcactagtgttcatctgttgaatttatttattttcataccttaatatatgagttaagttttgacctaagattttgtgaaattgtatatataatccatctgttttttatatatggtgtcattgactttttaatatacatttgaccatttatattacttaaaaaatttatgtaattatagtttattttgttgtgatttgatttatcattaatgttgatttaagcatgacttaaatttacatattaaaaatcatttaagcatgatttaatttgtcatgtcgcttagtgttcaaacgattatcaaaaaggtcaacaacgtcgtatattaaaaaccggaaatagtacattatatgaatgttgttaatttttttttttagaaatttttatgactatttacatggtgtttagataaatgagaggatcctcgaaggtttcaaatagttttcacattgataatggctagaattaagatgatcgatggaggcaatgtgaatttgcgattgtgtgcagattggaaggggcggccattcccattcagcaggggatgcagcttctaccgcctccagctggacgagaagcagcagcagctgcagatcgtgtatgggcgagactgcgtggagccagcagtgaagccaggggaatccgcgctgctcatcatcagggccgtcacttggatcttcgaacgctttccacgccttgcaaacatgctgtaactaactggcctttaattttgtatggtaactagtatttattttctcgttatgtgcactgtactttagcttataaaagaaattgaaagattgaagaatttggtgaacaattggctcaactgtaaatctaacaaacagcctcatcttttcgcttatgctacttattagcgaaaatttaaattttcaaccttaaattttaaactgattttagggttttttcatcgaagtttattttttagcctttgcttttagattgctaagaacacgtatataaaagttttatttacaaattacttttgtttgcaaaataccgtttcgaataagcgaaacaatagaactaaaagttgagcactttgagctagctgaaaattttcgagctcaaatagtcattatgatgcgtgttcaaggaacacaacctaaatgattatacagcttcatttcgggctgttcagctaattagcttgtattgctcacatgttctttgagctagttctaattagccacggctttgcgcaaatggggaattctcggttaaatcggcttattcgctgctttgcgctggaaggacgaagtgtgtgattggaaagatcatctggaagtcccgggcccctgcgagatgtaaattcttcatgtataccgcgatgcggggcgcctgtttgacggctgataacttgcagcggcggggttggcacctagccccggtttgtcacctttgctcccaagatagagagacatgcgcacacatcttcctcagctgtcgttacacgcagcaggtgtgtgcgactgtgcgtggccgccttggtctgtcctccactacaccgtcggctgatctttcctcctggtggcgctccgcgcggaaatcaatttctaaacaagaccgtaagactttcgatgctggagttatcttggtgacctgaaggaacgcaatgctagaattttcgacaacaaggccattccggcggcgcacttatgtgcagcaatggaagatgaatggaccacttggggtgcagcagggctgctgtgtccactgcaagccggaagcaacctgatggcgagagagcaacattaagccggtggtggtagctcgctgctctgtagtacagacgtgctttagtgtctggcaggcagcatcctctgtagcctgaatctgcagcttgcacctttgtaatttgtttcttgtgacttttttcccctatcttaataaacttcgactggcttccgccagcccggcgaattagccactgcactaaatatcgacttcaatttgctttgcaacgccattggaggaaacaaaaagatctctggaaagctcagtgtccttagaagacacaagcaccattactctcatctaatttagcaacatatccttacaaatacaagcaaaatgtcagaggagcaatgttattcaattgggaattcgtcagctccaaagcatcaatcgaaatgcagtggacaagagaacacactctctgttaatacatttgtacaatacactctgttagcacaacaaataacagaacatcaatgggcgagaagacgagaacacaccgcagcttcaacaaatcacaaaatgtccccaactgtctggtcttaaaaaaaatgtagaagagaaagatcaagaactccagaacattatttttttcattagcttcagttttctctatcatgtatacgtaatttagttctatccctctgcaacaagcatacatcaggttgtatacgttgatccttctttctcccttccacatacgtaaatacacactatatttttgtatttcttgaatatttgttcaatatcttaaatatcagagcttgcttcatcttgatattttcagaaaaccccaaaattgtccgtcatcatttatatcttaatatcagtaagtaggaaaactagtaatctgggtcatagcagaacatacgataaaaccagtaagttaaggatttacagtggcaggcaacaaattaagcagaacatagaccaatatcgcaaacgaagcaatgctatacgccacaatcaaattgaataatactactagataatatacatatatatctaagagtactccctttcagcatagaaaccaaccactagttaagtcatattcagcaagtgcgacacatacagatatagagggataacagaccaattcaccttcactgtgatagctccaggctcaacaactatttgttgactggcaaatccatggcggtttgctttgaaggaacagtagtgaccaacatcatttttagagcctttttcacataccttgaacttcaaatgcatccaggtatccgacgctactacgaccacataccttcttaagccacaaggctcgccaaccatgccatcaaagagttgaatttcttgtcgtaccttatcaataagaacaaacacactcagagataaattgaaaccccctaggcacttttgatatggaaacttctattgttgcctccactgcctggtaaaggtacgctaaagtgatgtcaactgcgccacaattgccactaacgcgacttgtcattggtctcattgctggtgttgttatctggctgtactctaatgctccatcaatcagttctagatcatcctcttctcgatctcctttttttatcctcatgtcaaactcagaacaacagaacaagacatcgaaatgcctcgcttagggccaatcatttcaatgcaagaaccctgtgaaattattataaattatcatttagtatattttcatattaaatttccaatattttaaactaatagcttggtttttataagaatgcaagggatatcaaataaatgatggcgtaaactacaggctctaaaaattgacaacttggtgttttgctatgacacataagttggttacacatgaaattcgaagtgttaattttagtatgttttgtgtgttattgtgtcatagttctcacattagatttattatgtcatggttcttacattagatcacgttggcaaccaggtctgggtatggggggcttcggtcagggaaagctacaccagtcttcaacatcatcactctactaggcgtggaaactagacctagggggatgtacaccagaggcaatggcggcgacaaaattggggatgggcagaagtggcctaggcaggcgtagggtagtggcaccggggccagtgcagaagtaactaacatcaatgcagagtggtgacgcagagcccatgaggaggaggccgaggaaggctccaggcagtggtaacgaaccaggtacagaggtggcaaaggcaggtggagctgcccagggcgaggccttcctcgcatgtggtagtcagcaatcacctgtggccacatgcatggagtgaggagggctgatagccgtgtgaagagaggaaggccctttttctcttttccatgggcattttgtcaaagaaatgcttaacccctattgatatgatactgtgagtgctacttaattaacgttaacggtggagaggcatattgatctcgctggtggaaccagtggcatcacaacaattaggaaaaaagtggtgccaaaatgataagtaggaaaaacccctgtggcatataccttacacccaacatattaaatcagtcttgtgaaattcatcgtgcacagttaattggtcatagatttgtgcacagcatacaaaactcaaaaggtgcgatggcatgtgtcattaataaacatatgctaaggacatttcaggtgctcctaggataaactaaataaaagtcatcccagaaatacattttttatggaaaaatgtttagtaatatagagtatggtgacatctgccacttcacaaaatttgaaatgtaaacagaacttgtataaggagaaacaagaattgttacttggaaattttttagccttcatcatgcaaagttttgaatttttgtgcaccacactctatgttgctgtgatttgtttgataactttccatgataaatatttacatttttaaggggatgggagcacctgaaagatgctcattcacatagacaaacattcttgtataagatcctccaagggacatgtatttgaagaacccatccacataagatcttcagatgcattgggagagaagaaataaaaggatatttttataactcaaacatttttatcctcagatgcattagagaaaagaaaagaaacataattttattgtacagactcactgttgtactcttaaatgattatgggttgacgaaactctcatgcttgttttgtctagaaaacctactgtttacttaatacatcagtcaacag

SEQ ID NO: 58892 - DNA, 4408 bp, Oryza sativa
gcgcgctccgcgtgctccctcgtcggatcctcccacgagcccaccaccgtcgcccgcaagcgcgcctgccgcgagcccaagcctcgcccggagaagaagaagaaggatccctcctccgatgacgcctccggccggggcggaggcgggggcgtggtccagacggcgccccccgcgagcggccgggccgcgccggagagccccagcagggggctgaagcggaagctggggtgcatcgagtccgccacccggatggggcggaagaagcggctcgagagcgagtacgagctcggcgccgagatcggccagggcaagttcggctccgtccggatctgccgcgccaaggttggcggcgaggagttcgcctgcaaggcgctccccaagaacggggaggagaccgtccaccgggaggtggagatcatgcagcacctctcgggccaccccggcatcgtcacgctcaaggccgtcttcgaggacgccgacaagttctacctcgtcatggagctctgcggcggcggccgcctgctcgacgagatggcgagggagggcaagttctccgagcagcgcgccgccattgtgatcaaagatctaatgtccgtggtcaagtactgccacgagatgggcgtcgttcacagggacattaagccggagaatatactgctcaccaaggcaggaaagataaagctcgcagattttggacttgccgcacgagttgccgacggtaatttttttttcttcatcttagattgatagtgttagtgacactgatactgaatttgaggctctacaatgttgagatgcgctctttgaggataatcttatgctgggatgcctcgagttgtctaagttatgaggaaacaaaaaatgtgcctgcaccaaaatgcattttttgttgtcatcagaaacaaaagttacccaaaggtagttgaagatcaactggaattctagcattgaattatagattaaaagatggtatcacaaagttagcatggacaacgttttagttaaactgcatctaacatgtaatattttgttgtgttattgtgatttagaggtgggtgccaggtttccaccacaattccaacttattaaatcttgaccactactcttttaccatgatcactagtatttttgcaggtttctcatatctactggccatgcatatcagctaaatgtgatgttaatatgttgggagttgtcatacccttatgagtttaagaatttaagcaagcattgttagcctggatcttcttggtttgatcatgtaacaaataaattaggctaactcaagtttacaaagttatgaggtccctcatttctggagtcctgtttaacttgtcattggcgactgattcagtgttctgtgtggtaccccacaagaagaaatttgttctttcgggatacaaacgagtgcaagctgtgtgttttggagtcttgagttggtagcagtgtccgttcacatgtcatctccatttgataggtatgctaaaagaattaaaattggtgagtcatacttgctattgggtttttgcttgggagtgtcatagctaattagttttaatagtttgcatggatttaaaagttcaaaacatgtgctaatggaaatggtccttgaaattgtgtgccaattcttaaggaattcttgtgcgaattgatatttggccggtctgaggctcaatgtagtgtccttgggcatttatgactttagtgatcagccggtgtacacactaaacagggcatttatgactttagtgatcagccggtttacacactaaacagagttaaagagctaagtgcactacttggtctggttatctaattcatactcatgaataattaaattttccttcatgatatgagctaccttaccttctcctgttaagttggcagtggttaattctttgatagtagtcctgtttaatctggtgctgtttactgatttaatgtttcacatagtggagcacgttctcataggaaatatctagaagtgagtgcaagttgtatcttttatgtcatgaattgacatcaattgctaagagaagtgaagctttatttgatctctgttgcaagatcagtcatacctttttttttaagctaactctgctgtatctttggttctaggcctgtaatagtccaaatccacctctaatctgtatttcgattagatgcgctgttgatttacttggactctattctttcaatcatgctatatgtagttgaattttgatatttacacttcctttccaaacaacacaaaagttttgtgaatgcactcagcttagtctggcctagtagattagaccattttcatttaatgcgtgaactgatatttttggtcttaattgagcaggtcaaaaattgtctggcattgctggtagcccagcttatgtggcgcctgaggttttgtctggatgctactctgagaaagtagacgtatggggagctggtgtgctactccatgtactgctgcatggttcccttccatttcaagggggttcactagatgctgtctttgaggctataaagacagttgaacttgatttccacagtggaccatgggaatcaatatcatctcttgcacgggatcttattagtcgaatgttgaaccgagatgtaccatccagaattactgctgacgaagttcttagtaagtgcaagcagtttctcatcttgcattgcagttttattggattttgcgtttacattgtcattatttaataataatgctatttttcaggtcacccatgggtcgtgttctacacagagtgccctttgaaggctgtaactgctaatttgagtattactaacaatatcgtagcacccagaattacatgggacagaattaggttacattgcgagtcaatatcttcagattcatcaagtcagagatcagcagatcaggatgaatgtggtatagttgatgcactgacagcagcaataacgaatgttaggatatcagagccaaaaaggagtcggctgtgtaacccagccattcccatacagcaggaatgctcttcaaacttgaagagcaacctctgtacggcattctgacccgacctgatgtacagctcctgattggaatggtgcatatttttctcgcagaggttggtctgatgccagttaaaaggctccatcaggtggtgtctctgagctgaggataataacctgggtttctgtcaaatcaaataagcgtttgacatgggtatgatgtagtttttatctggtgatgctgataaaccggccattagaaggccggttctgtaaattttgtaaatatcatgatccccttagctcctgggttgctaatctatgcgtacgtagcaaattgtttcaattaatgttgataaaatatcgtgtgccatttccctgtgcatgattcatcttgtttctttccagtctattgagactaattttgttggcagaggttttcaacctcatatcacaaaattcacttctctaaacttttaacgtacttcatcatggatctatatgcccttgttgtaatgaaggtataatttgttagaaaggaagttttaaagtatttcatcagggatataggccattgttctagaataaaggtataattaactagaaaaggggctatcttaagctgatacacatcaccaacatgacatctggtgcatctgtgacatgctatgctaccacctgactttggccatccctagctgcaccgacgctacgccatgttttctgtggttagtgccggcgcctttgacgtcctgcccaaaagctctcgactttgtagctggccggccactaaccccgcaagctaaacgccagaacaaagacttccatcttaaatagtttccagttcttttgaaattatctggacagctaaagtgtccacttattttacaaaatgtgagtaatttcgccagcttttggaacttgatactttaatttacagcatgcaaaagggtacacgagtaaaaactactccatatattcgttaccagactgtcactgtttcatgtcatttaattggagccttcgagggtagtcgagtcagtcacttgcctcctaaggaaatttacggtactcctctgaaaacgtacgtcgtgctgaactatagtgtgtccggctattctcattgccggccaagcctttttcttctactctttttggcatggaactcaatacgtgccaaagataatccatgactaaaaatgattttagtcaagaaaaaacatagtatctcttttcatgttcatgtccctaccctgttaacctctctatatattttcctatcagctcaactgttcaagttggtgcatgcatacagcacaatgctttgaaatgtatgcttagtttaatactcctacgtgattgatgtgctcattaattgtactagatagaatcagaccatatgtgactcactgcctcaccctag

SEQ ID NO: 58893 - DNA, 815 bp, Oryza sativa
ccaaattcctggaaatggttggcttggttgtctacattatgcacaattgcacatccttgaatgtatcacttatatcttaatgtctcttttgaaggtattgagctataaatgaatcctgaaaagcgtttaaacaaattcaaattcccatggaactattatttgtaaatattgcagatcagtatacaattccagacttgatatctccacttcctgttttactccatgtcaaggcttaggtcttttggtccaacaattccacgcttccccttcttatgtgattccatcttatctatatttattggttaatatatcagaaatatttagtttagtgcagttttttttatcatgactttgcaagttatgttgtgtggcatcaatctaagatcgttaataatatctatgttatctgttctataaccaatgtgctacttcagtaattccctttttttggttgcagtaccttcaagtgccagatatctcactggagacaaggccataaagatgaatgccatccaccaagagttgatgccaggcctgacaatataacagtagtttctagtgttaaaaagggtgttggaatgtacaattcatttgaacaaagtgtgaaatccagcgtagaaccagcggttgaagtcaacaagtcagttgctgctgtgcctgaattgtctgaggcaaaccttgtctccgatggtgtagataatgaaagaaagaagatgagaggtcagaaggcatctattactgcaaaggtttctgaggatgtccttgacaacaataggattagatctgttgatagttctagcctcccaacttctggt

SEQ ID NO: 58894 - DNA, 1446 bp, Oryza sativa
ttggagtagcatcccagttaaaacaaaaaaaaatagaaacctagcatttcgttaaacaatactagatgtaaacagaactccagaacacggtaccatatttattaggattatatattagtctataggctgtttgacattttgacagtggtctagattataggaattgataagctggggtctagatcacatataatatacccaacagaacaattttatgtaatctatgtgcatatttattttcctaatctgaagaagacatattaacaggttatctgaaaataaggtaattctctgaaagcagcgccaatgctcaaaatccattgagccaaagttgattgtacaacaattctaattggctgatatacttactcagaatcaaacaataatatcctcatacagaggaaattatagcttatctggtatttacatataacacactccatacataacatcaccacatagcaaaatcttgctttttccaaaaaaaaaaaaaactaaatattaccagttagaactaataaaggatttttgtggtcattagttctcatactgaatattacacataatggatactttaaattcctagaagcactgttaattgccatactttaggatttactcctatttctggcacatcttcttcacagtcccacacttccacaggcgctaatgctaccactgcttagcacaactgtgcaactgtgccagaatacatgtcttgcaagtgctgtccgtgaccattattccactagcatatcatttgattgaatttatcattttatattagaagcttcagaaataattgtcagaggtaatgcaggttctagcatgtcggtgttgagcaaatcatgtgttgaagtgttatgcagtttctggtactccaagttctataaagttctatgcaacaaatatttgggaaagggaaaacacgctcaagctcaacacaaagaacaggtgcagtggtactctattaacatttatgaaccattcaaatcagtggcgtagcagcgcccttgttttttaggaaagccaaactattttttatgccatttgcacaatgccacatcataatcaacatgaattgcacgggaaacaactcgacatgaattgcacgggaaacaactctaggaggatggtaagtcactgaccagtatttgacccctttgcagcgcttgcatctaaacgtggttggccttcggcacaccacgcacacccctttcaccgccgccgccgccgccgctgcctccgcctgacgggccgccggcatttccaactccaccgccgcggcctcctcctcctcctcctcctcttcgtcctcccgcggcgaagccacctcgggcaccgtccacagcggcgcacccgccacgccgcccctcccccgcgcgtagcagtacgcctcgcgctccgcgacctcggtctccaccgccgcgagcctggcgaggcgcc

SEQ ID NO: 58895 - DNA, 3959 bp, Oryza sativa
  unsure (1)..(3959): unsure at all n locations
tatagcttcttgtcgtcgagtagtcattgcttgattgaagatatgtgttgaagatgtccaagtagaaatcctgaatattggagagcctcttgttgtagtaaaataacatggcatcgcataccgagatgtcgaggctcacaaagacgtcatggttggtgaagtagcaaaacttgcgaagtagcagcaatagagtttgccagtgccgaagataataaagatgaagtcgctctaccgtgatgacaaagttgcattgccgtgatgaagtgaacacgagtcggcggcaacagaagcaaactggtagtgaagacgcgcagttgtgaagataaaagcaccagtcggcgacggcataaccagtcggcgacggaagacgatgatgttcatcagtagtggtagctgtctaaaccagacgtagaggtgagggcactagtcagcagcagacgtagacagcttgcgttgaagatgatgatgcctattagcggtgacggtgatgtagccagctgtgaagaagatagcatcagttggcgtcataacaggccagccgtgcaggcagtgacaccagtcggcggcggacgaggcggccggtcggtgaagacgtagacgcccaacaacggcggcataataggccagccgtgcaggcggaaacaccagtcggcggcggacgaggcggccggtcggtgaagacgtagacgcccaacaacggcggcataataggccagccgtgtaggcggaaacaccagtcggcggcggacgagacggccggtcggtgaagacgtagacgcccaacaacggtggtgtgaccaaacaaccgtataggcgaagacaccagtcggcgacgatgacggcaagccggtggtgatgttctgactgatccattcctggagcgtaagagataagcttaaagccatgaatcccttttgtgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaataaagtttcacggatcagaatttactactcaggtacttttgcaattattaagagcagaaaataaatttatctcatctctatgcttttgatttattccgaataatacttagcaccttgcgttactcggtccatccaacgagcccccgggtgataggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagaccccgactcactactcaatggaagaccaattggtgtagtgaggcagaggaaaaggaaaaatatcatataaagaataaaataaatgatgacttagctttgtaatattccccttggtgatggcagaggtggccaatgtgggaacaaagtcgtccaacaataacaatgaagacaccagtcggcggcgacgaaggcggtcgacggtgaaagcgaagatgcccactaatggcggcataataggccagccgtgtaggcggagataccaatcggcggcggcgaagacaagccggctgcgaagtcgtagacgcccagcaacggcagcataataggccaggctatgtaggcggagacaccagtcggcggcggcaaaggcgagccgtcggtgaaagcgtggacgcccatgaacggtggtgtgaccaaccaaccgtataggcgaggacaccagttggcggcgacggaggcaggccggtggtgaagtcgtatacgcccaacagcggcggcttaatagaccagccgtgcaggcgaaaacaccagtcggcggcgacgaaggccagctggtcggtgaagacgtgaacgcccatgaacggtggtgtgaccaaccaaccgtataggcgaggacaccagtcggcggcgacggaagcaggccggtggtgaagttgtagacacccaacagcggcggcataataggccagccgtgcaggcgaaaacaccactcggcaagagtagtgccgcggcgttacatgcaaacagcagaaaataccaagagagattaatctgacatttagagatcaatctaataaacaacaataagttgaaaaggaaaaaacccggtgaagtcggagattaaaaggaaaaaactcgccgagattgatctcttcgactgactccgagacggagaaaattggtcgtcggtgttgcaccgtgtcgctagggctaatcaagcaatcggcactgagatggtgaggcctcccggcggcagtagaagcagccagaagaatcggccagccggccaacgacgattatatgtaagtaaaaacccaaatcgatttgattagtaatacaaagcatatatacaatgtatgctgtataaatttgggtatgcatgcatgcttctgtagatggatggtgatggcgcagtcgtgacatcgtggccggaaaattaattgagtgcacatgcaaacgaataaatatcgatccatccaagcccaggatatgtttgatttgtccggcacaaatgcatgtttgcatcggccaggtcattattggcgatgacccagatcgcgtgattcgaaaccggccaggaggacgcgagcgccaagccccagcagggacgagatgtatgtgcggtttggtcgagatcatggcgatgtacagtacggtggccaatcccgtcgatcgtcctggcagcggatagctttccccgacgtgcggcggatagccaaatcgtcgagacatgaaaacaagaaaaataccagggcatcaatctgtgattagatttcaatctaaagacgatagattagaacgacaaacccgatatcttcctgtagattgatttgatcagaagatggcgtcgacggcagaggatctcacgctacataggcgaagacgaagccggcgactcctgaaaattgattccatcgtactttgacggaaaactcgacgcacccctacctggcgtgccaactgtcgaaacacgaattcggcaataataaaacggggtagcgcacgaaacctaaaagtggattgatgtggagacaaaggatttagacaggttcaggccctctcaatgagaggtaataccctactcctgtttggggatttggatccgccgggtgtattatatatctgacgatcatatgtgctcctgcccctagagggcctcctgcccaccttatataggatgggggacaggattacaagatagaaaccttaaccaatacggtatcggtttcttaaatatattctacaatattatcaaatcaggcttttaggccgctccataatataaaaggaaacgtaatacgaaaaaaaaaggttttnccaatgatctgttacatattccatagatataagctatcccctaagactagtcggataaccatgccgtgtgggtatagggtacccataatctccacagtagcccctaagaccttcacagtcgaaaagataatcttctctcaaaccagattactccaaagccgagtgcttcaatcatctttgccatggtctcccaactacttttaccaaatctgaagactggtttgggggaagggggggctgaaaaataattaaatataaacttaggtgcatcgactagatgcacctaataggtgtagcccccgaccatggggttaattgaataaaccaagcataagtcagggaataaataatccaaccaactgagtggtttttgataattatagtcaaccaagtgacttgataccaatacatagcatatacggtgtgaatccccgaataa

SEQ ID NO: 58896 - DNA, 3010 bp, Oryza sativa
catcctttaataaaaagaatgctgtttttttgggttcctttttcaaaataataaggtcaactagtataattttctagtgatactgtatcatgcaagattacggcctatgcgacttctcgtgactcggtatcattaggtgcttgatactctcccccaaaaaaagaaacttgatagtactcttttcttttgctttactttaacagtttaactataattttgttttggggccactttgataaactttctggaggaaagaaatgaggtcaccaagttaaggcgtgtgcatgcatgcaggggtgagactttgctccaagcatatctccaagcatgtcagcaaagtgcttagaaaattgaatattgataacccaccaggttcctggccacatgtcattgttgttcgtggtgcaactttttggttgtttgacacatttgtgaagcttgaggtctttttcacgtggggataggttgggaatttggatgccacggttataagtttatcgcataggccacttttttcatcatcgttgtcgacgttcttgtgaaaagtgctcaaaggtcgttagtaagtatcagttgatatagatgggtagttggacataagcatttgtttcttcatatgattataaatgtcaaaatatgctcacaaaagacgtgcaattggatattaaatcatgagatatgtatcttccctggttcactattaatttcaaggctctttatttcactctcaccttagtgtaatgtatgcattctcgatttaatccacggtattaaaaaaatcttgatttgataatacacttagatctttttttctaatggatattgactattattggaactttaaagtttgtattaattggtatctccatctaatcaagagtaacatagcattgggcatgtgcgtatttgtggattgactttaccttctcataataagtctactcacttcttgtccaacagaactcaacgattctataacctttttttttctgagaaacacaccccttcggaagattgggcgggcacaacgtacgcacactcacccctatgagcatgccactaaaagaataattagccataaatgcgagcacccgtgtcaaatctaggatttgcactcacccctatgagcatgccactaaaagaataattagccataaatgcgagcacccgtgtcaaatctaggatttgaacccggtgggctggttccaccacaaggaacctagccagttgagctatgctcacttcataacgattctataactctcaattcttgtcaaatactccatccgtttcacaatgtaagtcattctagtatttcccatatttatattgatgtcaatgaatctagtcatatatgaatgtagaaaatgctaaaatgacttacatcgtgaaatggtggaagtagaactcaactattccataaactctactagctatattattctttgttttcatcaactattaccacttctcacaataagtgtttctactatgtattgttacttctgccacctagcgattgatctacctccaaggcaagttaggtgttcgcttaggatccgacacttcgtatccaccgccgattgctaatttgctatgccgaccgatgttaatatttgaaacaaagctatcagtcattggaaaactctgttagtcaccaagactcaattgtgacattggctctgtcatcagcatacctaaggtacgtttgaatcttctaaagataaagatgaagataaagattaagtgtttcacgtaaaacgatatgataataatatgtgattaattaagttttaattattacaaacttcaaaaatggactaatttgatattttagaacaactttcatatagaaagttttcgcacaaaacgtatcgtttagcagtttgaaaagcgtgccacgataatccaaaattttatcatctactagtatggaatttcaccatgacagttctacaatgaccttacaaataagtaccaccagtgtaatacttatattgaatatattgtatacatgaacgaatactttgcactgccgcttacaacatgcatgtgctgcaaccttctccttttcatgacgccataggccaaaataacttttcaattagtatccttttccatcaccatcagcaaaattctgatagagacaaacttaattcattgttaattaatggaatcttattgtagatccttttaggtagttgtgctttcttccttttcgtgttctccgatccgctgaacattcaagaagaattagttgtgattagctgatatttgttggcatactactttgcgcagttaataattaactatggctgttgattctcaactagatgaaatacatgccaggtatccgttatttaggtgagaaatgtaactattgaatgtatcattttatcttttgcctaaagttgtttcattattttaagagagattataactctctggtttggtgctggcttatcaacacacactgtcaaaatttaaatcataaaacacaattgtagagttggtttttggccttttcattacatatagtcgttttttcagctctggtttttaaaccattaacaacaaaaatataaaagttttagctataaattatcttcattgttacgtttatttttctatgccttacccatcgtaactccagcaataagtgctaagattttatttattgctttttgtttcattctatgattacagaaaaaaatctaagttaacattttataagttaaatgagttggttaatttgagaaaatcataatgtgtattgttttgagcggtctatttatgaaacccaattttaaagttgaaacggtacgaaaaaaaagtgtactatataacccgcagattttagggtaaattaaatcatgtcattgtaaatgtgcctattcagaaatgttatgataattcgtctattcgtagcccatgtgtcgaggagtgatcctctctagcgggaggacgtgaagcccccctttgtgagtttgcccgggggaatagggcgcga

SEQ ID NO: 58897 - DNA, 7509 bp, Oryza sativa
cgaattgcgatctcccttattgattaagcgtctaatagttcgaggcgattcacagctggtcgtcaaccaagttatgaaagagtggtcctgccttgacgacaacatgatggcatatcgacaagaggtacgcaaattggaagacaagttcgatggactcgagctcagtcacgttcttcgacacaataatgaagccgccgacagacttgccaactttggatccaagcgcgaggtggcgccctccgatgttttcgtcgaacacctttatacgccgacagtacctcacaaagatactactcaagttgcgggcactcatgacgtagctatggttgaagccgactggcgagagcccctcatacgattcttgacttctcaagaactcccccaagacaaagatgaagccgagcggatttcaagacgaagcaaactttatgttatgcatgaagctgagttgtacaagaaaagcccttcagggattctgcaacgctgcgtatctttagaggaagggagacaattgctgaaagacatatattctgggatatgcggaaaccatgctgccgcacgcaccattgtcggcaaagcttaccggcagggttttttttggcctactgcagtgtccgacgccgacaaaattgtgcgcacgtgcgaaggttgccagttttttgccagacaaattcatctaccagctcaagagttgcagaccatcccactgtcttggccgtttgcggtttgggggctcgacatggttggcccgtttaaaaaggcagtcggcggttacacgcacctctttgtggccattgacaaattctccaagtggattgaagctaaaccggttgtcacaatcacagcagataacgctcgagacttcttcatcaacattgtgcatagatttggagtgcccaatcggatcatcactgataatggcagacaattcactggcggagtttttaaagacttttgtgaagactttggaattaagatttgctatgcctcagtggcacatcccatgagcaatggacaggtggagcgagccaatgtcatgatacttcaagggattaaagcgcgagtttttgaccggctaaaaccctatgccggcaaatgggtggaacagctaccatcagtactttggtctttgcgtactacacccagtcgggccacaggccagtcaccttttttccttgtctatggggcagaagcaatgttgccgagtgaagtcgaattcgagtctttgcgctttcgtaatttccgcgaagaacgctacgaggaggaccgacttcgagtctttaagcttatcactgtacttccctatcttgactgtcaacatcaagttttcttcttgaagttgtcagtcgggggctatcatcataataacggagtgtgattttttatcaattcaatttgcttccttggtctatcattgccttgtttgatttttctacttagtctgcgaggactgaaagtttttaatagcttctttgggttttaggctcaacaaagcttgataaaagcttttaagaaatcaaagacttggctagaattatcaagcacagtataaatacaccagtattgtacaagttatgcctccgtttgctacatttatgctcagtcagaatcagtcctttcatcatcagagttattactactcggctgaaggtcggtgttgcggaattgatctacgacgtcacttgcaatcttgtcagccgcattttgagcattgctgataagatcaagagcagcctctacgcttgtcccgtctgcaaagccatcaatggcgtcaatttcaatcctcgggtacaaggatttggtcatcgccaatgccgtgctagctctcatacttccagctttcttgatattcttgaaatatacatccggagcaactctctgcttgtcgaagatttcggttgcgccgagtacactcggaccactgttattgaggaacatagcttggacgagtggtatagcgacattagcgacttcatctcttgctccttcaagcctcttgattttaccaaccaggacgtcaaattgagcttgagatttgattttgcggtctacaaaatacatttatgataaaaatctactgcattaaaaagagagaagttcagattgtcagctggcagtaccttcaacctccttcaaggccgagtccctttgcgcagccagttctaccttgtctctttccagggcttcaatttgtttctccatttgagccatcctggcggcttgcgctgtttgaaatccaaatggttgaggatacagttacgacagcgtaaattaatggggcagatctagagattaccttttgatgaaccactcagctcgaagtttgaatcctggagctgagcaattcggtcccttaattccttctctgtctttttggcgagctccttggcctcgtgtagctgatccctaactgcttcaagagttcccaaatgaggaaccagcttttctaaagttgcggtcttggcctcattgcgaagatggattctctgcatgatggttcatggtttagttttgctgaagagaaaacaaagtcatcaaaggcagtcacccggaagatttacattcacaatgcgagtggcttctccaagtgccttcttcagctggcacacttcctcatcttctttttgacgatttatgacgatgccggcagcttgtgagttctcgtcccaccatttgagcaagataggaggacgagagtcatcagccgcctttatgcgaggaatttcttcttcgtcatcgcctggtggtcctgatgtatttccaagatattagacgaataagctgaagttatttaaatcggcatcacttgagaagatgagttacttgaggatgttcctagctgagcgtggggtgatccttgttctttatctggagacccaatcatcgagtcgttaccagcctctggtccttgagaagttgtcgtctgcgcttcaacttcgggagtttcttgatctggacctacatccgaatggtttctagtcgggggctcttgggttgttgtagttttagttgctgccgactggtttccagtcgaaggctggtcactcggattggccttatcacctgaagtatgggcgccagtcggctggctttcggcagttggctcagaatccttggatgaacttggttctgtcacagtcggatcaggatcttttccagttggatctatgtcggatggtttcctgcaaagtgttctttcaatattcagtactatttccatgagagaagcatgtcgaagtgaaatggtaccgagaggtttatacctggaagatgttctgatctttggccttggacgactagccagttttttcctgggagtggtatgctttgggagtttattgggcgagcctttgtccccagatttgttgccgtcgtcgccttcgtcgtcattaagcaccagctttctcttgcgagaacctgtctgcccagtcggattggaggtttgaggttgcggatctgatctgattgtcggccctccacctccctgaacggtgtgctgacgaggagaccggcgctgagtgattggggggtcagacttcatcaatacatattcctgaatgagatgcctccacggttagttaactcaacatgaagacaagattatgttttggtcatgggttgaagatttcggatacgtacctgcggaggcggattgaatgcgttatatggcacaactggcagctgatgtgagtagctgacgacaatagcatttgagaagattttatacattctctccttcatgattttaaaatccagagaatctggttcttcacgattaggatcatgcttgccgtcaaactcgaatgccgtacgggatctttctttaattggtgccaatcggcatttgatgaagtgccgagtaatctgctctccttgtaagccttgttctttgagttttagcatgcgatccatcagctccaaggcttgggcttcttcatccccaatcggaagagagttccaggtatcttggtacaccggaggaagacaagagtactcgagaagagcaggctcaggattctgaatataaaaccagtttgcatgccaccctttgtttgaggtcttgaagggcatagagaagtacttctggctcagagtccccctcagctaaaatccggcccctccgactacacatggcttactcttgtttggttggggcttgagaaagaagattcggcgaaacagagcgaagtggggcttaattcccaagaaggcttcacaaacatggatgaaattggcgatgtgaactatggaatttgggtttaggtgatgcaagctgattccatagaaacttaatatcccgcggaaaaattttgaggtcggaagagcgaagccgccatagaagaaatgggagaagaccacagcctcgtgtgtatcgggggtcggaaaagcctcaccgcacgctggccgccacccgatgatttccttggcagggagaacgccgtgcgccaccatctccttcaggttctcctccgtcacgtcggatggcgcccattggccttcaaagctttccttctcttccgccattgattttttccgaatgcgctgatttgattcgagggatggctagggagaggtgaaggattgaggcggtggatcacgggaaggattttgatgaactttttgaaggtggattcgagtggaatggtgaaccctagtttgccggcgcagctctgtactgtagcagggagtggggaaaatggcgagagttccggcggggaagatgaagtgtcgcttggatctcgggatttcttgttaagggtgtcggaggtgcgaatgggcttaggctgaacagtacttcagcccagtacttttaacagcgtggcccattgtgctccttagggacttaggcattttttgctttggcaatttatgcgcacaatagtgttgcccaatgctgataaaatcctttttacgcggtcatataattctttggaattattgcaatgcaaattaaaaggtgcccgacagaaaggtgttatgctgtttttgtaagcttttttaggctacgaaagctgtctgggttaacttggaatgacttgtttttaccatagtcatttccttggtatgttatatgcctgttttcattatggtaaatagtcatagcctaggctattagacttattcattaccataattttttataatatttggtgggtaatctttagagctttttattcggatgcctgtcaagtgtgttcattcgtgaaccttttagagtgttaaccactcggattccttttaattatggctaaaaagcagtcggctgagaatgcctctttaggcgccgtgtatgcttttgtcgtatgatgcacgattgtgctattattttattcttaactatatgtttagtttgttaactaatcacatagttgggggctacacctaattaggtgcatctattcgatgcaccatattctttatcttttcgccctttacagtcttcgtcttcgctactcggcaggccttggcatgaaaagtttgaagcactcggattattatccttgagaaggctatgatggttgactgcaaaggtctcgggggctactgtggagattatggatatcctatatctacacggcgatgatatttggactgaatataggataccgaatatagatagaatatcttatttgtatcttgggtttgtttctcaacttgcacatcaaggaaataccttgagacttagtcggttacgactgtattttatctgtatctgcatattccgttagggatatagattatcttttgtaacacggactccttcccatatataagggggtccgggtgcctctaggggcatatatgcgttgttgattttctccaaatcatacaatcaataagatactcggcggattcatccccggacaggagtagggtattacttcttgaataagaaggcctgaacctgtataaatccttggtctccaaacccattcacttctccagcttgatagccacccccttttattattgccgaaatctagtttcgacactttgatgtgacgggatgatgttgatgcccaacaaatagccatggcgcgctatcttcttttttccaatttctttatgtatgttgtgtttctctagtttgagttagctgctctgatgtcaaaatggagggatatggcaccattctgataaccgagacagagctagaggaagttaaactctgtaatgcttccatttctctactggaaatgggggaggttgtgacattgtgtcctccctttcttaaagaagaaaaacaaaaacaaaaaaacaatcagccgctagtggggttgctggcattgaagcccagctgcaagccacaatggatgagctgcacacgcaggaggaacaacgacgcggaggacaaagacgagggggctgttcggatatgcattttcaaccatactattttttcataaagttgtcaaaaaaaagtcaaactttggtaaatacataagaaattaggctaaaattttggtaatattgccgacttgttaaaattttggcaatgtcaaaatttggtaaggtttgttttagctacaatctgaacaacctcgagatgtgcgtggaaaattggtgcactgagccctgtggaggatgttagctagacacgtacttttttgaaatgataaatgagagaatctattgtatacccctgaaaatttaactaatcctttttattcctctaaatcttgtttacttccttgtatacccctaaaatttgattttgttccgtctcacacccctcccgtcagttgaccgtctaatttttatagaaatgaccattttacccattgaatgagcatataaatttatgaattacattatagaaaatataaaagcttgtcacatgaaatgaaattattaatagttatgattgctacggtacattatttatgaaaaaaattaagataatgaaataaaaaattatattttttttattttttgaaagtcataaaaatgaggagcattcatagaaagataggactaccaatgctcatggttttttttaataatgctcccgataaaaaaatctattatcctattagatttcaaaaaaaaattattacattttttattttcaaaatttatgacaaaattttctgaactaattatttagtctcattagtcacatgaaatgcacatagtactcaaacaaaattttcaattgtttttcaagtttatattcaaagctaaatcatcaagggcattaaagacatttgccaccaaacttaacggtgaaatgaaggaaaatgtaacgacaggggcatggaagggatgaagttgaaatttcaggggtatagaagggaaccggtaaatttcaaaggtataaaagggattgagtgagttttcaaagggtacccagggaatttactcacgaaaaatatgtgtgatactaacaagagcttcaccatcaattattgatatagaagaaattactgagataacttgtggtgagaagcacttgaggctagaccaatggcttgctcttagtagctccctaccaaatgagctatccaa

SEQ ID NO: 58898 - DNA, 15256 bp, Oryza sativa
tgtcctcaggtggcccccagcgccgtcctccgcatgacacgggggacactccttgtcattccttcataaattcctggagacttttgtgggcttagcgccggtcggacattgatcccccgttattgatgggacggggcatacctgacacagggcgggacgtgggtgcgctgtacccgtcccatccgctggtggatggtcacagcccagtcagggcgactgacgcacgtctaatcgctgggcggcgcacgaccagccacgccgcattaaatgcggcgagggggcggttggggcggtgcccataaatgtgcctgatagcgctcctatctccgcccactcgaccgccacgtggcagccgagtgagggcctcagggtggcgcaacccctcgagcccgaggggtgcaacgggacaccccgaggcccctagacggaggtaggcgcctcttcggctattcgctgcctgcgcgtccgtcccccccgacgcggggggggggggggggggtcgggccgcgcggccacatggctgggggaaaggattttttccctttagcgcacgtacccctgggcccatatcaccgacaccatgccacttaaattttataaaattaggagcttgccactgtcgtcacgttttccatccatatctctttttttcccccattttcttccttctttctcctgtcttcttcccttgagcgatgttctcggcaagagaggagcagcatggtggcgtcgtcctcaccgcacgacttgcacgactacttggatgccgttggcaaggtggaggcgttgtccgccacgacagcgagggcgtcggagtcgccgaagcattgggcgggggcgttgcggaggaggaggtggtcgaaggtgaggcggatgccagccgcaacggcctcgttgctgcaggcgagcccgcacacgcctggctctcggtggcagcgtgacggagcagctcctctagctcgaccacgtggcggtgagcagcgtcgagctcggcctccttctcccgtagccactgcagccaacgccaacgccatgcgcaccagcacctagcactgcctctccgcgcctgctccagcccgtcgtgcatccgctcacactccatccgcactaccgcgtcgatcttcgctctatgtaggcacatctcagacaccagcgcatctcccatcactgcagccgaggccactgaccaccaccaaccagcagtagcgtcgtgaatgccgccatcgccacatattgctccactatctccctctcccgcttcctcgacacccccatcaccgcaccactacaaaccccacagccattgttgcacgttagctcgctctgcgccgtgtcactcaccatgatagcgcagtcatacccactgtcgccattgttgaagcaaccacccaacgttgagaacatcactgaaggaagaagacgagaggaagaaggaagaaaatggggggaaaaggaaaatggatggaaaacatagcgacaataacacggttctaatgttgtaaaatttcagtggcacggctataaatagacgaatagtaatgttatttatctgaataggcacatttgcaattgcatgatctaatttaccctcgattttacccaagtttgaaaatcaacaataagcttccaaacgaccaaaccatacacaatacatccctaaacttccggggccaacccattcaatccaaccttctcaaggtaaaataagatgatttttgtttgtatggtgtttatcatcgtcatataagctaaaactcggggcaaataataaagcaaacgatttgaaaagttgaaagatgaaaagtgtccggtttaaaattagctttgattttagaatttgtaaaattaaaatgcatcttttttctatcaacggtactttacttaccaaaatgcacatagcaatttccatttaacctataattttctgaatttgaaaacacctttttcactctttctcccttttcaaaaggggttaatttgatccatgccattgcaaatgtgtctatctaaataaatgccattacaattcgtctattcgtagtcgtgccattttttacaaaaaatgtaaccatgccatcgccgtcatgttttccatcatattccctatctgcacgtgggacccacccgctagattcatcttcttcctctatcctcacctcttctctccttttttccatccctctccaccacttctcagcctccataactgggggagtggcatgggtggagcgatgaggcaggaggaggaaggcgatgaaaggggaagaggtggttggcttcggtgcggggaggaaccagaagaatccatcgccggcgagaggctgctgccgcatgggctcgccgccggccatggcgcctgtcagggttacgggtaaggtataccctctacccctcgatatacgtcacatatcgatatggtatgcttgcgcgtatacagacgttctcagcataagttaaggaagtccatcacggagtctatagatggaaagagtcctactcggatagaactgggtcgtcattgtatcgtgtcgggtccgatatctccgagtcctacttggagaccagttgacctgcggtataaaagggaccccccgggaggacctaaggcatcaaatctcagagccaacacatccaccacagcctacgaagccggagcttgttggagccaagtcaccgggagatctagtcggatcaactcaactacgatcccgacggtatcgtcgagttccgctattccctttgtaatctgtggtttctatcatataatcccatatcaactggattagggctattacgtaccaaggggcctgaaccagtataatccatgtttcctgtttgcttgatgtcgtactatgtagatcctcgtaccagcgtaccccaataccctctatatccggtttacgggtatcccccatcgacagtggcgcgctaggtaggggcacttggtgctcaaggttctactactatgacatccagcttcgtcgacaacagcgtcaacaccaacctcaactaaggagttcctacttcaacaacactggtgtggactcaagtcggcgaaattgtctttccggtttacaccacagtgccgatcttagctggtccgccaatagccggaaacgagaacgcagtggctacaacccggggcgactccatgtcgaaggatcctcccgccgaagcggagatcggaacgtcgacgacatccgagcccgagaaggatcctagtgcggccaagccttgtttttccaataggaatcacgagccgacgaggattacttccgaggtgacaaggtcctggtgtcctatccacaaaaccaggaaacacttcctgcaagcctgctgagtctttctcaacgtccatgctgaaattcggcctgcaaagagcgtgaaattcagcgtacctctccaactcgtgatgtctattgttctattcacaagacaaagaatcacgacctcttgagctgcaaggtctttctcagcgccatgaagacgccgcctcctaaggtacagcagtcacgcatccccatcagggataaggacaaggaacaaggagcgacgccgatttcagatcgatttattggggtaatcgacattgatccccacgaaccatcagtcttgcacctgctcgaagacatggatcatcgacaacaagtacgccatgtgaggtattggctattgatgatgtcggcacgtcagcgtgcaccaatacggaagcggagaatcaagtgactactctggcccagcacatcagagctgtcaacacaatactgagggaaaccccctacgatcccgttctgaacgacgatctcgcacgttggatagaacgactacgggaatcagtgaccaacctcagcaacgcgttcgaagaggccgctgccgcagcgcacccagaacagccaccaaccgcgatgctaatggtgaaaaccctgaacgccgggaatcgcctcatcgagtcacccctccacctcgcggcaccggcgatctccgcgatcacctgaacggccgccgagaggcatgacgcacacgagacaacgagaaccgttcacggcgtcatgtctcttcacggggtcacgataacgaagatcgaggaggccgttcaagcgaagaccaagaccgtgataaccgccacaaccgccacgatcacgacgatcgcgaacggcgggtgctgggcgatactggtcgaggacgtcgccataatgacgacgatgatggagattggcgccgagacaacaacgggagacgatgacaggattctcgagaacccggccgacgtcctcgtaatcgtacgccggaaccaagtgacccatcgtcatcgttatcatcctcgtcatcttcatcatcagacagacatccacgaaggacgtatgatcgccgacaacccaccgcccccagcgctgggtgtagagctttcggtcgttcacttcgggatgtccaatggcctgaaagattccgacctggagcaatagagaaatacgatgggagcactgacccagaagagttccttccagtttactccacagtactctacgctgccggagcggacgacaacgcgttggcgaattacttaccaaccgcattgaaaggctctgcacgtcatggctgatgcatctcccccctactcgatctcttcgtgggcagacttgtggcaccagttcgtagccaacttccaaggaacttacaagcgccacgcgatcgaagatgacctacatgcgttgacacagaacccgggtgaatccttgagggattatgttcggtgctttaacgagtgcagaaacacaatccccgagatcaccgacggttctgtaattcgcgctttcaaatccggtgtcagagatcgctatactactcaagagttggcaacgaggcgcgtcacgactactcggagattattcgaaattgtcaatcgatgcgctcatgcggatgacgcactgagacgcaagaacgacaaaccgaagaccggaggagagaagaaaccagccaaggatgcacctgagtcaagcaagaagaaaaatcgcaagagtgggaaaaggaaagctcaatcggaagttctcgcaacagaatacgcggaccctcccaatcgcgcagacccacaaggcagcgacacgaagaaagcatggtgccctatacacaagtcggacagacactctctagaagattgtctcgtcttcaaaaagtcgcttgcaaaacacatggcatcggaaaaagacaagcgagtacgcgtggttgagaaggacgttgaggcgcctactcaggaatcggactcagcataaccagattccgatctccatgtctcacacatcttcggaggttccacggcatactcctcaaagcaagaatacaagaaagtggaacatgaagtctgttcgacgtggcagggggctgcgcccaagatgaagtggtccgagcagaagatagaattctcagaagaggaccaccccaagactgctgtcatcctagggcgatatccaatcgtggtcgaacccactattcgtaatatcaaggtcgaacgagtcctgatcgatggcggcagctcaatcaaccttctcttcgccagcaccttggacgcaatggggatcccacgaagcgagttgacgcccaccgatcaacccttccatggaatcactcctcagtcatcgtccaaaccattgggcaaaattatgttgcctgtgactttcggccaagcaaacaacttccgaacggaacagatcacctttgatgtcgctgaattcgatacagcatacaatgccatcatcgggagaactgcactcgcgaagttcatggccgcatctcactatgcgtatcaagtgctcaagataccaggaccgaagggaacaatcactattcaagggaacactaagctggcggtacaatgcgacaagcagagcctcgacatggtcgagcatacgcccaacccgcttgccacagcagagccatccaagaaagtgagcaagacaaacaagacgccgaaaccagacggcgcaatcaagatcgtcccactctccagtgccaaccccgacaagaccgttaagatcggggcgtcactaggagagaaataggaactcgcgctcatcaccttcctccgcgacaatgctgacgtgttcgcttggcagccgtccgacatgtcgggggtacccagggagatgattgagcacaaactcatggtgcgacccgatgccaagccagtaaaacaaaaactatggagatttgcaccagatcgaaaacaagccatatgagaagagctcgacaagcttctcaaagctggtttcatcagagaggtactccatccagagtggctagccaacccagtcatggtgcggaaagccaacgggaaatggagaatgtgtgtcgatttcaccgacctcaacaaggcgtgtcccaaagatcactttcctcttcctcgaatagaccaactggtggactcaacagccggttgcgagttgttgagctttctcgacgcttactccggttaccaccaaatcagcatggcgaaagaggacgaggagaagacatcattcatcacgccgttcggggtattctgctacgttaagatgccgttcggactaataaccgcaggaaacactttccagctcacggtccaaggtgcacttagcgaccagctcggaaacaatgtcgaggcttacgtcgatgacattgttgtcaagaccaagacaagcgactcattgattgacgatctgcgggaaacgttcgacaacctccgacgatatcgcctcatgctcaatccagagaagtgcacgttcggagtaccatcgggcaagctactcggcttcctcgtctctggcagaggaatagaagcaaatcccgagaagatcaaggcaattgagaacatgaagtcacctacaagactcaaggaagtacagaagctaaccggatgcatggcagcactaagcaggttcgtcgctaggatgggatagcgaggacaacctttcttcgctctgctgaaaaagcaagacaaatttgtatggacacaagaggccgaagaggcattcattgcactcaagcgctacctatcaaatccacctgtacttgttgcccccccaacctaatgaagaattatttctctatattgccaccacgccatattccgttagcactgtcattgttgtcgagagagagaaggtccaacgaccagtctactatgtcagtgaagctctccacgacgtaaagacaagatatccacagatccaaaaactgctctacgcagtaatcatgacatcaagaaagctacgccactacttccaaacccacagggtcacagttgtctcctccttccctctcggtgaagttgtgagaaacaaagacgttgtcggccgcattgccaaatgggtagtcgagctaagccaatttgatatccacttcgtgccacgaacagccatcaagtcccaggtactcgccgatttcgtagccgattggaccatgcctgataacaggtcagacaaccaaatcgacaatgaaacgtggacaatggcgttcgacggcacactcaacagccagggagcaggggtaggattcatcttgacatcaccttcgggagatcaattcaagcatgcaattcacctcaacttcagggcaaccaataacacagccgaatacgaaggactactcgccgggataagagctgcagctgcactcggagtcaggcgactgatcgtgaaaggggattccgaactagtcgcgaaccaggtgcataaagattacaagtgctctagccccgagttatccaagtatctcgcagaagtcaggaagctggaaaaaaggttcgatgggatcgaggtccgacatgtataccgcaaagacaacatcgaaccggatgatctagcacgacgtgcgtccagacgagaaccacttgaacctggcacctttctggacgtcctgacaaggccatcagtgaaagaggcaaccggcgaagatagcccggacgcccccaacgtcggctcgggggctacaaaggcagagcgcgctgttgccgatatcgagaccacagacgactggcgcaccccactcattaaattcatatgcagcgaagagctgcccgaggacgacgcagaagccgagaaaatatcccgtaaatcaaaagtctattgtatgatcggcaacgatctatacaagaaggcaccaaacgggatacttctaaaatgcgtctcatccgacgacggcagacacctcctcctcgacatacatgaagggatctgtgggtcacatgccgccggtcggacattagtcagaaaagctttccgacaagggtttttttggccaaccgccctcaaagacgcctgcgacatggttcagcggtgtgaagcctgtcaattccacagtaaacacacaaagctgccagcacaagcactctagactatccctctcacttagccgttctcgtgctgggggctagatatgctcgggccattcccacgaggacagggcggctacaagatcctattcgtggcgatcgacaaattcaccaagtggattgaagcgatacccacgggggaaatcaaggccgacaacgccatcaaattcatcaaagggatattttgcaggttcggattgccccaccgtatcataacagacaacggctcccagttcatcagtgccaatttccaggattactgcatcaggctgggagtcaagatctgcttcgcctcggtttctcaccctcagagcaatggacaagtcgagagggcaaacggcatagtactacaaggaatcaagacccgcgtctacgacaggctcatgtcacacgacaagaagtgggtcgaggaacttccatcagtactatgggttgtgcgtaccacaccgacaacgtccaacaaggagacacccttcttcctcgtgtatggctcagaggccatgctccccaccgagctacgacatcaaagtacacgagtacagaagtattccaatgaggatcaggaggagcagcgatacgacgatgtgaatctactcgaggaacatcgcgaacgagttgccgttcgagtagccagctaccaacaagcccttcaccgttaccacgagaagcgcatcctagcacgcacgctttcgatcagcgactacgtcctccgacgggttcaaagccaagcagggcgcaacaagctctcaccctaatgggaaggaccgtacacgatcacacaagttctgcggccaggcgtattcaaaatcgcagacggcgatggtcgcgagttggcaaattcctggaacattgatcaattacgtaaattttatgtataagtcaatagtatccatacttgtaagacaacttacagcctcaataaagcctatttttcaggtatagactacagtcaaagtgttccttcctgacgatcccttacccagatgacacctagcgttgaaacctatcctcatgtccctttacgccgtcttgacaaggcctccgaggaacctaagggaacttcggctagggacgcccagagccgataaggccttgtcagatcctgtagagacgaaagactatgtcagatctggttgtgtaagagttctcgccgtgcgtattaaccaagccgtgtaatcggaaatatactttccaacttcacggctgggggctaggatcagtgcttgttcaaccgaggcatgtcaaaggtccaagagccttatcttccgagaagaattctccgatgacaaggctgtgggctagggagagtgtataactcaaacgactgatcaaagtcgtgaagtgagaagacactcatacacactacatccagagtaagaaagcttagatttcttttctattccacaagtatttcttacaattccatcaaaatccgaaactatatcacactttttccctaagacatttgtaacaggacacggagactaccaggaaggccaacgccagtccatcgactggaagaccttctccgccagcaacgccatcaatttcgccaggccatctatctccgtaggagttctccgagaacgagaaaacccttcacggaggaactcgaggtgcagctgcgggcgatgatctcgtatgcaggccaacacgtgccccccggcatatcggcttgagcaacgacactcctgcttcaaggcctcgtcgatacgttgaccgatgccttcgagctgggcgcaggccccattcagccacgagatgtatccggccgccgattcctcgggatccccacggggtactcggagctctctacagactctcgacatggatgtgcagcaactcttcagatacgagttgaaccacacctcacgaccccgaagtgtctctacagcctggtcctttctcacttccagcatattcctgtcgagttccgcgacctcaaacttcgtcctccagtactggatgcgacgatcctggtcagcaagcgcactctcgagatctactcagcatggaaacgactaagtcaagttgctcttctctcccgagaacacaacaaatcaagtcgatccagacggaagggcaaaggaaatgataacaaagacaaccaacctaagggagtcgtcgccatgctcgtttcgatgggcgaattttgagctacatcgccctccggcacatgtggctcgaacgcaagtaacggaacgaccaccggcaactcagactgcccgcgctgctggacatcctcgacatcaacatctctacaaacgacaacaaagtactcaagatcaaaatgctgaaaacgctaaggtgatgactgcacacacaaaggcggtcggaaccaataaaagttttacaaagcatggccaaagagtacaagaaagctaagaccctactcttcaaaaagagggaggacggactcctacctgttggtattcaccaaggaagaaatatccaagtctcctacgaattctatcaccctataagttcagctagacaacttggattaggccaactccgaatcggcttattctttgctgacaagatccaatgccgaggagaaatttcttcaactctaatgatggatcgactgcttaacctccaaggacctcccttaggcagtatcgacaatattgagttagcaggattcaggagcaagaactttgacagatggtgggggtgaatggaagttgcatctatttcatcaatcggccacaatgtacatgacagatctattccctgacgtcataccccaggtaaactttgtcatcactaaatttcataacggttagccgattcattacttaactaatcttttgttcctgtattgtagacaacagaatcctcccctccacatcagagcaatagtggtaggaacattgaatatgccccaggtctgattcctaatagaggcggattgtctccccctgtcatcggctatcacgcccccaaggtctcaaccctcctccaaggcgccatcagggaaccaaccaatgtaaccaagaaaagaaaaactagatcatcggctgtgagcaccttgactctagctccaaagaaaaaggccaaatctaagaaaaccaagccaaccgacgacctgcctgcattggatccatccattgaacaagctctggatgaagaagatattgaggatgatgttgatcaggctgcagtcgaagtaagtgatactgaaaaaacaccatcggcttcgcctaagcagataccttcaactccttctgcccccactcacttcttcagagtaaaacatctttccttgcaaacccttttgtaatcattatttttcagccgactactcataggttttgtagttgcagaagaagaaaactgctataaagaagaaatcggcagcaccaattctcaaaccagctccatcagtaagacactctcaattttactagccgattttgtctaacacttgtctttttacagcctcctcctcctccttcttctcatgtacaacaatcatcgagtgaccgaactccatcggccgtggggagtcatcatattgttaaagaagaacaaccagctgctcctgctattctagtaagttttcctttgatgcaagaatttagatcgactatattgacttagctctcaaactttctgaacttatacctgcaggttctagccgatctcttttcttttgatatcaaagattatcttgatgaggcagaagaagatacttcaagcaaagctctagctcccttatctgacgatgcaaagaaaacacttgaagatatctcgcgtcggctagaagcctcttctctggatagcttagttgtcgactgtggatcgattaggacacgattgcacgaagttcaagctctaattcctgaagaactggccgatgtcctaactccacccgcttatcttgagtaacatcaatttaaactagaaaaagccaagctaagattagccgaacgccgtgagcgtaaggagattgaagccacaatccaagtcaatcggcagcttgtgcatgaagaaaaagtcaaactcgatctgctatccgaaggtccgatcaaatccaatatcgaccggcttgaagcccgtaagatcgatgtcttggcacagcttgaagaatgtaatgctgaattggatatggagcgcaaaaagctagccgatctcccaaaatctgtcgaagagcaaaaagcaaggctcaaatcagctatcaagaatgttgttgacctaaccaagtccctgaagatcattcctaggactgattctcaagatgcccaagccaatgaagaagtcgaacaaattaggcaaagagctatttcggctatccatcagtacttgtctcaataacttttgtgtaataggacttagaaattcttgtaatcgactaagataccttaataccctgctgttttaacaatcctttgtgccgattaacataacttctaattttcaagaatttcttgtatatatgtgccccccaattttataatgtcaacagcattgataaaattaaaaaaaaacaactaagggcgatataacaatatcggccgttatatatcggcaaacaaaaaccgattacaattagaaaaacgactaagggcgatataacaatatcggccatctcaagacgatgtaaaacacatcggctgtcatgcatcaacaacactagccaatcatgcgtcaacccaaacacttgggtaatacttcttcaagtatttgccattgagcgctcgtccataaactttaccatcaagcccttgcaacatatatgcccctttagacacagccttatatatttgaaacggtccttcccaatttggtgaccacttgccgaacttgttatcccgagttccaatcggcaaaatcaacttccatacaagttcaccttccgaaaaatccttaggcattactttcttgttataatgcctagcaactcgttccttatctttggtaaccttagcaagggctcgtaaacgcaattgaaccaagtcctccctctcatcggccataaggttataatactcatcggctgtcaaaccgtcttgcaattctatacttctagagccgattctaacttcccatggcaaaacagcttcatgtccataaacacgcttataaggaggaacttgaattgatccatgacaagccatccgataagaccataatgcttcggccaaccgggtatgccattgccgaggataatcagaaatcttccgcttaattaatttgatcaagctcttgttagatgcctcagcctgcccattagcttgtgcataatatggtgaagaattcaacaatttgatacccacgctatcggcaaactgaacaaactcattggacacgaagattgaaccttgatcagttgtaatagtttgaggaataccaaatcggtagattatatgttcttgaacaaattgaattgcattcctagaatcaactttcttcaaaggaatggcctccacccacttggtgaaataatcagtcgccaccaatataaacttatgccctttacttgatggtgggtttatcataccgatcatatcaattccccaacctctaaatggccacggtttaataataggattcatagccgatgccggcgctcgttgaattgccccaaacttctgacaatcttgacaccccttataatatctgaagcaatcctccagcattgtcggccaaaaataccctgcacgccgaagtaaccacttcatcttatgggccgattggtgaatgccacaaattccttcatgaacttcgccgattgcaactttagcctgatcagcactcaagcacttaagtaacactccatcaatcgtctgataataaagctcatcatccaatagagtgtacttcaacgccttatatcttaatttcctagaagccgattgagatggattatgtaaatattgatgcacatcatacctccaatcatcggctgttattgctgcaatttcaaccttaacatctttgatcatcggcttataccccgatgccccttgggccaaatcattagcttcaatattttgttctcgtgatacatgctttaaagtaaccagccgaaattccttcatcagttcttggcacttctcattataaactattaacgtatcattcttgcattcatactcccctgccaattgactgattaccagcaaagaatcccccatgatttcaatagcatcggcttcaacttgcttgagcaattgcaaccctttaagcactgcttcatactcagcttgattattagtcgcataaggtttaatagtataagcaaactcgaaacatgcccccaggggaaattataactaggccgataccataaccatgagtacacaccgatccatcaaagaataaagtccacaaaaattttgggggggcgccaaccccccaatttttttcaaccggagccgattgaatcatcacgatgttccacaataaaatcggctacagcttgtcccttaatcgccttcggagactcataccgaagatcaaactcagttaaggaaaatatccactttccaacccttcctttcaatattggagccgataacatatatttaacaacgtcggccttgcatataatagtacattcattggacagtaaataatgccttaaccttgtgcatgaaaaatattaacattagcataacttttccacaggagaatatttagtttctgcattcaagaaccgacgactgagataaaatacaactcgttcttttccatccaactcctgaatcaggactgaccgattgacttctcaccggccgacagatacaatctaaaaggtatccctttctgtggaggaatcaaaacaggaggggaactcatgtatcctttaatattatccaaagccttttgctgctctgccccccaagtaaactgctgatcggccttcaatctcaacaatggtgtaaa

SEQ ID NO: 58899 - DNA, 9420 bp, Oryza sativa
aatagcttaggtagcgtttgggctcactaaagtgcttcctttttcttatcttttagacttccactatgaattatttaacacccataaaagaactttccttgcatgattttctttattatgaaatcaacatttatattgacaaacctgcttagcttcagttggacaatgatacgctgcagtaaggcatctcattgaaggacattggtggattctgcactgctattctattacttaacttcagtagagaatatatttgcccttttgcttgacttcatatggtgttatatttctcattttagatggacattcgtctaatttatctgtaccgtgatctttttctgaaaatattctctgcaaagagaggtcatctgaagcattgttaaaaaacagtaagtagcaaaaaaaaatcatggtacaggagtcaatggtacgcagtagtgaaaacatagttaggagttgcatgttatgttgatttgctattccaaaacgtgtttgaactgtagcaggatgtttgttcctattaaaactagagcttttagccatgtattaccttttgtagcttccctgctgattacgttcgaagaaaacaaaaataatccttattgaaatatgcacattgtaaaacagtaaggggttcttatactgttttctttaattccacaatacagtaaaaagagtgagatcatatggcaacattctttgtgaaagcaacacatccatatctggatgtagtggttgccataatggagacaaggagctgttgaatgtagtattgcttgatgttaaaagtgggtcacaatttccagtgttggaatctaattcagtacatggcaatgaaatttcattgacctctgaaagtgaggtatcaaacttaaggttggtttctattcattcagggttttgactttcattcttctcatacaagtattttcctagaaaatcatgaaaaagcatggtgttttaaatagtggagtactaacattcctctctcaaaattcgctacaggtatactcccatggtacctcagatacatcatgttctaggtgttgaaactgaaagttgcattcattctggtgattcaaactttctggatcttgaatggctttcagcttcaggcaactcaagcgatgaaaggtgtttacttttgcattgctattgtatttttttagcgtttttgactgacagaatatcatcttctcagtgacagtcaatttgatttacacacattttctttgccttagtgtaggaaaaagtgaaggataattattagttgattatcctgtaaatttcttacccttcatgcttaattccatatcaatctattctagagttcttttgctctcactgcatttccatgtgataaacacaaatctgtagtatcgtgctgtaccacttgatataactatctgtattgagaagtaaaatggaaatattatgttgccacgcttcctaaatccaattaacaagtgtcttatgagcttccattgatactgatttgaaaatatcctccgaaacattttttttaaaactcatttaatgctgatggattgtgcttgaacaggtccattgcaattagtactccagatgtgaacctttcagcggagaatgttattgccacaatgtcttcttttgactggtagatttgtatgatcaaatatagttgtaccatcaccatggacacattactccgatcattatgtaaaactttattttcattttttatatgcattggtgcttcatctttagattgtaatgtgtaagagttttgttctcagtagaatctgtacaacgatgtatgcaaaattactcatcaacagcatcccctgcaaatgtattcgtgggttttttccttacataatcattgattcagcctgaaaacaaatgattagtctacagtaatcaaccaatctatgtgtaggtggcgcgccattggcgcgccccagcatctagtataatatgaagccgagcctactggcgagtcttaaaacaaaaaaaaaaagtacgatgagtgtgtaatagtttcagagaaacttagtaaagaatctatgtagcgtatgatgcgcatatctaacatggcaacaaaagctcagccaacaataattcaggctgtgtttagttcagcacaaagtttggattttcgttgaaattggagatgatgtgactgaaaaattgtgtgtttatgacatgttgatgtgatggaaaaggactgaagtttggatctaaactttagatctaaacaccccctcagccgctcacttgatcgaatgtccatgtggaagcgaataatggcgccacatatcaaaaaccgttgactccacaccaatcaagcctgtcaagctcatgcaccagattgtaatgcacatgtacgaaatcacctatatatatcgaaaaaaaaaacgcgtctgttaattagatggccggaggaatgtcagctgggaaaaatcacatgcccatgcttgtcagactgtgcagtggtgctctttcgcaatcaactatatataaatatttaagcaacaagtcaaattctaaaaaagaaatagtaaaatacacggccggtccttaaagttgagcgcgggtgtcacttaggtccataatcttgtaaattgcacatctaggcccaccatcttgtttaagtgactcattgaggtccaaaagacctctgaccgggttgactggcttacgtggcggtccagcgtggcaacatatttgcattttgccctcctttttgattccccgtgtccgatccaatcccttctttgcgtggcgcatgcaggaacgcgccgacggcaacgtgcgccagcacgcacacctgcggcacccacctgtctcaaccacgctgcgcccgctggcgtgcctcgtacccctctggcagccgctcgccggtgttgcgcagcgcccagagaaaccgcacaccgtcgtcgacgggaaggagaaggagcaggggaaggggaaggcccccgctctagccagccgtgggtgcacgcgacaagtggctgcggcagctgctcaagtcaagcttgccctgccgccccgctgccgccatggagctcgcacccgcccagctcgtgccgaactcgccgacgcctcccccacacacgcggccgcggtaggcgacccctccccccgggcatggccggcgacacctcccccgcgcgcgccaagctcaccgacgcctctagcaccaacgaccagcgggaagggagaccgatggatctggccgtcagtgaggcgtgagcgccaccggcacgctagctacgaagacagtgacggcgctccgcaagctctcctctagttccctccgccgcctgccaactgctgccacattcgcccgtcgctgctccgctcgcaccccgccgccgcgcttgccctccaccgttccgcccgccgcccattcgtcaagaaggatttgaggtccacgacggcgcggcgtcctgatcttcgagctcgtccgccgctcgcttcgtcccctctaatactgcgtcgttggcaatcatgcgtcgcttcgtcgaggtccacgatagcggcgacggaggacgctgatgttggcgaggcgaggccggagaacgtgacaagcgaggcggtgcagccgtggtgtgcgactaggcgccgcaacagctcagccatcggtatgacatggccagcgaaggggctgacgatgaggatgacgtgcggcggcggtgggcgatgtgacgacggaggcagctgagggatttgggggttctttttggtgcccagggctctactgaatgcaatgtagatggtcagcttcggtcaaaccgggtttggaccttaatgagtcacttaaacaaaatggtggacctagatgtgcaatttacaagattatgtacctaagtgacacccgcgcacaactttaaggaccggccgtgtattttactaaaaagaaatattaagcgacaagtgagacgtatattcacaacattcgacggttgcaacggggccaaattctacacggagctttgtattaatttttgggaacttttggagtagttgcctttcgtcgtgggtgctgctggctctcctcgaaattcaccaagcaaaatgtcaagaattacacgtgcagaggatcaggtccaaagggcagatgttactacggtatttgcccactatcagaagggacaagtgatgtatatgttaattctttaataattattagttagccttattagttagcctcatcgagtaatttttggtgatcatagtgccttggagatgtttttgtttgtcattgattaggatgatttaatttgtcgctccaatgttatgtgcccctacggatcaatctctctgtaattgtttttctgaatttgggtgcatctatcagtttatcatatcttcaacctcgatgtcatcaattttgtaatttttgtcgatggccatgatctcttccagtattgatgcacaaattagttgagaacagaaaaatgtttggaatgaatgaacaagcatgaattactaggctccactgtaccagtccaggtcaccaccgattgtcgaaactggatttcggcaataataaaagggggtggctatcaagctggaaaagtgtatgggtttggagacaaaggatttatacaggttcaggccttcttataaagaagtaataccctactcctgtccggggatgaatccgccgagtgtattattgattgtatgatttgggaaaaatcaacatctgcccctagaggcgcccggaccccccttatatatgggaaggagtccggattacaaaagataatctatattcctaacggaatatgaagatacaggtaaaatacagtcgtaaccgactaagtctcagggtgtttccttgatacacaagttaagaaacaaacccgagatacagataagatattctatctacattaagtatccggtacccaatccaaataccgtcgccgtgtagatatgggatacccataatctccacagtagcccccgagtcctttgcagtcgaccatcatagccttctcaaagatagtaatccgagtgcttcaaattattcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgaaagacaaaataataacacaatttgtgcattatatgacaaaagcatacgcgacacctaaataggcatgctagccgactgctttttagccacaataaaagaaatccgagtggtgtacactctaaaaggttcacgaatgaacacacttgacaggcatccgaatataaaaactctaaagattacccaccaagtattataaagattatggtaataaataagtcaaatagcctaggccatgactatttaccatggaaacaggcatataacacgccaaggaaatgactataataaaaacaagtcattcctagttaacccaaacagcttttgtagcctaaaaaagcttgcaaaaacagcataacgcctttctgtcgggcacctttttaatttgcattgcaataattccaaagaattatatgaccgcataaaaaggatttgatcagcattgggcaacactgttgtgcgcataatattgccaaagcaaaatatgcctaagtccctaaggaacacaatgggccacgctgttaaaaatattgggctgaggtactgttcaggcctaggcccattcgtacctccgatacccttaactggaaaatccgatatccaagcgacgcttcgtcttccccgccggaactctcgccattttccccactccttgctacagtgcagaactgcgccggcgaactagggttcaccaatccacccaaatccaccttcgaaaagtacatcaaaatccttcccgtgatccaccgcctcaattcctcacctctcccaagccatccatcaaatcaaatcagcgcattcgggtaaaatcgatggcggaggagaaagaaagctttgaaggccaatgggcgccatccgacgtaacggaagagaacttgaaggagatggtggcgcacggcgttctcccagccaaggagatcattgggtggcggccagcgtgcggtgaggcttttccgacccctgatacacatgagatcgtggtcttctcgcatttcttctacggcggctttgctcttccgacctcaaaatttttccgcgggatcttgaatttctatggaatcagcttgcatcacctaaacccgaattccatagtgcatatcgccaatttcgtccatgtttgtgaagcctttttagggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggatggcatgcaaactggttctatgttcagaatcccgagcctgctcttcccgggtacacttgtcttcctccagtgtaccaagatacttggaactctcttccaatcggagatgaagcagtacaagccttggagttgttggatcgtatgttaaatcttaaagaacaaggattacagggagagcaaatcactcggcacttcatcaaatgccgactggcgccaatcaaggaaagatcccgcacagcattcgagttcgacggcaaacatgatcccaaccgtgaagaaccagactccctggatttcaaaatcatgaaggagaggatgtataaaatcttctcaaatgcaattgtagtcagctactctcaccaactgccagttgtgccatataatgcattcaatccgcctccacaggtatgcatcggaaaccctcaaaccgtgatcagaacataattttatcttcatgctgagttgactaactatggaggcatcttgttcaggaatatgcattgatgaagtcagatccaccagtcactcatcgccggtctcctcgccaacacaccgctcagggaggtggagggccaacgatcagaccagatccgcaacctcagacctccaaattgactggtcaaacaggtcctcgcaagagaaagctggtacttgatgatgatgaaggcgacgatgataaatctggggataagggctcgcctaataaacccccaaagcgtaccatgcccaggaaaaaactggctggccgtgcaatgccaaagatcagaacatcttccaggtatcagacctctcagtatgattccgcttcggaatgttttccgatgaaaataatgctgaatattgaaagaacactctgcaggaaaccatctgatatagatccatctgggaaagaccccgatcctgccatgacagagcaaaatatatccaaggaccccgagccgactgctgaaaaccagccgactgctgaaagccagccgactggcgcccatacttcgggcgataggaccaatccgagtgacctgccgccgactggaaaccagtcggcaacaactgaaacggcaacaactcaagagcccccgactggaaatcagtcggatgcaggtcctgatcaagagatccccgaagtagaagcgcagacgacgacttcgcaaggaccagaggctggtaacgactcgataatcgggtctccaaataaagaacaaagatcacctcacgctcagctaggtacatcttcaggttagttgtcttctcaaacaatggcgatttaaataacctcagtttatccgtctaacgtcttggaaacacatcaggaccatcaggtgatgacggagaggaaatccctcgcataaaggcaaccgacgactctcgtcctcctatcttgatcaaatggtgggacgagaactcacaagccgccggtatagtcataaaccgtcaaaaagaagatgaagaagtgtgccagctgaagaaagcgctcggagaagccactcgtattgtaaatgtaagtcctccgggtgacggccttcggtaactttgttttctttttagcagaacctaaccgtgaaccactatgcagagaatccatcttcgcaatgaggccaaaaccgcaactttagaaaggctggttcctcatttgggaactcttgaagcggttagggaccagctacatgaggccaaggagcacgccaagaagacggagaaggaattaagggaccgaatcgctcagctccaggattcaaactatgagctgagtggttcatcaaaaggtaatccctagatccgtttcatcggtttaaactggcataactgtatcctcaaccatctgaatttcaaacagcgcaagccggcaggatggaacagatggcgaagcaaattgaagccctggagagagacaagacagaactggctgcgcaaagggactcagccttaaaggaagttgaaggtaccgctagcagacaatctgagcttctctctttataatgcaataaatcctcatcataaatgtgttttgtagatcgcaaaataaaatcgcaagcccaatttgacgtcttggttggtaagatcaagaggcttgaaggagcaagggataacgtcgccaatgccgctgcaccaattatccaagccatgttcctcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtacccgagaattgaagtcgacaccattgatggatttgcagacgggacaagtgaagaagctgcccttgatcttatcagcagtgcgcaaaatgcggctgacaaaattgcgagcgatgttgtagagcaatttcgcaacaacgacctccagccgagtaatgaagactctgatgatgaaaggactgattctgactgagtttgaatgtaatacatggaggctcaatttgtacaatactggtgtatttatgctgtgcttgatgattcttgcgaagtttttgatttcttaaaagtttttgctaagctttgttgagcctaaaacccaaggaagctattaaaaactttcagtcctcgcaaactaagtagaaaaaccaaacaaggcaatgataaaccaagtaagcaaactgaattgataaaaaatcacactccattattatgatgatagcccccgactgacaacttcaaggagaaaacttgatgtttgacagtcaaaatagggaaatacaatgataaagttaagcgtagaaacgacgaagatgttcaatgttccaagaattgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactagaaagg

SEQ ID NO: 58900 - DNA, 20572 bp, Oryza sativa
gttagggtttcgtctattcgttgccttcctcgccggattagcgcgtccagggagggtgagcggggtgtgcttggtcgcgtcgcgtcgtgccgtgccgtgccgcgcgtgggatgatgggcaccgccgtggagctcggccggaggcacggcggcgaccaccgcttctacgacgcatccagggtccggcgagggtaccaccaccacgggctccccaaggcgaggtgggcccccgccgtccaccaggagaaggcggccgaggagccgtccccgtcgccggcgagggcgccggtcccgccccccggcgtcgcgggcaaccttgagcggttcgtggccgccgtgacgccgttcgtgcctgctcagttcccctccaaggttcgccctgccctttgacttcctcgcgtggtagggttagatcgtagtaattacttgcggcagtgcgaccatttctgaatcggcggtggatttgggatgcagatgcagagagccgcgagggggtggcggggctgcggcgtggatgccgagcgggaggaggccccgcacttcttcctcagagacgtgtgggaggcgtacagggagtggagtgcgtacggtgccggtgtgccgcttgtcctcgatggctgcgacggggtcgtgcagtattacgtgccgtacttgtccgccatccagctctatggagaccccgcagtcctgagactggcttctggccctagggaattgtgatttcttctaatcatgctcaggcacgctattgatctgatttggaagtataatcctgaaacccacttgacttttattataattaatatatggtgtgcattgttacatttacaaaagagcaacgatcatttctaatatgtgtttttgtagaacaatgtttcatacatttctagttgccagtaatacctgactgtttgctgtcacacatgtcgttaggaagcacttatcgggttaatgatcccatggtagtgaatgtttacctcatgaagctattagttgtccatttgcataaaatggatggcccagagaattttagcatgaaattccacacttgttttattctggcgtcttgtgtttaccaaaacaatcaggaggttttaatccggtgcagtgtgttctatgacattccaactttacaatttgtagtgattgtatagactcgaaggtagtgaagttcaatcagatgtgacttaatcgtgagatgttgtcgttatgattctggatttggaatgatatataataatattatttctcattgtcaaaactagcttgtgatgttgtgacagatcaatgtttgcaactttaacttgtgcatgggaacgaccttaaccatttcgttaaagtttcatacgtccatacattccatccttttatgttcgtttcctttttgttcattaaacctttaacgtgacattaatattgtgtttgtagagaaatttccccaaaacacaatttagcctctccattgatcttgtctttgaacagtatttgttatgttcatttagattagcagttcactaaaatgattgtgtttgaattccataatgccatgaaaaataatgagcttcggttacttcttaatgtgcgttatagctctagttgctcatgattttttacatattcccacatgcatcatgcaggcaagcttttgcttccctttactaatttattaactatcattatgtttctaacgaattctagtatgaggtgttatagaaaccacttagtctgttcagtaagatataactttaagatataacttggtccacttgatttgtgcaatatctaattttgtggttatgtttggatgaaaattttgaagcagacatataatggatgacagtgatggggagtatcatgattccagcagtgatgcaagtagtgattatgaacttggaagagtaaaacatctaactcaggaaggcttctcaagtgatgatggtgaatcaggagatttgcatggccgcttgctctttcaataccttgagtttgattctccattttgtcgtgaaccattgactgataaggcaagagttaactaagacggttctataatattctattgcatataaatattctgaccttatttgttctttcagatttccagtctttcagcaagatttccaggactgaggacccttagaagctgtgatttatcaccgcgaagttggatatctgttgcttggtgagttctttttccattggcatggtagcagactagcagttatagagtatggtagtaactagttactgagttgcctacaacatcatgcaggtatccaatttaccgtatccctactggcccaacattaaaagatttggatgcatgctttctcaccttccatcggctatcaactgggccagaagaaggtatgatcgttctgatttccaaaacaaacagatatgcttccacctgtctgctgttctttcattcggttatcttctgtagtctgatttagcacacgtctagggggcacaaatgtttttgaaatacaataaagttgtacaacaacttaagtatgtgttatgtcttctgtgtacctgctctgtgttggctcgagaatatgagctcaaaaggcctttccgatagtattttttatttgtttagtttgaaatgatcaaatgcatgcaattgacaatctctttttcctggtgctgatgtttagaaggatttaacaactgccagttgcatccaaaatctatttagaaaagattggcatagttagggagcacatgttctataattctgagatatcatttcagtgatagttctgtttttactgcttggcgcattactcctgcatgcggattctgccacatttaaagataaaaaatactttcataaaactgaagaaattaatgaatgacagttggtcgttggcacttattttattttgttagtttgattcttttttatctaattctgtggctgcacgctgcttgtttaaacactatggaatcacttattgcttgcttgtgttgtgatctcaagtttttatgctctcttggccagataacggtggtgctgtaaaatactggggtcctggtagcaaaccgactataccactatctgtttttggtatggcttcttacaagttcagcaattcaatatggtcttcgactgatggagatcggcagctggcaagcttcttgcagcaagctgcttctgactggctgcgggatagtcgtaccagccatccagactaccagttttttgcttcccgtggtgcatacaacaggtagtggcacggagtctacgccttggcagaatttgcagcagaatgtctggaaggtttcagctgtaaatacaccgaagggggaggtgaatggctgatagctttcacacatgcatgcggagagacggtgtgagctcccatagtaggatgcaagcagtgttctgctttgtaaatggcggtaataggggagggtttgatcggctgtgtttttatgcttaatagtcggtgatcctcctgagggaagttgagatgaaaagtgaaaaaaaaagcaaaaaaggactgaagaaaaaggcagtaaaaagattagctgtgcttgtttgttgagctatgcatgcatgtcgggttgttggacttgttgaggctacttatgtaatcctacgaatacgggggatgagttttgatgatattccccttaatgtctgtaaacacttgtgaagagcctgtctgacactacagactgttgtgtttgaagggaacttgtagttagcaaattagagtcatccgcatcgtttgttctatagaatataatgttgatactaatcatgtctagacttgcaatgcacaaattaagagctgctgatgcgtgtaaacagtctgatgttcattagtcaaattaccttaaaaatgccggtgtccaaacttctcttacaagtgcatcagctctgttagtaaatactcccgttctttaatataaggattttaatattttgttctttaatataaggattttgatactttgtttgcactgtttgatcatttgtcaaattaaaaaaaaagaaatcattatttattttatttatgatttacttattatctaaagtactttaagcataattttttgttttttatatttgcataaatttttttaataagacgagtagtcaagtaaaatatcaaattcttccccttattctttaaaaaaactaatagaaagcttaggaaagtttaagcaaagaagtagacagttttcttttaagtaaattgcattggtcatacataaacttggtatatacgtgtaatttaatatacaaatttataaaatagtcgtttcagtacacttacttgtttagttcttgcgaatgagaatcaaaataacctggcaatattaatttatgttaattttatgaagctgatgttgattaggaatgtgacgtgcatacgtgtataaaacatgtaatatttataaatctggtctctagtgaatttcatatatttttaacccttatatcattgctcggttttttttaaccttttttaactatcactatatcctattctatttttttttatgaaaatgtgtatatctaatatcaaccttatcaaatttatgtttacatagtatcctagtcaacccctaagtcaataagattagccatgtagtgtccttttcgcttttcttcacacgcaccggataagttcatacatcaaaacgagcattttacaagttcgtgcactagattacacccacttaataagttcatgtaccgatgatgcaatttactttttttaataaggggcgtttttaataagcaagtttttaataagaaaggaagtattttaaaagatgtatattcatgacaacaatgtataaatgaaacgaaggtagagttatgtagcacatggagtactttgatgcttggttggatggagcctttaaagtttgaagtgtttgctaggtggatatagggttgcaagcgggccgacccgtgagttcacttatagatcaaactagttgataccccgcgcgttactgcgggcatagaagtataattatcaatgtgcaacattagtgcaaacaatctaattaagtttgcttataatttgctgagaatctcttaatgatagttctgttcccagcaatgtatgatagtatatgaaatcttcatctgctggccaaaacttcaaaatagagaaacaatagtatacagtaaagatctgattggttgtgaacgtttagaatgaaagaaacaaaagactgaaaaattatatatttattaggcatcattactataattcataaaattgtatgcttccagatcatggattgctgcataccttagcaaaaataaaccttcacctaatgtggatggttcaaaatctaaaagatgacccaattatatatatgagcattgagggaagcatcaagcatacataggagttgggcacttgacatccggatcactcatagtatttgttaagagattaccaacaaaataattccatttaatcaattgaaaagcgaatgggatcatggcacctgaaagcttaactttctatatgccctcagtctgtctgaaatatcatagctcaaattgtataccaccttaccaactgcatatatgacatgaaacaaaagcagttacaaattagatggaatagcataaaacaaatatgtgcagattgatctggctctagctttagaaatacaattacatattacatatatttgagctatccaattttaagagtttttcagctcatctgcaacagaaaaagatctaaagtataaaacccgtcacagatttttttttctttttaatgaactggcaccggtgtgtcaatttcattgaatatagtggaaaaaaagaaggcaaaaattacacgaaacccatcatccggaaaataagttgcaacttgttgatatgagtattctattaatcctattaagccctaggccgggatgttacaccctcaccctcttaagagagatcgacgcccccgtcgatcaaccccaggccaggaacgtcccctcttggccatgtccgtgtgtccagtgccagcgcatgtgccatgctgtgaccactccaggtccacaacagccatgcgcaccatgcctgcgcaactgcgacatacgcgcccggctctgataccattttgtaacgtcccgcctctcccaggcttttataggtcatagactgccctcacagggcaacacaagtcttttcggcgcactttgtgcttactcatgtgcactcgggaagaatttcccgatcggtcacccatccctaaattgctctaggccaagcacgcttaacctcggagttctttagagatcagcttccggaaaagaagttgcaacctgttgatatgagtattctattaatcctattaagccctaggccgggatgttacattaatcaaaaatagaaatatttaatatgggatattttcaaaaagcttatatgaaatggagaaaaacagccagacctaaaatcttagccaaagaacaatatattttggatccacagatggccttcacctgaaatcctgttaattagaactctggagtaaatgatgcatgcagagaattagagactgaaggttgcaaagtcaaggtcttagtgtagcatctattaacttgtcacgaatgcttagaattttaggagcggatgattcgatggctgcttaccacctcaatttactggcagtgcagctttaaagcccatgaaagtggactgggataggagataattaacagaaacatgagacatatcagagatgatgtaaaaatctctatgtagaggaacacaacaactgctttgtttggtgcctacacattgcaatgtatatcaacatcaaccaatcagatatgggaacaaagtatcatcgaagaaggtcagctacatgggtatcatcaaagaacttaataacttcctggacctggttggcgctatatatcgttgacgcgggcgataagatgagggtgagagagacatcgagcagtgccgcctcccaatctcccatccatgcgctaaactgatgaggctagctaggacagctagctgctgatagaaacgtatgttgccagcagctagatcaacgatgatatcgcagagattagtggtggaataaaaacatgcattaggtgaaaggagcataaaaaggaattaaacatggtattaaaatttaaacatagcccctcggcttccctttgatggcgacggtttcattgacggacaatacgattattattgaatcggtttcatacaaaaaaaatcatagaagaagagatcatgcctggtcgatggggggagacggtggatgctattcatggtgagctgaagagtgaagaggatgcacgacgctccacctcgccgcgcgctgtccttaccaccacctgcgtgtgaccgcgccgcactacgccgccgccgccgccgctccgactcaggaagtcaggaggatgagacccaccgaaccctaaatccttcattgggctgcgatagactaacatgggtctcctgggctgcggtagattgacatgggcctcctgtggtggaagaaatatataggcctcacgtgttgtgttcaatccgacggttcagatgagatctaatataccgatccaacggttgtgaattaatgatgacgtggaacattgaggtgtgagttttaggagattaattgcacttagtggaggataactttataggaagaagggataaatgataatttatgggttttcacgtcgtgcttcggtttaccgcatctagatatacaagtgggtcgatccataaacccatttagagcaagtttaataggatagccaactacgagctccaattcatctatagccaatttaatagtcgattcgtataatagttgtttactatactattaatacctggtcctatctgtcatacacacgttacgtcttggagtccgtgctacagctggctacagatctgtaacccgctgctcttctctctcctattttatctatttaaaatatgtttatagctggcttagggcatcaccaatgtatatggcaaagtgatccatatagataggacccatataaatagtttttacctatggcaatctccacaatgtatatggatataatgtatcactaggagaagagagatgagtagagatagataatataatttattccatatgggtagtccatatgcatatggataccttttgttattttttctatatatggactagttgcacaatggttataggtggctgaatggaggacctcatcggtttgctgttgctgaggctgatcttcagcacaagcccatcagttagcttattggggctgaataaacaccagctattagtagtggatccgatcttactggacacctttttacggctgattatgctgaactgaaaaagccaactttggctgatcaaccaaagctgtagggttaccgatgaggaccggaatattctattgcttatggactacttttacactacattgtggatgcccttatagcctgctattgtacctgctattctctctcctattttatctctttaaaatatgtttatagctggtttatagcctgctattgtacctgctcttatagatcaaattaataggtaacccgctggtcaaatccgcgggttacgtactaattttggttataagtgggttcgcggacaagcccacttacacctctaggtggatagctgtggtaccttaatacatgggtggtgtataggatgcgggattttttttcttctaagctttccttcatagcaaggtttaaattaagggcccctttgaatcgcaggattgagaaaacgtaggaataggaaaaacgtaggattttgataggaatgtaagtgtaaaacagaggattgcaaaacacaggaaaaacataggaatggccgtttgattgaaccacaggaaaaacacaggaattggatgagagagatagactcgaaggaaagttagcaagaggttgaagctcttgctaaatttcctccaaaatctctataggattgtccattccataggaatttcaaaggattggataggattcaatcatttgtttcaaagggcttcataggaaattttcctataggattgaaatcctctaaaattcctatgtttttcctccaaatcaaaggggccctaaaatctggaatgacccgacatttgaaatcctctaaaattcctatgtttttcctccaaatcaaaggggccctaaaatctggaatgacccgacgttttccttactcaaaactggcagcgctaaaaccagcctcgagtcgacggctgaagattggttagaaagtggggtccatctgcagagtatattttcttttgagatatctgcagagtatctgtggatgtatacaaacaggctctttatgccgactgaggcgctgtttggaactaaggaatagaataggaaatgaatggatgtgcaattgcgaaacagaggaaccatgaaaattataggtttgtggtgtttggaacacagtaacagcaaacaataagggcccctttgaatcgcagggttgaaaacaatagaggaatgtgaaaaacacacgattctgacataaattaaagtgttaaacaaaggattgcaaaacacataaaaacatatgaatgatcgtttgattggacagcaggaaaaacacaggaattggatgagagagataggctcaagaaaattttccaagaggtgaacctcttgctaagtttctttcaaaatccacatgcaatgtgtcattccataagaatttcataggattcggaaagtttcgatcatttgaatcaaagggccaaatagaaaaaatccctataggatttgaatcctataaaattcctacataaatcatttgattcaaagggccctaaaacttttctcttcctcaatgctctcttggccaatagattgcattcaaaggaaaacttcctttagcttggagcagatgttttattttctccaaaaaaaatagtactccatttcaaaggataggggaaaatgtcataggaattggtttgctccaatcctccattccaaacggcatgtgaagtgctcaaaacaaaggattcacaattcctgtacttttccttggttttcctccaatccaaacaggccctgaaagggaaaccatagccctgtggactttgtggagtgttatgaactgtgatgattctctactagtctgactggacacgcataaagcaggaaaaggataatgtggtaccaattttggacgttgaagaaaatccatcataaccgataaacaattcacacgcatgccatcagagtatgtagatctcaattttcaaaacgaacactcaacatcaacaactttgtgcagttcaacagatgtaatgcagcattgttcaatgtacaacaggaacaagggaatgtttgtgatagaaaagtcttagcatattcctcaaggaacactagacctcttaatgtagtaataaatcaaatagcacactgataccagtaagcgtaccaaagttacccagaagatatgacattaaccgtatttaggatcggtataacctgcaagggaaaaccacagtataacattggaaataagaggactgtaaagaatggtaggcaagggcatgtgtgtctaaatataagaagggcctaaaaaatcagatggaaaagcaaaacagaattggatgttcagtttgttctgacaacacataaccaacgtaaatgatgatgaaaaattttccatcttcaaaaaaactacatatcagatcattctagcagcccttaattaatcattgcctgaccctattacatgtaaaactacaaaatgatatgcctcaaatctaaagcttcttatgtgtattaacaaaaaacattgccaggaaacttttcaaatccagtagttattgttaactatatgaattgttaaccagaaaatctataatggaacttataatacaggtgagtaagctatggacaaaactgaacattattgcgcgcccacaaaaatggtacatgtggcataacaaagacatatatagggaattacctctaaaagtatcatatcaatgttttgacatattgatcaaggtgcttattgaaaagctcgcacctgcttaagaaaggtttgaaaagttagtcagttaaggtaaacaaagaaaaaattgattgaaagccactataagaaaagtttgtcaacctgacatagttttttatgtatattattaccatactattaaagttttatttagtcacaagaaaactaaaaggatacttaaaagttatggaagaaattgagtgtttggattgtagccgatatcttgggatagcaaaattttggaaaggttggctcaagcataaacgaaacaaaagtttacaagctaccaataccaaattaggattatttaacgaaaatgttcactattgtgcaaataaatcaatagaatggtatcctgataggaatgactgccacaagtaatctactccctccgtttcacaatgtaagtcattctaacattttccacatttatattgattttaatgaatctagacatatatatctatttagattcattaactttaatatgaatgtggaaaatgctagaatgacttatattgtaaaacggaggaagtacctcatatctacatctgcatgaaattcctaatataatgggtagaaggacaaagtaatgcctaccttgcatgaattttctcttgaaagaaagaatctacattaatgcattttgttttctgatgagataatcctgatagctatatctaatgctgttatgaaccgaagggtgaagcaaattttcattcgcagggaaagcttacttgattggtgtgccaggagcgtacaaaggattttttacaacatattccacatataggttgtagatatgcttcagcgtgtcacgttgatcaccagtccttggatgtgtaattagaataagctacacataatggtagtgtcagtgaatgatatgttttggaacaaatggtattaaacaacattctgttccagcaaagataaaatcatgccatattaagaatggaaaactggaaggcaggagatgaaacaaattgactaaccttgataccagaagggctctctaggaagttcaatttgtatgtgtttgtcttgaagctgtaaaatgagcaaccctggcccggcagtagtggcaccccaagattccccttttctgctctgcatagtgatgtgcagagtgatcatgagaacactgataacattttaagctcaatttagattcacctaattcatcaaaatggtaacaatctcgtgggcatgaaaaggagagcagttagaaaatctaggaaagggcgacgaaagtgtagaacagtgtgctgggaatgaagataaaacacaccaaaagttgtaatgacgatataagaattttctattgttcaattttaaaaacttacacatttcctcctctgcttttagtgattaacatgttgagtacctggggtgttagtattgagattctatatttatatgaagaggtgacagatcagaggtcagacccttctttatttttccatcttaaactcctgctttggagaagaggtagagttcaactcctggtattgtggcgattattgatccaaataccagttgtaaaattgaagtgatgaactattcccaatcttaaatcgatttcggcggaccatccttgcgcaagggatcccttgcttaattttctactgcaaagcctgaaatctctgccaaattggccgcggataactgtgaattactcccactgacccaatttagtgagtgaaacaacaatttatagttcattcatttgactcatttttcaagcaacaagaaacaggtggtttgcactgaagggcacacttgtaggtagtaacaataagtaaagtaatccattccaaaccactagcggttcgatccaagaactctgttgaggtggggggagagagagaggcgtagtacgtggtgggatcgatcttggcggtgaaggagcggagggagaagaggaggccgaacatgagcttctggtcctgggtggggtcgagcgtgcggagcggccggtgccactcgcggtacagcaggcagacgccgccgcggttgaagacgtagagcacctgcgcgttggcgcccgtcccggtgcccggcggcgccgccggggccggggtcgcgtccggcaccaccgacgtcagcgacgacccgccgccgaaggagaacatcgcgcgcgcgtggatggcgcccgaggaggaggtcgagcccgccggctgtggatctccgcccgcacaagaggagatctctcacgggaggtgaggacgacggcgaagaggagtttgtcatcgtagatagaaggcggcccatgtacacagacagcagaagccaatgatgggttttgggcattaagccccatgggccggtaaagcaaaccgatttctcaagtttttatttgtttctctgctggagtattatagatgtggaattcttaaatttatttatttatactagataaaatgtccgtgcgttgcaacggatgaatgctattttaatcttattattgttatacggtttagctaggatgaaattcactgtaggaattcgcttggatattttttttagaaaatcatgagctgcaattaggagtccgactttcatctcaaattagcatgcaagttttttaaaaggaatttattttacgacttcttttatatttccaaaagcaaacaaacttaaaatccgattcatacacgaacttgtaattccaaaagcgaacaaactttaaaactgactcaaatacggatggcgtaccaaaatactggcaaaaacatattcaatttttataatagttgagaatttatcagttttgaaaattttatttttcttaaaattacagaaatatacccaagggacttaaatgtcaattttgccatatagcttgttaacgttgtgattttacaatttaaaaatatatcatatcaagtccaatgaaatcaaactttacattaaaattatagagcttgaggagatttacaacttcaaagttaataaccttttagtttaagatcgtttaggactccaaatatttgttacaaaaatctaaaacttgtttctaacaaaatctcatatctacgtttcaaacgacagtgtatgtagacaaactttcatataagctttgtagtttatcacctttttatttaaatttaattagagtggcaaacaagcgttaatagtctttaatacaaataaaagaatacagttaggccccttctcgtcctcaagaagggtgattttcaaaaaacaccctcatggagcgtctagatctgtagattttttaaactaaaaattattttcataaatattttaataaaaaaatttcttctaaatattcctcctccccaacaatcacattttccccacataaaatacaacattaacatattcagtgaaaaccatcaaataaataaaaacccgtaaaaatcaaacctaaaaattttgtaaattcatgacaaagaattagagactaaattttgtttggggagtactgaaaacaatgacaaatttcttgagttatttttttcctcctctctcgactgtagcgtattagctagtttagctaatgtgggtgcaactggcatccgaatgcggggcgctgattagtgaccagtcgcgccccacgcgcggtgcgtggtcactttttcctctcttagtctctcttctctacagcacatgtatatacgtatgtatatactatatatatatacacacatataaattttgtatatacatatacaaaatttatatggtatatatgtagtatatatacatataattttttatatgtacacacttttaatgtaaaaaatatatacacatgtatataaagtttataaagtttatgtgtgtacgtataaaaaacctaaaaaaaaaatatgtgtatataaactttatatatgtgtatacaaactttgtatacatgtatacaaaaattggtatatgtacatataaaacctcacaaaatgcacgcatatacaaactttgtatatgtgtataaaaaaattgtaatatatatgtataaaacccaaaaaaaatacacgtatataaagtttgcatatgagtatacaaactttgtatacgtgtatataaaatttgcatttgtgcgtatacaaagctagcatacgtacgtattaaaacccgaaaaaatacggaaagaaaaaaacaggaaaaaaaacgaaaacagaaggtacgaaataaaaacagaaaaacaagaaaaaaacaaaaaaaaaaggaaaaagggagccaacgcgccgtccgccgccctctctccacgtacgacacggcgtacgacacgggtccagtgcacgactcgcgggcgactggtcgcgaactagcaatttcgcatccgaatgaacctcgttgacacttgatagacgcctttttagagaagacaaatctttttagaaaaagctgcatctgtctgaattttagaccatcttctgaactgcttggtagttcgatggtgtcttgaaagagctttcttctgcgatggcgttgtacggagcatcagttagtgaaccgcctcttattctcacgaaagagatgaagcatggaaaagcttcctctcaaacatcaattcaggttccaaaagaagctcaggtgattaggtgagctcaggacctcaggttctaggaagctgagcaatctgaattcaagtttcctcaaagcccgaaacatcttatcatcagggtgaggatttagaaagcatctacatatatctcataatggaatttcgcaagtagatgggggaaattcaccaaccatcacagataagaaatcagaattgtagaacaaaattctcagaacatatagctactcaaaattccatgctcactggcatggtcaatattgttgtggaagccattacaagggtttacaggatgtttcttcattaactatttaccactcaatataacgcaaggtgacttccacttggtaaacacaacagcccaaccagttatgaccaaaaatccttaacccaacctgatagttcccaactaaaaataacttcttcagcttcttcactcgggatttatcttttgcttctttgagtggtccttgtttttcttggcttcacgacgctccctcttcaaccccttgacatcgtttgataaactcatctttgcgatctttaatagtcaaaaaccacgaatcagcttagcatgtcaaaaggcaatttcaacctttacaattgcagcaaaaaacaaaacaaacacttacttgctggtctggaatgtagaccttgcccagcttgccatgcactggatccttcgtgacatttttcatctgtaaaaatgttgataattgtgagaaccatagtgaattagtggtttaaggattttttggcaagaatacaaggacatgggctatagttgtttaatatcacaacagtttacacggcaccaaaggtcaaaagacaattatcaattgggtttaccttcttagcatgatcagcagtcttcattgcttctttcttcaagctttcaactggataccggtgtcgcctaactactagatccatagaaggtccaacttcaaccagctcaattctaggaatagatgtgccagaccgttttagacggagagcacagtgcatcatgtagacagtagtaggggagattgctgtgcacacaaatacccgatctacaccagcaaggttcagattctctaccacctgtatcaacaacaaacagctcatgctgaagctcaacagataatctggtcccaacatgccaacataaatacaacaaaaggcgcacctctcctttgaaaagatcaagcagcacttccttcagatgcttcagctcttcaacactttcaaagtgctccccaatgaaggcaaagaaaggctttgacccaagtttaggtgccagtttcttgtcatacacatatgattcaattgatttgtagttttcaactcctacttcaacaagatcatatatgtggtgatcataagtcctccccaaaacaagattgttgggcctcttctttgagtgagaaccatactggaacaaaaaagaattgaaggattacagtcaaaacgatgaagaaacataatctctgaaaacacatcatcttactaccacattaaaagaaaaacggacaaactaaaagcatctgaataggcaaggagtaagtaggtttcagataggtttcatataagcggtgagaagttcatcatagtagctcattgtatacggttctacttctcctccacactatcaaatcaaaccactaggaatattaaatgatcctatcttgtgcaaaggaaactatttcttctctacaccaacaacctacaattataatcagaacaagtgagctttaccactataaggctgcaatccgtcttgagggagaagaactcgagagaagtttcgccgccgctctcgaacggcctgatgttgtcattcttcttggagtacttgacggcattgtcacgcttcaggtggaacaaatccgcgagcacggagttcagaacggcgctggtcttggttccatggaggataagcgtcttcttgccggtctcaacctggcggcgcggcgcaaatcatcagagagagagaaaaaaagaacaaactcaagaaccgcaagctcacggggggagcggagataaacgcgcttacgagcttcggcgcgtgcttgaggagctccctcttggcgcgctggctcctgggcaccctgatggccgccaccatcttcttctccccgcccggttccgatcggtcgacgccgccgccgcgtggggaaggggaagacggcgggtgtgggggaagaggtggggagcgagcggtaaaccctagaaaacctcgcgagctgggagagttggaggcgacgcgggtctttgtgtcgcggaaggggaggaggaatgggatggagggatcgtcgggatggtggagaatcggacggcttaggttcgttgcgcggatggctggatccctatgggcttttcggcctacctgctcattggcttttaggattcggcccatctcctccagcacgacatcggacagaacaaagttactcggtcagaatctactctcctgtcctccatccgtcccaaaataagagcgagtacaatagtagaacatgttcgggggaggagagctagatgagtgaggagaggagggagagtgagggcgggcaacaattttatcgccggctccagcatcgacttcgagagaaaagtgatacttcctccgtcccataaaaaaccaacctaatattggatgtgacacattctaatactacgaatctggacatacctctgtgtagattcgttgtactataatatgtcacatccgatcctaggtttgtttttttagtactgagggagtaagtgtggagtgcatgtgtgacagtgtgagtctgagaggaagcttaaattctttttaatatgacgtgatgttcagtggcggatccagaaagaaatagcagtggggtctgaacaaactagatagagttacaatgtcccatcccatctatatataataaaaaaatttagcgggatcttcgtgggggctctcatagtcttcacgccagtagtgggggctcgagaccccgccgcccccatgctagatccgcccctggtgatgttgatgggtccagcattgtagcttatttattgtattcacaaggtgcaaagaaagctatagctgagttggatgaaattggagccaactgcctatgctactataaccttgctctaaaccaacatcgtactaagatgtgacatatccttgtataataaatctgaatatacagagtgacacattttagtaggatgttaatttattttgagacgaagggagtaaatgtggcgtctctacagatttatagtattatggtgtatcatatccactagtacctctttaccaagtttattattatttttatttactagtaatattgttagtactaatgctaaataaagactaaaataatgcattaagataatatttgtttggcaattaagtatcgaatgtgtcagttttaagattcgtgaaaaaagaacgatatagttaagctattctataaggacatgttgtttgtgtaaacaggtctaaaacagatttgaaaaggtgtcacaccatatttttcataacactacatatttaaaatatcgtatcagaaaattacatatttaacatcagttttatcacaaaactacaactttgataacctcaatagtgccaaggatacgagctctaaaatttgtagttcttcggtaacctcatcactaaatttgtagttttgagatacgatcaatgccttaaatctatagttttataataaatttaacactaaatctgtagttttgtgatacaaatatttaaatatgtagttttgtgataatttagtcaagtatatatatagttttgtgaaatttactctagtttttaaggtttattggatcctaatcattgcaaattttcccaattgaaaatctaccattactatttattcgtgaaatcgggcaatgtaaacatatttgtattaaattttaaaaattataaatagatgcaaattgacattaagtgaaagttagactagaagtaattgttcttaactacaataaggaaaatgatggtacctcacaacataaataaataaattactgaaaagtgaaacaaagaatacattttaaacagtaccattttgtaacaagtacaaggccttgttccacacaccactttcccgattttatcaaatttggcaaaaatccttaatgatgttgccttaccatatttttgttattagaatatgaagaagtatattccatacacagaagttcagaaaatccaaataattaacctacaaagaacatcaacaaatactattatattcactttttaaacataatacctccatcccaatataagtgcagttgtggtttttcatatccaacgtttgaccgtacgtattatttgaaaaaaaatatgattagtatttttattgttattagatgataaaacatgtgtgactaatttttttaaaaaaatttcataaaattttagaataaaacggacggtcaaactttggatacagaaacacacaactgcacttatattgggatgaaggtagttgttagaacagaagaatgtgatggaataaaactaaccataagatagaagatgaaaccaccaaaacctttcgatatgtcaagcttggttatgtgattcatcaaccattcaaataaaaacttgctccaatccaacttatcaatagaatccaactcttctggagcattacgacattttgtgctatgtaccaatgatgagtttgggtagacaaagcaattaagatagacaaacatggatcaaatttggatgtgttcaacagacatgccatctttgttaataagcttgtctataaagaacttcacaaaggacactaaagatttgccaaaactaaagaatctttttcttcagatcatcaaaacttgatttgatagaattgcctctaactggtaaactgtgaacaacatctatagattcttttgattcggtggtgtttgaatctcctaaagatgaagatgaagataaagataaagtgtttcacgta

SEQ ID NO: 58901 - DNA, 5571 bp, Oryza sativa
taaatatgattgatacattataggttatcccggtatatatggatcaatagtatggaccctatatataagcatacttatacgatgatataatctacatccattattttttttcatgatttgtcaaatctccaatgccatgcaaagtaccaagatttgtgaactgataaccgatatatagtgatataatttatattgtcatattttccataattttcatatccgtttgcattggattacatgaaaggaataaaaatgctatctaaaatataatttccctttacaagttgaaatatagtaaatatacataataaattattaatttaatggtaaataatataattatgtaaactttgttttaaaatgcggtaaagctaattgagttatgcttgtttgtaaagtgatttaaacaatttgctatatctgatagatgtttgtgttttttagactttctaggattttccctaatttattagagcatagttcatagaagtttaatagacttttattatataattgaggctctttgatggtacacaaaagcaaagtataggtccgcatgtctttttttcaaaatatacatggtttttcattgttgttattttggctatgcatatttatgaagttctatacttaataatctacacggtaaattttgttttgtatacttttatgagtaattggatggtgtaaaaaagagcaataatctaagttaacatgttagtctttttcacaacatatgcgggtattaaaattgttggtttaattgccaggaatacaacttttgaattagcctttttaatataataatccaatgagagaatttgtcggccgaacgtattaatcttttttgacacacaacacgtacatacgaactactccctccgttttaaaatgtttgacatcgttaactttttagtacgtgtttgaccattcgtcttattcaaaaaatttatgtaattatttgttcttttcatatcatttgattcattgttaaatatactttaatatacacatatagttttacatattttacaaatttatttaataagatgaacggtcaaacatgtgctaaaaagtcaacggtatgaaacattttgaaacggagggagtatgtatttacgtattagagatcggatgagtgatttgccggattgatcaggaggagtgattattagcaggatgttattttttttctcaaacttttaggattggaggctttgtttttctaacaaaagatagattttatggtctaaataatatgtctaccaatttaagtgaaaattgatggaaaaatacttttattaataaatgtagtctaaaataatgggcacataatataatataatgggtctaaactttattttcaagtattatagagctaatttatctatatatgtttgtgaagagttctatgctgatatattgaatgctcgtaaggtaactattatttaaaatttattatcactgataataattattattggctcatatacatacatggaaaaagaaaaaaaagaaggtcaaatacgtacgtacgttcatactgaacggaaggaaggaatagtgagatatgtaagggaggaggaggttggtgggtcatctgtttgttttaagagatctaatctaacggtttataatattggacccaccgatttaagtgaaaatcgatggatagatgttttattttttttctcagtttttttatgattttctctaatttattagagcgccaagtggcggcttgagagcgtttcgagaaagtttaatggacttttagtatataatagataatagatagatagaagatagatagatagatagatagataatagattttcagctacaagttgttactaccaagtggcatttttctaaagaaaatcccttgagtattttggtttctcattaccggtgaaagctagctagagcccagcaccaccagtttatcgaatatacgcagtgtatttgtgtttgaacatgctattaatttctttgttaattgtattgatcgtgatcaggggtaccgtaagggttaccggcagtagggtttgataaattatacccaaattcaaaattccgaaaaaaattatggatatagttcttgatttgtagtggtagatggtgaagaaatgttttgaaaaggagtaagataagttcaaatttgagagcgaaaccgaaagtacattagattgttgttgaattgcttcgaaatccataatatagaaaatgttatgctgaatttttgtattttacacctaaaagttaggtttacaaatatcctatatattcttttatttatacccaatttctagacacatttaagtgatttttcaattttttgctagacacttgacgataactgcgcaaatattgcggttaccgcgagaaaccacgctgaaaccgttgatttttgaattcaaatatttgaagacggattttacacggttttatacggttaccatggtaactccctttaatatcaaattctttgagatactgttcataataagcttctagtatttcaattacagaacggaggtattataattctgacacgttcgtatggcgcactacggacaaaaattcattgccatgaattaaaataacaaaaataataattttattatcatctctcgctctttcatctctatcaaggcatgtttagtattccggtgaacaatcctggtggtgaaaccactttttagtcgtagtattttaccgtttgactatctgacttgatgtttgtaaagatcggtaaaattcacatttaaaatcactttggtcaacaggctttgcatgcatgcagatgtagttgttcttaaccttcctcgccttaccttgttagattttaatgtgatctgccagacagagttactgattaagttccacaactacttcttccgtggcagatgaaaaaaataatcacaggatagcacaacaatcgcaatctggcccttgcattgttatactttttatttcgaataactaattaaattatcgtgctttaccaccaagagaaaaagcaatcactcaccacaggtttgagagtataagcgcagtccattgagattctttttctcagtgaaatttcatacaaatgtagccatttcgttaaaaccgtaattttgttacaactttagcctatcatgttgcaaatttcgatcagtagcgagcaattttatcactacactgcaaatctgcacactgtttgtgtggctacgaggcatgatcaatgagatcaacaaaattagtgttatgtcaaatgtaaggtacaatttacaggattacatttcacaaacttttaatgatcgtgataaaggccgatgttaatattgtaatactgtgaaatagaggtatgtcaaacgtaagggaagaagaataattgtaattcagtttacttgtgttgacaaacgctatatatgctacatttgttaagaggcatatatatgtctcacaaaattacatttcatagaatgttagggtgccatcgtttggtatattggtggaataagccaaatggcatatttgcaaacgaaaagtaatttgtgaataaaacttttatattgtgttcttagtgatctaaaagcaaaggctgaaaaataaactttgatgaaaaaaccccaaaatcagctccaaatttaacgttgaaaattcaaattttggctgataagcatatgaatatgccaaacgatgaggatatcttagttaattaaaattataatgcaattatcacttatactttattttaaaaaaaatcttgaatgagagtacagtgataactgatacattggaggaagaaattaaataatcacatatcctatatccaaacaaaagcaactcccaaaactaatcaattattaaaagaaactagctagcaaacaacgtactagattattacacgagactaaatcaactaaagacttttacaaattgtcgatcgattccctcaaaatgtaacacagatttcgcagtaacatttggcaaatatgccatgtttcatgcacttgtgacgcttgactctgcctttattgtatttcgcctcaagccaacagtccaacttgcacgtaggacccacgcagacgatcagcttgccaatggctttgtagcaataatctacaaagagaaagaactcattagatgctagcttataaaataatctagcttatcatttattaaatcacatgaaacattaattgtaaactgtcccctataatctcatcactgacagatatctatagagaaccgctcaagaaaacaaataaaattcagagcatatagaacgcatgcagtttcttcgaaagatgaaatcaaatgggttgagggagaattaagatgaacctgtggcagaagcaggacctccaagtgctaacacaagcagtaagatgcagcaaacaacactggcttttctcgcttccatagctgatttaccgatcgatggagacttaattggcaagggagaaatgattagatcgatataaccctaaatgcactctagctaggaatgaaatctagctactttgtgatgctaatgagtgtggatgtacctatatttatagggaggatcggctatctaatgagaatgcaggagcggcccttttcagcagccgggataatcgactggatcgatctggtcaatccatctatccctataacgtaggcgcattcgcatgttaatttctactgccgcgagtacactttcagcctgcacgccgataattatattttgatgtttaattaccacggctattgaccagttaatccaggaaaaaacaaattaatgcgcatgcatatgcgcctaaatagtttgaggaccaaaagaacttctgcatacatgcaaattaaagcgtgcgatcagtttgagggtttcgcgtgattacagttaggctgctttactaaatattaagaaaatacattcattctattatactgaaaaaattccaaagataaagtgaaattttctagtatttgatatgggtgcggcttccctgtcccgatacgcttgttcctggcgacgtgtcatcttctcattcgccgagttttttctggtaggccagtacgcatgcgcttctctttcacttaaacggcgtcaacgtctccgttcttttttcccacaacggcgtaacatatcccttccctcccccaacagaaggtatcatatacattattaattcctctctctccatgccgctgatctactattactacaacaaaataaaaattccccaccttgacctagatgaactccgccagattccgccgctttacgggtgagctcgagcaccgcttgcccgagcagtcgattgtctcgagctcgccaccactgatcaagcgccttgccgctgagttggagctgatgcatggttcagctcgtgcaaattaatcaatgtccagctgcatcaaagtgcatgagcttggatctagaaggtccatgatgtgatcgatgctaacatcgtccaaatctagatcacttctgattctcaagaacttctctatatcttctgccaatttttcaacacaattagtagacatggagtatgtttcttcagattttgcagctgtagaagctattcg

SEQ ID NO: 58902 - DNA, 21639 bp, Oryza sativa
cttttctctttgcctgaacttactgatagcatataatttttgcccccaaaagtcaaatgaatccccaaaaggcaggcccaccgtaattcatgggtattcaaatgggtattcataaaagtatatatatttaatatgcacatagatatggtggtgtttaaaattcatgtagatgaagattaagtgttttacgtaaaacaatgtggtattaacgtttgattaattgagtttttattattacaaatttaaaaatatatatatatctgatattttagagtaacttctttatagaaagttttcatgcaaaatataccgtttagcaagcagtttgaaatcgtgctataaatatctacattttcatccaacctttttttgagaaaagaacggttacttaattgggcttgccatcctcccaccctccttctctcctcgtcgtttccggcccattaacccccaatagagagaaaaaaacccaaaaccaaaaaaccctaactcttctccccatcgatctcctctctgagctctctccgacagccgccgccaggcgaggacgcgccggcgcccgtcgcccatcgcgccgtagccgacctcatcacctctccggcgccccgcggcctgcgccgtcgccccgtctcgccgtcgcacccgcaccgccccggcgccccgcgagcccgcgacgccgcccgggcctggcgagtggcgtcggcgcgctgccgtcctgttcgtccaccgaccattcaccaccgcacttttcctgtcccgagagccgagaggccgaaggtaactctgcctaaatcctaatgcctactgttagatggtagtgctaagtgctgtgaatttaggatttaggaacttttttaccatttgaatccaggggatggttcatggttgatttattgcatatatttgaacaattgaactttagtaatttaattagtagtttcatggttcatggttcatggtttcttatcattttgccattttccatcctctataaatttgatatgttttgtcaattagtagtttagtactttcatatgctaagcacattcaatttatggtcaattttatttatctatgactttatgaaattatgcttataccgctatatattatacaactattagactttgggttgtaaaaaaaaaatgatctcttcccattgcgaataaccaagttcaatcctgggccggtgggcccacccccatggccccctgagtcctgatgattacaagcgtttatattgctttgtcagattaaccgccgcaactccgcatgttctccttgtgttgctgtttcaatgcttagtcatcttcattgtttcttgctctgtggcacattaagggagtaggaatgtaaaattgtctcttgtgcagttgattcagtgcagtttgtttgggcaacttttatgttctcgttagctatcttacttgctgcagcctgcaagtatataacatatctatgttttttgaggaacatgttagtttattactacttttctgtgttattaaaaggaacctgtgttattgcagaaaactcgagggttaaagtgttctcttacctgttcctttttgtgatatttttagagtttaatttaaaaatatatgtatatatttagcattcttataattgacaataccacctgtcttgaaaaaaaaatcaccctttcactatgaaagacacaaaagataaaatgatttacacatggtgattcatgcagcttaggtggtgcaatggctttaagttcatccattagcatgtctcggcgtcttttcaagggacttactatcaacccggcattggcatctgggatgacgtgccagcatcaccagcttcaacagcatgcgccagtgagtggaacagccaagggtaaggctaagctcaagtctggccaacaattgaagcgtaacaccattggagcaaagaagggcggcgcgccttccactggtgggggtggtggcggtgggcgtggtcgtcgtgaggctattgagcgtattactcagattgcagagtcttgtctgaatgcctcaactcctctgcgccatctatcccccaaggagcgtcttcgtgaggccaaacgtgaggagcttggactcatttctaaggaacgtcaacgtgaacttgatttagccaaggctaaagccaagtccaaaggtacccgtgagggtgatggtggccgtgtgctgatgggtccaccaggtcttgactacatcagtcttggattggttgatgaggacgcaatccctaaatacgagctgacagtcgaagatggccggcgacttgccaaacaatacagtcaggtgctaatgcgacggcaccgcgcacggcaaactgcagaatcgtctcttctaagtctcaagaaggaggccattgcagcactccctgagaagctgcgagctgctgctatgattcctgacatgacaccattccctgcaaaccgatacatggcaacactcacgccaccaattgaagggtatattgaaaaggtgcgggatgctgccaagaagtattctgtgaaggagaaacttcgctgatttttacctcaagggaggaaagggtatctagaggtaattatttaagttgtgcttttggccttatatagtaaactaagatgtgcaatgcttgctatattttattttactgaaatagtgtgttcaatagctcaccatccagtttccagtatttactctgtaacctatattagtaatgtacaagtcctcttggaagataaatgaacttaatccaattcgtagcaatgtgtacatataatgattttggcaagtgttagtttctagtgctaccagaaattagcttgagaacatgagttgagaatcgtgtgctattttagacaaatttgttgggaagtttgacctcaagcaaactgtgttgatgttgttcactttctatagacaaactagtttggaactctgaccgcaagcatgaatgggcaaaactgcacaggtttttttttttcattagacacaatgcaagctgagtaaactaatttgtttcctgtgtctactgtcaatatcctctaatctagcatatgtttttatagtctagaaactgggcttaagtttaatctcacatccaataaaatgctaaccactatcttgtatctctagtgcatactgtctactaaaatccagtatctgctcttttattggtggggtttcatcaactgatttctctcgtgtgtccatcttctaactcacttctgttttttttttccattacatatgtataggtacatgaacatgtcaggctgtcagctatgacaacagagcatactttgttgattggcatatcaatgcaaggagaaattgggaagcttgttcaattttcagtgagtttttggtcattttcttctggctgggatgctgcatgaatggcaatttctgaagctcgatgggcattcgctttgtttcattgtttgtttgttacgaatgttgtatgcagccacttctgtaataagttcccggcagttagatttgcttctgccatttagattttgcgaactttttttttactgctaaaatggctgtagcaaagcaatgcctcacttaggatcttgataatggctcccgtgtttctctcggcaaaatagcactgctgtctgctcctgaatttaatctggatagtgctgctccttagtttaacctggatatgtgttttttgggcctgttagcaagcacggaaagggaaatatttcaacgaaagcactaattgcagagggtgtggatgctactgtattcgggcgcccagcgcggaaaacggttcaattaagtattagctaaacttttgttaagaaaaatgggtcaatatgattttttaaagcaacttcatttcatatagaatgttttttaaaagcgcaccatttcagtttgaaaaacatgtacactaagtgcgggtagttgggaactttaacagacgaaaacagctgttattgtgttctttgttgacaatggattagcatgggcacgcctaaagttattctggcctaaaatataataagttaaagttagttataactcttatttagatgtataggtaaaacgttaatttattttgagataaagggtgtaaattgtttttttcgtgctacaaagagtttacttttataagggcatttccactgtactaatatgtgcaaaggcatctaaatgtcatttcccacgatactaatatttaatttatttatttgtactcttaataattgtcaaaaacttaattttatccatcatcactttatcacaccctaactaaaactgatcgagaaaagcaaactccacttgattacttcatcgtgccgacgtcgacacgcaaaatgtcgtactactgcatcgtcgtgccacgtggctatgcagcggtcgtcgcggagctctcgtgtcgtgcaagtgtccaccgcattcgggaagctcggacctgatgaggcacatccaaattgatccaaagccaaattttgatacttccaagtcgcgcgtgatttgtcagctgttagttgtcacacctactcatcagccaaccaattcgccatcaatagcaaaccaagcggattgatcatctcatctcatctcatcgaccgagcattctagcgagcgagcggccaagccagcaagatcgactcctcactctctcaccgatctagcagcagcagtggtagtagctagcagcgtcagcgtagcaaggggttgcgagaatggcctcgccgtcagcgccggggccgaagctgcagaaggcgatggtggcggtggacgagagcgagttcagccaccacgcgctggagtgggcgctgcgcaacctcgcgccgaccatcgcgccgccgctgctcgtgctcaccgtgcagccgctcctccccctcggctacgtctccgccgcctccttcggctcccctcgtacgtgacgcggatccctttttcctcctctttcaccggattgatccctttttccccttcttgaatccgttgttgattttgggattgtgtgcttcttctgctccgcgtgtgtgatagtgggcacccccgttgtagccccggagctgatcaaggcgatgcaggagcagcagcagcagctctcgcaggcgctcctcgacaaggccaagcagatctgcgcgcagcatggggtatgtattatgtgcttgtttccgcacctactatgaccataatttctcctcattaaacttgtgagaagttgaattatcaagcaggatgtgcagtacatcagtatgaatgacctcttgtgtttgtttggtcgctgctcaactactcagcacattgttgttagttgttactagttcaagatattcagcattttttgttgtttggccatatcagtaagggaaaatgccataggtgtccaatttcatgtgtttgcaactgcaattaggtaactggagatactagcttgtagttacaaatagtaggagatactagcttgtagcttgtgatcggtttggctcttgtctgtctcgtcatcttatacatttgactacatttgtatctactaaccctgctctagaccacatggactgggtttatattttacaatcgacacatcatatcagggagggtagaattgtgataattgtttggattgtcgtaaatttgtctatgttattttataacgaatggcaacgtatgaccgactaacaaaaataaattagcgtgaggtcataaggataaggcaaatcacaggagatcttcagtttattccgtgcaacactgtgctatgtggatggattagtgttcagtgattgtaatccttgtaatattgtacctacaattcaggtggctgtagagacaatgatcaaagtaggagatcctaaggagatgatatgtcaagcagctgaggaatcaaaggttgatttactgatcgttgggagtcacagccgtggacctgtacaaaggtatagtttgaaatatcgtggtttctttatagattatagttgatagattatattttctgcatgaacaatcaaaatagaattatatgttcgatgaaaaactgaaaacatgttgctctttttgtatgtattatggttggattaggctctttttgtatcttttcatattttttttagataatggattaaaccggcctctacatccaaacggatgtacacagccaacagatatgatcttttcatgaaccagactaaatggattggtacaagactgtaacaccttccgatcaataaggaaatccacagttgcacctagcacctatggagataattactgttagctgatatgtttttataggactccttatataccgcttgcaatcatggttttactgaggagcacaatataaaaacaagagtaatattttttatgggtgaagataaataatattttttgtgtagatcctaataatatggtattttagtgagcaagactagatggactggcagaaaacctccattagcttcagcaaagaaaagcctcagtttcacctatgggattaatcgttgtcaactgaacatgttttggtggtgctctttataaactgctcataatcattaagtttattgtactctgtacattataaagataagagtaatatattttacaggtgaagataaaatattacttctaataattttatcattgagtgacgcagatgtagtgattgcccttcttttcagttccattcctttcttttgtttttctcaactcaacagcttctgttttgttatgttccttataaattccaaaggcctaatacatatcggacattctgcatttctacaatgacattgataccaactctttgcattcaactatcttttcttgaacaacagttttatcaagtaaaagaataactctgattacatcagacaactattcagttacttatataaagctctcctgattccagatatagcattatcgaagacaaggatatagcataaatcaattgcttgttgcatgaattaatttccaatttatacataaaactcatcgtggattatctaactgttgcctattgctgctgcaggttgtttcttggaagtgtcagcaattactgtatgcatcattcgaagtgcccagttcttgttgtgaagaagcaggagtaaataagctttccgaatctcaataaaaatctttgtgtattgtcgatgtgttatcctcaacaatgcaataaacaaagccgtattagatgatattcagataactgaataatgtattgtgtaaatagtcaagattatcttgcaaataaatatccgcttcttgttgctgtaaagtaagggcgtttcctttaggagtatcatccatgtagctggcatctgttgcagaaccgaagacgatgaacacccaacttgtgtatatatgtgatatgtgtgtatgttttgttacttattcacaatgtgtctcgttcatcttgatgtctattgccgcttattggttggttattcttgtactctctctagccagccaaaaaaggaagtcgttttgagatttgcataaaggtaaatacgagaatcgttaagccaacgtgacaactgcctctcgtgacaaatattatagctgtaggaataaatacaacaatcaatcccaaaattacgtactaaatttcattttttttttgcagtattttttgtttgcatcctaaggtggggaggggatggcatgcatgcacaggtattagttgtatcctcccaacttttggtgcatcaacacatgatagataatttttatttcgaacattaattttgtcttgggatcaaagatgtgaactcgtcaggaacaaatcagatctcgaaaaaggttagtgaaataccacatcaactctggttttaggagtcgacagacgcgtcatatctagtaatgcggttttgagacgaattacaaactaggcgacaaattaaatgacctaagtgaacttattatttccttggtttgcaagaagaagccatacattttctctttaaaaaaagcacgcacaggcccactgatgcgaagtctacagaaaaatcacatactccaatttgttagtctaaaggccgacagagaaccacagagacaaaaagcccacaaaacaaataaaacccacaaagcccgaacccaggaagcatttactgggcctgaagatatacagatccaaagcacattatgtgtgtttcaacatccaccctatattctatatcgaacggcttaagaaaaatgctagacaacacaatttcattttatagatgtgggtgtacatagacttatttctaatataaaatatgttttatacaattttgtggaggaattatcaagggaaaaaatgataatggtgtaggggaagcacttagttttagtgtctgccatctaattcaatatgcatagactaatcagtcatatctagcaagctatgcaagcacgtttgttgtttgccggcccccactgccatacacgcaaagtcttcgaattatattttgaaaatattactattttttcgtaattttgcaaaagtacaccggtttcaaaaattctacaaaaatttttgtgtataatacaacgttaggaagaaacaagaaagataaataacgttagatagtaaagcgaaccatttttaatcttttggaggggtaaataagttttttaaaaaataatagttagtaagtgatccaatgaaatagttgagggtaaaattgactttttttatatgaaaagaattacacaagaatcattagaggaattggcgaagccatgtccctttgtttccaagccatttggcaacaccatgccgtgccatccgatggattagcgccatccgatggattagccaatccaattggcgaatcgggtataattttacaattattctgaaaaccagtatattccttaaaaaaatatgtaaaagtttatattttcatatttaaaacaatagtcctcaagctatgctactcccatgttttctttaccgtttggagaggttaaactacccccaaagaaaaaaaaaccgttcttgcagtttctgtggtaacagtcaataaccgcatgaatttcatctaaaaaaatgaattcaaaattttcaaaaatcacacgggtgtgctgaccttagcgtaggcctatatgttatgctgccataatacttgtatagctttcaccgtgggtatattgtgacctcgaaatattctgtgatgagcatacgggaaaaccttctttggatttcatccaatatctttggaattcatttatttcttgtaggggtggctttctttagctttggcaaatttcatgtaacgggtttgtatggtcctgggatatgggtgtcaatccttataaactcactgggaaagtacaagttgctgttacgctagaaattcaaggttacacacgagttcctattcacagcgtgctgctaggggatttgttctaggtataggtaaggtcaaatccgtaggggttatacaaatacataggccccttttcttctatcgagttgtttagaagacatttccgttctacggtcctggctctaatgttgtgttcatcaggttgcaggtggataaatgtggatgtggggactcgggtcagggcacagcgtaactaacataggagagtggtttgtgcacgataagccatggtaaccgtatgctataaccgtggtatttgtgacttaaataatgaaagccactaagaaaaataaaaatcacaacctcacgtttgacaacaacaaaaataaaccataatataactgtcataaccacagagattattgtgaacataatatactatccacgagcatcaaatctttattttaaagcaatgcagctttgttgttatgctaaaatatgaagttagccttagaatatttcaaaaaataaaaaatcaccatacctcattacaaataatgtaatatttctccaaatgttttgagatttttcctttttctttttaagattgaactcgaataaatttctatacccccacgctgtcgtggttactgcggttatcggtagttgtagaaactctggttgacactggtgtgcctatgtgggagggagtgtaaattttgtgcagtaaatactccctccgtcccaactatatttttttataaggtcttcaatgacatatttttactattaatttattccatgttatgtttccaataaatatgaaactagcatcacatgaatgtactttaaaatatgaatctagtgatataacatacataatacttagcatatatatgtttagtatgattattagtcaaaatctatcaagtttaattttctttaaaaagaggacgtcctataatttagggatagaggcagtaaaatactagtagtggtattaattatgtgctattacaaaattcggacatcacatgattaattaagtagatgttaagaacctttcccatgtaaaaaaacgaggttgtttattagcacataattaattaagtattagctaaaaacttaaaagttaaattaatatgattttttacaataactttttattttttaaaaaaacacacacatcagttagtattttgggaagcgtgtgtatggaaaacgagtgagtagtggtttggaaccttgactaacacaactttaggccacccaaccctctatgtcatctagtgtccatagcattaaatacattaccacataagaaaaatcttatgtggaaaaagagttaatgaggagagagaggggtaaaaaggtaaagaaacaatttctcatggaagaaaccatctctacacaagaaccaagaatgaaaaaaggggatatttatgtgaataaaaggggagggaatggatgtggttggatgagaacttaatttgaagatattatctattgaatacatagtttcaacatagtgtttatataacatgataagtatagaaacttacttgatagtttctgagttgggatagccttaggctatgttcattccagtcgattcccaacccctctcactcgttttccacgtgcacgctttttatactgctaaacggtgtgttttttgcaaaaagtttatatgcgaaagttgcttaaaaaatcatattgattcattttttttaaaaaaactagcaaatacttagttaatcatgcgctaatggaccactccgttttccgtgccagaggtagcgcttccagcccaaggagatgaaggcagccttagtctgtgttcccaacttcactcttttgtttttttcgcacacgcttactaaactgctaaccgggaaagttgttataaaaaatcatattaataaattatttttttaaactaatacttaattaatcacgtgctaatgagtcatcatgtgttcgggaagtgattaattaagaactagcttaaaaaaataaaacaaatggattaatagctgagtgtgcgcggcggtgcagctcgcgccgcccacttcttcggaccgcccaataacctgtcatatcacgcggcaagtgcccgccgctagattctcgtaccaacccacagactctctagccaatccaggattcaacccgcgagtcttttgccaatccaaccaacggtgagagcgacgtacgggttccaaccctgagcaaagggggatgtaacctgtaaccagacgcccatggtccatggattccttcaccccacccccctcctcccttaaaaaaaaaaatgcggctccggcaactcggcacgcaagtggcgcccgcgcaccactcgcctcgtccgtccccggatacgtgatccggtcacacgtactatactacatcatccgtaagaatcagctggcgaggcggccaaccacgggccccggattctctcatctcctcctcatcaggcttcggtttccgccaaacagtagtagtaataaaataagcacagtattccattccaagttgcacggaggaaaaccgcggaagtgggagccgttgggaagtcacgagccgcggccgcgcttgctttgcttgcttctcgcccaatattttttctccccgccaagcaaaaccgctgcaccgcccaaggcatcgggggcgggcggttgttctccttcctttcctcgctggtttgactctggattgacagccaacttgggctctctaaaatgctggaatcgctccaatccgtgggtggcatatgcatgaacctgtgcgaaaccgaccggtttggagaggtagagacggtggcccccagagttttggaaaaaatcttcctttggcccagccgtggcccgtgggattgggggatgcagcttcctgttccctcggtggtattcccatccgtgttccgttagtatcaacggctgagtttataaacagcgggacccacaccttcttcttccttgagaaccagcatttattgcatcgagctatccatatatatgatcagtgccctttaatttcattcatcggaaaagatcacaactcacaagaaaaggaatcttcacagtaaagaaacatgggagatccctcaaaattccgatcacccgcacgcggctagatttataatcgtgtttaattacccactagatggttgctgaaacaaaatcatgccgtcatggacgtgatgactccatggcgctgaatatttgtcttttatgaaaattagatggcacttgactcgtaaatagttgaattacaaatatatttgagaatcttagttatgatatattcaatttctgttcaactttttgatacaattcaagttgatcatggtacgagaggtttcgtcgtcggcttgccaattttattagtaatggcatgtttgtccaagtctaattagtttgttttggaaggaagagatggtggctcgatactgaatctaattagtttgtttagtggttgatgccattagccggttctcaaggaagaagaaggtgtgggtcccgctgtttgtaatctcagccgttgataccaacggaacacggatgggaataccaccgagggaacagggaagcctcatccgggattgggaacatcagttgtatttgtgtgctttgccacgtctctttttgctgaaaatttcattaatcttgaaggagtacaatagcaatttactgggataaatatacatataaccgcactggttaataattttttatttcaattatataatatataattatctgtatatatttttgaataactatttccaaattttttatatgttgaaaaccatataagtttacaaattaatttttatattacataactagtttttattgtttatacaataaatacttaaaaattgcaattgatatataccaagttgtacatgatgaagagtcttataaatctagctagaattcagatctagtatgtataaattacttcctctgtcccataaaaacttaatctcctcttagattgagttttttttggacggagagagtaaacctataaattttggaattaatagttagtactgcgtagtaagttgttggaatgaagtccctaaatctctacttaatatatatatcttttatctagattgtgttatcctgtgacgtggaattgagattacataaacccattttttaattcatgctaagggggcgctgagccattgtcttcaggaaataaaagaaaaggaagacataaccctctattttattttgtcgtagaacacccacttgacgttttcccaacagcttgaagaaagcgacacaagaatcccacgatagaactacatttgtatccatcataccatcatggcatcatgcatgcttgcggaccaaagatcttttttttttccaaaattgggccggagaagataatgctattcctataccacatttattagaacacacggattttttttattgcttctaaaattgagctatacattctctgggctgataatacttgtctttttatataaaggtgatgtcaaacgttagaatctttgattataaatctttttaaaatatttgtccttcaaatatgatggctacatgtatagactggttttaaatagtactttaataaaatcatatatttgttaatatttttatacatattattataatagaaaataagtgttaatttttttttagagaccgtacttttgtcaagacgataagtactccctccgtttcgaaatgtttgacaccgttaactttttagcacatgtttgaccattcgtcttattcaaaatttttttatgaaatatgtaaaactatatgtgtatatgaaagtatatttaacaataaatcaaatgatatgaaaaaaataaataattacttaaattttttaaataagacgaatgatgaaacatgtgctaaaaaatcaacggtgtcaaatattttgaaacggagggagtattatcgttccggaaagagtactagtaacagtaaacgcttccacagttatttttcctttttccgtgaggacattttttttctgtgaggatattaacagtaaacgcttccaaagattctttttccccctttcttttcgatgggaaaaacgcaccaaaagttctgaaaggattcgtgcagccccatatataactcctctcagaacgttctcctcctatacgagtataaatgctgctgtgtgattttctttttcctttttttagaacgtttgtgttttctcacgacaatcaataaaggcctcaaagaaatggtagaccccagaagtagccacctgtatccagattccatggggaggaaaacacacatgcgccggtggggccaggacgatggccgggaagttggagctctctctttctcgttctcctactccaacaaaaccggaaacctggactcccaaaaccgcggacgcagctggctgtttcggacgcccccgcggacccgcgatggcgacggacggccgagccgagtcgtcccggaaatctagggaatataattgcgcacaatcacgacgccatcacgctacagtagtaaccagtacccctctcctaggacaggtgccaggtgggacgcaggcacggcacgcgcgcgattttcacatcgctgcaaaaatggaatcacgatgcgcgcgctcaccgggtcggcgtcaccggccgcacccccaccaccactgcgttgtgagcacggccactccgcttatccgcagccgctggttatctccattattactgctccggctatggtgtggttgagattgatgggtaaaatataccttaccaaaattttgataaattgataatattactaatattttttattagaattatcttgataatgttgctaaaattctatgcacattgccaatatttgataacaaactaaacataaccacataattagcattcttaccaaataaacaatatggttgaaaatgtcattaatctgaacaggcccaatataatttcaaaccatactccctccattccataatataagtcacaaccactttttttaaatattctataatataagtcatgcatgcatgtagacaattaactataacaatttctccattaaattagtacttttttaattcatccactctcatgttctctaattctattggatgcatgtattgtatttattaggatgatccaaactacaagataataattattttcttggtttttgggttatgggtggttatgccttagggcatccacaatggttatctataggctctctacaagatatccatatcagcatattttcctacttggaagagattaaatgaagagagagcaaagctatctactaacctggagatagtctatagagaaaaacgaggcaacggattagagagctatagatacccatgtgtagatatgctattgaggtggtatattattaatctagttgctgagatgtacatattttatagatagcaccttactttaccattgcgggtgctcttttattttggaatggagggagtaccatttttgataaagttgttaaatacgtgtattcatttagttttttttatcaaactctggtaaatagataagaaatcctgtcaaaacttagtaatattatcaaattgctaaaattttagcattgccaaaatttgttaagatttaatcaaaatattgccctgtactaaaatattactgccctgtttcgcatgcgttgcgtccgacgagtgggagcaccggtgtcctggagtaccacttgtgctggtcaaacggcggtatgctggtatgggtgtgttagactgttgtacattgtgttgggggtgtatggtgtgttgtgtgtgaacaactgaacataggtaagggagtggggcttaaacaaacgatcaactgggcaaaatggtgcggggctgtctcctggattacgcgaacctggcgccttggattcaagaagaccggttaggggtgagagcattctccggattaacaatcctagtacaatttttttatatctttggccggtgagccttctttttttttcattcatacccgctatatagtagagatgctggcagttacacacggttggtctttcaaggcttccctcgagaaaaatagctgtagtttatagaagttgtttcgaaaggccggtaagctttataaaactatgggaggtaggagtatatataatatacatgtgcagatctagtgtcaaacttatgaataaattacgttcataagaataagttctacataactatgtttaattctatagctcacatctccaagctacagaatattccaaaactctatgagcctgcattatgcttcaacggtggcaaagagataaacatgtgattttaggatacaaattgcttatgcacttaggctccatttgtaacatacaaattcaacgacatcttcgcaggagttcgataaaaatacaaaacaaagtctttttttttttgtaaagaaaagcactcagttctccctttgtgttataaaagaaacccatgtttagtaacgttgattcttgaacaatagttccctggcaattttgattagtattatttgtggaaacttgtacgagaacatgtatacgcatttatggttcaattcatcaattatattaagcctcaagcgtcgatataaatagagctacaaggtttagatctcaagtaaatgagtaatcctagagataaactgcaaactaatcatatatgataatatcctaacaaatcagccggatcatatatgatcctatcgttctacataaagatgtcatcatttagcaactaattagctcttcatgttttgtgcgtaaggcccaccgtttgtccattattgtatttcttccataactcccactaactttgtattgggtaggtcattcgcggattccgctgtttagtcatgtatcaactgcacgcacgggctaatttttgcgattttcatactttttcaaatttcgtaggattggggtaagatcttttatgaaagtcaacttaaaaaatgatctacatattaagagaaaacatacatacattattttaaatggaacaacaaaacggagtaagacactactatacaaaacgtttttctacacggacaaagtagattatcgcatatggatggctgacccgcttgcctgaagctatatatctatgaaatgggggttttacatagacggccagccgtgctgcatgagttaactcctttcgcacacgtgcacttgtccctcgaaggaccgagcataccgcaggcatgagttgaggattgtccgttaaaaccaaatttacatagtgagatccaattcattgaagttgtgatacaattttttttctcttgtgcatcaaagtttgagttgaatatttccatgttttattatcaacgacgaggatccaattacttgaaattaagaatttgagacattttatacatccacgcccttctttttctactagtagtacgtgaaccaacagtgagaattgacaagtccatatgaaagtttgaccataacacatcctatcagtagcctgacgaaagagagaaaattggacgcagcttaagtaggaactaggagtgcctgccatactagtacattgctttactctcagggtgtgttttttccgtcaaaattggaagtttgattaaaattggaacgatgtgacggaaaagttgaaagtttgtgtgtatatgaaagttttgatgtgatgaaaaaattgaaagtttgaagaaaaagttagaaactaaaccagacctcactcactccatccaaatatgcatgcccgtggttatcttcaaaatattttttcttctcaaccacttatctgattttcaatcatctgattttcaatccgattacaccattgtacttgttataattaaatctttacaacatagatttcaaaccgttaaaacttaatgtttatatacaacagtggcatgtttcactatgggtttttactgtgttacacaaattttttttcaaatgtttcaatgtttactttttatttcaccatatataacttaatatttcatcgatggctgatatacatagggtgtgtttggttggtgggatatacccggataggccgccgctttttggagggtgtttgaatgctgggcgagagtgggatagggcggcccagaggggaatattctctccagatgctggatagagggatccggccgatttggccggatacaaccgcccgaggctcggtcgagccgggcaagcgagttgcgtgactcgcgtcacccctcaccaccacgacacgagcgaggcgacgagcgcagcggccggcgagaggggcgacgagctcggcggccggtgagagaggcgacgagctcggcggccggcgcgggcgacgagcgtggcggccggcgagaggggcgacgagctcggcggctggcgtgggcgacgagcgtggcggcggcggcgggaggaggcgagccgcggcggtgggaggaggcggccggcggcgggaggaggctgccagcggcgtcggcgaggccagatctggcgctgctttttttcctttttctttttcttttttcttttttctatgtgtatttataatggaatgtgtttttataatggagtgtgtatttataatggaatgtgtattatgtattaatttgatgaggtatattcaccatctcaagtgagaggtgaccacacccacaaatccaccatacttcctccaactaaacaaaaaaattggatcaccaaatctacctttgtccttacaaccaaataaaaaattggatcgccatattcacacaaccaaacaaaaaactggaccgccatatccagcaaaatatggaccgccgtatcccatccaatcttgaccaggaaccaaacacacccatagcttactgtatactctatcaatgcatatatgcatgtagtgatcttcaaaatattttttttttgctaaaactacttatttaatccacaatctgatcacaccattgaattcgttataattaaatatttataacaatatatcatataattatatttcaatgaaataaaaatatatgtttcaaacaacacattgtttcatacgggatagcgatgtatttcaacgtgtggttttaccgtgttttacagatattttgactgtttcaccatgcactatttaatatttcactcgataatcaactgaaatatttgaccatttaattttttggtaaaatcaggcactcgatttgtaggtgttcgaaagtttggctctcattttcgctggaaaaagcgaagaatatgcatgcctcagctcagcgcaacttcaagcgggcgacccaaaaagccaatttccttaaacaaactgctaaccacatttagttaacgttgattgactccatcaacagataagcacgagaggaggcgcgagagagggagaggaaaaaaaaagcaaataaagtgggtacaggcacgggtgcaacagccaaaaactatggagagcagcaaaggaggagaagaaaaaacaaacgtgggtttcttgggggtggatgactaggaaactgagagggggaggagagtggggggacctggcgggaggcgggatccggaaacccgcccacggtattgggcgcgcgcgcccacagaggcagcggaaacaggggccgtcgctgtacgatttccacaaaaccgggagccagagccaccccaccccctcccctttccagtttccgcggtatatgtggtggtgtggcgccgcggtctgtggctagcttgcctgttcgctgggccccaacggggacgtggacgccacgcgctgcgctgtgctgccccgcgcggcccgcctcctcctcctcgcctctcgggcacgcaccactgaccaccctcctttccctgcgccgtggggtccactgccccccggagtcttggatctgttcgctctcttcacgccaactgtcagaggacagaggttaatcataaacacaactgcacagtaactagtactactagccacgatttttaccgtgcttttaaagatttattttttacagagtagaatgattggagaagggaggaaaaaagtggagccggagtactagtttctttgcagaatcctttttttttgcgggggttctttgcagaatctgagtcatcgccacgtcaaacaacctgcggtttactgtaaaatcaacggacggccgggccgttgtttcctttctggaatgaaagcagccctggaagatggtagtagtaggagtagtaaataaactggagtagtatacgtagtactaccaacacgtaatagtagcaaaagtgtgtactgctgctagtgtactccaggacgacgcgcgcgggggtagtggtagtagcggcacgcgagcaacagggaaaaagatagcacgcggttccaccgaaatctcccggccggggcgcctccagttttggagctagaatccattcctcggacgcggcttggcgctcaagcccgcagttaaaccacgcggtgggccccgccccttgattcgcctcgttttttcttttccctttttttttctggtgcggcgccgaacccggccttccgaaaccactggcgccgaacccacttataaaacaggcacccctctctctcctccgctccccgtcattctcacaccaaacatctccatctcaactcatctccaacaagcaaggcagtatcgagtcgagtcctcgcacaggcttggagaagaagaaggaagaatagtaccacctcggatctccaacaagtccggcgcccagttgataagggtttgcagaagcatttcgaagatgcggatgagttgcaacggttgccgggtgctgcgcaagggatgcagcgaagggtgcaccatccgtccgtgcctgcagtggatcaagacccccgaggcgcaggccaacgccaccgtcttcctcgccaagttctacggccgcgccgggcttctcaacctgctcgctgccgggcctgaccacctccgccccgccgtcttccgctcgctcctctacgaggcctgcggccgcatcgtcaacccgatctacggctccgtcggcctgctctggtcgggccagtggcaggcgtgccaggccgccgtcgaggccgtcctcaagggcgaccccgtcgtgcaggtctcctctgaggccgccgccgccgcccaggccaccccgccgctcagggcctacgacatccgccacgtctccaaggacgccgaggccgacgccgccgccaacctgctccgcgtcgcgcgcggcggccgcacccgcttcaagcgcgcctcctccagctccaactccaagcacggcgccaagcttgccggagcagccgccgccaagcgcgccgcgtcccccagcagcagcagcccgacgcacgagacggagccggaggcggtg

SEQ ID NO: 58903 - DNA, 12046 bp, Oryza sativa
cgacgaggctacggagcacgagagatcacgggaaagagggcaaacgaaagaggaggactagggggtcctatttatagccttggattgaagagatcggactcctcccgcaagaaatcgatccgggaaatcaaaaactcggttttggagataaactcaaaaacgagttcgattcggataaaatactcaacggtttgctccgattcttgggggtaaagatagaggaggataagaggagtatttcccctcaactaattttggaaatacacgagataaaaggccggatttggaggggaaaaccgcggctatacaggtactgtgcggctggctcgggctctgtctccagccggctggagattgaagatgacactgtagcagggaggcaaactagactttttgctgggcttctacttcttggcccgattgaaaaagggacacaaagcagactttggaggagggataaggccagccgaaaggaagggagaatgggccgaggacagaagctgaacttttcctatttcggcccgaaaaggagaaggggattttaaatacttttccaattaaattaatcactgaaatgatctttgaattgttaaaaatacttcctatgctcaaataattccaagaaaaatcttgaaaatacttggacacgcaaagtacttaacaaaattataattagaccatttaatgattaatttaatatgtgggtaattactgaaatgctctttgtaagattaaaaattaggaattgagctccgaaaaatccgagaatattccagagagtataattaaccatggagaatttaataaaaattaaatccatccatgctttaaatttaggaaattttattttccacatttaacttcacttgtaaattaatgaacatttaatataaattctattattaatttattaaataatttataaatcctgaaacgaaaatcaggatgtgacaacaaccaactaaaagatcacttctgcaaattattaataaaactcctacaattacaatagaacataacataatatcttgtcttcagtggtactaaacattcttacaaagttggcacaaacatttgatcttgtaaccttttcccaagcacttgtgagactggactttggctttgttgactttggcgaaaaaccagcagtcgaacttgcaagtgaaaccggcacagatcggcgacacggaaacttcataccagcaccattgttctacaaaattaatttagccagtgaacttacaataatctcacttggttgatgatcttaatcacacaaaacattggaaaatagaacctataataatctcttttatccttacttatagtggtgaatccttactcatagtggtgaatccataacagttttacagctagcataggcataacatagttaattataccatagctagtatattctataaaacttctatcttcgggccttccaattatatagaattttaatgtaccaactaccgatgacatcaggcggccgccccgggccggggtctcggggcattagatttgccgttgcttagtcatcacataagaaataaaaattaaattaagatttcagtttctacatacaattgaataatagataatacatatgaaatgatactcgaacacaatacattggagagggatagagaagggaggtcaaggagcatgaagaactaaccagcataagcatgttgcgcaagtgttgacagaagaagtaccaaaaccaagcaaattccagcttttctctcacccatggctcgttaattggctgtgagagagctaacggctaatactaagacctcggctttaaagtttcaagctcctctgtcacacaagagagtgatgaggtttaactgtatgatgatgtgtatttatagggagaataatccaactgaagaagatgtaggttgtaatgcaacgtaaatcatgcgaggataagtaacagcatttgactgactgagtgtgagaggaagttaattagataggagaatccatgcaggcatgcttggccctgttcagctggaagaaagaactacattgcatgcaagattacgtctatgtatagatcgagagaataataaaactgaagatgctgaaatgcaacgtgaatctttgaagaactacattgcatgcaagattacgtctatgtatagatcgagagaataataaaactgaagatgctgaaatgcaacgtgaatctttgaagaaatgcaacgtgaatctttgaagggttaagtagcaacatctacaaagactgagtgatcctttttcttttttgggaggggttgttattcctcataagtaaattaattatattattattaatctttgggttagtataaaaattaatgagaaaattaaatatgttttattaaataaatgaccttgccgcacatccatatataagggtgctcccaatacctgctcaaagagacataaactagcggtttcaatattttgtactgccactttgcaggcaaccacgcaaaataaagttcaccgtatttcagcaaaggtaatcatgaatcgaatagcgcatgcaaaagttgagtgtccttccacaaaatttaccctatatatgctagttaaatcccagagatttttcttcctactagcagctagcaaaattatccattcattgacacgcaaaattaaacaaagagatcgtcgtcttatactagctagcatgtacatgtctagatctaattctgttatcgaaagaatttatgatcagcttagtcttcggctccgcctcctccaagctcagtcaagctctgaccaaaggtgaggccataattaaactcctccggcatgcttgtcctatttcattaatactttttttttgaacgaatgtattgcataaatactcacgatgcaaattatttatggaaattaatttattggtttggatttgtattttgtttttgttgttctgggagggtgtgtgagctcggtagtgtttggttgttgtgagattatttcgttattaaattctacagggaaagatgttttgtgttccttaatttgaagttccagtaccctgtaccgttgtcattcttgactaatcactcatgtgcatatatattgtgaaaacatgtctaggaattaaatcgcattcctttctgaaacaagaaactgaaaacagggaaaagtagttcaagccagacgtacttgttggatacattttctgaacattatgttgtctcgcactgttttatcttcttgacagagaactataccagattgatccatctatgatgacctatcagtaacgggccaaagtgtctcatcacaggtgaacgcatttgtgatgggttcaattggagcccattctagatgtggcccatcacacataaggggccagttgtggcaggccagtatgtgcacccgacacatagcacgtttgacatgctcacctatagacccatcatagatgacccttttacctgtgaaggtacaaaaaaatataaaccgtcacaagtgaggacactcctcgtatatgggtatattcttttacccatcatagctctttctctctctcccatcgaaagaaatcgaagacaccactaagtccttatccacacatctctctcccttctttttatctcagcaaccaatcaaccatagctctccctccccagctgagcaccccctgagtggcccccatgtcctctcgggccccgagcgccagaggccgcttcctccacccaagcgacgaccgtcgccgtcgccgtcgtcacatcgacctcgagtgtcagcgagctcgcttctccgcatttgagctccatccgtcaccgccataacgtcctcatcacgtcgacccccaagcaccggcaagcttgcctatctgccctgagctttggctggtactgtcgtcatctcctcatatcgtccattcccaagcttcggctgttgcctcctctacccttcgccctaaggttgtcagcggccgcctctccgctgccaacaaacaatgggacgccagatctggtatccaacaagttggagaccaccggatctaaattccctagagcttcggccgccacctcctccaccctctcctgcatggtagccattgtctgcctcttcaccgcctccgagctacgagacaccagatttggtctccaggaggttggggaccactggatctgaacgcccctaagctctagccgcctcctcctccatcctccgctccaagatcatcggtggccacctgatgaaggcatcactcctttggatacacatgctactcctcatgttgttttgtaaggtccaatcactagagctcgtgcccgacaattaaatttacaagtgagctcgttcctaagtacttctttatgtgctcttgaggatagattgctacctaatgatttaattatgattaggaactatagagacaaccatggagcacttggagagaggttaggagatggacaagatcatcatggacgttcaagacaagatgaaggtccacttcgggctccaggagcagtccacactaaattcatcatccaggttgtatttggactccgatttcgacgttctacatatgtatggaaagctaacgagaccacctttccaatggatctgatcccacgtcaaaattccttccgaatcaatgggaatcttcaaaacaaaaaggcattcagaatctatcaggtgctatgtccccgtctttgggcccattgggccgtgtgtcgtctcggagtctaatagggaggcgtacaggggtctaaggtcgaccctagaacctatatattcagtagttatcattgagttagggttgtgttttgcttagattatttctgccttcgcagtttcgctgctagattggtttgtgaaaccccaacgtcgagttcttaaataatcattcatttgcaattaagttgttgtttttcttgttcttacttgtgttctttgattcacacgcagggattagccttctcggcaaggtcaatcggttttagcatggctgataatcagagaagacgtgctactacgattgtagggtttggatcatgttgatcggaagttggatcgtgtgtgtcaagtttccaccaaatcgatagttatcttcacctgaaggaagatcgggaatcccataatcccgttgccatcaccgcctctctgcctttaccccaaggtccatcctagagtgtgcaccaccgcggcctctgcctcttctccggtctcctcaggattgtcatgtcgttcttcggagtctcaagtcatcgaggcaacaaggattttgcaagtattttttttgtgtttgtgtcatgttttggatcttgcaagttttgatgccaattttctgattgagttgtgttctttttgaagcccactgatttgtgctgctggggtttggagaggcagatggctgattatagaagaagagtcgggtcatttgtttcttgtagaaagagttagtctgaagtaaaatgttttgggttaataaccatagatatattactgttaatacacattttgcttcctgttgcaaccgagcatcattttagtttttatttttttaactgggtttttcacacctgtaattgtgatgggtcacaagttattcttcactcttattcttttatctttttgttgggttacactcatcactgatgggccacaacttatgagacgatcgagattgagtcatctgtgacaagttctatacagtcaccatcgacgggccttcacccgtcagagatgagatcagtcatcactgacccctaatttctacgagagctaaactcgtaagaggtgatggtatgggtgcatcggtgtggagattatgggtatcccatatctacacggcgacggtatttggattgggtaccggatacttaatgtagatagaatatcttatctgtatctcgggtttgtttcttaacttgtgtatcaaggaaacaccctgagacttagtcggttacgactgtattttacctgtatcttcatattccgttaggaatatagattatcttttgtaatccggactccttcccatatataaggggggtccgggcgcctctaggggcagatgttgatttttcccaaatcatacaatcaataatacactcggggattcatccccggacaggagtagggtattacttctttataagaaggcctgaacctgtataaatcctttgtctccaaacccatacacttttccagcttgatagccacccccttttattattgccgaaatccagtttcgacagttggcgcgccaggtaggggtagcgtcaagcttttcgccgatcagtgcaatgggtcctttctccggcatcgacgacctcgtcttcccacccgggcagacgtttcggttcggcagcctcgacttcgtcaccaacaacttcggcaagatttctctccttgactcggaatcagaccagtcgggagagaaccggctttcggtcccgtttggattcccgaacgcggctgaaagctacttcaagaccatctcaaccgagtcggcttcaaaccactcggccgagatcgcatcttctccgacgacaccagatcaagatgatgggacttacccaccagtcctgatgaagctccccgacgatttagcggccgtcttcaccacgacagcgtcttcatcccgtaggcctaggcagaagtcggcttcaacaccgatttcgcctagcttcagggaagtcggcgtcatcctccaaccactcggcacggtttcgacggatcagctagatgactacaacagctctcccaccgtcgactcacgtcctactgacatcgtggagtacgacgaatttagctctcgctacaacgacttcgacgactacgacgacttcgacggaagcctagatgacaactacacccctctctactttggcgttttcatggccaataatgagacggaggagcaacgccaagtccgggagaccgaagaacgtcgccgactggaagaggagcatcaagcacaagaacaagaacggctacggcgtgagcagcaggaccgtgagcggaccgcgaaggaggctgaggatcgacgtcagcgagctttggaagcagggcgccgagcgcgtgatctcatcggccaacaagacgtcgaagggacaccggttttccgcacccctcaacagaatgcggttgccgcgatcactcttctcgacaccctcctcaaccaaaacgagctcaatcgatccgaccacgtcgtcaacatcttgaaccagacgaagaccatgattgcggcctcggtcccagttaactccgaaagcgtccacacgccgactggcagccgagttccccacttccgatctcatgactaccgtcatccaagcctcagcatcaccggcgcaggatccaaccgcaggagcaggggtcacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcaccggaccgccacgacgacgaccttgacggagtagcagccttcaccgacgacctgcgtcgagtggattggccagccggcttcaaaccgactggaatagagaagtatgacggcaccactaaccccgaatcgtggcttaccgtctacggtctcgcaatccgcgcagcaggaggagacaacaaggccatggcgaactatttaccggtggctttagcagattccgcccgatcttggctccatggattgccccgtggtacgatcggatcttgggctgaattacgcgaccacttcatcgccaacttccaaggcaccttcgagcgtcctggcacacaatatgatctttacaacgttatccagaaatccggagaatcccttcgagaatatatccgacgattttctgaacaacgtaacaagatctccgacatcaccgacgacgtcatcatcgccgcattcaccaaagggattcgccacgaagaattggtcggcaaatttgggcgcaaacctcccagaacagtcaagctcatgtttgaaaaagccaacgagtacgccaaagccgaagacgccgtcaccgcatcgaagcagtcgggtcccagttggaagccgaaaaatacgccggctacgggaggaggtggaagtaacaatcataaggaccgcaagcgtaagcctgaggaacttgttgcaaccgccgctcactcttctcgacagcgttcgcgcgtcaacaccttcgacaagatcatgaactcccaatgcccgcatcatccaaactccaaccacgtggccaaagagtgcttcatctacaagcagttcgcggagcagtataccaagcctgctcggaagaactccgacgaggaacaaagcacgtcaaggaagaaggacgacggcgacaccccggctggatttcaagaccaccgcaaggagctcaaccatatcttcggcggccccttggcttatgagtctaaacggaagcagaagttgactgaacgggagatcaatgctgttcagcccgacacgccccagtatcttcgatggtcagagattgcaatcaagtttgaccgctcggatcatcctgaccgagtggtccacccggggcgggtaccccctggtactagacccagtggtccgtaatgtcaagcttcgcagaaccctcattgatggtggcagtgcactcaatatcctcttcgccaagactttggatgatatgcagatccctcgctccgagttaaaaccaagcaatgcgccttttcatggagtaattccaggattatccgcaactccactcggccagatcactctcccggtcacttttggcactcgggaaaacttccgcacagagaatatcagctttgaagttgccgatttcgagacagcataccatgccatactcggacgcccggcgttagccaagttcatggccgtcccgcactacacatacatgatgatgaagatgcctggtccccgaggagtcctaaccctacggagcgacatcaagcaagctgtcacatgcgacaaggagagttgcgacatggcccaaacccgcgagatggcgtctgcccgagaggaaatccgactggctgcaaccacggtgagcgaaggagaagtgcccgctgccaagatttcaaaaagtggagaaaccgaagccgagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgccgatttgcacaagacaggaaggacgcgatcaaggaggagttaaccaagctgttagcagcaggcttcatcaaagaagtccttcatcccgactggctggcaaacccggttctagttcggaagaaaacagggcaatggcgcatgtgtgttgattataccgacctcaacaagtcttgtcccaaagatccttttgggttgcctcgcattgaccaggtagttgactcaaccgccggctgtgagcttctcagttttttggactgctactcggggtatcatcagatccgactgaaggaatccgactgcttgaagacttcattcatcacgccttttggtgcatactgctacgtcaccatgccgtttggattaaaaaatgcaggagcaacttatcaacgtatgattcagagatgcttctcaacacaaattggccgcaacgttgaagcctatgtggatgatgtagtcgtcaagaccaaacaaaaggatgatttgatctcggatctagaagaaacctttgcgagcatccgtgctttcaggatgaaattgaaccctgaaaagtgcaccttcggagtaccgtcagggaagctgcttggttttatggtgtctcataggggcatccaagccaacccggagaaagttactgctatcctcaacatgaaaccgccaagcacccagaaggatgttcagaagctgactggatgcatggcggcgctcagccgattcgtttcaagacttggcgagcgggggatgcccttcttcaagctactgaagaaaacagataatttccaatggggacccgaagcacagaaggccttcgaagatttcaaacaactcctcaccaagccaccggtcttagcttcaccacacccgcaggagccgttgttgctgtatgtatcagccacctcccaggtcgtgagcacagtcttggttgtcgagcgtgaggaagaaggtcatgtccagaaagttcagcgaccaatctacttcgtcagcgaggtcctggccgactccaaaacgaggtaccctcaggttcagaagctgttatatggtattttaattactaccaggaagctgtctcattactttcaaggtcacccggtaacggtggtcacatcgtttccactcggcgatgtactgcacaaccgcgaagcaaatgggcggattgctaagtgggctttggagttgatgtctttggacatatcattcaagcctcgcacttcaatcaagtctcaagcgttagctgattttgtcgccgagtggaccgagtgccaagaggatacccccgtggagaaaatagagcactggaccatgcattttgacgggtcaaaaagactttcgggcactggagctggggtggttttaatttccccgactggagaaagactaagttatgtgctttggatacatttttcggcgtctcacaacgtcgccgagtatgaggcgctccttcatgggctacggattgcaatttccctagggataaagcgtctaattgttcgaggtgattcacagctggttgtcaaccaagttatgaaagagtggtcctgcattgacgacaacatgatggcatatcgacaagaggtacgcaaactggaggataagttcgatggactcgagcttagccatgttcttcgacacaacaatgaagctgccgatagacttgcgaactttggatccaagcgcgaggcagcgccatctgatgttttcgtcgagcacctttattcgccgacagtacctcacaaagatgctactcaagctgcggacactcatgacatagctatggttgaagccgactggcgagagcccctcatacgatttttgacttctcaagaactccctcaagacaaagatgaggccgagcggatttcaaggcggagcaaactttatgttatgcatgaagccgagttatacaagaaaagcccttcaggaattctgcaacgctgcgtatctttagaggaagggagacaattgctgaaggacatacattctgggatatgcggaaaccatgctgcagcgcgcactattgttggcaaagcttaccggcagggttttttctggcctactgcagtgtccgacgccgacaaaattgtgcgcacatgtgaaggttgccaattttttgcccgacaaattcatctaccagctcaagagttgcagactatcccgctgtcttggccgtttgcggtttgggggctcgacatggttggcccgtttaaaaaggcagtcggcggttacacgcacctcttcgtggccatcgacaaattttccaagtggatcgaagctaagcctgttgtcacgattacagcagataatgctcgcgatttcttcatcaacattgtgcacagattcggagtacccaatcggatcatcactgataatggcacacaattcaccggcggagttttcaaagacttttgtgaagactttggaatcaagatttgctatgcctcagtagcacacccaatgagcaatggacaggtggagagggccaacggcatgatacttcaagggattaaagctcgagtttttgaccggcttaaaccctatgccggcaaatgggtgtcacagttaccatcagtactttggtctttgcgtactacgcccagtcgggccacaggccagtcaccttttttccttgtctacggggcagaagcaatgttgccgagtgaagtcgagttcgaatctttgcgcttccgtaatttccgag

SEQ ID NO: 58904 - DNA, 10256 bp, Oryza sativa
tgaccgtctaatttttatagaaatgaccattttacccattgaatgagcatataaatttatgaattacattatagaaaatataaaagcttgtcacatgaaatgaaattattaatagttatgattgctacggtacattatttatgaaaaaaattaagataatgaaataaaaaattatattttttttattttttgaaagtcataaaaatgaggagcattcatagaaagataggactaccaatgctcatggttttttttaataatgctcccgataaaaaaatctattatcctattagatttcaaaaaaaaattattacattttttattttcaaaatttatgacaaaattttctgaactaattatttagtctcattagtcacatgaaatgcacatagtactcaaacaaaattttcaattgtttttcaagtttatattcaaagctaaatcatcaagggcattaaagacatttgccaccaaacttaacggtgaaatgaaggaaaatgtaacgacaggggcatggaagggatgaagttgaaatttcaggggtatagaagggaaccggtaaatttcaaaggtataaaagggattgagtgagttttcaaagggtacccagggaatttactcacgaaaaatatgtgtgatactaacaagagcttcaccatcaattattgatatagaagaaattactgagataacttgtggtgagaagcacttgaggctagaccaatggcttgctcttagtagctccctaccaaatgagctatccaacgttctcgttagacatgtatatttttttttgaaacgaaaaatgtgacactaattaataagatttttagtactccctccgtattttaatgtatgatgtcgttgactttttaaccaatgtttgaccattcgtcttattcaaattttttatgcgaatataaaaatacttatatcatgcttaaagaacatttgatgataaatcaagtaacaataaaataaatgataattatataaattttttgaataaggcgaaaggtcaaacgtttatcaaaaaatcaacggcgtcatacattaaaatatgaaaggagtatcaattattgatattgagaaaatgctgacataacttgtgatgagaccgacttaggcctggtttagctctcaactttttcttcaaacttctaaattttccatcacatcaaaacttttatacgcacacaaactttcaacttttccatcacatcgttctaatttcaatcaaacttctaattttggtatgaactaaacatacccttagaataggcagatggcttgctcttgcctcttggttgctccttaccagctaagctgtccactgttcctgttagacaagtacggtgagccatggacaaagatttgccgggacatggacgaggaggatatgatggcgtcacaaaattagtgttcagtaaaaaaaatggaggaggtttctcggtggtatgaaattgtaatgaagaaagaattatttggtggaacaaaactataacacttctaggaatagggcattcatttataacaattagttgtagaataaacatatgtatggcattttgcgttttcgaaatttattaccccttttcgtttgcagaagtcaaggttgctccaacagctctcgtccataactgtgtcgaggcttctatttgggtccatgtgtacagcaccgtaggaagacgtgaagaccacacgacctgcacccacgtctgctgcagcgttgatcacattcttggttccctcaacggcaacaggtacaaattgctgcattttagttgtcgattcatattattaattagttggttgactaatttccatgctaacaaaatttatttaaccggtgcttcaacagaaaaatatgtatatgtaccatgtattgtgtgtcatctgtatttgagcagtttatatgcatttaggaggtaaaggggaagataaaataaaaacttatctccaagcatgtattataaagaaacccaatcataagcataattaaatcaatacaagcaccttttcaggtttatagttagcattagattttttttttaatgaaagatgtacgttctactccactctttatatatttaccattctaggaaacaagcattcatcaaatcttgaaatttaagctttccatgtgatatatactttgaaatttaagctttctatgcgaatgaatgcttgtttcaagatatttggttttcgatatattgcgaaattgaagcttaatatacaccgtttgattttcagcttaatatatgcgaatgattttttgcatatttgccatgaaaaaatgctgtcatatagtcatattttttatatttcatatgatttcataaatattactccatccatttgaaaatatatggttttttttttgcgtgtttttcaaaatatatctagacatccctctatcttaattagatatatcttgaaaaacacataaaatttttatattttggaatagagtgattataaaagatgacgctgaaaaggaaatttactactacaaaacatcaaatagttgttgcccctatatgtgccgatagtgctaaaatcggcacctcctataggcattttttcacctccgcgggttaaaatcgtaaaaaaccggcacctttaagtatttataggtgttggttctaaataaaaaccggcacctattatattttgtgtcggtttttttaaaaaacgacacctatatattgtccactcactggatcattggatactggtgatgcaacatgaaagaccccatcacatccatcaaatgcaactcggagactgttgtagtccatgacattagcgtagcacagagatagcctctctgctgctccttcaagtgtttgcaaatgggggtacttctgagcagcttcacaacaacaaaatgcaaattatcaggcatatatagatacacggtagcaattaattaattaattgtcaaaccatatataatcaactagcataacttggcaatgatcttgttgaaattaaaatagtttcaaacaatatatatttaacacaggttgtacttagagcgtagatgtaaagtttgtgatgatatagctacacaagagtctcacaggggtctcttgcagttcctctcacaacatagccacggtgaaggagctccttcactacccaagaaccaacaaatcctcctgctcctgtaacacaaaccctatggccaacttcagccttggccatcacttgggataactcaagatatcagctagctagatagctgtggtactatgaatgctactattgatctgtctggcttgttgtgtgaagcttttgtgtgtggcacatgatccatttatagctgtatggtgtatgagtagagacagacaaaacttagtactaggaaattaagaaaaaaaaagaaattgggagaaacattaagctggggccgtccgtcccctgttcagatgatttgcacaatttataccactttttttatggacatgtgttgctcgtttcattaaattatagtatcaacactagattcctggttttatgagacaatagcttgcgcgattgttacaacgtagctactactatatactccctccatattttaatattgtatgacgccgttgactttttaaccaacgtttgaccactcgtcttattcaaaatttttatgcaaatataaaaatacttatgtcatgcttaaagaatatttgatgataaatcaagtcacaataaaataaattataattacataaattttttaaataagacgaaaggtcaaatgtttgttaaaaagtcaatggcgtcatacattaaaatacggagggagtatattattattttttccggatgagttatacataactgtcaacatgtaatggagcttgagagagacactgcatgcactgcatgtacacatcacagatctacctcaccacgccttcaaccttactggccaatgatcatcacctagagatgaagtaaatatatttgtttcacactaatgggaatgaatcccaagtcctacatcaaagatgttgatggtatttattattctatttggtagatatgattgacattttatctatcgtgacttcatggcgcatggcgcgtatgttgttgtgagaattcgaagagaacaacacagacgataaattttataacatgtgattgtttcataataaattgctcataacatgtataagttacaccccatccattccaaaataagttcatttacttagactcgttccataaatttagaagttttaacatttcaatgtcatttacatacatatccaccaatattatttcgaggactactttggtattttctttactaaagtttttttctgatgcgagtgtccgagtactttggaatagagggagtacttttgttttggcctatactctttaatttatagggttaatgggatcatgccatcataaattgttgagtttcaaaaaatatctttacggtttatctattttgtaacgatgccatcataattttacaactataggagatatgcaactgcatatataccgcttcaccgtgtttatcaatttatttgtgttatgtaaatagatgcacaacggagaaacgaattttacatggaaaacccttacgggaaaaaaccacggacgccgaccgaccatgatcagtgtagaggagttggatacaaatgcaagagatatattaggctgtcgcaccctccccatgcggcttacaaggaatatataaatatatatataggagaaaaataggagtccttatgggcaaagactcgaagtcctaataggaaactaatcctataatgcaaagtcctattagaaaactaacccaaatatatagtaggcctaaaattcggatcacatatttaaccatctccactttaagacgaatttcccttgtagcataaaaatcttcaatctccaaagaggacgatcaggacgatgtcgaccacgagtggcggcggcggggagcggcggctgcgcgaccacggcgacgacgacgggattttttcaattttattttttttccgtacgggtggtataatttgactgcatgggataatcgattatcccgtgcagttgggccgcccgcacgtgaaaatattgattttcacagacccttgggtgcagacgggtgctacctccgcatgaaaaaatggattttgaccacacggaaaaatgaattatgtactagtggaatattctaaattaaaaatgtgcattttcttattggtcggtgtgagcgtttgtccttcatatcactgtaaggtgtcaaaaatcataattgatagtattgtttgaacttatttgaaactagtaatcatgcaatgcacgttttccacaaaatatatcactggaatacataattacaccaaaaaatttagaaactacatcttcctagcacaacctatttacccaaaatttataaaacatatcatcatgtaatgtaagttgtaacaataaaaataaccattattatgagtaaatagttatttttagcttaatcagaaatgcacaaaaaggcatcaaagcaagatattgacttgttattctcttagcagtcatcaacataaccactcaggcatactaccagtagtccagtatgcagaccacaatcaaatgagtaaaatctcggcatttgttggaccttgaaatggggagacaaaaagattatattgacttcaaatttatttatgtggttatatgtcaataatgtgtcctaacaaattcaggcttgaattaagagcatgatatcatggcttctgttgtatagaaacagacataacaaataggacggttttccgtgaagaagaggaggatgatgtgaccatggctaccacggatgcaaccattgctcacatcatggatgaacaagaagatatcgagatcaaatcctacaagtgctggaatccgattcggccacctgctacactgctgacttcaaacggctaccaaatctgcatacgacctccgtttttggcccacgagtacttgattgaaaactctcggagtcctctttccaacggatccggcctcatcaccagactccatcttgtttggccgcaaacacaaaaataaggtgttgcgtcacctgtcatgggcctttggtcttgtaacttcgtttgggaccccggcccaagtggggcccatgtggggtgcgcccaaccaggtggagcacgaccctagagtccacttggttatcctcacacctttataaatagttaggtacccctttagagtttattgggttttgatagattaaagtttagccattgctacttgcttgcatcgcgcgtgtcgactagaccgtccgtctgcttgttcttcagaaccccaacttaacatttgtattaaattcctatttacaatatcatattgctttttcttgttcttgtttgtttctttgatttgcttgcagaaatagggttgatctgcaccagcaagatcaacaacccacggagagctttcgttgctcggtgagtttctatcaacctataaccagaaaattgcaatacaaaaaaatattgtatcctgtacctagccatatttgtgccattgcattgtccatttcagtttttgctttgttgagtattctgttgcatcgtcgagtcgtagtcgctagccttagcgtctagttcgtttagagtttcgagttctggtcacgttttataccacagtcgtcgtcgccgccgtgtcatggttgtcatcggcacctacgaaaacggaatcgtctttccgccagggttccatttttgtagttttcataaggttatgtcggttcattttgttgttgagttgcatctagtgtttgcaaatactacgtctgtttttttgccgtgcatgtgtgtgctagcaagaaagaaggttgagagatttttgtagattggattcggtttccatacgtcacgaaggaggaaggggaaagtttttgtttgattggtattggtttccagatttccacctattctgtttccatctaggctgaaccatcccacctactgtacccaccaccaccgtgactagagagtacgactccctctcctctctcggtttcaaacctactccatgacatccctgacacagcttgctgaaaaattttggagtatcggattggaaatctgtttgcaaaaacggaacctatgggacaagagcattccattttttatagttataattttgggttttcacttttgtatatcagtccctgtaatttttatatttacgtttgagtccctgtaatcttgaattaaggtccttgagttgatttttgctgaaaaaaaataaaaaaaaagaaaaaaaggcagaaaggtgctaaaaagaaagaaaacaaaagccgcaccgaaaagaaaaagaaaagaaagtaaaaaaagatagaaaaaagaaagaaaagagaaaaatcagttctatctttgagtttgctttcacatatcagagtgtgcctaagttgtttctagtgctatcctgtggtatcgtttgtgtctaggctcgcgtttctagtacgttataccctaggaccagcatggtacttgactttgaacaattattcaactttgcattctctgatttgagtatttgctattcctttactacatatttaagcctacccagagctccacagatttaattgcagtcatacagcaagtgtttgccaaggcatcgatacatccaacctccattggggtgcttggttgaggcggtgtacatcaccattccgcttgctttggtaagaacttgtaagagcttggtgaaaagcttgagtgtgtgtaatacttcagctgccactacctagtagttgataggagcgtgcatattcttgtgtatgtttcttgtttgctactaacaatgacatggatatgcaagatcattggagataacatagcttgacatcgacatcttcgtcgagacataacgagtgatcaacatgatgctaatgaggtacgcgatgatgttctaactaagatcaatagagaatttcaaaagcatgtcttgtctgagaacaaaaaggttatgtgtgcctctagtgttttaattaaacatgcttcaaatgattggaaaacatctttataggcataacaaaataccacaatcttggaaagacctgaaatgatattttagagatgtttatgttcccatgtattatgctgatattctgctcatcaaactgcaatgtttaaaacaagatacctgtcgaaacatgaattcggcaataataaaacggggtagcgtacgaaacctaaaagtggatggatgtggagacaaaggatttagacaggttcaggccctctcaatgagaggtaataccctactcctgtttggggatttggatccgccgggtgtattatagatctgacgatcatatgtgctcctgccccctagagggtctcctgcccaccttatataggatgggggataggattacaagatagaaaccttaaccaatacggtatcggtttcctaaatctactttacaatcttatcaaaccaggactttaggccgttccataatatacagggaaacgtaatacccaagtaatgatccgttacatattctatagatataagttatcccctatagctagtcggataaccatgccgcgtgggtatggggtacccataatctccacagtagcccctgagaccttcacagtcgaaaagataatcttctctcgaactagattactccaaagccgagtgcttcaatcatcttcgccatggtctcccgagtacttttatcaaatctgaagactgtggagggctgaaaaataaagtcaggtgcatcgactagatgcacctaataggtgtagcccccgactatgtggttagctgaacaaactaagcatatagtcaaggaataaataatccaaccaaccgagtggttttgataattgtaatcgaccaagtgacttgatatcaatatataacatatgcggtgtgaatccccgaataacatgatccaagtgatataccgactgctttgtaaaaattgatgcgagcaacctaaagttgactacatcattgaaaaacagctataaagaagcttgaatgctgcgaataaagaaatttccgaagtattgggcatacgccacgcgcacactactttaacagatgtgcttaagtccctaaaagacacatggtttcaccacaattggaaatatatggcatatgtggtgtaaaatccgagtaaataaactcataaaggatttaccagccgcctagaaaatgaccacaatgaataatcagcctaagccataatattggtcaataaaaatgcacacttacggggcaaaaagcaatgatattgtatccaatcaattgcttgataaactcaaatagcgtcatgactatataaaaaagtcagcggagcagctatataaagctttactgtttgacaccttttaagatgcattgtaccaactcctaaaaagttgagtaactgcggtataaaagggttttaaggtattgggcacttgatcacgcgcactttggcttaagcaaaaagtgcttgagtccctaaaagaacgtgacaggccacacctgaaaatatgggctgcagacatattaggcctaggccaaaaaatatgccttcgacaccctttaaaggatgacgcatgtaacatgctcccgagtaatagatcttccgggtgatatagaccaagtgtagctcatatgaatagcttctgatctgattgattatccctaatgggatactccaaaatagatataaaaattgaatcccgactggcacaactattcggttgataacccttacggggaataataaatagtccagtctttaagtatagaaaatagacccatgatcatgaattcatgttgcatgtatccggaacaactccaaattgaaggtatgatacttgtgtttgatctagtaagcccctgagcatatagcttgtccttctgtcatagtcacaattgttcattgatggtagcaatcaaaagtaatgaagtcgcatagccatggaggcgaagaaaccagtcggcagcagacaagttagccaacagtgaagatgaaggcgtctagcaacatcgacaaaattgagcagccatggtggcgaaataatcagtcggtgacagatgaggcagccggtgaagaagatgaagatgcccattagtggcgacataataagccatccgtgaaggcgaggataccagtcggtggtgacgaaagcaagccgacggtgaagatatagacacgtatcaaaggcaatgacgaaatccatcaatcatgaagatgaagaaaa

SEQ ID NO: 58905 - DNA, 2431 bp, Oryza sativa
tcaattcccctctcatggacaagaaatcccaagaactggccagccgatacaccaaaagcacactttgtcggattcatcttcaagccatatttcctggtcctctcgaaaacttttcttaaatcggctatgtggtcttttatttccttagatttaacaaccacatcatcaatatagacctcaaccagccagccgattagatcatgataaatataattcatggcccgttgatatgtagctccagcactcttcaagccgaaagtcataacaacccattcaaataagccgattgcaccaggacatctaaaagctgtcttatggatatcttcttcagccataaaaatttgattataccctgcgtttccatccataaaactcaaaattttgttccctgatgtagcatcaaccagctgatcggctactggcattggatattcatctttcggtgtagctttattcagatctctaaaatcaatgcataccctcaccttgccgttcttcttgatgacaggaactatgctagaaacccactcagcatatcggcaaggacgaataaaaccagcatcatataaacgcttaatctcagctttgaaaggttcaagcatatcggctttgcatctcctcgaaggctgctggtgcagcctatcccctggcttgataggtagccgatgttctacaattgatcggctgagtccaggcatctcataatacttctaagcgaagcaatctctaaactcttataagagctctatcagcttggttctaaattctggagacaaattcttactaataaatgtcggccttggccgatcgcctggacctatatctatttcttccaaatcatcggccgacataaaaccttgacttgcttgtcatcgagatcatctaccgtatccttagtgtagacacttgaaccctccacgacgccctcaaaataatagcttgggttctccatcttcaactggttgtatatcagaatcggacacttttagaaaatctccattccaaacttttctagataaacaatcaaggccatccatctcctaaagagctaaatcggcactggcaacattaactgacctgtcggctggtacaatctctattctgtcgccttgccactaaatcaagcattgatgcatagttgaaggaatacaacaattggcgtgaatccaatcccttccaagcaacaagctgtaagaacccttcccatcgatgacaaaaaacgtggtaggaatagtcttactgccgactgtcagctccacatttagaacacctttggtttcctatggattgctaccaaagtccttgagcaccatatttgtcttaatgagatcctcggcatttctacccaactttctgaacgtagcataaggcatcaaattcaccgcggccccaccatcaaccatcattttagacatcggcttcccattgacatagccatttatatacaatggtttaagatgccgattctctgtcccctcagacttctcgaacaccgcctgttctggtgatagaaccaacttagccgattcctcttccacctcgtcgacatcggcttgatcgatcccgaattcggctggcaaggtaaaaaccatgttaactggtgccgtcacaacactctttccttttgccaacctctttgcctcatcagctgcaacatcgtcggctacaggagcctgattcttaacacgccactcctgcctcggttttgctttcttcagccgatgattaatttcttgctcgacctcctggaagcgttccctactcctcaatctttgaacccttcttttctgattcttcgtaaaaatactagcaggacaccattgagtcttcttattttcgtcatattccgaatcaccacgttggtttactggacccaatctctgatgaacaggcactcttgtctgttttagccaattgcctccatcgtacaatcggcttgaaccccttgcaacatcactgcatccaggacaatcctcgatagatggtaacctcataccttcattccgacagaacctgaagaactcacagccccaatgaggatcaaagccaccattatcttcttcatgatgcctttcctgttgcttgtcatatttcctttgatatttgtttataattctagccgaacttacttgataacccctcatgcaccccgtatcagctattcggccaactgtgtgtactatgttaacgggaaatgggttaccatcgaccctcatcggcttttggaatcatcaaacttaatcttgcctccctcaatggccacctgaatctgttgtctaaacaccttgcaatcgttagtagaatgggacccagaattatgccatttgcaatatttctttttgcctaattccttagatgatggaatcgtatgaccagcagggagttgaatttgcttctctcggagtagcagatcaaaaatgttgtcagcttt

SEQ ID NO: 58906 - DNA, 35347 bp, Oryza sativa
cgttggggaagtttctttcttccaggatggttcttactagggtctatcctagtcggttgcatgaaagatcttttgggtagaagatgcttccgcgaacctatctattcagccaatcggccatgtgtatctaagttataagttgtatgatcctaactaaaacttagaacttagaactccctatgttgagatatcatgtgcttggatgaaagtgtttagtgtgttccttttgttagggacatattaaacatgagtatgagttaaagatatttgagatgttgtggatctttagccatttttgtcaagtctcctgattgtgtaacacatctggtcgccaccttcgagtggtttgacgggcacatctcaggctgaagttgactggcaggctaaaggcccggcaatgtctcacatatttttctctcggagcgtcgaatgtcttaatatgtttgatggaagaattgtgattagctattcatccttcaaatatactaaggggttcggagtgcttccgacatagggtaactcccaaaatatggagtttttttttccacatcgccgcgtaaccatcttcgctctctataggctggctgccaggcccctttccaaacactactttaagatctttcaccatagcaaacactgttttaccgcggcgatgttttggcttcgtacggtggtccacgtatgttcaaagtgcttgcctttcttccataccgggtggttcgctgcaaggaatcgacgatgacccatgtacacaaccttcctacagtgcttaagatacgtactttctgtttcatccatatagtgagtgcaagccttgtaccccttgttggacttcccggataggttgctaagtgcaggccaatcattgatggttacgaacagcagcgctcgtaggttaaactcctcctgtttgtcctcgtcccacacggggacaccttccttcttccacaacagtttaagatcttcgaccagtgatcttaggtacacatcgatgttgttaccaggttgcttggggccttgaataataatcggcatcattatatacttcctcttcatgcatagccaaggggggaggttgtagatacacatcgtaacgggccaagtgctatggccactgctcatctctctaaaaggattcatgtcatccgtacttaaaccaaactgtatgttacgtgcgtcctttccaaagtctttaaattttctgtcgatgtttcgccactgcgaaccatcggcggggtgcctcagcatcccgtcctgttgacgctcttcagcgtgccaacgcatcattctagcattccccttgttcctgaacaaacgccttagccgtggtattatagggaaataccacatcacctcgcaggaattctcttcttcgttagttgcccgtcaacttctcctgtatcatctcgtctaatcttgtattgttgtgctttacaaacagggcatgcttctaggttctcgtactcctcaccgcgatataggatacaatcattcggacatgcgtgaatgttctaaacttctagtactagagggcagactatcttcttagcctcgtacgttgtctcggacaatttgtttccctccggaagaacgttcttgacgagtttcaataaatcaccaattgccttgtcactaacaccattttttgccttccattgcaagaactccagagtggtatccaactttttgtgcccctgctcgcaacctgggtacaacgacgttctgtggtcctctaacatcttgttcaatttatgggcccccttttcactttcgcagtcctccttggcgtcctgcaacatctgaccaagatcatccgcaacgttgttaccatcagcatccctttcctcctcgcccgtttgatttccttcaaatctagcgtactgagcaaagtccggaatattgtcgtcttccacttcatcttcttccattttaaccctttgctctccgtgggatgtctaacagttatagcttggcatgaactccgatttaaacaagtggaaatgaatagtcctggatgcagaatactcctgattcttacacttattgcatggacaacaaataaaacccttatgcctgttagcttcggccactctcaaaaaataatgcacgccatcaataaactctttggaccgccggtcagcgtacatccattgccgatctatctacatgaaatgaaaaaaaatcgtacacaaataattattcgtacaaaaatgacagtcatacaataatgataaaataattacaaactctttcaagagtcatacaataatgacatatcattattcatacaaaaattataaaatattccaccaaataattcttatttactatttctaaagttttaaactaatattaatatgttgtacttcttttaattttcattttagtttgttttctattatttaagattaactttcactatattttccttctcaactattttataaaaccttctttagcaaataaactaaatttatatatattctttcttccccatatacattttctctctcatcaacttacaacaaaattttggagacaaaaaagtgtgcaaaacatagctccaaatgtaatatgacaaaaaaaaacattggaggatgaagttgctaaccttttaggcacctccgatttgtatataatcaccaaaataaattcactataaattttggcatgacctcccctcttttttgaagaaattttgaagcttgctcgggctggaggaggaagaagacatatataaagggatgggactttagtcccagttagtgttaacaaccggggctaaagatcgccgggatctttactcccggttggtaacaccaaccgggactaaagttacaatctttagtcctggttggtgttaaaaaccgggactaaagataccgggggggcctgacaagccctgacagcatttgaaccgagactaaagatgatctttagtcccggttggtgttaccaaccgggactaaagatcaaatatgcccgttaccctttttaaccgggactaaagatcatctttagtcccggtttttgttgcaaccgggattattatggaattcggccgaccgacgaatgatggtttctccaccagatacatacattgtttttagtttttaggtctaaaatataaaggtttcaattgattagataataagaaatatcacaagagctgatacatttacaattaggagctgaaacacaacaagtatttagagcaaccttcattatgggtggtgtgacctatgtgtggcttgagcccacatagcacattaaggccactctaaagagtagcatctattgctcatgccctaagcaaccttcaatattcatatgcatattataaagtgaagaaaacatcaaaggtcacacactacctggacctaaccaataggtcaaaaaaacgccaacaaacccgtgcaatgctcagctcttgtccgtttcctgatcacatatttttctgaaaacaatgcatgacacaaaatgctcagagacaagaggaatagaggagatcaaaccatacatataacaccaaatgcaaggtataaaagcaaagcaattgaggggaaaaaaataaaaaaaattccagattccattgattgatcgacagcacaagcttgtatacagcttgtaagcccaatcagggagcatatcgtttctcactgtctgaagcaagttccactatctcttaccatcgtacacaaaagctttctgcaagtgtccctaaagacagcgacaaacatgtactgcatatgggcctccaaagtgcacaaccacacagcaaatggcttcagaaaaagctgggtgaaaaaaaaggattaggtacattaattgttgatttaacctgtgcatttgcacaggaatatttcttgtgtgccctggacctctggcccgttcccggtgcaaaagaaaaatatttttttccaaggaatttattctttttgtgtctctatgtgtcaagaaatgaccatgcatgtatctgcgcatcggctttaggctacaatggaagataatttcacaatggaagataatagaggaatggaccatagaagataatttctccatgcacatgttggtaaaaatgcttatacatgtttagcgaggaaaatttctaaaagaactactacttctgttgcataagcattttgtacacaataagtattgatcagatccatcagtctgcgtggaaattcaccactttcatctttgacaaattttgcagcctttatactttggctcatcaccttcaagttttacgtatgtattcctgcattgaaatctaaagttagtcacctatcacaagtttttgttattttctcaaggtcaaaactaatctgatcggcagcttatattacccatcatcaatgcatcatgaccaacattggtctaagtccaaccctagaacccaaaaaatcccttttcaacctaggacaagatatcggcaacgaccattggagcctcctttcctgctacacatcaagtgtaagcagaagtgtgggaataagagagtggaggtagaggaaagggctggctacctagctagcatagaggggacaacatcaaacaagaggaatctgcaatgccatatcgttgtcgctgttgtttggcctacgcctcttggtgtcgccgacaacgcgatcggggagctagacgagagccccctggggatgtggaaggtgacatggaatatccctgcccatttggttctgcagaagtagtggtagtggtgttggtggtggagctgatcagctgatggggtgggggcagtgatgtctcccaccatagctgtgaaaggtgagcactagtaccactgcagatgaatctgcagcttgcatgatctgctggcttgaattaagcttcttctcttcccttgcatggggcagttcctggtatagggaatcaatcatagccactctttctttttggccatggttccatggtgataggatgccctgtccatgcatgcttgcttgatccttggaactgcatactagctggttgcaggaggcacatttgcaacttttgtgagaggtggtggtgtatgatcatgatcactttcctagtttcctatgagaggggagcttctttggcaagttaacatccttgacacttggaagagaacttgccttctgtggatggttgtttcattagctggaagtgtgtctatgtacctgtatatgacataaatacctaactttgatcaggcacattgtcaccagcacacatggtctacattagagttacctattaaggtggtgggttgggcctgagtcacttgaaatgctctgcagaagatattcttcctccctccatcccaaaatttaagacacaactaacactaacgcaaaaaccaaaaaagaattattatcaccacctcatttgtcacctcaacaaatacaatgtatgcacccaatgtgatttaagatcttgaggatggaggatttaaaaataaaataaactcaagggagagagtggtgctagttaattacatgtatgtatgcatgctcgccttgaattatgaaacattgaaaaaaaaaatagtaacgccatatattttggaatggaagaagtgtaaatttaggctaatgtggtacattgtttttttctccaattgtttcatatgaaactactacaaaatttatatcaagagccttagatttatgctcaacaagatgaaatcccaagcattgttgtgggagttttttaatgataataggagaaataacatataagatagctagatgacataactttttatattttatataattctcatcttttatctactattaaaccaaaaaaatataaacaattaagatggtgtggtctataacaatctaaattatatatagattaatcacttaaaagcaaaattaagataatgtggctcaattaatgagagaaggaaaagaaatgagataatatagattaatcatctaaagagaaaacttaggtgatatgacatcataagagaagaaaaaggaggaagataatttgaaccgtagatcaatcactccaaaggttagaaataattgaggtgatgtggcttaatgagaaaggagagaaatgtcattaattacactaagtgggatttgggtggcgttgctatgtgttatgcttatttagaaattcaaagttgtaattgttattttttaaaaaattaaattaatgttaaataaaatattttatctaattatgatgtctatctctatcccatatttttcagaatacatgtggttctcgtaggaatctgcactaacaatcataattttcacaagcggttttaatttataaggcactctcggtagtatcgcaagaagatccatgtgaaaattaatcactattgacatggcatacttgtcggtattaaatacacaatcatgtgctaagagtgggtatccttctatttttctctaggatgaaaacgtgttatttgaggatgttgatgccaagatggatggatctgaattgtgatccagaaaagtgtcactgccccattccccaaatttcttaactacaaataatctgctagcaaagacctcgtatactgacaaattatgtgtcgggaaaagctttattgagagataggatctgttaggatgacttcatacttacaaagatctttgcagactcataaatcgacgtcgtggatggtaccacatgcctacctaattaagagttctctaacatataaaatcaagagcaattttacggtcctggagtagataccataaggtaccactttttctattgtaaatttggtacctaggtaatacgaggtatcatgctaaattttatactaaatttttggtacctcatagtacctcctcaataaccgtaaaattgcttataaactcaagtgctaaatgcagtccaacctctaaattaacccttctagctacttgaagaccgggatcgagactatgagtataggtggggcaaccgcgaaaaagtaaatgaataataaggtcatccctttttgcattgattgtgaaatttccatgtagtaaaaaaaatgtgattgatacaaattaaaccagtcaacctcagtcgatgttgaagttgaaacttgaactctcaccactactactagcccacatggttgagtcatcactccgtgactggacgtgcacccagcagaacatagtaagatctcattggcctgcatctgaacgtgcatctcacattagatgaaagagaaccattttcaaatcaaggatgtaattgtcaacaaatagaacgtttctgcatgatgaatatcaatgcacatcatggttactagtgacattaagaagatgtatagttgccttgccggcaaggtatatgcattgatcatttcagttttcgcaattcttgtctcggatgcagcaagttcacacgaactattagcaagaatatatgcttgttcctgtggattattttgccaatcctctcctgtccaaatttgatggacccgaatatatagacgcaatttgcatccatgttcactagcttctctttatatggcctaaaagtaaatgctacttgtcgcaagttttttagtgttcaaatataataattatattgtaactaaactgtaactacatcgtaacttcacaaaataaagatagcgcaatccctttaggtttcacaaaataatgaccaaaatcatagtttttttttgcgaatggtatatgaaattcacaattaactgtagtacgtagcccactagcccatttagggccttgtcgtaacaaagatcttttttatggaaacacactatgaacacctccgaaaaactggaccggtatatcttgagactgacgaaattatcatgggcgtcttgctgacaatgggtacgtcgcctaccactgaaagaataattaaccataaatacgagcacccgtgttaaatataggatttgaactcgggtggactggttccaccacaagaaacctaactagttgagctacgctcactttgcaaaagaagatttggtgcaatacctaagctttatctagagttctcaatcattcatatatatggttagacaatctctggtgtatatcgtcccggaacaaccaaaccgatgataaacatgcaagatgcacatcgcctagtgtttttttcttaagaaacaggcgcccacaacgcatacacactcatctctatgaaagcacacacgcacacctaaacccttatgagtacctctgaaggactgggccggcatatcttgagattgacgaagtcaccatgcgtgcctcgttgtcgacagatacgtcgtctattactgaaagaatagttagccgtaaatgcgagcacatgtattaaatttaggatttaaattcgggtgggctagtttctccacaaagaacctaaacagttgagctacactcacttcgtgatgcattgcctggttttggttggaactgatcagagggaatataaaatattgcctaaaattattaagggaacccagtggtggcatatatgcaaggataaggacatcacctgtgtgtcaaaaggacaagagaatggagttaaaaaaaagataacgaaggatagactattgcaattttttctcttcattattggccccaattaatttggatggtaaataaaaggtcgataattacgtgagaagttcgatggtaaattatgatcgatgaacaactgagatgacacgtggtttgaccataagcccaaagttattacaggttgctggctgggctaccttgatttatgataaaatttgctacatagcatataaaatttatgtaattggttgaaggacacgcaaaatcgtgtcactgctaagggacaccataaaattgatgtaattggttgctggacactggaggtatcattttaggcaaattttgctacatgacacttcttatgtgtggttttagccctaggacactgcccaaactcatttttggaggaaaacacttcataaacatggtaatttaccagtggacaccgtgccgattaaaataataatttccggttggataggagagggaaatcgcgtgaaatatcaaaagttcccttgggcccacttgtcagcactccatctatcttccacacttttctttctcccttcttcttcttcctcccgccgagcagggtgaccgggtcatcctgcgtgacgcgatccttgcggcgcgccgggtggtgaaggcgaggacgggacggtcgtcggcgaggtggcggatgccgcagcgagggagacggggtgcttggcgagggcggatgccgcggcgagggagacggggtgcgtggcgagggcgaagggagatggggtacacggcgagggcgcagggagatggggtgcacggcgaggtgggagcttgcgtccacggcgtccacggagaagaaccagatggtgttcaccgactgctcaaccacctccgccgctgccgactgccctccgcacgcagcagcccgcggcgagggcggagggagacggggtgcgcggacatggggggtggccacggaggagggggaggacggagccactccaggacgcggcggcaggcaaggtgggagcttgcgtcgccatggggtgcgcgctgctctcgctagctgcccgctaccgcggctcctgccacgcgctcgctcgccgccactagctaccgcctacgctgcgctcgctcgcacgctgctagctgccgcctgccgcgcgctcactcgccactgttgccactccacttggccgacgctgccactccgccggacgccgtcctcgctatctccgccgcgaccgacgccgtcccgtgcgcctctgagatagatgaggagagagaatatagagagagatgagaagagagaaaggagatagagctgacatgtgggcccaagggcattattgacatttcacgtgatttctctcccctccccaactggaaagtattattttaatcggtgcggtgtctactaacaaattaccacgtttatgtagtgtttgcccccaaaagtgagtttggacagtgtcctaggactaaaaccacacataacaagtgtcctgtagcaaaatttcccatcattttattatatttgatgcaaatggagagagagagagaaatcgtgcaaagtacaaatgtaccctgcacgctgttcttcttcatgcttcagctcgatacagagcaacaaaaggagtgggtttgggggtcggggtaggggacaaaatggcagcatcagcgaggccgatgatcacgtggccggctggttggagtcgttggggtcggggagaggaagaagctactccggtggcggatttggtggtggaggaggtgcagattcacccccaaccgccgatcgtttcactgaattaggtcggggaagggggggttgctccccatcccatccacattgtttcacccataaatcccccgtgaatcacggctattgtgcgaattaattggttgttgtttggccgccggcgaaccaaccggccgagctcctccacggctcctcctctcccccgacggcttataaacagcgcccaggaccacctctccccctttacctcgctgctcggatgccatgccctccccaccgccgtcgtgcgctctgtcccaagcaccgccgccgctaggcgtcaactgggacctccccgagcaccggcaagaccaccgccgtctttgtcgtccccgtccacgcctccgttgtgcctggtgagcatcggagctccatctccaccccatcctgagcctgccacgctttcctcctcgtcaccactcgccgttgccgcctccctatctcggtgcgctcccgcgcttgcgccagcctccctgcgcagcgcgccgctgcgtcgtggccaggtggagaaagagcaggtaggagcaaacttgtctattttaaatttctctctccacgcttttttcaaatattataaaataatgcttccggtgtcttatatccaattacaccatttttgtggtgtcccttagcagagccacgattttacggtatccttcaaccaattacacaaattttggatgtcctcgggtaaattttgccttgatttattggctataataagtgtgccataatcgtggttttgagatccagatatttgtttgtttagaaggcgcaatatgtgatctcgaccaatgttaggttggagagtccaaaagaaatggttacttggaaacattgatagtgaacattcaggacttgtattttgttttgatgcctttgtaacctagtttaaatgtcaagaaagcgcataaacttttcttttcttctgaacaatatattgagtgccttttgttgtgtacaatgaaaacggattgttctagagtgttgccgtggagaaagggatgagatgatgtggtatgcatgatttgatgagttaggaggtagtgcatccctatctgtccaagcaaaatgctcagcaagcagccaaatgatgtgtttgtgacctcttcaaaagtttgtggatgcagtggcacaggaaaagtggaggctacgatcgagtgctctagtttctagttagcacggtccatcataataaactaatttggcgcacataatggaatgtttcacgtcgtgattgtcgtgtgtgatatatatatagcggcccgtgataggaaaatgtgtatatttgattagcaaatttatttccgtggtgaactaaattatcttacattatgattctattgaaaaagatgcttttctgtatgttacagtacagtgcataaattttacaccatactcctatatatgtattaaaggcattttggtaaagcttcaactcctatcttcttaattctaccttgggttttaaaaatgtacgacgctggtgacttttcaacctcttttttaagataactttttttagaacattaagaaaactgttagaacattattacagcagggcatgcaaagcagtagtcactagcctcaacagagagaaatatagtggtactaattaaagaaacttccctaaaatctaagagaaaattatcattaatttttaagataatcataacatgaataagtatctatgttactccatactgatatgtagcaatattcgttaaccagtacactatgaaataagctgcttatcccttctatacaagaaacgttgttcccatactgtgacatgtcacaaacactaagtaaacaaacaatttaatatttttcatattttcactaatttttaaatatatgaatagttatatggcatgtctaaaagtcaataatatcatgcatttagaaatagagggagtataacaaagagtttgaaggctagaataaactgatttaaggctctaatttaataaataaaatgtgaacaaaatctcatgtctagcaaaccctatttttccagcagctgcagctcacataatttttttggagctagctagagatgcccagcttgaagaggttggaggagtcttatcaataggtcataatgtagacgtacaaagctagctagaatttgaagctggcatgaaaacatattagaaaaaatagctatagtgttttcctgtaacacctatcttaaataatgtgtgtttgcatagttctttatgtgttacttgattgtgttacaagataatgttctgtagcagtgtggtgcctaaagtggacctggcccctggcagtgataacatgcatatattaatttctcaacagtttagcttttcaaggttgaaaacctctgagtgcaggtatgcagcgcacaactttattaccatgatttaaaacatcgatacaatgccatcaagtactaaagattgtgccatcaatgacttgaaaactaatgccataaaaataagctagttgttatattttctatctatttcataaaagaaaagcctcttacctctaaaaatcccaacatttgtatgcaatgggggcgggccttttctagagtttgagcaaaacctattatgattggccactggtatgctcgctagtgccggtgagtctgtccatatttcggtgtcggtcaattaagtttagttttacaacttcaatcattttgttttcgatctcgatcagtttggttcagttttttggtgtccatcaatttagtttagttttacggcctcaatcattttgttttcgatctcgattagtttggttcagtttttctgtgtcggtcatttttacccatctctatgcccgggcacctgtccatggcggtccacccattgtttgtaggggcacacatgcacatgtgcatatatggatggttctgcgttcttaaatccaagttctcaaccttcgcacgcttctcaatttgctaaacggtgtgtgttttgtaaaaattttctatagaaatttgctttaaaaaatcatattaatccatttcttaaagttttcttaagctaataattaattaatcacatactaatctattgctccgttttccgtgtcggtggtgagggttcccaacccttacctaaaaacacagcttaagttgtgtttggggtcgaacatacactctcaaaaaatcatgtaatttttaattgaattttggctagttagtttttatccaatgggttacatagtcaagccatttgaaaatttatatagatacagagttgtacatatgcatgttttcttaatgcataatatatagatggaccaccaaaattaaccgtttaatttacaagatatagcaacataaagtgttattttattatgagatacatcctatattaaccaattaatttctacattaaagtaaatcagccaaccattctgaccaacactaccctcaacacaccacctttttcctgcagttttcttacaaactcatcatgctgctttatttttcagctatagggaggtgaggtccttcctaagttcctagctagtgacggcaataatacacaatcctccgccgagttgtgggggcaacaagatcctgctgcctctctctctctcatggtcatggtctgtgcagctacattgccaccattccttaacactacagagctcatgatttgagccaataagcaataagtagagaatcttttgttgtataggacatctgggagctggagaggcatttgagggagggaggaggatatctcttgattgtcatcttcccccctctttcttcccttcttataaccttcctcaactatggaggcctaaccctcctctcattcttcttcaacaacaacaacctctttctttccactctctctctctctctctctctctctctctctctctctctctctctctctatctatctatcttgacaaaggaagagtttccaagaaccctgaatcgatcatctggagaaagattgctaaactctcagatagctgcatgtatgagagcttccttatcaaggtgatttctctctctctctctccctcttgaggctctgattactgactctgatcatcatttgcatggatccatgcatgatgatttcttcagaaattcattaaactgtataagcatatatgctgagcatcaagctttatattgcagttcattctttcgatgccttgtgtcacaagggaatttctcagttcttccatcctaatttctagtgaatcatatatgttttttttaaaaaaaaattgttgtggtttgttttatttttattggagcctttattgtgcatgggcacaatccaaggcacatgctgctttcttttggtcattttgagatatataaaaaaaatgatcaaggggatttgtacttcacacccatactgcaaaaagtgcaatcatgtttacttatatcactcacatctagtaactacctcctttcttgtgtttgtgtttttttgcatatatttcctttttcattcatggaaaacgtttttctctttgtacttctttgctcatcaacaattagctataaatacattgaataccagttgtactaattttgcaaggcaccagctgcaaacattaaatccctgtgttgcatggtccttttccatcatgcaattctcttccagggcaccaacccccactcttcattgaatctggcacatgctgtgcatttcatgctagctgcacttgatgcttcagtccacatcccacttagctagtgagtttcattcagaattatgggaaaccgaataagcgcgtcgcagtctgaaaactcgcaactactattcacatatggatttttgttttaaaagaaacagagccagagaagaattttgtccatcaatatcatcaattatatatcaaactcaatatatataggtgctgatcatggcaagcctgcatttgaacactgaggccagcctacataaatggacagagggatgaggccaagttggcaacatcttgtgcagaaaaaggagaacagcaaaaggagaggaagagcaagtaacaaagtcatgcctatatgatggggccttgtgctgctgctgctgcttgaggtgagcactgttccatctgaaagcagcacagagcattagtgcaatcaccactgtttgtttgttatcctaccttaccttttattttttggaggcacacacacacacctctctctctatgattctctccctctctctgaaaactgaagagtatgtttatgctacaagctggagtttggtgcatgatgaggatacaagggacatgagttgcatggaggccccatatgtcttccttaatgccttgatgctttgggcattcaagaaaaatgctaggcacacaagcacaaaactagcagaaaaatccacttcttttggattattcctacactagaaaagtttaaaaagttatcttggatttacttatttattctccgctcttccttggaaaattttgattaccttatcctggatttcttcattgcttccttaaaaaagatgcctctaatgaggcaagatccaactctactacattttctttgtcactaatgtggccagcaccctgtctttgtattggatgatgagtgtgtgtgtggtttgggcacaagtcacaccaacacacaccatcaacaaaaaggacctagctatgctaagctagagtgatcctaatcaaatcaacaggacccctaaaattccacccaagtgcttgtgctatgtgtgaccctaactgtgaagtcatgcttgcatataacaccaaggaaatgcatacaaaaaacacaccaataatatgtacacttttttcttatcagggatactctctgaaggtgaaaggccatagagagaaagagagagagagagagagagctagtatggggctcacagaaagttagtagctatgaacagtgaacacacacactcacaaaattgaaggtgtggtcctgaaagctcctctcttcccttggaggtttatatatatatatatattagcaaggctgattgtgccttttctctaaagagaagagaagggccacatcttattagtccccctcacatttgccattagcttaagcttcagctttttagctggcagatcttaaggcttcagaatttctctttaattcatcaaggtatggatccacttgagcatcatacattgcatttgttttgcctggatggagcttttcttgagttttaaatgttttaccaatctatcattgtttcgatggcatgcttttgcccctggttttgatgtttcttagaatcaagctcctgcaatttcatcagcactttctggtttttttgtcaaatacttgcttgttctgttcgagcaatggttctgaagaataaccagccaacagcttgctagcttggtgactgggattattgctggaaatactagataaaagatcaaaacagtttatctagttctgttctgggattattgatcgaccaagttattggaaatttatgccatgttatgaaattcttgatgaaatacccaacttggtgattttgctctgttttgctggaaattagacagaaccagcaaggtttttgtcagtttcagtttcagtaaagaaaaatgtcactgtttatgttcacctcagatgtagttcattgaacctgcagcaatattcagttatattgtttcttaagatagtgatgagttcagtcaattaaccagagcatcctttgcaggatatcaagaagttcttcaccatgaagtacatgaagcttgggacaaagcctgacacattctacaccgaagaagctgtcaggtaaatgtcgtgcattcgtattttcgtttgtcgtttcaatgaatatttgtaactattttgactttgttgcactacaggtctgtactgtcagacgtacctgctgatctcatcatacatgtcaacaacacaaagtatcagctacataaggtgctggttttgttcattgatgcaaaattatctttattaccacttttgaaccatttcctatattcctcgcagtgctgatgaaatttcctatccttaacttttaatgatataagatatacatattgatcacagacttttcttctagaaaacagtatttgaattcaatagtcaatcaaaaataccttggccacctaatccaatctgaggagcatctcccctgaaaagattttgttccatactgaaagccaaagttgattgaaaagatactcttggccatcaactccatttgcacccttatcaaggtattcaaatctgatagccacaccacctttgcgaatcactgatttattaagcattgggcatacatatgaaacatagaatatgataggaggcgctgaatcagatccatctttctctgatagtttaacatgtcacatgttccccaatgctacattacattgtttaagcaatgtcacaggcctaatgatgatgtgaagttgtgaactaaggcaactttaccaagtcgcggctcgcaatgattagcacacatcaaagcctaatgatggcctcaaaccaactctatctttgtttagtcatcctttctgaaatgacgaaccgacattggtttaggttcataggcctgaagatctgctttgccaagattgtcatggtataagcatcaaatgaggcattaaaaattacttgctatgcccttttctgatccacgcctcaaaagcttcttctgaacttcacaaaatcccggttaggaaagttgcgggaatagaatgcaaagttctctttaagttcagtcccgtgaatgccactgatggaaatagtttaatggaaaagatctaaagtgaacaagtggtaaaattgaagttcttttaaataaaactgaagattaagctgttatttaagatttttgcagtttggactatgctcctccttcagatcctctcatgattcatgattttgaaaagattataggacaaatgtacaaaactggcttcctgatttatttttccatgaccaagcttctgattcaattatgtgcattttgacattaaagaaaacaaaactgggagaaactattttgcatggacacaagtgttacagcatttatgctttcataaaaaggatgttgcttttaggttggaaaatgaagacaatctgtgattaagttgctcggaatgcagagtaaatctgaattgttgtactttcttttctcaaaattacttgcagctaaaattctgttcccactctgaaaatgctgatacagaaggcactggttgccatccgtattatcaagtatgcaagcaattttttagagaagagaacaatcaaaagttaaagtgctcttgctaatttcatttcctatttgcatcaatttctggttaaaacctagaacaattccctgtaagcaatttcagtaccataacagaagttcagacttcagagtaaactgaagttaaaagcaaataatcatagtttaaggacataaatctggtagcaattagactatcaaagcctttatcatagcaaaactgcatctgtattgcctacagttcagactgaatattgttttgctgccaattcaaaatatacacatgtcccaaaaaatatcacaaacttacaacaaaggttttagcacataactagaggattccatttgaaggaaatgaagaacagaaatacaaacaaataggccagaaaattaaaatttggtgagtatttatcttttctgttttccaatgtccaacctgttgattgatttcaggtgtttttaccctgtagttccccctcctcctcaagtgcggcctcctgcagcgcctctgctccgatgacgacggcgtcgacggcgtcgatgcggcgccggtgccggtggcgctgcacgacatccccggcggcgaggaggcgttcgagctgtgcgccaagttctgctacggcatctccatcaacatcggcgcgggaaacttcgtggcggcggcgctggcggcgagattcctccggatgacggaggcggtggccaaggggaacctcgtcgccaagctcgactccttcttcgactcgtgcatcctccagggctggaaggaccccatcgccgccctcacggccgcgtggcggatctccggctggtccgagagccgcatcgtccagccctgcgtcgacgccatcgtcgagaagatcctcacgcccccctccaaggtagatgctttgtccttcgcgccaaattttgattttgaaagccatttgaagttttttttttcccgtttctttcttgattttggcgcggaaacggttgatgaccgcagattatagatgaatacaagtgaaatttacacaaattttgccaaaaattaaaattcatttggctttttaaacaccatgaaattttaaaataaaacgttgtcatacattttaaaacctaaaaccatgtaaccatcaagccggttttgtgcattgtagagaaagtagtgatgtggcaatggcgacaaattcactacaccaaccactttctagtaatatgtttctatattgtaccaatcacgctcatataaataaggatatagtataattatgattaggaaataaaacattagattcgatagttatgtacgctgcgcgctaaggtagaagtaaataaggatatagtataagtatgattaggaaataaaacattagattcgatagttatgtacgctgcgcgctaaggtagaagtaaataaggatatagtataagtatgattaggaaataaaacattagattcgatagttatgtacgctgcgcgctaagatagaagacaggaggaggatgattccacttttatatagtaataacagagaaaagtataaataacagtttattagatcgtttttaaatacaaatcgagcctgacctaattcgtagcagccgaacccagttttatttcttttgagatatgaaccgaatttagctcgtatttgacgaaatttctgtgaaaaattcataaatgagcgtaaatatttgtgcaggttacgtggtcgtacacctacacgaggcctgggtacgcaaagaaggcccaccagtcagtgcccaaggactggtggacggaggacgtgtcggagctggacatcgacgtcttccgctccctcctctccaccgtctgcgccgcccgcctcctcccgccgccgttcatcggcgaggccctccacgtctacgcctgcaagcacctgcctgacccgctcaaccacgccgccgccgccgccaccgccaacggccagagctctgagctggagacggcggcggcgaagcagcgtcgcgtgctggagaccatcgtcaccatgatccccggcgacgccggcgcggtcaccggccgcttcctgctccggctgctccgcgtggcgagctacgtcggcgcgtcgccgtcgacgcgcgcgcagctggtccggcaggccggggcgcagctcgacgaggcgagggcggtggacctgctcgtcccgatgccgtcgtcgtcggacccgccggcgtacgacgtcggcgccgcggaggccgtgctcgagcacttcctggcgctgttccagcggccggcgccgcccgacgagcggcggcggatgagcgccgccatggagaaggtggccaggacgttcgacgagtacctccgcgccgtcgcgctccacgccgacttccccgtcggcaagttcgtcgacctcgccgagtgcttgccggacatcgcccgcaacgaccacgacggcctctaccacgccattgacacctatctcaaggtcacagaatcaatcacaccgtcaaaataccagctaaattaattgatcattcgagctgataagatcaacaatggcgtatgcaggagcacccggagctgagcaaggcggacaagaagcggctatgccggatgatcgactgccggaagctgtcgccggacgtgcgggcgcaggcgatctccaacgaccggatgccgctgcgcaccatcgtgcagctgctcttcgtcgagcaggagagggccatgggcggcggcggcgcaagcggcagcaacagcgccgtcgcgcccgacgccatcgcaatgctcgccgcaagaaaggagaaggaggacgagccgccggcgccggccgctgaccacaagtcggacgtgcaccggccacgcggcgaccacggcgaacgcgcccgggcggacggcgcggcgatgacgaggtcgctctcggcgtccaccaccaagacggccggcgctgccgcgccgaggacggcggagagtagggggagcaggatgaggaacaagtaaatcaatggtggtcgcccatgaatggatgacattcttgtttcttctgatcccttgcttgaaatttgttgatacttgtgattcttgatttttttttcttttggtattctttttctattttcttcttcattttgatttcagtgcatcccatttttggtgggagatgtgagggccatattgttgaaagagggaagagaatgaggggtagattttgtaattaaatggatgggggataataagaggctataatcatacgacctagcatagctcaccaatcaagaaaaatgtccatcttcatcattcattccacatatgtatctactgttaccttcatccaaatattcccttgtgctctttggacttagaggataatatatctcttaatatgttttcaaaaaaaattaaagattgtgatataattattcagcaaatgaacttaagattatcatatttatattcatagtagataatgtttatagtgaaaaatcaaagattcaatacattggttcgtcccagattcaatacttcaaagagtggattttaaacttttgaggggacgtaagctcattatttatatgccactcaaaaaattatgaatatatcacttcacaaaaatgcaagttcattctaaccaacaaacacgaaaatgcttcgtatctggcgtctggtccgacgccaaatatcggacgactcgtccttatccaaaagttactctgtaactacctcctcctcctccccccccccaccacacacacacacacactcctatctctcttctctttttttttccccttgcggcagaggcaaggtgctagacgaggctggcgacgggctggtcagcatcctgctcgtggcggcgctattcatcctgctcgtcgcggacggtgcggcggcgttgttcctgctctaccggccgcaggcgccagccatcgccatgatggccgtgcagctcccctccttcgcctcatgcaacggcaccgtctctgactttgccgtcacctcctccgctgcttcctcctcccctgtgcagaccatcactgtccccgcctccggtccgtccccagcggcagtgctgcagccggcccgtccctggcggcggtgggcgcggtggcgctgcagcaagaacagccgcagcagcagcagcagcaggtggcggcaccgccggtgatggaggtggactcgccggtgaccggagatgaagaagatggaggtgggtttgtttagttggagtttaggatattgcatcctactgttttagcttgttacactctgttgcattaaggtgtttcattttgttttgatttgatgtagcaatctattgtatgtgtttgttgcactctattttattcgtgtgtttcatccttgttttatcggatgttgcacatgatgtacgatgttttagcttgttgcactctgttgtattaaggtgtttcattttgttttgatttgatgttacattgcaatatattgtatatgtttgttgcactctattgtattcgtgtgtttcatccttgttttatcggatgttgcacatgatgtacgatgtgttttcttggatgttgcagaattgagtcttgatgatgcaagtagtgttttttcactgtttcatctgattgaaacatttttttaccaattggtgaatcatttctcatcgagtaatgaagcatctgtaacattttctagtgaaacattatttaatgagtgatgaaatatctgaaacatttttttatatatgatgaaacattgtccgatgtatagcaattgcaagttagaatttaacttctacaagtgaaaaaaataactatagctatttcattgcaacatgtagaagttaaatataaccttttatgtttttgagtgattaatcacatattaatctatcttattgatttttttaattttttaaataagatttttttaattttttaataactatttaaataacatgcaaacaacgagggaacgttctcttcagagcagtttccacatattgaactagagttcagaaaaaaaaaaggtgtatatgagaagtgagcagggagctcagtcaaagaaagtacaacaaaatgtagcacttgaaaatgccatatatatttcacacttttcccccctaaggaagtaaggaacccattgtcattcatgaaaaaaccactatatcatgtcggcattcaacaatgtacagttactggttccgtcttttcataacaatgggcttaaaattcccccaaatcaaccccacctatgatacaacatatccagatcatctgagtgactcatcaaatctccttcacaacagtgaaaagaaaaatataccctcatttccctcgcaaaactggccttagtgtcaagagcaatgctttgcagtttccaaccataaaccccaaaacacgatctgctattataaactaatgtatccaacttcatatctaaaatacacttctcatttgttagtccctatgaatgcttccgatgttttctagaaataacatcacctcttaccgtacttcttgtttcaataattctggaagcaaagcagatgaaaccgatgattgccaatgcatagagcgccctataaggagccagagccattgagctaacaaatgaataatatccagctacaaggtagagaaagcttagtccaacatctcgccctctccttccaggtagcttgaaagatatacagctcacatttggtggtgatccgaaaagtccatgcagaatagtgccaacacaaagtactgaatccacaaaccatggaaaattttgacccattccgattctctgcagaaaaataatatgatgcgatttaaatcgacattcaataagctgcacagcataatttgctgagctgcgcatcctatgaatgatttaatagaatgtaggaagaaccaaaggacagatcaacaaaaaatatactagttcagagataaacagttggcagggtttgatgccgcgatgttagagtacattgatttcattgggatatcctgtagcagctataatctgaaaaactatacactactcaatttatagcccataaatccaatcaaagcctgatcttaactacaggtgaaaagttgcacttagttaacgagcaatacaaatcgacatcatatttctaaccacacaatcttatttttaggacatttatgccatatcaaggccttccagttcctgacaaaatgaaatgattctaaatgcattgcatttctattccacaaaagtcaaaaacacattattctaaaatattcttaaatagatgagacaaatttcaccctccgtagtttattaaattttgtttgcatggctgaagtgccatgggagcagtgtagttgcttttctatagtaatgagtcaaaatatcactggctcatcaataatgttagtcctggaaatggtagaccaatactgtctactgtctatcttgccaaaacacatggacacaataagaccgtttcaatctagatagcctactcatgcatataggcaaactgatttgagaaagactggataatagctctagctctagctccatcgagatgaccgacaaaattagtatgaggaagcatattttacatatctcactccacattggcagggcaaaagttaataaaaactacgagtaactagaaattttccaaatgatattcaggtgtgtaagaacaaacctgtagccaagcaacaagagaaggtgcaaacattagagtggcaagaaggtgcaagatcatgatcccatgccgacagtcaaatacttccaattggcagtcagtaaaacttttaacagatgttgggctatcatccatcggcagaagttgctcgaggccatcttgtttattttcgggcagaataatattatcacccatggatttatacaaatcctttttctgagtgatactgcgaaatgaagctgctaagaaactgacacaagatcaaaacattagtgtagtagttgaatgattgcaattatgtacaaaatagatgtacatgagcatccatttgtatattagagatactaccgagaaatgcaagaaattcctcctagaaaatgttcttgtaaacatgcaatttcaaaaggcacagggaaaacatatctatagaggattttagtaacaataacatgtgaaatatcagtaaaattaaattgtacctgcaaagggtggagtgtgcatggaaggcatgtgagagaagtaatacaccaagaccaattgctggatgaactaagcagacaagtggtattgtagcaaatgctacaattatacttggattgtttttaattatctgcacaatcttttccaagggcacatcagcatagtctgaatatgatacaagaaaactaaaccatgtatgaaggtcttgatataatctttactttcagaagcaatttacctttagcgactgaaatggtaatgagagagtgaggaagtggcgaacaatcattgattgagtaccatcctcccatgattgccagctgtagatcatacaaaataacaacagaaaaataatatttggtcagtttaaccacagattagtttcacaactatatacactttttttaatttgacactagagtatcacttatgaagaattaataaagcaaaacatggattccacaaaaatgtttctaaagttcgtttcatgaaaaccatcttttttaaagattacaaccatggaaaagaaaggataaattggttctaaataagcatgcgttccctcaatttcactacgaactacatgcaaaagtctagtttttgtccctcgattactgccttagtctaattttcgtccctcgactacaataccggacaactcatgtccctcatctctcaaaaccagttatttccatcccttgcctccttagaaccctggttttgtccacgtggaaatattactaagcattactgaggtggaatcatgctgaatcagccaggcccattaagctctgcaccaagcccccccccccctctctctctcccttctctatcatgctgtccctcccctgttctagttctccaaactccccattttcaatcccgcatctagtgagctcccaccatccatggcaagctcctcgagctcaaggtcccctcgtttgaaggctgcgggcttctagtgtccctcacctgcgggcttttgcttgctagttaatgattccatacagagagggatttggtgctctttggattgattatgatttcccttttcacccttgaaatttaagcctggtcattgcaataaaaatgctggcatctgcattgcttgtgttctgctgtttcttgctaatttgttgattgtgttcctcccgagcaaaaaagaaaaagaaaaaaaataaaataaagaaaataaactgaagaactaagcttttgttctgcctccacgtccctgacttggtcgtgggcgtcagccacacattatttgggtaagatatgggcatcgtagtggggatttgatgcttgagctagggatttggagatctgaccagtggttgctaggttggggcaggagcaagagcgggagggagagagaactagaaaaagagtaagagagtggtcagtactgattgagcatgatttaatcccaatcatttgagtagcatgtccatgtggccaaaaccaggttcaaatgagatgaaggatggatatggaccggttttgagagatgagggacataagtcgtccggttccgtagttgagaagaaaattagaccatggcaatggttgagggaccaaaactagaccatttcctaactacattctcaatttcctcaactagtcaagtcacaaacaatttgaaatggcacttcacaagaaacaaagaagacaaacatagtgaaatagggaattttaaacaggcaatgatgatagacccatcagaagactaaatcctacttgaaatcatgcacatttcccaattggaccatacaatgcccctaattataaggcacactacaattcatttactttaacagaattaaagggcatgtactgaaaatattgcaatatttgcacacatgatttcagcaatggacttaatagtgtcaaaatacgcatcccacgacaatagacttttaggaaattattgtggaatggagaagtagaacctactcctttgcccaacaatcctaggaaattaaaatgttcatctttgtgttgttcataaatgttcttgtagttaattgaaaaggaaaatagtacaccaataagacaataatactaacagcaatactaatttaggacacatgaatcagcacactccacaacagtagtgtcaaaaggatgatgcggaggactgctatattgttacccgacaacaatcatcaaaataaaggtaatgtatttaagttagaagcaaggaactccaatgatcatcaaatgaaccatctccatcacaaagataaatagaattttaagattcctaggtatttcacagtaccagtcaaatcgtcagtgactgcatcctacacaaaaaaacattactcaataaaaaagggtacttagtgtactaaccgcctcttgatgaagacatgaagaatagcagcgacataaagaatcaattttgaacttagtatcaataaaattgtgaagccattagcaactatgtagcacatcatggtaactagcaggaaggttccaagtggaggattttgctctctggtgaaaacaagaaaggcaagaaaaagaagaactggtatgaagcaaaggaacatgaatgctctaggcagcctcagattagactctatagctgacaaaacagacggcacagaagaatcatgttcccatgctgatgattgccgcatcaggccgaaaaacattacagcaatcatgaaaccaagaatctgcaaaatgtaaaaaatgaaacagttcgataagttatctggccaagcaattcatgtaaataagcaggcatccgggtgaccatgacatcctctgaatatgaatcaaattcagcaatagggacagtgccataattatgcatatatgcgcaaaaagattacctgtgatgagtacagcaaaaagaatctgcttgctgcagcactaagtgaaacacgaagactcacttcatatgagcaatgtggatcagcctacaataataggaagccacctaatgtagtaagtacacaagttgagaaagtattctttagttaacagcagatagaaataatttgatggatagctcagtgacacttgaaaaatggataatgtgcaaatggacaccctaaactttttgaattccgaattttggagagaagattttgtatgtcagtagtatgctcacggctggtggacttagtggcattgccaaaaatacaggcctagtagctggcaacactcaatggttcagacgtgcagcactgcaagcatgaaacatgaaggctggtagcttagcaactaggggactagacagtagagattgataaccagagtgagactgctcagcaactcaagcagaacaacttgttagcacatgtgggagcaggagcagcatatgcttctgggaggtggcaatggcaggtggtacatccatgcatggcaggtaataaagtcacaataagctgagattaaagcagtatgcaaaaatcttacaaaaaaatttaagctggcataataaatggctgatcccttgcatgctaaaaactttaaggtgttccatgatttatgttttgcagtctccctaatcactactgagctttacattcatgtcaaaaactcaatatcgcagctgataaacttaccaggacaagcacagtagatctttcagtcccttgatgtgaatcccaaagggcaggtgaagaatcaaccactagagtctcagagtaaatatttggaataatgtgcagacctgatacagggtcccaagccaaagcaacaggtgggaagcaccgcagtttacaaagttctacaatgcataccaacataccaaaaattataatctattaacagcgctgcatggttcctcaaactgtacgaattactagtagtctggtacaagaagtatgcaaattgatgtatggtaaagaccatatatcaggagtagaatgtacactgttattagttgttactaccaccaccatattaccatcaaaaggaaaacagtacaggcagtgttgctatcaagaatttcggtatatgcagagttaaagagaagaaacagctcactatttttctcagcttccaattggtcgccagtagcttttactccacatccagcagttctcaaagataatataactggtagaagaccaaggctcacagaaaacgacaagtttaaagccagtgggtggtcctccttcaaaaatatttcctaagataaaaaaaaattaagtttcaacacatccatatcatacagttacaaacatcattatccatattttggtaagcaagaattaattacttcaggaatatagctggagccaataattcgggcagcagaaagtgcactcgtcccttcctctggattaaagaactgtcctactgccatagatgccgctggaggtggtctacctgaaattgtctggatacagaagatcagaataacatcgacttttaacaattcagcagggaaggtaaacatttagaatatatttctattgataaaagtttatatccatgaaacaggacaaaatacttaacatccacaagatggatatcaatagagtttgcaaccgaatcgcagaaatgggcattaatgcattgatgtgacagtgttccaatgtactggtcacgtgcacagacagacagactagtcatgacaattatatatcaaagttagagaagacaatgaatccataactttccaaataatcatctttgattttattttttttatggcagtatggcttgtcatcgcagccagcaaaccttcaatgcgaatgtgaacaagtatgtggccaattcccatgcaaacacaaaatcctatatcctctttcaacattaaaggcctttttttcatattaaattgcacatttcttcttggtacttccatagccaacagatgaaagggacaacgtagatgactgaacaaaaaataaccaaaataatactacttttcactactcccaacattacataaatatgcccctctaatttcaaaatttgttaataacttcatattcgcctattctgttacaacagatggatcgacaacatgcaatacacatacatgttatcacacagaagaactttcacccttctaacatacatgaatatcgatagttttgacaaaacaattgtaattttttaaaatttattctaataagattgaattctatttgcgtgtgtagagaagtagaaagggatatgttacacaggaaacatggaaaaagatgtcttataggtgaaagctgcatatccagttagaaagatgttacatagggaacctttcaaaaatcatattgtgctaaactaaatgatgccaccaaaaagtacacagggagtcaatgattgatatgcaccatgaaaattaatcctaataatgaacagaaaatattatggtatttccaaaagcttatctaagtcacgcgcaagatgttcgccaacaaagcaacaaaccaatttgtcatatctaggatgaacatgaaacaggagttcctgaaattgttatcatttaaagtggactattgtataaataaggcctgactgcaactgatctcaccagatacatttctgagaaattaactgatgctgggcagggggggttttagtatcacaatagtacagcaatagccttatctttgttcacacttttatgtagccctgaactttttattattattattatcaaaagcaactagttttattataatagattatgatggaaggaattcaagatactgtcacctaaaggttgatgcgcatgaagaagcacaagaacacaataggggtttgtgcaaaaaattacaagaaaacaggaatggtacaagggaataccggtcgaggtgccactgagatagtcatgaagcggaaaccactcatttcttctggactaagcagaagaaatgcagtaggaggtggttgctcggtttgactcccaggttcaacctgttcaaaagcatagcatgtaattatcacaaccatgatggcaatgtgcaagatagcaatgaagcagagcaaatcaactgtagtaatggagttaagttatgctatgactcgtgttatactagcatcgtcaaaagctaaagaacaagaaaattaaaaaaaatcctcatgcaacagtttctggattaaatctacataaacatacaagtggcactgcgagcaccgataagacgaagggaaggaggaactgtaaagtgtgaacaacacaagagaattactgccatttgctatcatattgtcctaacataatttagggaaataagacagaaattgcagttaatagtttaagaagacaaaggtgttgggccatttattttaagcagaagaaacagagaaactagtgaacatgaatcagagagtaagaatgccagcaagcaggaaaacaagtggttcagaattataaatacctgttttggtgcaggtcctgcaggtatttggaccatctttgatgtaacttccactatctttttgctggcaggtactccattttgttcagatgaatgatccttttctggccacaaatgaatcctcaccccagaacatggagaaagattacttacaaaaacaaagtgccctttgccatttgatcccttgaacaagaaaaaataaagcagtcaggcagctgctccatctatacttctaataggatcaatataaacagaactatatataggcttccctaattaactcacaacaacatgcagcaaaataaaccactggttacaccagtaagccagtttcacctaccagttttttaatatctaaccatcttctcttgccatccattgctaaaacagtaactgaatttaactgaatatgcaggtccttttcaaggccatcacttgtccattgaagagatggagggcaagaaagtgaatccttttgctgcaagtctatgataaacatactatgttacattgagataacaagaaacacatgagtttttgacgccattaaatttgataatgccctacaactacctacatgggctaatgttatattaggttgaatcatgtacaaagattaaagaaacatactattctaatcatctatagttgttgaaggatatagaaactattagaaatgagtcaatcaatattggaccttggctatttaccatgcattactatgtactaagaagatctcttagattatggttctaatccagtgcttccattgattttttgaagaaaaaaatcgtttcatttagcctgtctgtactgctattatctgaggggtatgcaattgcttatttgttaagttgtgaagagaaaattagtttactaaattgtaaagagaacttggagaattgctaatttaatatgccatgttaataaatttgaattatctcaaaagcagagcagaattttgcaggtagaaaaattatttcacgagaaatgaaatatatgctttttcaatatattgaaaaggtggcaaggatattttttaaaaaaaaatcatattctattacttggaaacaaataattttaccaatgtttcccatacacaggtaagcttaccaactacaaaaaaggtgacacatctaacataatatatcattttctaagcaatcaatttgccattgtgcaaaggatgcaagaaacaaagaatgaaagaacgagccgtaccactagcttccttgttaccacttgcaatcagatttggaggcttaacacctgaaacaggagccacccaactcaaagactgcggaactgcactttggagcatttttgcaaatacaaaaagtcttttttgtgaactcaaaaatggctgtccattcaaaggatctaccatactaagaagtgtgtgtgcaacctgaacaaagttaaaatcaacataagtaaactgttgaaacatactgcacaacacaaagaataatttggcatgaatacacagttttgacctgtacaactaactgattgcaccagaggatagactgatgttccatggataaccaaacattcttcatgcttgagctccctaccataaaaccatgagtagaaggtacaattccatccagcaaagctaactttgacctaacctgaataagaatgaatggaaacttgaggttcaattggcctttaaggaacgaccatacctaatgttttgaagtaatcgctcaatattggaagtcaaggatccaaggatccaaaaactcgggcaacaatcattgagatattgaatcaaccatcataaatcaaatgaaattccattatctttaagtgctgtaggaaattccaaaatagaaaaatgaatggaacttcatctggaatacaatcattttaaaatggaatgaaataactttatacctccagagtggtagctaattgcaatactttaagagatacatgtcatctgttcttttagagatgtagcagctacatgacaaattacaggggactgaataaattttataatcttgatccagtatatgacacatggtctactttttttctaatggtctagtattttttttcctttccctctagctccgattggaatttccatcccagtgtgtggatggcatattggcaaacaaacagtcatagatgcaaattttcagagcatgcacatgaccagatctgcataggatttgtcatgtgaaatgaaaatttattatcaacagaaaagatacctgataatcatggatgcctccagctacagagacaacaacaacatttgagagttttgcactgctggtgcgtgataaccctgtcttgtatccatttctccattcttcattgacatgcaaaaaaaactgacccagagatggctgcagagcaatgggagggtacctggacaggcaatcattctacaaggtgaacaacatgcgaaacatctaatcaattgcaagaaaagagatgcagctacccaagtacccaacacatgcgcgcgtgcacccacccacccacacatgcacccacctgcgcacgcacgacaagcacacacacaaaccacgcacgcacgcgtgtacacacacacacacacagaggagagataggcagagagagagatagtactgatgtggactggagagtgtcagtatggtttccacagccgatttccttaagcctggatggacaagagctgctcgagccacaaaaccacccatggaatgtccaactaaaattacactggatggcaagttgtcagaggattgagcacgaccctttgatcgtgctaaatgagattctttgtattgatcaaggatctacaaagcataaccaagatacagattaacccgattcaaacaaatcatgatcaggtgtattcagtgaacctatatgaatacattaagcatttgtatgtatgggaagttgggaactaaacaggcttttgataatagcagcttttatatccaactgagcagaaaactttctttcttggtgggatgatagcaggagttcaaataaacacagttatgaacgaagggtcaattacagcctatgctaagttgttaccctgtgaatggcgtaaacaacatattcagtatgctcctcaagtatgcgtccatccattgcagagtgttctccttcaaggtcaacagcaaaccaatccaacatacggccatatcttgatgggattgaaaaaccctccagttcatttactgaaaatgcagtagatgcttcccgataaaaggtaggctcaagtggaccattttggtatgctcgaaaggattcagcagccagagatcggacctagatgcacaattacgatatgagaagcaatcatcatgtcatcagtaacactagtactcattcacaacaaa

SEQ ID NO: 58907 - DNA, 12902 bp, Oryza sativa
ccagcagggagttgaatttgcttctctcggagtagcagatcaaaaatgttgtcagctttagtaatatcaaaatcatattctcttcctttccatacttttacccattggcacggtatgacctttttaatcctcacccattcggctgtagctatctcagagtcatcctcatcgtcatccgacccatacatgtaaggacaaacatgattaaccttcttagagcttttcctagtctccgcagacctatgctcgtgcaaggttaccttttgtatcagatgtgacaagctatcaaagtcttcagacgagaatttctccctaatcggagcaatcataccctgaaaggctagatcggctaactgagcgtcagttaaactcaagctgaagcacttgtttctcatctccctgaatctctgaatatactcgtgcacaggttcatcatgccgctgcttaatcgccgtcaagtcagaaaacacgaggcctgggagatctgcttaactcagataagatcggctgaaactccgatactaccctaatcggcaaccagaggacaggctagagattgatattctaagcacgacttaatagatcaaactcaactgatgcagcattaagtatgaaaagaagaacaatatctagacaatcaagctgctgggtgtttcataaagtggtagatatcctatataatctaggacaacgtcgctatttaacctaatcggctgccttctattaacagatgttagccgattgtaggttaagatgacgatattgccagagattatgtaagatatatgataacttgacgaattatatagacaagattagagtgtcataaagatggaagcactaatcccgagaacacaagtcgtcataacaagttttacctcttgttgaagatcgaaaccgatgcagctcaacccgaaagcaagaactcgtcgaaacaaaactaaagcaaaaaggtggcgatgcgccgaaattgtgttgaacgtgtgtgttaaaaattacatagggctcggggtctatttatacccgagaattacaagatatgtccataccagacacgaccactatctctaacaaactctaagataccataagtctttgcggcagacttttgcccaaacatatctctaaggaagttacataaaacatcctaattaatagatacaattgccttctcaggactctatccatgtgcggcaatcatcttgaagcacctcaattcaacccaatgtcatacaccaaattatactgtcagaatcggctgcatcggctcacctagtccgactcagacccagccgatcctaatcgtagccgatctggacttcagccgattcttgctctgttctcggatcaatcttcgccttcgactccaccttgatctaatatccttttccgatgctgatattagcaaatttggtcgttaacacatgccccccaagtccgggatatttgataatgttccggatttgctgtgtaccgactccgagcaagtctcgcactctgccgtttttcgaccgttattctatcgctttaaataccaaccgttgccctcaaaaaatctcacgccgtgacttccgttttcaccgcccaagcgaaactttgtcctttctctctccggcgattcctccgacgcaaaagcgatccccaggcgattccgcttttgatcagatctccgcctgcggcgatgtcgtcttccactagcccgtctactacgccattggccgagtacgctgaggtaagttctcaccggctagatcccttttcctcgcatgaaatcgatttctccttttctcattatgttttctgcttcccgattcctttggatttgcagcacctttccaacctagttgcgattcccagcctatcgcacaaaaaccactattttcttggcccaatccacaatcttgaccccactatttcatcattggtgaaaccaacagaatcccctttagactagccaaccctaacttgggtcactggaagaataccttcaagtcttggtcatctctcgaaaagcctacccctgataagagctggaccacctggtaccaacgcatatcggctagtaagaaaacccactgggatgagattgggatcggccaagcgcttgctctcaccatagccaattctgctaaggatgaacctctgatggctgccgccacctatttctggtccaacaccatcaatgccttcttatttaaccaagggccgatgactccaactttgatcgacatcatcatgattactggattagatgtaacttcatcggctaaccctatgagtatgaacaccaagaaccaatttgacttcaagaccaaaagcataggagggtggtctggttatgtagcggcatacatgggcaaagggcctgtcactcctcgggagcacgtagctttcttgctaatgtggctagaaaagtttctcttctgtagatccagctgtggtcccacaaccaattggcaatttgtagccaaagccttagaatcaaataaacaatttcccttgggcaaaatccttctcggctatctataccaaaagttgaaaaatgcatcggctaagatagccgtcgactcaatagttggagcaggtggaccatggtggctactgcagacctggctaaacctggtagtcatgaaagttgtcaatcggccatctataacagaagctgaattcccaaggttggagccaattgtagaagacgatggagaagaactcacccattgcagatgcatgtcatatggagaatatgcatccacaccagccgatgctggggcaaaactatcggctgagctgctcaaagattggttctgcagcttttatgaaggcttccagaaagatgcccgggtttggtttctttatgaagactcagcagaccttgagctcccattagacttcagatttgaagacatcaatcatgaaagatatcaaacgtccagggaagtctttacagctgcaatcagcccatgcatcctacctgtcggtattcaccaaggaagaaatatccaagtctcctacgaattctatcactctataagttcagctagacaacttggattaggccaactcccaatcggcttattctttgctgacaagatccaatgccgaggagaaatttcttcaactctaatgatggatcgactgcttaacctccaaggacctcccttaggcagtatcgacaatattgagttagcaggattcaggagcaggaactttgacagatgatggggtgaatggaagttgcatctatttcatcaatcggccacaatgtacatgacagatctattccctgacgtcataccccaagtaaactttgtcatcactaaatttcataacggttagccgattcattacttaactaatcttttgttcctgttttgcagacaatagaatcctcccctccacatcagagcaatagtggtaggaacattgaatatgccccaggtctgattcctaatggagtgcacttacgttgatggcagcatcgcgctcggctgcccccttctcgcaaagggggacggggacgttgctcgctgttgtcgggccactgatcatcagttggccgactcggcgctccacggttgcgctgtccaagcctgcagatcgagaccggaatccgataagtcgggaagaacacgcgtataagggagtcaatttaactaaaaaggaaaataccccgaggagaaatccgggtcgcgtcctccgtcccagaataatcaaaggtcggatgagctcgagcctgaagcggctggatctgcctaccaatgaagtcggcagtgacttcataccccgataacccccgttctcggaggtcatcaatgacatcgatgaaagattggagggatggggtcaaggcgggtttggtggtccaggatggaatcttgtctggttgctcctcaggaacaacgaagaccggatccgaatcctctatctgaagatagaaccacctcccccgccatttgctgcgagatgaggggcactggaaggggatgtatcgcgacttcaggccatcccgaagtcggaaaccaacacacccggacacctttttgggttccatccaacacaactcatagtaaaagcggaaaaggtcaagaaacggctctaccccaatgtaggcctcacaaagatgcgaaaagatatttaggaaggcgatggaattagggttcaaatggagcaaggaaagaccatggaaattcaagaccaagagaagaaattcagaaggcggaggaagaaaaccacagagaataaagtcctcgatcgcaaccatgcaacccaggacaggctggggttcagtacctcctacttccctctccgcggtcccacgaccgggaagggcaccatcctcctgcagtttcttcagcgatgcaccggtggaggttgacttgtcgagatccatcactgctggggatcgccgaagaaaggatcgagatgagctagctagggttttttgcgggagcgaagaagacgagggacgcttggaagctggagagtgttttcaacaggcgtacttcaaatgggatccccaaaactcccttaaatagacgcacttccgacggtgcgaattccaaggaaaggagagagatggccgccggaaatttcggggtccgttacatgcgacagtttttcggacttcagtttaaattcactcatgaccgttgagcttcacccgacgttgtcgatcactccttgtctctcggtcttcacaccgagaacaacgacaacatcagaagccgcgatcggtctcacaagttcatttaagcagaagtcgggagctactgtcagggttacgggtaaggtataccctctacccctcgatatacgtcacatatcgatatggtatgcttgcgcgtatacggacgttctcagcataagttaaggaagtccatcacggggtctatagatggaaagagtcctactcagatagaactgggtcgtcattgtatcgtgtcgggtttgatgtctccgagtcctacttggagaccagttgacctgtggtataaaagggaccccccgggaggacctaaggcatcgaatctcagagccaacacatccaccacagcctacgaagctggagcttgttggagccaagtcgccgggagatctagtcggatcaactcgactacgatcccgacggtatcgtcgagttccgctattccctttgtaatctgtggtttctatcatataatcccatatcaactggattatggctattacctaccaaggggcctgaaccagtataatccctgtttcctgtttgcttgatgtcgtactacgtagatcctcataccagcgtaccccaataccctttatatccggtctacaggtatcccccgtcgacagcgccgtcacaggaatccacacctccacccctcatcgccacggatgacttcgcctccgccctcgtgaccgcaggcgtccacgtctccgatgttgccgctgtggagtactcgtccaccctcgtcgccatgggagtccacgcgtcctccctcgccgtcacgagagtccacacctctgccctcaccgacacggacgatctcgcctccgcccttgcggccacagacgccacacctcccccactcgcggccgcacgcgccacgcctccgacctcgccgccggggaagtccatgcctccgacctccgtcacggcttgctccggcatggtgctggcgccaacggcctgcgggaggatggaggaagtggtgcaacctgttgctgatgaggctgagattgaagtggtagagagggatggaaaaaaaagagagaagaggggaggatggaggaagaagatgaatctgactagtgggtcccacatgtagatgaggaagatgatgtaaaacatgacagtgatagcatggctccaattttgtaaaatttgagtggcacagctacgaatagacgaattataatgacatttatctgaatagacatatttgcaatggaacggatcaaattaaccctttcaaaagaggggtaagttgagagaaaacggatgatatgccactctctaacatcggttcggataaaatgccactttggagacttttatgcccaaaatatccctggagagagaggaaaggggagcaccggggagggccggccgggcggcgcaggaggactcgctgggcggcggtggtggcgacggaccgcggggatgacgggggaagaggacagggcggcaaggacgacggggcggaggaagagccgacattggggaagcctcagacggacccgtcgtccccgtcgccgcccggccgctgctgctccaacgtcgtcctccttctcctgcgtcgcctcttcctcctccttcccctgcatcgcctcctcgtcctcccccggcggcaagcgcgcgtgggtgccaccgccgccgctcgcttgctcctcatcacctcgtcctcctcctctcgtcagcgacgtgccagctccgtcctccttccccacgtcgacgccctctcccgatggagccggcgctgtcctccccccttcagcggcactgtcctcctccccttctcgccgcccacccccgcgtgcttgctgcccgctggcgacgagcacggccgccgtctttcctctttcccttcctctctctccacggtggggtattttggtctcaaaaccacccaaaatggcaaagtatactgatgataacctattgagtggtattttatcctttgtactctagtgggtgacattttatcctttgcaattttctggagtggcatattttccgttttctgggtaagttgaatggcaacgcgcaacgcagcaacaagccaacaaccagccaaatgcgagaagcgcggcgcgatctccctcccaaactccggccgccgtctccgcctccagagactcaagcagcgccgcggcgccgcctcgcgggatctcgtgttggaccggatccttcaaccgaggatcccaaccggcaaccgcaaccgctccgggggcgtaagattcgctaatcccatcctcgcctctctacttctacttcccctcctttccgaggccacgcccacgcatccaggtgtcgatgggtcgatttgcttagctccaatccagccatggcgatcccgaattgtttaaaccgcgccgacgtttcagctttcttgttatagcaaccctcttcagcgcgcgcacgcgagcttaggcccaggaccacgcctgcataaaatgttcttaaattccctggaaccagacccaggggaaggcaacaagtgcaaggtgacaagggagattgttggattgggggggaagtggaatttactccgacacatgtgcggggtggttggggtttgtgggggcttgatgatgcaatgcggacagtgtatctgagcaagctcgcatgttggccgtccccaggatcctcccagtgtaatcatcagtagggaaggggtgatgattcgctcggagctcaggttgcgtcgtatttaattggatattcagatgctaggtggggctgggggctttgccattggaatgatggggtcgtttattagtgtggcttggagtggacattcttcaggaggttgcgaagaacaatgagcgtagggtgaggggctcactgcattagtttaagtgactgcttagattaagaatgatatctgtttgatcattaggtgatggggagaaacataagaaaatgtggtctgttgttcactatctagtgcccacttcttttttttttggggcacgtttactgttattagttccaaaagctgcaaaatggaattgctcccattatcttctgggttcaagtagataataagtaaattatcttcatgatgggaaaaatgcacagtagtttgcaaattcagattgcatctgaatgaaggatagtcctgcaagtagataaaaataagcatatcttgatgaggggatagttgcatggtagtttgcttttgagttacttgacactgacacagagttggacagttggttcacttctatctttgtatgcatgtgttggagcgcatttcaaatctagattgcaattaattaaacatgctgtatacaagagtaccatctactattaatagaatcagtgtcgctttgatcagtaccttgaccatttattgaagacagaacaagttcaataattgcatagattaaagacatcttgtcttggaggtattcaaatgtaatctgtcacattattgttccagttgcggtgactttaaaaattgctttttaatgttaaattgtttccataattggttctatccagactacttttttagttccccccagatgagaatagatagtgtatattaaagaaatgttaacctttgtgtcaattagaaatttagaactatcatctgttggctgttgtgctgttttctttcgatttacaagtggtgtttaggcagatatagaatttattaaataaaattagacatttctttggctggcattaaatataaataagttgcgggcttgcggctattgcttgaaatctatactccttttaaaagaagacaatggtggtggcagtgaatctgccaccccaccaactattgtatagagttttcttaaccaactaccccttcatgttttttattaactactacttcatttgctttaatattacaaaatagttcttctatatataattctatcgatttcattcctataatacaagtttatcatacaaagacatcaacaaggacaaaattgtgcaaaaatgtcacaattaatttgttccaaacgatattagcacaatataatttgtttaatccgtagtaaagcacgactatttagttagtgctctattataattacaacagtcctttcgagatagcaagagaaatgtagaatagtatgattcagaggacatgcacatgttatttggtttggacaatgcatatactcactgttgtaaggtccgattctgttttaagatgttttacccgattatgtatggtggtgttgctgttaaatcaattaaaaccacttaaaatgagctagtgtatggaatactttttctatttcatgcgtgtaaagttattttatgtatgtgcagggatgctcctaaatattgctctttggttcagaatatgatatttggatttctattttttagatttggttgtcctgttgccttttggtccttttttgcgccgttggatgaagctgctatcatctttttggaaatttagtagattacctaccaagagagaatccaagaggacctaaactgcacaaaatgaaagcaacttttgttaaagtcagaatattggttgagtaaatagcaccctgaagtgatggaatacagccaaatttgttggttggattgtctctatgcaatttatccttatggcagtcctacattgcaagtgggccaaatccaacaggccaagaaagtatgtactttaggcccactagtcctccatttgtccaaccaactgatgtttgaaggcagcacctgctgcctggaaacttccattggttcatctaactcaattgaatatctatgaaaaatgatccttggtttggacccttttggacatgattcattgtttgcttgttagcagtctggattctaatggaagcacatgtgattcactgttaagatgacaaaaaatacctgttttgagttttgacagagttggttgtagtactgtttaaattgggtatgggtatatagaagaaccaactccatgatgcttgactgctagcttagttccccttgacaaggagtgcactacggctcttgaaataaaccgtgcagattgtgagaagctagcagtcaatcgaatgattcctagtgtcaaaagggcaaaggcataaatgattccctcagccgtgctcagttttttttttctttggggggtgtgtgtgtgaactttctcagttttacatcagggcaagtttcaatgccccctctttatattatgttgccatcttgtcatttgtggccttatttttggagacatttgtcatgaattttcattttttgaacattacttgaatggttatgcctatttcttgcagaatataaattttctacatagcctgtgcgttcctgttcaatccaacactaacgtatcacttaggaaatactgtgcttcaacaaacctgcacctttggcagcaatacgatccattaacgcatctccccaaaatgaagcaccgtagatcgtcataactggaccggacagaagctatggaccactctttcaccattaatttgctttgtatgaagtccaacaaccttttaatatgtgtttactggagtaaaaggaatatcagctcatgttgtcttgttgagtttttgtgtttgccgtttctagagaatggcagttagctaacctagattgtcttgatatgttggaagattatagagattaggaagatatattttcccctatccgcttcatgagctgatcacggcgttctgtgttatacctgcaattagacggtactttgtctcactgcagatgattattggaattagaaagcacagcatattagccttttactagtttcttgataactacagcatgtgcatctttcactactactatcttcattgcagatgattatttgttctgtgccattgactcattgtgtattgagtactgacgtgtccaatccaatactttgttaaagtttaattagttatttctttcatgtaatccacaataaaatttcatggcgatgcactgtactctgtcttcagggcatctgcaatattaattcagttctataaaacagcctatgctttatgttatgagtaacttgtatgatgcattttctgttgaaccatgggaagttattagttatgtacagtggcggatccagcatggggtctacggggtctcgagccccactactaggtctcgagccccactactggcgttgtaaccgtgggagcccccactaatttttttctgtcatacatccattagaagagggggctatagttttgtatagtttgtttagcctctccttttatccgttcctggatccgcccctggttatgtaggctttgcatattcacatattttcatggctttctcttgcagtgttaattttgcagatctactgaaaacagctctgttttttttcctattgtgtacagaacatgtgttgagttatattctttttcctttttatacaaaaggaaggggatagcttttcatcaaacatgtcgattttgaatcttacagtacaaattattccccttgccaggcagtctgaccggccaagcatcaattcaggttgacaacctgatgtaatattaatacatggtacatgttactaattctttactgaagtgaaaaccgcaatgttgttctaagctagatattataatatagtatggtaagagcatatatctattctgcataattagtctgaaactgttgtgttaatttgcattgttcaatacaagtttacatccagtatcctgtttcagtgtttcatgtctgtcacaggtccaaaaataccatcaatggcgtccttcagccgcctgttgatagcctgcgagggccgaggatacgccattgcagattcagcacttccagctgcactcaattataagtcaattataatcagtaataaactacttcctccatctacttttgatagtcatattttatcttgacacagactaagaataattaattctacttatcatctatttaaacatgctactaatcattcatcgtaaacaagcgattcattaatatttacatttctcaaagcccatgtacccaatcatatgtggaagaatggagagtcacgcattaaattcgagaaaatcattaagatgatagtttgttggattgaaatatgcctatcaaaaataaaattttcagatttagaaatatgactatcaaaagtagacggagtactatttttttcttcttctgaagactgcaatccatcatcacttcactgttatgtgtcgcaaatgcaattgatcacaactgatcagatcactttgaaagacaactaccatacgcaattgatcagttgccttgtagaaatccaaaaataacatctcacatcaaaattaccacaggaaccttttagttcgtctcatcagtgcaactcggggtgcagctttgcaaccgttgcgatggaggcttgcaggacaaaatcttactaattggaaattagttagatatatagttatttataacttaatatataattaagtatcctagcaatggcctgtgcatcttcttgggcgatcgccatgtcgcctcggtcagactgacagaactcaaaaactcagaagtcgacgcccttcaacagcttccgaacctgctcgagggtcacgaagaggacgatggtgaagggcccctgcctcgtcaccgtcgggacgaaccccttgtacagcgccatcgccccctccgaacgcacggtcttgatcaggcagtcgagcgcaccggagtagggcggcggcgcgccggccaccaccttcatgttcatgaccctggtcttgacgacgtcgacgggggtggacgccgacgcggccacgaggccggcggcgaggccggccgcgacgtgcgtggcgagcccgtcggcgccctggccgcggcgcgccaggatggcctccttggcctggtcgtacgtggccagctgcgacgccgccacgatcatggcgcgcttcacggtgagcggcgacccgcgccacaggctgcacacgccctcgtcccgggccatccggacgatggcgtccgcgacgctccggtagttccgccgctgcgccgcggggagccgcccgtccgcctgcatccgcaccatggccacgtcggccgggttccccacggccgcgccgacgccgccggagaagagccccgccgcgaccttccggtgcagcggcagcgggccgccgccgccgccgtcgtcacgctcccacctcctcttgagcgtgtcgtacagccccatgcaggtcgtggagtagag

SEQ ID NO: 58908 - DNA, 2432 bp, Oryza sativa
ggggaacgcgagcgctggggcagggggcccctcgccgtgaagctgcatccggaccttgatgagatcgagcgggtgggtgcagctgccggccacgacgcaggcggcgccgccctccacgaaccccttcagccccatgccttccgcgccagcgccttgggtgcgaatgggggaggagacggcggaggtggacggcctggcggcgggggcggagaggaggagaagggaggggaggcgaggcggccgcgcggcgcgggcgggtggggtggtgtggggggctagattcacgggccttgccgtataaagtttgcaaggacaaaagtggatgctcgaagcttgaaaccctagttgaaaacatgtccaattgtccatgccagcctagaaggcctctttttttattctctcttgattcatatgttcaatttgaaattttgaatgctcaacgtttcgttcctgcatatcgttttacacgcttatattttctaaaactatgtttttctatatatatatatatatatatatatatgttgcttaaaaatcatactaatttattttccaaatttaaaataattaatatttaattaatcaatcatgcgttaaccgttcactttacgcatcttcttaatcttcttatttcccatcctctcaaatactccaagttctcattttctactatagtactatgttcttatttttctctttttattagtatgctttctaaccaatgtatttttttcaaaagatctctatacaaaaatttcttaaaaaatattaatttatttttagattaactgttgcttaattaatcatgttctaatgaaccatccggttttatatgaacggagagaagatccctacctccatccgaacgcacactaggaatgtttttcaactagaaattcttcattgagttgaggtctcatacttaatttcttgatttagttttaattaaagatatgattcatagtctacagtgatatcatgatatggaagtatatcgtaggcaacaccattaactgaatcaactctgattttagttttttttaatcaaaagaattcatcaaacaacaaactacatacaaattccgatgtttctttcttcactggtgcaatgcttttcttgcggtggaacccgtctaccaatctacctacattcagtgttgaacgtagtatatgtgcttgcatttatgattaattattttttcagtgataggtaatatatatgtcgatagcgagatatctatgatgactttgttaatatcaatatatatcgtcctagttttctggagatattgagagatataagagtaagttcaatagtatagcccactactagctacaattcacctatagctaatctaatagccaattcatacaatagttacttactgtactattaatatatggtcccacctgtcatacacacacaatgtcttggagtccgtgctgcagctggctacagatctgtagcccgctgttctctctcatcttttatctcattaaaatatgtttatagctggctactagtctgctattgtacctgctctaatgtgtactccctccgtcccaaaatataagtatttttagaacagtgtgaagtcaaactttttaaattttaactattaatagcaaataaattaaaaagattaatcatgtaaatttgatggtactttgtttatcattaaacgagctatcataatatgcaactctctttatttaaaacatcttatttttataaatattattggtcaaagtagcacctcgaagactgaaccgaggttaaaaaaaatacttatattttgggacagagggagtattacgtttgtatggtgttaaaaaaaagagagtaacaactggtcaatctacagctggatcgaaattgcaaatgtcccagcatcgggtgatgcggacgtttcccttttttaacacgtggccgtccaaccaccacaagtcagattcagattcatcgaacgactaggattcgctgacacgtggaagatcgtttaactcgggcctactcaccagtgacataacctccccccaccccacgcagcgcgcgcctctctcttttttctccccccacaaaacccggagaagcgaaatcaaccaccagatacgacgagcgcctcgacagcgatccgccgccgccgccgccgccgcgtcgggtgtgtggtagggtttggggcgatggggcccccctccgcctcctcctcgccggcggcggcgccgcggcggtcggcgccgacgatgaggctgcggagggaggcgctggagtcggtgctggaggaactccggcgggcgctggacgagcttcgcgagtgcggggagctcggcgtgcctctccctgaccccgagggagccgttaacgacggcggcggcggcgaggagcagccggataacgaggaagaaggcggcggcggcggcggcagcggcgg

SEQ ID NO: 58909 - DNA, 10238 bp, Oryza sativa
agccgttaattgccgtaactgctgacaaattgcgatgatgaaactaaaattcactaccactgttcagtttatcctgataaattcagaattaattgattcgatttgtcatgcatttagatctgataatctgagatggcttgttttcacaatctggattcaatactactagtagtactactgtttcatatttgtctatctgatgccctagtggtgtgatagtagtttttttctcaattaataaggaacctagtggtggctgttgtatcgagtcaaattatctactacttatactatgaatcctatgtacggagtactactttttatcaggagcatactgtgtccttgcacatgtagtgtcgattagttggtctgtcagaacatcatgaagtactgagtaggttagtggattactgcggagtgaaaaggagtacgttagtggcttatttctgaatggagaagaggaactggaaatccagctgacagaacaattgtttctatataggagtagttatgaatgtgtgtgaagtccttcaaaataaaacatctcccctgttaacagtgttttcaggtttgtaagagtatataatgtttaactttaggctagtcatttctgtagttttacatactagaaagaaaactgctaacaggggaaaagggtagaatatctgaacagtctcataataattatggagatctctttctttatgactgggagaatgtacaagttcaattacagttcatttttatgttaatctttcctaatgtttaaaatcgcttgcctttattttttcagctatgtgatcttcttaaatctacattcgaatcacccaatttttttcaaaaggttgatgaaattcagaagtcactgtatcaaaatgatgcaggtattcctttactgaatgaacttattattgattgtgatgtgtaagctattgcatatatggagctgaaattacacttgttgtcgtgctggatctgaaactcacttgctgttctagtaatgcatagaatgaaacggaggctatcatactctaaagttcattgactgttctttgccgcagttgaacaagatccatcatgggatatagtaaaggcagtagatttgtgggaagacgatgacttaggtgatggatatgttcttgttaagaacgatgatgcaactgaggggatggctttctttattgccacatacatatcgtcgcttaaaacagccaatgtaggtactccctattattaatacttctgctccaattatacatcatttttcttgttttgttgtccatgattcactgaaaaaccttgcttaatattgttcacgcggttataattttgagaaaccctagtttttatctgttgcatatcttgtctcaaataagatctgtcaccatattttgaacatgatctagttttccctggtctgaattacgtttatgttcctttaagtaatacatcttgcttttctgcctaaaatatcatcattggacaatcatatatctgatgcctcaaacttaatgttgtacaggaatgttctcctgatcaaattagaaaaggtttgtttccctttccttaattcagataaatggttgaatcattggaatgaatgtttcagtgctgaagttgctcatcattcttttgccagccctcaagaagacattttcatctcgaaagagaaaaggtaaacttcggaaggcatggaatgggacaaaagttatttataatgtagattcatggagtgccacagctattgggtaagttattccaccaatatctgattgtgaatcttctttatggtattattctccctgcaaaatgatagccttgatgttcagttgagtagtgttgaatcaaccagcgcagcttgtcactaagctagttcggaggcaccccaaataggccttagtttcatacccaagcttcagtagccagctttcttgcaggctgcataagtttttataggctgtccataagattgtcaaacagactttcgagggttcatctcagtcctccattatgtagtctcttccaacctggttatgataggttagggggcaaacctaaatctttgaagtgatcctgaagatcaagaaaccataagatcacatctgagctttgtgttcccgattttaagtccaaatatgttctctgcgattagtgactgtcataccttgttattaaactgtatctaaataaacacgtgttttctgtattggtttacttacaagaacttcattgcaacactgcagaatctaccataatcaagcaattcttaaggtagcaactacagccttccggacgtcctgcagtgtgatatccaaatttctgtgagctgctgctgttactggcatgcttcccatcatcattaggtaaattggctaacacggccagaaagacctgcaatactcatgtaaaatagtgtctattcgttggtttgccattgtaagctttgactttctacaacctaactgtaaatatgacattcgtttgaaactttgaataaacatttcaataaatttagtgctggaattaactttccactcgtttgattggaaataattgtaccatcttcttggttggaagttgaaaaagggcacgggatgacaagatcattatttgtctgtaattaaaacagaaaatctataatctaaagtacagggttgcggcagtcatgccatttgcaaccgaataaaaaactaattgctcattggaacaatgcatggcccagccataggcgtcgttccttttattccaaagcccacccaattttacacacatccaagaccggaaattctaagcagcaagcatatcctcatctacattgcattctccaaggtaaaccttgatgcttcgaggagaaccgcagctgccttctgctatgagcgctctatcatttgctgccatgtgctggattattttgtatatcatctcaatctgatgcaacaaatggaatagcacgagttattaatatgaaagggtaaatctgttttgcagttcgcaatgaatccagatagtaacagaagttgagtcaggaatgaatattacatcttcagggcaatgacagcgctctgctatttgatccagcgtcaacggctcggcaggatccttgcagctgaaagacagcagcaagtaatcagcagaaattcaggaaccacttagaattgtaagagataccccatcggggagtaaacgcaaaaccgagagtttcatgtctttaggttaatacactgataaaacaagtttaagcgatgtgctggaatttcacacatatgagcaagatatgttccagttgttacacaaaggcttccctttgtcagtaattaggtttaaactgtccaagacagctaactgttcaaatagaattcatgctatctggtgaatttgcagccacatgaggtaggttctctgattcccaataataacccacagaagagtttttcccaaagaatttatgacatctccaatattttggcatctgaagctgtctagaggccattaatcagagtgcaagtcattccagaaaagtattctctaggtaaagatatagtaatgtaggaacatctgtttttcaagtgctaaaacctaaaagatatgcatgcctcaaactactgtgcacaaatcaatatctgtagataaataatatacgataaataatatacaaatgtaaataaagatataacatgcctggcctcattcagaacagtcagcaccctcttctgaagtgccaacacttcacctgctgcctttttcccagcctcaacacctgtacagcgcatagcacaaatacatcatatcataatcataagaatcataatgcaacaaaagaatcctagtcaactttagcttgtttgaggaatgtaccaggctgatgataggcattgatatttactaaagaagcataaatccccacagcacgttcatatagagcaaccagcgctccaacagccctaggagtaacttcttgcacagtaacggagatggattctcggtcattagaataaagagcagaacgggttccctgcaaaatatttctttcctctgtcattgcattcatagaaaaaaatgtcatagttctgtatcttaaaaagctgaatatcaacctgcaacatcccgaacaaatagtcaccacatgtaactccaggttcaagctcccaatcatgaccaggaggcctatcacgcaaaacctcaataaaagtaacgaagaagttgtgtacaccttctctcagctgctgaatgtagctgtaaccggatataataccattagatttttgcacttttaactacagactcttaagcaagtactgcagaaaaacaggaaaaaaaaacttacgcatgctgatcggtgcttcctttgttgccatacacagttagaccttgattaacctgccattaaaaatttctgtttgtcagcaaactattggagacataatttaattattggtaactagttaagtttaggctctgtttgtttcagcttaagattattgtaatctagattattaaatcagattactctaagctggattataataagctgatataaaataatctacgagttgtttgtttctctggattattagaggcatctaaaggtagtgggtctttacccacttaataatctggaaaaagctcctctagaggagattattggattatagtaatctggcttatagattataataatctagcataataatctacttgtttgttttagcttacttctaataatctagattataataatcctaagctgaatcaaacagggccttagtaacatcagttacagtgagaataaaacggaagaatgtgtacccgattgccatcaaggtcaaattctttcccaagagattccatgacaagctgttgcaaatatctactcaaaagtagcaaactatccttgtacggaagtacaaccatatcctgaaacatatgttcaactcaaaacataaaaataatgcacaaaacaatgacaaaaaaacttaaacagaagtaatcaacaatgctaaccttatttcctattccttccgatgcccaataccagcacaaagcaagtaaggctgctggattttccttaacctgaatgagtggatagcaacatcttgatatatcctcaacagtccattgtatcactaaactacaaactgtatgtattcttataacatcataccacagtattcctggtttcctcatccattagtgctgcgccaactaacatttctttgatatcgataccctggcaagcaaactcgtgttaatctgagagctaatgaaagttcagttctcagcaatataggagaacggagcagcactgacctgtaatgcagctggaagcaatccgacagctgacatttctgatgttcttccaccaacccagtcaaacatgggaaatctagctaaccatccctctattctggcagtgttgtctaacagagaattttcttgagtaactgcaactccctgcatagcagtttatgctgtcacataatggtatgtaccacaccagtcatatatagtactacctccatattttaatgtatgacgtcgttgactttttgtctaacgtttgaccatttgtcttattcaaaaaatttatgtaattatcatttattttaatgtgacttgattcatcatcaaatgttctttaagcatgattttatatttgcacaaaaattttgaataaaacgaatggtcaaactttggtcgaaaagtcaacggcgtcatacattaaaatacggagggagtataatataatgatctttatatcttgagttacaaaatgcacgttaatatcatgtcacacaaatggatccagaacagcccacaccacatgacctacttatgaacactgatggtttgcttgtaaaacaagagaaacaatattgtttcagtgtttatcttaataccatcagtatataaatcaagaaacgggactagtacaaatcgattacagtctaaattggcttaaaataaatgttgcacttcctattttgttgataaaagacatacaagaagtaaaagagcctgaggtaaaaacctgtttcgagaaatccagcccagcatctcggaaggctttttgcacttcaagcagaccattccgggtttcaggtgtgcctccactctgcaagtatagacaaacataaaatttgcaaaagaagcagggagaagagagggtgaataaggaaaaacaagcgtgatatcaaccttagaaataacaattacaagagtagatgcaagctctggtcctagttgagcaatttgatggtcgattccagcaggatcagtgttgtcaataaatcgtatctgagacatcaaacagaacaaaaggtgaggttatagctacatgagaaacaccaaaatctacaaaggggcaaatgagatcgaagcacattgcatggatataaaagtaggggcgcaccttcaatggagggttatcaggtgcaagtgcctctgaaacaaattgaggccccaaagctgatcctccaattcctattgagagtatttgagtaaatcggccagctggagatgacggaggtttaatctacatttgcaccaaatcactttgttaatagtgtttctcaagatcaaaaaagaagtagcaagagcctgcataagcaaaactcgactggcgtctatctattgaacaatgcacattccccagtacccatttcatggtaatcaccaaaacataggtggctccttttcttcacccttgagcacacagcttactaagcttaaaaccgcactaattttaccacaatatgctaatagggtttcgtttgcttatttgctattagccgccagaaattaagctttttttatagtagcagtagcagaactagagatatcaaattagtaacacgtgaaaatcatctaatttcagcgagtccagactcctaacagcaacaatttttagcatctcgagcaaatggaaacttctgcaatcaccttgccggagacgacgtcttgggagaaggcgaggatgcggtcgagggtggtctcgatcttggtgcggaggaaggagttgggggcgaggcctgggtcgcggagccagtaatggccaaccatgcggccctcgtcggggttggcgatggcccccttctcgagctcccgcatcgccgcgaaggcgcgctgcatccgcggctccatccggcggaggaactcctccgtgaaccccatccggctcacgtccacgaacaggccgagctccttgtgctggtacagccactccacgtacctctcccacagcttgatcgggtccttctccaccgcgccgcgggtgctgccgttctgccccggcctggaggcgagcggcgccgccggggtagaggagggctgctgctccgacgaggacgaggaggagcgggagaggtccgcgatggagtggggggcgcggaggcggaggtgggaggggcggaggaggagctgccgccgcagccgcagcctgcacgccgccgacgaggacggaggcgccgccgcgccggagatggacgccatcgcggccgccgccgccgccggagtctcacccggtagtgctcgctcccgctctcctacacgagctcacgcgcatctaactccggcgagagcgagagaggaggggaagcgatggtttcgtcttggagtccacgaagaagaggagttggtggcatcgctgggcttggctttatctgggggaagacgaaggcaccgggtggaccccagccacgtcaccacgtgggacccacctgtcattgtgccacgacttggccccacatgtcagcgtcttggggtgaggcggcgcgtgcgagcgacggcggggggcggaaaaatctcgacggcgagatccggtggtggcagctgggtgccaatggtaggtgggcccggggatcttttcgcgagcttgacgcgacgagtacgggacaaggctacaaaacggtaaagcgaggagaactcgcggtcgaggaggggcagagagatatttggcgaatttttggttgtgatttctcaacggctgctgtttcaggaagtttgctggtttctgttctgtcagttggatggatggctggacggtgaccctcgcaaggagcaagtagaaaccaatttacggccgtagaaaacaatttacggcgtctggtgaatgggaatgtggtttgattttgatggcactttcgtctcacctctgttttcttagacctgatttggacggccaccgtgcagcacgtgtgaccgtcttgtcgtgtattggaagagtgttcaagttgttaaaaccacttccaggtttcaaaaactgcttcttttgcatcaaaattttggaacataaaataaaagtgcatacatacatatggaccaatcttcctctagtttattttggatgatggcatgcatcatttgtcagcgcaaaacaccccagtgaccaaattaatattgcccagttcgatctttaatatcgtcccacacgtttgaaaagcccaagattactgcctcatgctgaacgctaatggccgcttagtgttaggaaagcgattggctcctcccttccctgacgagctacatgctaactgattgcgtcagtattccaattgctcatcacagtgtagctactgttccggctgctatgttgaccttgtcttcctacattctcaggagtcaagcatgcggacaggcaatatccgacatgacattagctagtactccctcagtcccagtatagtggtcgtccgagaatcactgacacaaatttgctttaggagaaaatgaccaaaacacccccaaatcattagctggcagctgcatgtagtcatttcaacatgcagagaattgacacacaatcagaaaaatctcatgtggaggagaaaaatcccacgccacccacggtactagatgggcccacttcttttttctagagtacttctcgctgctgggacttctttttttcaagtacttatcgctgctggaacttggatgcgtcaagctttctgggacatctgctacggggtaaaacgaccgctatactgggacggagtatagatttcacagaatattacaagtttagatgaaagagggggagaactatcaattgggttgagttgctttgtggaatttattttttgggaatatacccccttttttttaataatttgagtttatataccttaatggaaagatttagcacaaatatacctctaacacataatggagacgcgggagagcaacataattacggcgtggacgtgcgggacaggcgggcgggccggttaagaatgacacccgagcagcgccaagtcccacggctcagaagagcagcactgatacagtcccgtgtccccattgcacaaaaccgaggcggtcctgctaccacatgcccgttgtgcagcaccgccctctccccgtcacgcggtagtgttttggaacccgcaatcccgtggcgcgcaactaatttgatccaaatagtccacgccgaaagttattttcacgcggcaacaatgtcgcaatcacgcactaccagagaaaagagtaatttctctcgtccgtctcagctttattcacacggcgtagcagttattttatcgcacgcaacaatgtcgtagtcacgcacgcctatagaaaagagtaatttatctcgttaagactcagctttatgcacacgctgtagtagtgaagtagcaccgaaagtttgttatactgtaccatcaaaaagtttggatagtctactcacgaactgcctataaaggaatcttacgaagggaaataagacatacttcagtagattgtatcactctttaaagttcattgttattgtacttatggtgtataaacttcactgattagaaggtctcgcgaattcacaggacatatcttgtggtatgaactaagtacgtgatgatttatggtgtgtattgggggcttaccataagataaggctgtgaatttgcgaaactttcaaaccaacttaaatgttgtgtaaagattgtggaaaaattcattatcatgctgcatgaaaatatttataagtgtccatttagacgcaggaaaggcatgttgaaagggtcacttaggcctagaagggggtgaataggctaagttaaaacttaataaaatgcataagctaggattttcggatatatgccaaacgacaatcacactagaaaaatgaatctagcaaggcacaacaaataatctaaagctcaaagagaagctaaagctatagcggcacaagcaagtgaagatagtagaagggaaagcgaaaaaggatgtcaccaaatttcttg

SEQ ID NO: 58910 - DNA, 12280 bp, Oryza sativa
gccaatcacttggactgttttccgtgagggattcaggtctgctcacatccctgctggtctcatgaaatcaaaaagaaagaatttcttaacttgaagcaaggaaacatgcccttcatggagttcatggaacgcttcaattatctgggtagatatgccgcttctgacttgaacactgaaacaaagaaggttgagctatgcagagatcgtcttgcacctgaactcaagcatgctcttgctgctcatgaaatcaccagcatgaagacactggttgcccttcgtgttgaatcaagtgaaaaggaagtggttgaagaccgtaagcgtaagtgggctgcaaagaaatttgctggcagcagcagttccactcggcctcgtcttgctccatctcctgcggttcgtcctatggcacctcagccacctcggcagatgtatgtgcctccacgtccgcaaactcagttagttcgtcaagttcctcgcgcagttcaagctgcgggagatgcatctcgtaatgccaatgtcacctgctacaattgcggcaagaaggggcattattctcctagctgtccttatccgaagactggaacatccggaccgtactcgcagggagcaccgcagcagcctcgtggtcctcctcaagttcagcctggacagcgtggagctcctgctgttcccaagccagctccaacttttggaaggggccggctcaaccatgtcactgcagaagaagcaaccgacgcacctggtgtcgtacttggtacatttcttgtgcactccattcccttaacagttctttttgattccggtgcaactcattcattcatgtcaaccttgaaagcaaaacaacttgacttgaaaacagaatttcttagcgatgctatgcgcatccaatctcctggatccaccatggtcaccaaacttctatgcaaaggtgtagaacttataatagacggggtaaagtttaaagctaacctcatattattagacaccttgggcctagatgtcattcttgggatggattggttaactaaacatgagggaaccattgattgtgctcatagaactgtaactcttcgtagcaccgatggtcaatttgttaggtttacctttgaacaaacctccacttcaaatcaaccctctatacaatctctctctataccggagttaaaatcagtacccatcgtgaatgaatattccgatgtgtttcctgacgaattaccagggatgcctccagatcgtgacattgaatttgtgatagatttaatccctgggacagcacctatagccaaaaggccatatcgaatgacttctgaaaatttgatggaattaaagaagaaactcaatgagcaattggctaaaggtttcattcgtcctagttcatctccttggggctgtccagtgttgtttgtaccaaagaaagatggaaccatgcgaatgtgcgtggattatcgacctctgaatgaagtcaccatcaaaaataaatatcctcttcctaggatcgatgatttatttgatcagttaaccggagctcgtgtcttctcaaaaattgatcttagattgggatattttcagcttaaaatcagaccggaggacattcctaaaaccgcattcacaactcgctacggtttatttgaatacaccgtagtctcttttggattaaccaatgctcctgcttctttcatgaatatgatgaataaaatcttcatggaatatcttgataaatttgtggtggtattcattgatgatatactcatctactccaagagtgaagaggaacatgcgcaacatttacgtatggtactcgataaactccgtgagcatcaactttatgccaaattctcaaaatgtgaattttggttaaaagaagttgaatttcttggtcatgtactttctgaaggtggtattgctgtgaatccaagaaatgtacagaacgtacttaattggaagcaaccacaaaatgttcctgaaattagaagttttcttggactagctggttactaccgtcgtttcattgaaaatttctccaaaattgctagacccttgactcaacttcttaaaaaagaaaataaattcatatggtctgaggcatgtgaaacaagttttcatgaacttaaaagaaggctcacaacagccccagtgctagtgatgcctgatgttcttaaaccttttcatgtttactgcgatgcctcacatcatggtctcggttgtgtactgatgcaagaaggaaaagtagtggcttatgcttctcgtcagttacgaccacacgagatcaattatccaactcatgacttacagctagcagctgtggtgcatgctctaaagatttggcgccattatttggtcagtaatcggtgcgaaatctttaccgatcataagagtttgaaatatttctttacccaaccagatctgaacctaaggcaaagaagatggttagaactcattaaagattatgatctcggtattcattatcatcccggtaaagcaaatgtagtagctgatactttaagccggaagctacatcaccttgccgttattgagacaataaatcagccatcgttgtcctctgaatttcagaaattgaatttgggattggtagaggatggttatgttgctgcactagcattacaacctactctctattctcaaattaaagctgctcagtccattgatgaggaagtagctgaaattatgaaagaaatcaattcaaagccacaatctatatacactcttaattctgatggtatggttatgcttggcaaacgaatctttgttcccaataatcaacaccttcgagaaaccattcttgatgaagcacatcaaacacctttgtctatccatccgggttgcactaagatgtaccaggatattcgcactcaatattggtggcctagcctgaggcgtgacatagcagcatatgttgcaatttgcgacgtgtgccaacgtgtcaaagctgaacatcaacgacccgctgggctactccaacctttgcaagtacctgaatggaaatttgatgaagttggaatggattttattaccggtcttcctaaaacacccaatggacatgattctatatgggttattatggatcgactgactaaagtggctcacttcattccggtgcatgtgacttatggtggagccaagctagcagagttatatttgactcatattgtaaggcttcatggcgtaccaaaagtcatagtatccgatcgaggaacacaatttacatccagattttggaaaaatttacatgaacttctcggaaccaaattgttcctcagcaccgcctttcatccacaaacaggaggtcaagtggaaagaacaaaccaaatacttgaagacatgctccgagcttgtgtgcttgaacataacactaactgggagaaatgtctatcttttgctgaattctcctacaacaatagctttcaatcaagtatccaaatgtcaccatttgaagctctttatgggagaaaatgtaggactcctctttattggtccgaagtaggagaaagacaattctttggacctgctatcattaatgaagctgaaaagaatgtcactcttattcgggaccgattaaaagaagctcaaactcgtcaaaagagctactctgatcgtcgtcgacgagagctaagttttgatgttggtgaccatgtctatcttaaagtatcacccatgagaggtactcaacgattccaaattcatggcaagcttgctccacgatatattgggccataccaaataatatctaagcgtggacaagtagcctatcaattggaattgccatttcagttgtctaatatacatgatgtattccatgtttctcaacttaagaaatgtcttcgaactccgattgagcacacctcacttgaagacattaatctaaagccaaatctctcctatcaagaatacccaattcgtattctcgaagaaagtgaacggcgtacccgcaaaagctccatcaagatacttcgagtacaatggagcaatcatactgcggatgaagccacatgggaacgagaggaccgacttaaggccgaattccctagtttcttctagaatgacgaatctcggggtcgagattcttttgtaaggggggtaggctgtcacataccatgactttgggtgtttggaaaacatggaaatggtggaagaagtaaaataaataaaacttttgtttaaaacttatatgcttgcttgtttgtgcattttgtggtgtatgcatatgctttataggatcatgttcatatttaactaaaaccaatggatcaaagaaaaattcttggaacaactcaaaaatctgggaagaatttgtggtaacttcttgctgaccttagaaactaaatgcggattttaatttagcttatcaactcattagatcaaccaaacaactctctaaacacttaagcacaggattttgacagattctctggagcactctttgacactctgccaaaattggatcttgaactcctaggctgtaaaactcgatccaaactgtagttcaatcattgctttacaactttgcctttggtcactagctctaactctgcctggaactaattttaaactgaacccaaagatggaattccacctctgttccagacttggccaaaacctagatctcctctccttctctctcactagtcgctgccatgtgggccagggctgcatggcgggaccccattgtcagcctcacattcctctccacacgggcccactgcctgaactcgcatgccacgcgtgtgagcacgcgtcgagcacgggagagggcgagctcctcctgtccatctccgccggcgaccatacttaacccgaccggccgaccaactttctctccctctcgcccttgtctcgtttcgcggaagaaccgaggtaccccgcctcggattcgccgggaacggaggcgccatctccggcgccggcgagataagtcctcgactccgtcgcaatccggtgagcccatttccgttcaatatgcgttctgtaatcccctctcaatgccgtctctaacaccaccaagaacacctcatttggtgcagccaatctccgggaacgtgaccgcgtcaaatcggaacaccgtcgcgctctggacgccgctgcttcgcctttgctcgtcgcccggcttccatagttcgttacaggctgagccacttcgtcacgagcttcatcaacacctgtagatcaagaatcccgaaggaatcgacgcgaggtggaccacagtgggagatcctcttcttcttctccaatcccagccgccgacgccattcctttctttctccttctctggtgagcttcggcgcaatattttccgcctagagctaccttgtgctgatctaaacagaggcatgcttcctctctttgcagtagaagcctggggatacgccgtcgacgacgaccgtagcagccgcgccgtcgccgaaccagtacaccgtcgccaagacttcgctgagctgcgtttgcttcttggtgagcctcctagtagtccctagagtccttaccatacgcatgcacgattagatcgagcctcaaaactcacatgcatgtgcaagccgagcttagccgccgcttctaacaccctgacagccgctatagagcaccaaggcttgcaagaaaaacaccaataggttcgtacggttgttctctacactttttgttttgggagcttgagctgaatcgccgctgttcgccgctggtgatactgtgaagttcgtggctgtgctgctgctctgttctgtccagagcaagggcatggcttttgaaatttaaagactcccagggatgtattagcagcccgagcaatcacttacatatggggtcgtgcactaatctgtaaataacatagaactcaagtcccattttgaataaaatcctggaacacgtgctaggggctgcgggatctatttcctgagaacccaggagcttttgcgcaaaatgttagtctctgtctggtggacctgagaaaggaaaatgatgtatgaaaatttgagaaaatacaaaaactaatttcctatcaactgaaaaatgtcagaactttagaaagtggtagaaaattcatcctgactctaaaaattgcaaactaaattatgttggaatcatattttcatgctttgcatcataaaaatgtttgacttaacagaatcataaagatttatgtctcaataattcgaaatgcatttaggaccataattaacatgtaaacactttaaaaaaaaatctgtaactttgaatgtaaactgttagattgaagtttctttcactgaaaatcaaactaacacagagcacaccaactccataaaaaaaagcattcattttagagcatgttggatttttatgtatgtttaaattttaaatttttgcatatgtatgtttagacgattcgcagccgagtctcgaggaggcctactttgtagctgagcaaggagtggaagagcaaggcaagccacctcccttctttgatcacattgaacctatgatttggatgtttttgaaaagtttgcaaaatatgcatgtctattgtacactaatccattaaaatcttgtaaaatttgttagatcaactccttaacttgcattatcacctgaactccacaaaagaccttaaccattattccaaaaccttaggaacaatccattgtgtcacattaagaatgatgtttgagatagcaagtctataaaaatgctcagccatgcttagtgatgagtttacttaccatttgggctcaattacatatattaaatgatttattttatgatctggattaaaatgataaaatgtgatatttgttaaataaaatgttggaaaatgtggattttaggtttgggccgcatgtggtacacatattgtgtttagttgtgtactgatagggggagagtgtgcccaaaccgacctaaggacttcactcagcgtcaattcatttcgtatacagtacaaccacatgtgctagtatgggatagcccaagcttagtaaattatttatgatttagccttacattctggtaggccggtgtgtatgagttagtcgataattctgaggaattagtcgttgattcagaggaacttcctatttaccccgacgtggtagtttaggtgactaagtctgtccaatacaacggtattgtgccacgtgggtgggttcccgttgcgtccgccaccacggcgttaagtttaaggcgtgggcccgccacttaacggttctaggtcatatatcgagtatggcttaggatggagtaacacgtatcgtgctggtgtaaggctaaatcatgaatcttggaagggctttgttgtgagtaataaatcgggtacttatgtatcgcgtgccatgcttttgcatgattattatttcgcatcatgtgggtaaagtgtacgtactctgcagagttaaaactaatcgattagccgtgctcacggtcaagagcggcgtgtgaatatgtcatgagtttagacatgtgttttattcttctaaagctgaatttgaacttcaaaatgtgatgtgatttgtggtttatatccttgctgccatggaaggcaataaggagctatgttatatgtgtttatcatctaatttggtgcccaattgctaagtgtatgcttgctgaaatttatttgaaaataaatctgaaatttgaaatgctctttgcaaactaaatttgctttatgctaaaattatcccatgttagctttactttgaatttgccatgcatgtagagtactaggcttgcttggtgcttgccagtacaatttattgtactgactcttgcttgtattgttgtattgttgcatgtttagaattggttgcaggtgagatcactcctgtggaggatgatttcgttggggaagtttctttcttccaggatggttcttactagggtctatcctagtcggttgcatgaaagatcttttgggtagaagatgcttccgcgaacctatctattcagccaatcggccatgtgtatctaagttataagttgtatgatcctaactaaaacttagaacttagaactccctatgttgagatatcatgtgcttggatgaaagtgtttagtgtgttccttttgttagggacatattaaacatgagtatgagttaaagatatttgagatgttgtggatctttagccatttttgtcaagtctcctgattgtgtaacacatctggtcgccaccttcgagtggtttgacgggcacatctcaggctgaagttgactggcaggctaaaggcccggcaatgtctcacatatttttctctcggagcgtcgaatgtcttaatatgtttgatggaagaattgtgattagctattcatccttcaaatatactaaggggttcggagtgcttccgacagctttggtatcagagccaagaccgactgtaggaacccttttaagactgagcggtagtaaggcttcaaaagaaaatattttgagggtaatgtcctcactaaaatatatttgcaaaatctaatctattcttacttcttagccctgtttggataaattcctttcctatgaatcttgttttgattttaaaaccccatcttactctataggaccggaagatgcataaatagagaagtagtaactcatagagaagaataaggaatgaatgaaacaaattcgattcaagtcagtacttgaatgatttgaaaacttctcagtaaatagatgactaaatttttcccttctaaatttgaatttaaaattttaaaattttatcgatggcctagaaagtggtagtacggggtaggatggaattgatttgttttaaccatagtttgcttgtcatataaaggccaccagatgtttgtaaagcctctacattaagttcttagcatgtcccaaaattggtacgaattttacatgctcgcattttttttaaaaaaaaatatataattttttttaaactgcgcagattctagaactggtagcagtcgtccttctcattttttactcagagcagtatgctggacagaacctgacataataaccaaaacaccatttccaagttcctaaagagtttcaattgaaattctaattggtctatacttccaatatcttgtagatgtcttctatgtggcaaccatcgggctattctggaggttttgaggaagaatcactgcctcacatcctgtggcttatgctgcaacatctaggttatgatcatccaccggagtatcatttcttttctcatgagcggagttcatctctcgagcatatatggctgagctgtgtatacagggactttggacccatgaaccacccctttactttcaagcttgtggttgggatgcaccctcagcaatgcaggaagctgcattacaagcgattgtgtattaccgacattataggccagggttggacgggttctttcatttctttccagctcgcacaaaccaatcctccgctaattactatccaggtcttgagggaaacatgagagagattgacactccaggactattcttagctggcctggttcgtgctatggatagatatctcgcaaaaactataactgagttgcgtagattgcaagctagggtggtcatgcttgatagacgaatagaaccactcgggcatcaaggacattttgataatgccatcatttatgggaatcatgaactccagcctcttacagagactttgcctcctcccatgggtatttatcataatataaacactagagcccgcatgagagttggttttcatcgaaatcgtcgaaccatgccagaccctgcacttgctggagatccggtgctgctggggccattctatgagttcgagcggaatgggagacaataccgtttgactatggccactccgtcaaccacagtgcctcaacctcccatcggattctccgaagttccatagaatggtgtactggaaaaaaagaatatgtatggggtgtaactttcatttcttttctttaagatgtatgagatgacaccctaatatgtaatctttttaacggtcaaaattttgtaacaccaaggcatgaacttggtttcttatgaccattatccactcctatgtatctgtgatcacttagatcctttaaaactaatgtactggaatgaacttatgctccttttggaatggattgcttgctgtccagaaatttgtttcatgcaaatatatgatggatgacttgtaaattcggctataagaaatcattcctgtatgctacctatttagggtaatgtatatgccaattctatgctcaagcagctcatgtacttttgtactttgagtgcaggatgacacatactcgctctatggctgctcttactgatgatgccaatggtgagggagcgagtcagcctcgcactggcccatattcttctggacgtgccgggggtagtcgccgtgctgccactgcagaacagcatgatgatgaaccatctcttgctcaactcctggctaatcagaaccgactttttgaaaggatggtagcgaactctgaaaacatgggggctgccatggcacagcaggccaatcaagcaccctccaagctagcagatgttcaacgaacacatccacctcatttctcctctgcggctgatccactcgcagcagatgattggcttcgtgatattgaaatcaagctgaacctttgccggtgtgatcctgtagagaaggctacctttgctgcttactacctgcaaggtgcagcagctgcttggtgggagacatacaagactctcattcctcctgacgagccaatcacttggactgttttccgtgagggattcaggtctgctcacatccctgctggtctcatggaaatcaaaaagaaagaatttcttaacttgaagcaaggaaacatgcccttcatggagttcatggaacgcttcaattatctgggtagatatgccgcttctgacttgaacactgaaacaaagaaggttgagctatgcagagatcgtcttgcacctgaactcaagcatgctcttgctgctcatgaaatcaccagcatgaagacactggttgcccttcgtgttgaatcaagtgaaaaggaagtggttgaagaccgtaagcgtaagtgggctgcaaagaaatttgctggcagcagcagttccactcggcctcgtcttgctccatctcctgcggttcgtcctatggcacctcagccacctcggcagatgtatgtgcctccacgtccgcaaactcagttagttcgtcaagttcctcgcgcagttcaagctgcgggagatgcatctcgtaatgccaatgtcacctgctacaattgcggcaagaaggggcattattctcctagctgtccttatccgaagactggaacatccggaccgtactcgcagggagcaccgcagcagcctcgtggtcctcctcaagttcagcctggacagcgtggagctcctgctgttcccaagccagctccaacttttggaaggggccggctcaaccatgtcactgcagaagaagcaaccgacgcacctggtgtcgtacttggtacatttcttgtgcactccattcccttaacagttctttttgattccggtgcaactcattcattcatgtcaaccttgaaagcaaaacaacttgacttgaaaacagaatttcttagcgatgctatgcgcatccaatctcctggatccaccatggtcaccaaacttctatgcaaaggtgtagaacttataatagacggggtaaagtttaaagctaacctcatattattagacaccttgggcctagatgtcattcttgggatggattggttaactaaacatgagggaaccattgattgtgctcatagaactgtaactcttcgtagcaccgatggtcaatttgttaggtttacctttgaacaaacctccacttcaaatcaaccctctatacaatctctctctataccggagttaaaatcagtacccatcgtgaatgaatattccgatgtgtttcctgacgaattaccagggatgcctccagatcgtgacattgaatttgtgatagatttaatccctgggacagcacctatagccaaaaggccatatcgaatgacttctgaaaatttgatggaattaaagaagaaactcaatgagcaattggctaaaggtttcattcgtcctagttcatctccttggggctgtccagtgttgtttgtaccaaagaaagatggaaccatgcgaatgtgcgtggattatcgacctctgaatgaagtcaccatcaaaaataaatatcctcttcctaggatcgatgatttatttgatcagttaaccggagctcgtgtcttctcaaaaattgatcttagattgggatattttcagcttaaaatc

SEQ ID NO: 58911 - DNA, 12766 bp, Oryza sativa
tttagatgggtctaggtcatctgagttagaggatgaataggaggatgagtccgacatggttggaggaggaggaggaggatagattgggttggcagtttcaagttatgagaggtaatatatagatgctgcaaaggactagctgtaataaccatacaaattttaatatggctggactatgactgcattttaattaggaccagctgcaataaccatgaaaaatttaatatgtctggactatgactgcattttaattaggaccagctgcaacaaccatggaaatttaatatgggttggcaattgactgcaatttaatttagaccagctacaataatcatgaaaatttgggttgactgcatggttatttagactaatggcagttaatcagcacaaaatatgagactatatgcatgattatttggactgaatgctattaattatcacaaaacagggactggttgcatggttgtttggaactagagctatgaatacagtacaatagtttgactactgctcaaaatcaacgtagatatatgcatgttttactactgcaaagaacttcatgacacatacctcactggttttttgtaaatatatcttctctcatgcatttcaacattgcaacaagctcagacctcacatcatcaggcatatctcttgtgtctttgttcagtaactctctatatgctgcaatcatagcggtctggcgacccaccttcttcgcttcaagattatcactagcaacacgtcgctgggtctccaacaattcactttactgctccttggctgcttcatgtgcttccataaacttgtgggtgtcatcttctagctcagcagtacaatcttgaaccttgccttttcctttgcctatacgcttcgccttagctgccttgactcccattggacgtgggatctcctcgtcatcaaggggggtagcatcagcataatctcgcttccttttattcgacttgtcaagctgatccaaatatgcatgccatttaggttgggtttttagttcattccaacactcaataaacaagaatcgcccatccttgaagtcattctcatacattttcagcgccttgtccatgagatcaacattacactccccactagcatataatgaattagcctccttccaagggcaacaaaaattcctaacttttttcttgatcttactaaaccggcttgacggagtagtgctattgtaagcagcagcaacatcagccaatatttatcattctttttgaaattcgattctattggatcatttgagttgtttaaccaagcctgacctacaatttccaaatatttcactattgttaaattgcatgtattatgaatgccactaccaaataaataactcgcgtaggacacttaccagcctcaagtcttcttcagttgaccagcctaggcgcttctcggtcctagtggcatttccattgttgccattctcaacattaattggctgcaactgacacccttcagtcacatggtgcataaggttcgtggtgtttttgataaaatcaacaaaaccaccgagcgggcgagattctagtcccctatataaaaatcatgaacatgaaaatcttgatcagttatgtcccatatataaaaaggaatgaacaagccaatcttgatcaatgcaaggcctaacccaatattaccccagtataaatggtatattgatatgtgcagtcaaaattattttatttcagttcatagtggtaaatgagtgctcgaatctaaaacaaattagtaatagatgtaacattggactcttgtttttactttgccaaattactgcataaatacatggttaccaccactgctaattaccctaccatggttaccctacatgtaacattggactcttgtttttacttagccaaattgctgcataaatacatggtacaaatcattgcagaccaaattacatgggccaagttactacggtaacctgattatcagaccaaaatcacctcttttttcctaaacaattcattgcactagtgctgttatggatcaaaacaataacgaccatgaaactctcaatattagacagggaaacagaagcatgtcaaaatcagaactgataaagccaaataataaatgtaccattgttccaaatcaacttggacgtccgtcttggcatcagtaggaggacgatatgcagatgagcccgccatggcttgtgacggtggaaaaggaaaccatgatggcagtggggtggggaacaaaggacctccatatggatacggtgttgccggcgggatatgaacaccgggaggaccagacgagcttgcaaatgagtttgcggtggtgcaacctctctcttcgtccgacgagacatggtgaaaaggaactagggttttggtgcggtagaactatggaagaggacggggggcagtggccctccctgaaattcaccggggggatggatttcaggggcgattttggggctttggcatcgttctacctgccagcaaaatgaatttcgcgcgcgcgggagaagttataggaccgggagagaagaaaaaggagtgagtgagagggaatactgcgcgggaaggagatcgatcgatgcggtgggtgggagatctgtccatcgatttggcgggaggggatcgatgcgccaggaaggagagatcgatgcgccagcctcctttctcgcgctcgcgccaagagggagagggggatcgatctcatggcaaagagaaaggggaaaggggatcggatcagtggatcggcggcctaggagcggtgcgcgcacatgatcagtttttccgttcgtgggccccacaacccgcgttttctagcgcctgcctcggctgcaagcggattcagattgggtgagataggatagacatgtcataaggtgacatagcgtagatctcagctctccaaaataaatccaacggctgagattcgttcacatcatcatgagttaaaatttaactcgtatgagtaaaaattttactggtagttaaaatttcaggagttaaaattttattggagttaaattttaacttgtaatgacgtggacgaatctcagccgctggatttatttcgaaggactgagatctacactatgtcaccttgtgacatacctaccccatgtcatccaatctaaatgcgctgcaagcgggcgctatgcccccaaaaaatgcgttatagcttggcgacaatttagtcgccagctcttctctttcccctcaatcattacccttccacgtagaaataatgtgacgtggcaattattggagctgatgggtcagccctattgtacctgctctaaatgatcaggtgggtttccttgtgcaagaattgttcgtagctagattggttaggcagccgcgccttaaggcctgtgggcatatggttcaaatcccttcgctagcgggcgagtttggctcatttgcatggcattcggttttggcgcgttgctgctcgtttttttttttgccttggttttcactggcgcgctcacggcacgctgtctggaccgacgcttgggtctcccatctcctgcttgatctatttaagacacgccacttcttaacgccacctcttcctcacttgttcatgtactgagccatccgcacatggccgatttatttcctgggttcgatctcaacgaacctgcggcagagcacggcaacggtaatgcatcatttcattgtttcattgtttccgttggagtatgaggaaattagttttgttttttgatattcacagcagtctcatgcaaattagtttccattatcagtgtgttctttcattttcgacaggatttgatttgaacttaccactaagatgaatatggtgcatttgattttgatttcgtacaaaacatcgctggtaagccgtggttattatttcctttctcagtttgtactttccatgtatgattgttttttaggtaagccgtggatattattttgaatgtgcttgttttttttcctcttactagaaccaaaccatcgaaagaaagaaatgacagaagaagtcagaaaacaagtgtatcaagtattgctggctaaaagcaagaatgggacactaggcaatacagatacaagaattgttgctaatcaatttggattgcacattcggtcagtccaattgtggttgcaagtagaaagaagggtagatgtggccataaggcaatccctcttgatttgaaacaattgcgcaacattcctctcaagtaaagaatgaccatagaagatgtgtctagtaaacttggtataaacaaagctaggatacaaaggtatttgaaaaaaggtttgcttaggcgtcactctagtccagtgcgacctcgactgagtccagatccaccttgacggagtccagcgccatctcgactgagtcccacagcgtcatctctgagtcgagtgcgacctctgagtccagcgtctcctccatgtctagagcgagcttcatggcgccgagctccatggcgagcgtgctgcgggagaggaacgcgagcgcgaggaaggaaggaggacgtgcggcgagcggcgagctgtgaggcgaggcgaggcgaggaggacctgcgacgaggaaggaagccgcgcagcgaataatttcttcgagcatgcgcctacgaagaaattaactcaagcgtgcgcagcgaggcgatgcgagcgctgattcgctgaacagagtccgagcagcgagcttaacgaacaggcacgattaatgcgcgtgattactgcggacgacgagcacgcatgcgcaggggcaaacacgtccacctcctttcctccgagcgtacagcgacatcctttgcgaaaacgcgagcgatgccaaaacgacatctaattcgagtacggagggagtagatacttagctaatgccgttttctgatttgtagtattcactctgtttcaaattataagttatttgactttttttttcatagttaaagttttttattttgaccaagtttatgaaaaaagttagcaacatctataacataaaattagtttcattacattttacattgaatatatttttataatatgtttgttttgtattgacaatatttatatattttttataaatttgattaagcttaacaaaatctgactaataaaaagtcaaatgacttatagtaaatagtgggagtaccatagtatcgatcggatcgatcctataacgtccgaatatctttcgtcatcatcattatcgaaatccaactgccctacacacattgcaaggaggcaatcccccgtttctgctgccacgattcctttggcggcgtggaggcaccccttcaccaaggtaatcagtatagatactagctataggatagatctgcagtatcatggtatcataggatcataatacatttttaaattatatattttatacaaatatccagaaaaaagaggcgaaaaaaaaccaaaattgtccaatctaaaaaaacaggcgaaagaaaaacgtaaattatctaataaaaaaaccgggtgaaagaaaatgtgcggaaaaaagaaaagaaaaaacaaatctgcaaatctgtccgaaccagaaaaaagggcgaaaaaagaccgggcgaaaaaaaaaaaccaaaattgtccgataaaaaaaccgggggtaagaaaacgtgcgaaaaaaaaacaaatctgacgtggtaaaataaaaaccgggggaaaaaagaatttgtctgattccccaaaaataattgtccgataaaaaaaacggggcgaaagaaaaaaaagcgaaaaaaaatagtccgactcctatccgattcctctcataaacgacaaaaaggtccgactatagatccgattcccccttaaaaacgaaaaataaaaggagccactccttctgagtccgagatattagccaccactcctttcagttttaatctataccgtgatatctcacacatcttggtgaaacaaaatgatgtgccggattaaagatctgtataaaagacggaacctataggtcgagagcattccatttttatatgattttattttttaggtttgtacttttacatttgagtccctgtaatttttatatttatatttgagtccctataatcttgcaataaggtacttgaggttgtttttttaaaaaataataataaaagagagagaacaaaagctgaaaggtgcgtaaaaagaaaatataaacgattcaaaatgcacgagaaaataaaaacgatttaaaaagagaaaatgcacgagaaaataacaatgattcaaaaaaacgcgtgagaaaaaagtcaggaaaaagcgcaaaaaatgctaaaaaaggctttccatcttccataaaaaaataaaaaacacgtgagaaaaattatttccaacgtcggtaatttttttaaaaaaaacatgggaggaaaaaactataagaaaaaacgcgccattttaaaaaacggtgctaaaaaaataccgtctattaaaaaatcgctctgagtcggataggatccatcgattttttgccaccactgtacacggcttttatttcgtcaatactaatatgttgtgtagaaaccatgtctcatgtaagacctggtttccttctctttactcgtttattcacttgccacattattttttcatcttagattgcagcttatttaatgctatggatatcataccagtcaatggattgggaatggccttataatttgggatggaggggtaccaaacaaattaatgaacacttgaaaacacaactccaaagagttactagtgagatcccctgcacgtggctgcagaacttgtgtatgatgaattgctacaaaatggtgggtgcaagctagattatttggttaggataaaagggtatttttctagtgaaatttgtacattgcgatgatcatccaatggcagcttaaaattaaaaaattaaaataaatggttgcttcggatatgagaattttattgttattttgtaaagttattaacatttccataattgtgaagatatgatgatcttttctatttattttgatgtagccagtcatgtactcaaataataagattgttcccatggccatagcatttgagcattttttttatctccaattaagtatagaataatccaatatgaaaatttaagatctgatgaaataaattcaagatcaataaactgcttggaaaactggccaacaagttcaaaaataaaatcaatgttttggcaagatttgtctaaatttcactagttttttgtcatttattgagctcaacctgtgataagtgatgaaaccactcccaagcggcaatgggtcaccaaatatttttttaaccctgcctatcactcaccatatgtaagttgctccttctcaaaatcaccaagactattccagtatcacaacactttatagagagttcccatagcaagataatatattattatttgaaattgaaataatcaatcaccctattaccaaaaaaattagcacaaatcaattattcgaccagactagctaataacctaactaaagactctagcaaatcattgaccccggcaacatctcatcttcagtgctactatttcctgcaaatcaagcagtaacattttgtcttgtaaccttttcccaagcacttgtgatcaatggctttgcctttggtgaatttcgagaaaacccaacagtggtacttgcatgtgaaacccacgcagatcggcaatatggaaacagattgcgtacaagtatctgccataaattaatttaacccatcagtaacttataccattaataatctcatttcatttgccataattaatcacaagaaacatttaaaaatcaagttttcggtttaaaaatcgagaaacatttaaaagtactgaaaaatgaattggttcttatcgacaaattaaatatgtatatccttcaacacaatgagaatatacatgagattctttgataaaaaaatgagtataacagtgtgtgtgagagagaataacctataggtgttggtatagaattcccaagtgataacagaagcatcaagacgaaacaaatggcagcttttctcccaaccatggctgattagctctgatcgggcttaattattacccgagacttgtagctagcttcagaatcgataactaattcctatgatatgggaatcaaactgttctatcatgaagagatatgatgataagatgtctatttatagagaggagaaatcaaaggcgctcgattgatgggggacgtgaaatgtgggtggataacggcagtgactgagttagttgaatattcatgcatatgcatatggacctgttcagccggaaaacttcaccaatataatgtacgcatgcaccacatcatgaccaacttatgatatgagtgtgattaattaacggctaccgcctaatcaaatgtttcagttgaccgttgatgcaacattaagttatacacgatgaaacagaaaaatcagcctatgaaacatatagaaattttgtgaaacaaaatgagaacacgtggtgaaacatattgctattacgtatgaaacaataagtttttattgtttgaaacatatgtttttcttttatcagaatataatcatgggatatctttaaagatttaattatgacgaattcaacggtgtgatcgaatcgttcatcagataaatagtttagaagaaaaaaatatttttaagatcactaatacatgtatgcatgcatgcatggtgagggagtcaatagaatgacaggagagagagtaggagcctgaccatcctgtacttcttcggtcattggtgaaacattaagttatacatgctgaaacaccagttagtgaaacatttaaattattttatgaaacataataaaaacacatgtttgaaatatatttctatatatcacgtctgaaacatttaatttaaaggattgaaacatatcttttctttcatcagaatgtaagaatatgagatttaattataacaaatataatggtgtgattatatcatagattggataagtagttcaaaagaaaaaaatattttgaaaatcattacagcatgtatggatgtgtggagtggacaagatttagtaattttctcgtcccatttttcttgttgcgtcagatgtctggtactaataatttctatcatctatatatatatatagtcgtttccgtttggtaaactatatttttttcttgtttggtaaactgcttttcacttgctatatctgttttttccgtcccaaaataacttaaactctaaatttgatttatgtccttttatctatcctcacttggcaaattaaataatctgacatgcagtacaaacgtcgactctcatacacacgcacaaacacatactcttataaacacacactcacacacacacaaattctaaatgtatgagcacctcttaagactggattagaatatcatagaataaacaaagtcatcacaaatatctcgatattgatggatatatcgtcacctactacatattgaaagaataattagtcataaatacgagcattcgtgtaaaggcttgaacttaaaccgggcatggacaaggaagaaagcttagcttacctcgcaaacttagaaatcttatctcttcaatgtacattctttgtctacccatgtgtactacttttctattaatgaggtgtgctttgacatttttctttaccactaaattttctctggatatgagggttccaatagtaagctgcaaataataatattattgtagtataaaaacatgaattaattggaagagattaatgaaggttggatagcatatttcatgattgtaatttcatcagtaaaacaaaatacaatctatttgcacttatgctaattaaaactttctatgaactctcacattagctagaaattgatttgatgcatcggattattgtgaatgtagttcatgctgagagtcatgttaaataaacaaatgacacaaatgaaaatagcacagactctaatttagtaataaaattcataattaaaaatatcatatcgtatccatcttatactctgaatttagtatttattaattaaaatctagaattcaaaattcataagtagtaacttgtaactaacgtggaccctaattttagtatgagcagatcaatatcaactcacaaccaacacatgcaatgtaataatataattttaatattaaagagtagcctatgtaatgcatgggttagcgactagtggttataatttctaatttccgtagaaacttttatgagattgtatgtgtacttttcatgacatatgtacaacacaccatatgttttcaaactaagtattcattactttttttataagccaattttgaaaaaaaaaatgacacatggccatgtatttttgagcagagggaacatgttatgaaacacaaatcttgaaactgagtcacattccttaatttgagagttaaggcatgttggatatattttccttaatttacatttttctaataattcatgattgttcattccgacatttcctatatattctcaactaatcaatctgcattggatcgatacgatgaaagagatcatcaactcaaattctgatggcatcacctggacagaggttgcatatcatgatactgaaatgacagaaataattacaaattaaatagatcgatttgtaatgcgtctttgaaacttttggatcttagaaactttgaaacgtctctttaatatccccaatgataacaagccatgcgttgcgcgacttttgattccatataagaactatttgttgtataggatctattagtttatagaagattttagatgagttattttatttacaaagtatctattggtctagctaactatagatttagctaagtcgtgctatatgagaaatcactagaagcttcttggttttttttttcttcattatctttgcccccgctctctttgtaccatgtgtctataagaggaggcactagaaacctctataaattcccatatgtttatgctattgttatttttttaatgcatatgtaaccttttgatccaatggccattatttatctaaattctttattcaacggttgatatgtttttgatgatgtggcgtgttctcgtgtaagaaagcttgttgctttcactatataagataagataataagatatgatgatagccaccggccggaatacacaggagactaacagtgctctgattttcttttctctcgggctgaaacgccctcgccgagaaatatcattatatatgtatcgaaattatataataatttgataagatgcacattgtgacagtacaccattggaggtagaagtcaaattaatcataatgccaaacaaattaacaacgacggtgtacttcaaagagataaatttagggatctagctagcttacgaacatatgactagcacaaattattcaatgacactactagctaacgatcgacaactgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaatttacggtctagcgatggcttcagctccactcccacaggcagctcaactggggtataagccaaacgtcttctccttctggatcctttatcttcaactgaggtttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacagcacacccatgctgcacaggcccaaccatcctgaacaaccatacccggctgtacagatctaactccaaaccaggagctaagcaaattgttaccagttataacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcacccccttataaacaaggcatggactccccagcgacccccgtggacttctcgccacttctcagtctggcgcactataatgaatcacgctatacaaaagataaagccgttgcccacgctggcttgtggttggcacggtaaatgtctcacaatagtagctcgcgaaccggtccttaattgccatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtatgctaatgtttctaagcatggctaagcaatcataactaatatctagctgaaccaatatataaagcccaactagtcaagttataataacccaaggtatcaaggaatagggtaatcaatgcaaactggccataacaaaggaataggttcacaccacccggtgacattcgaaaataaatgcacagttgaaataaatagagaatttaaatataggatcaacatgctcaaaggattgtgtttaggatctgtgtgacttgcctt

SEQ ID NO: 58912 - DNA, 27204 bp, Oryza sativa
aaccaccaatagccaccctaagggcgagagctacagaagaagtagttaaccggaaagaagccctgtggagatccaacaccaaccggaaaggagaagaattgaaagaagaagaaaaatgcaccggcgttccaaaacaagaattaacctcatcacggatggaattccctggaaagaaatcccatccccccggaggcgaaggcatgaccatcgccgatcagaaggaatcaccattgcggtcgccaacggagtcgccagagctcacagaaggagtcgccattattcaaagttgttcaaagttgttcacaaaagggtatatgcgaaccgactaatagctatttttatcccgagactgacattgcctcgcatgaatcactttgtcaatgggaaagagcgaggtcgatcaatctacatttagttttgtggataacttaattaaactgtttaggatggtgttataaatattgatgtgattggattgtggtgtaaatactcttatatgaagttttattatattttctagtgatatgttatgaaatgaggatggcatcctctttttctatttgatatatatgatgagattatgtgatgatttctaagatgaagtatataacttgtgatgaaatatggttctaatgtatagagaaatatgtaatccctgtaattgtttaaagagataggggcagttcacttcagtgaatggctcatggaaaaaaaatttcgcgagcggtttgcttaagtgatctgcccatgaaaacatattttcactgacaatttccttaagtgatctcacatgaaaaatgattttcacagtcagtgttatgaagaaaacaacccctgcaaaggagtctccacatgcggctccatttaagcttgtgtaaatagctgatttctgcagatcctagactgtaggcggctggattaacgcttgtacaaagttcactcaaatgaacgacccgtgataaaaaaaaaatttcaccgatggtttgcttaagtgcttcacccatgaaaatgtattttcacatacagtttgcttaagtgttccacccataaaaaaaatcttataggcagtataagaaaaccacccatgagaagttgtctccacatgttccatgtaagcttatgtaaatatccgattcccacatgccctagactgtaggctgctagattaacgattgtacaagataggttatcagacgtcggcagaaatgtttcatgtaacaatgattagatcaaaatttatggggtgtatgagttgccagagtttaattgagtgggtaggtgtatttccaatagaattttcataataagtttaagggttttacatctagtccatgtcttctttaaccaattattaatcactactaaaaaacaatttttctgtacaaggacctctttagatttcagatggactgtaactggtcgcgtctgtaaaaattatcctatattttcacgtgcaccttaagaggaccacatggaaaatcggtttccgtagaggggcctcttaagtggaccacacgtgaaaatgagcttattttcacaggtgggccacttaagtggaccacacgtaaaaatatcattctcctttacagattttttttctcccctcctctctctctctctcttccctctcactcacttcaaatttttcacctcctcaaggtaataaatagcgttcgtagcacccgaaatagcggcctctatagcggtagcgaacctctacagtagcggactgctaatagcgtattggaacttagcggccgttatagagcttcacgaccgctatagcgcttgctatagcgcttcgcggccgctatagcagcccgctattgactttgttggatcactataatgcttaaatagtgttcttcacatagggaaagaataacttaacattgtgtaccttctttatcttatatatttatatgctatttcataattttttatgttatgaaatgtataagtaactaagcatacagtctaaattttaaattttaagtgaaacttgatgttaatattgatatacaatctaaagttatggttatttttttaattccactattggagcttagcgtccgcaatagcacccgctatccgcaatccgctacccatacactaatccgctaccaaccatctatacactatttattaccttgcacctcctctatcttcctttcccttttattttcactcctttctctctgactttctctcctttctatcttcctctcctcacctcttctccgaccacacggcacgcggggcacgggaggtgacggcgacgggcagcggcggcggcaacggagggctcgggcagcaagggagggcagaggaggcgcgcgatggcacggatccaacagcgaccgccctctccccgcgcggaggatcctgcgctggggaggcgcggcggctatcgcccacgcgcaggagcggtggatctagtggtcatgagacatggtggcctttgcctgcgcggatccgacggtggccgtcctccccccacacggcggcggtggatcgcacggtggggaggcatgggggcggcggctagcccttccgcacgggaaaacttttttcgggccgtttgcaaaaaaaatatattttgtagtggtgaataaagggggcttatttgtgtgtgttgtgtttaatggtacatgtacatagcaattgaaaaatggaaacctaaactccgaggtgatgcgtttgatgccgtgtcatgcttatcatgatcttgccttcatgcaaattggattgatcgcataaacacttgcatgcaatggcactcactcacataaatactactgtaatacccattgttaattggcgcactgcaacattgaagcttttgatggtgtccctctttaatttccttaatttcactagctaggtaggaaccaaatttgcatcgagattgtgaaacggaggtgaaaaaaattgcaaccaaggacaagtgctccaggccacgaggggcttctgtcctaggaatttgtgagagttttgagataccgcgtcgatccataccatcatcatttgactatgatcaaatcaggcttaaactttaataatgcaactgggtttgacctggctataattagaggcgagcttgttgtactaaaatttggttttattagagcatttcgaggggaaatctttcgctagttatgagtttttcttgaccatgcatgtgaagctgcgtgtggtttcacacttttttctttatgaaacttatcaatgcctttgttaaccaactgtaagtttctctagtcgatctggttatttccacattgcaagggacacatacacacgtattggtcactaattaactctccccataaattaactaggacgtgatacaaaatgatcattatatatattaattaacttgtgtacccccttcacttcggcaaacatatatgtaatgagagaacgacacttagcaagagcatcaagattatatttaagggaatagagaagtactcattatgacccgtttatcacacaaaattaaatatacagaagtatcattaatttcccttttttttttacttgatgcactggatatcaaacattttctttttcgattacactgaaggcgtatgcacataccactgcataagcacaccacactcacgcatctgccattgcgcatcctaacacacgtttcaaaatatgaaaaccagcggctaatcctaggcttacaaaaatactattaattagaaatgtatatattcacatgaacgtagtattcgtgagtaccaggatttgaactctcatttaagtagtgcacccacagctagcagtactccaccacacaactggtgctcccctcactggatgtcaacattgatatattcttagactgaaatgtgtttgatgctttttataaattagttttatgaaaattatcattagattgaatgctttcataatattaaagtctaattttattatataaactctgttttcaaaaagaggtgtgtcattgcagagtgtgtagaacatcaaaccatgaaagcctatctcactcttgtatatgcacaaatgctatgatttgatatatgtcaaaatgacattagtacattaatttcttctcatggaaaatactttcgtgtatgtgtatatgtaaataaattatgagtggatttcccctctcagtcaatacctatgcgcgcgaggggaagagaatcatgcgaaatggaagtgttaaggttaaactacctgtagtgtatttaacaagtgagtgtgcaatgatcaaagtaatgcaaaattctgtcaaaacatgtgatacatgttttccgaacgttagattgcttgattgacttgtttgagatgtgtgacaagtaaatgtttcaagagtatgtatacatgatacggcgaccacgagatgtatgcaaaaggtaaactgattatactacattagattactagtaccaaagatcacatcaagcagtaaattaaggaaacgtaaattctgataccagaggttacaccgcctaatataagaaacaaccacgatatggaagcatgaagtattataactcacattaatcaggtctcatgcatatattggattcacataatatttaagcacgcaaaatagtaagaataaaattttaacagttacattagacatgactaaaggaaaatggtataggtgtggcaaaatatatcaattataggaaaaaaagtttaattaccatcaaggatgaacacaaatttgaaaccacaacttctaaagaaagggaaaagctctcttgtgggcaagataaaaaaaattcgagctagcagcacaattgacaacacaattgatttaggaaaaaaatattaggaattagaaaatgcacaacttgaacggtccaccaagttcactgttctttctgtcgtgtagcgatttttttcgagatggtgcactttcagaactctcatttgtagacattattgtaaaaaactttgttaaattaccaagaacaaaattaattacattgacgcttgtgtacagctttattaagtcaaccaaattaaactcaaaagcttacttgcaaattaaatttgtcaaccaaaagttagagttaaatgtgctgaaaattaatgccattaccagtttacttgtaatttctcaaaaatattttagtgaactcatccgtccaaaattgatattaattcaatcaatattccagtttaggtcatgtcaaatccgagcccaatttaagcccacccaattaagcccggttaagtcgatcgagcttggcgaaaattaagagcatgtgtaacagtgcaagcaggacagccagggcaggcaaacccaatccccagaaattccaaggaagcttcttaatcaggcatgcaaagccgcaattagaccctggcttaacggttaattcacacacacaatactagtatacatttctgtccaagttaacaacaattagcagcactggccctgcagcaagcagcaacgggctaatagctagaatagctatagctcttcattaaaagtgtcccacatggcatggactcgatcgacgcacacggtgccggcagattccccaattcttcccaagctttttttaacccaagatcacacctccattgccaagaaatttaatgcccaaatcaggtcaaaacttgcagccacagctagtgtactactctcccagcataaaataatagtaattaagaacaagccaagccagctactacactgtgttagctactcctaaccagtgcaaagtgttagtgttaatctctctataaaaccctactagtggcctacctgatgccttactctggagtctagagtctggagcttgtagtgcagcagctagctagcatcagcagcagaagaaaaagaagaagatcaaagtagcaattggtgtgtacaccctagtgctacttctactactactgatcaactggtagctagtactactctccactgtatctctactatcctcaaatcagctagccactgagtgagctgatctctagacaccagagtgagtgctactagctcttgtgtttgtgtgtttgtgtgtgtgcaactgtgcattggtctcctccaaggcagtctagtctgcacctttcttggatctgaagctcataggcaccttaattagccagggagagtaccattttcttggttctctcatcatcagggtcacagaacaaagaattacagggtgagtagtactgttcatatttgatggttgattggttggttctgccaaaattattcatcttgttgtgttttgtttgtagtagtgtttttagctcatttgatttatctttttttgtttgttgacaggtgagtgagtgagtgagtgagtgagtgagtttgttcatcagaggtaagactgagaaattgaagttaaatcagcagcaacagcaacactgcactgaaaagcacaagatcttgtacctgagggggcaagagggcagcaagcaagggtaacctaaggaggaagcaacctcacatggtgagttgctggaaccaagcctagcaagctgcactttccaacggctagctcatcgtcggcttctccggcgccgcgacacggacaccgaggcgacggcggcggccgcagaggaagagttagctagctcgagctaggtgaggcagcaatggcgcctcctccgaacacgtactcggagtcgtggtggggtggcaaggaggagcggggcacgccggtggtggtgaagatggacaacccctactcgctggtggagatcgacgggccgggcatggcggcgccgtcggagaaggcgcgggggaagaacgcgaagcagctcacgtgggtgctcctcctccgcgcgcaccgcgccgtgggctgcgtggcgtggctcgccgcggggttctgggcggtcctgggcgccgtgaaccgccgcgtccgccgcagccgcgacgccgacgcggagcccgacgccgaggcctccgggcgcggccgcgccatgctccgcttcctccgcggcttcctcctcctctccctcgccatgctcgccttcgagacggtggcccacctcaagggctggcacttcccccgctcggcggcggggctcccagagaagtacctccggcggctgcccgagcacctgcagcacctcccggagcacctccgccgccacctgccggagcacctccggatgccggagaaggaggagatcgaggggtggctccaccgcgcctacgtggcgtggctcgccttccgcatcgactacatcgcctgggccatccagaagctctccggcttctgcatcgccctcttcatggtccaatccgtcgaccgcctcgtcctctgcctcggctgcttctggatcaagctccgcggcatcaagcccgtcgccgacacctccatctccaacgacgacatcgaggccaccgccggtgacggcggcggctacttccccatggtgctcatccagatgccaatgtgcaacgagaaagaggtaatcaattatattgacaatgttttaaatagcgagctaaggcatttagcggttagcttctcaaacagctatagcgacagctgtagcaggctaaatggagctatagcggctaaattgtacataagaacaaatagctagaacccttctaaaacagctatagcgggagatttaaaaccctatgtacactacatattgatatggagttgtttccgagcatatgattatgaaattaatgttgtgttgcaggtgtatgagacgtcgatatcgcatgtgtgccagatcgactggccgcgggagaggatgctggtgcaagtgctggacgactcggacgacgagacgtgccagatgctgatcaaggcggaggtgaccaagtggagccagcgcggcgtcaacatcatctaccgccaccgcctcaaccgcaccggttacaaggccggcaacctcaagtccgccatgagctgcgactacgtccgcgactacgagttcgtcgccatcttcgacgctgacttccagcctaaccccgacttcctcaagctcaccgtcccacacttcaaggtaatatacataccccttcattctaaagaaaagtccaatcctatcattgaatctggacgtagctagagtttgtctttttttttttagacagagtagtaaatagtacatgtcacactcttcatcttctttaagcaatatatatgtggagatttcgttgagcaactgaaatcatccgatttctgcaacaaaccgtacactgattgagtaatatcgaaacactcttctgcaccctgtttataaattgatactagctagtctaatagtatatgtgccaaatgtgcatatatataagtatatgtccaatgggattgaaagatgtgtgccttcagttccaagtctcagatctcaatggccagaggattgcattactataagttagccagtgttgaatcgcgggtagaaatattccctaagagctcgagatcagtatagtatacaaatgtgttgagattatgctttggtattagagcctaataaaagccatggcgacttacaaggtctgtaataaacctctgcctaattaattagttagtgattatttataatagtactactactaacaacatgttaagaggggtatactatttggactttggacatgcaagtaataagcgtttctgcagttagggcatgcatgcatggaccatgtaagtccaaatcatagattcggtacagtagttgacctccaaagattggctctccttttgactaaactgatgcgtgcgttcacattactatacatgttgcacaactgccgaatctagcgatacagtagtctcatctttagaataaacttaacttcatgatgcaaaatatgggacccatcagtcagtgagacacattatcacaatccattaatataaagggtctcttatgtttcattaattttatgcatggattatacatttttagaccgttttagatcggagatctacaagtcgcgaaagatgaggctaatacatatcgaatcccaaggtcaatggaatcattttgtgatttaatttgcttcttctagaataaccaattaattaattaattaattaacaagcggataattaggtcaaacatgttggagatcgatcaatcaaacaaactaaactaaatcgaaatgaaattttgtgtacgtattacaatagggaaacccggagctagggctggtgcaggcgcggtggagcttcgtgaacaaggacgagaacctgctgacccggctgcagaacataaacctgtgcttccacttcgaggtggagcagcaggtgaatggcgtctacctcagcttcttcgggttcaacggcaccgccggcgtgtggcgcatcaaggccctcgaggactccggcggctggatggagcggaccaccgtcgaggacatggacatcgccgtccgcgcccacctcaacggctggaagttcatcttcctcaacgacgtcaaggtatgtatgttaaccatgcatccagccatccacatgtccatgctccatggttgtttaatcagggttttaaatctccgtctaaaaagtgttttagctatttactctcatgtaaaatttaattgctatagctgtatttatttagcccgctatagttatttgagaaggccaaccactaaatatcttagcctgctatttaaaacattggctatggctactatgattgaacgatgccatttgttgcattcttgtattattctaggtcctctgtgagctgccggagtcgtaccaggcttaccggaagcagcagcaccggtggcactccggccccatgcagctcttccgtctctgcctcccggccgtcttcaagtccaaggtaataacctcatcgacgccggcgcgccggccgccgccattgctaatgagatgaggatgatctcgagctaattcagctctgacactatattatatgatatttgcagatctcgacgtggaagaaggcgaacctggttatgctgttcttcctgctgcggaagctgatcctgccattctactcgttcacgctcttctgcgtgatcctgccgctgaccatgttcgtgccggaggcggagctgccgatctgggtgatctgctacgtgccggtgatcatgtcggtgctcaacatcctgccggcgcccaagtcgttccccttcgtcatcccttacctcctcttcgagaacaccatgtccgtcaccaagttcaacgccatggtctccggcctcttccagctggggagctcctacgagtgggtcgtcaccaagaaggccggcaggacctcgtcggagtccgacatcctcgccctcgccgaggccgccgacgccgacgcccggccgccaccggccaagctccaccgcggcgtctccgagggcggcctcaaggagtgggccaagctgcacaaggagcaggaggacgccacggcggcggcggcggcggcggcggcgccggggacgccggtgaagaagagcaaggcggcgaaggctccgaaccggatcttcaagaaggagctcgcgctggcgttcctcctcctcaccgccgccacgcgcagcttgctctcggcgcaggggctgcacttctacttcctcctcttccagggcgtcaccttcctcgccgtcggcctcgacctcatcggcgagcaggtcagctagcgaccaccaccacaataaagaaaaaaaagccaccgccgccgccgctgccgccgccatgcgtgcacagcgcgccggctggctggccggaggcgaagacgacgacggccagccaagacacttccatggatcgacagaggattacatttttagccttcttctccttatttttatccctttgatatattttttgttcagagataaaaaaaacagagtgcgtctccatgttacaaagaactcttcttttctttgtgctttaattagctagtgctttgttgctaggagaggcaagcaggccgcatcaggttgttaattacattcagattaagttgtgtcaattcagtagccacatcttgctaatttgccacattatgttatgatcaacatggtgatattttgtaacagatactgtactacatatcaatggataaatcaaatcttgtatgcaagtttaaagtgttcatcaatatctgtgcttgatgttggacgaaattgctatttaggctgtgtgttcggaggtgggtattgggaacctatttcccatgcacagaaaacggagcggtccattagcacatgattaattaagtattagctatttttttaaaaaaaaaggattaatatgatttttttaaacaacttttgtatataatttttttatataaaaaacgcaccgtttagcagtttgaaaagcgtgcgcgtggaaaatgagaggtgagtgttgggaacttgctcttgcaaccttagcgcagctgcgttcccaccgcacaagttttcaggttttgagttaaactttttttctaattcaagatgaaagtttgcacaactgaaagtttcttataattctaagttaaaagttgtatgatttaatttggttgaaagtttcatatggaagtgctattaaaaggaaaaatagtgtgcgctctaattagcaatcacttgtattgaatgatttatttattataaggcaaaaggcctgtccccaatagtatggagtagtacgacggagtagtagagttgagctgaaatcagttgggctgaggacgcacgcatggtgagcccaactttgtgcatatccagcccaaaactaggccacaaatggaccaattgcataatgacataagacaacaaattccaacaggccagaatcaacattcaaagcccattacattcatgttgcagcctgcaacagtagcgtaacaactcatctttctgccaagcagtgggctgggaaggagtacttctaggggaataagttcaccagagctccctcaacttaacagcgagattttttgaggtccctaaaccacaaaaccagaaatgttaatcccttaacttactcaaaccatgcaaaggaggtcccatggtagtatttacacctgattttgctgacgtggcatcctagtcagcaaaaaataaaaaaataaatatgcggggcccacatgtaagtgagagaaaatggtgtaggcccacatatctcctttcttttatttttctcttctcttctctcctctcgagctggcgcgatggcagactcgggcgtgaggcgaccggcagcagagctagggcggcgacagcgggagagggggagaaagacggccggtgcgatggcaagctcggcagcggagagtagcggcgcacggcgcggcggcaggggagaggagcggcaggagagggggcgccggcggtagaagctacttctgatatgtgccacccctgctgtcgccgccgcagccgagcatctggagcacctacctccgcgtggcgcccgcagcgagcaccagggagacctgaacggcaggggcagacacggccgcgttcccggtccccgccgtggcgaggatgcgccccgcgagtggctggcagaaggtgcgctgcgccgcggctagctgctaccgccggtgtggccgacttgttcttcctcttcgtcctcctaccccttctgctcctcctcttcctcttcctcctcacgccagttgcccttgccgcgctcgcggcggcgctcctcgctctcaccgccgcggccaccgggcgacatgtgcgggaacatgtgcgggtacacgatctcgggctccccctcgccatctaggacatacgcgaccttgaccgaccgggtgttgtagaatggcgcgttcatggatccctgcaatacaacgcaacgaaaccacgcgatcatataccaatcaatccaatgcgcagtgaggcgagggtgcatggcgaggcgcgtggacgacgacgcaaacacaccgcggtgatgttgacaacggcgacgcgaatgtcatgctcggcgaggtcgaggaagctgcgggtgttggcctcatagaggcggccgtggcggttggcgaacctaggcctctgatccaggatgttgaagggaccgcacgacgactcgccaaatggcagcagcggctagtgctgtccatagccgccctccgacacgtagtgaccgacggagtagagtggagtggcggcggcggcgaccttgtctccctccgtgctcgcccgtcgccgcctgcctgctccgcccgctgccccacccgcccaccggcctcttaggctcggggaggaagaaaagaagagggaggaagaagagaagaggagacgataggacaaagaaaagagaagaagaaaaaagaaaaagaaaagaggagaagagaggacgctgacatgtgggtcccaccatatgccacgtcagtgaaaccgtagaaaaattaggtcaatactgcctagggacctttttttttacacggttttttatagtttagggggtggagatttctggttttgtggttaatggacctcaaaaaatctcgctgttaagtttagggacccctggtgaacttattcctacttctaggcgatgcaggcatgctgggcttttacctagcaggctgcagacgtcatcggggataagctgggctggccaggggcagctggaagccgctttgctgatattaggccggcccgatatcctaattagctttgtgtccctaaattatgggcaagtctgttttgtctccctgaaccacaaaccagatgttttatttcaccggttcattttgtgtccctagcagtttagactacgttttagtgtcggcgtatattggggtgtgcctatgatcgctcggagtgatcaccccctattcaccccccccccccaatacgctcctctctctcttcttcctcaccttattctcttcctactacaccataaattttaaaaaaaataaaaaataaagttggaaaaaattatgtatagaaatactatatgtaaaaaatatttaaattcaaatttaaattgaaagggatatataaacttttgacttataaactttaggtctataaactttaggtgtataaactttaaatgcatagaactactatatataaaaaatatttgaattcaaattcaaatttgaatctgatatataaacttttgacttatatttggatctctaaactttagatgtgtaaacttgaggtgtataaactttaggtgcataaatttattaaaatagaaaagtaatacggtgccaaaaaagaaaaccacgtggaggaggggaagttgatcgctccaagtgatccatcgccctttagcctttttgcgtctatttggcacattaacctgttcttcagttcacttcagaaaaaaaaaaacaattggacgcaagtgtcatcctctctctctgttgacaaaaaaatcgaacacatcggcctgggagatctgcttagctcctatgtaggtccaaatattgatgagatgcgggcgtgccagtcagtttgatcctgcaactgacaagatatgcaaatagtagatcaaaacagtcgatcggctgataagccgatggagtagttccagccgatgccgataatagccgatgccgataccagccgatagcgatagggtgtaagcaatcggctatatgtccaatgtagatgatgatataaaggcaatcggctgttgataataaaatataacaataatatagttcagtataaaccaatcggcagataatgatatgataaataagcatcgatccgaaggttaaagcacaaatcggctggaggtccgatgtcatgaaatttacaagattagattaaacaatgaaacctttgttgtcatcggctaaatccaacctatatgtatatgcaatccttatgagtcgatgcaacgtccagataactcaccggctgaaaccccgatgaaacccttattggcaatcaaaagcaggctagagattatggttctaagcacgacttagtagatcaaacttaactgatgcagcactaagtatgaaaagaaacataatatctagacaatcaagccattgattgtgttttcagggtggtagatgtctaagctaatctaatctagcaaagcgatttagccgataccggcagaaaccctaaaacgagaagcagccgatagtgctaaattgatatgctaagactagactaacagagacatatgataaataggtagacaaatatatcatccaaatcagagcaatccaagaggtcgaatgtattgatgcaacctttaacgacaccgatgtagatgagacaattgcctgggccggcagaacattggacttatcccttcgccagagatcgaagacgatgcagccccgcatcgggtgccaagttccgccggaacgtaaaaacaaaagtagaaaaggtaaaaggtggcgatgcgccgaattgtattgatcgtgaagatcgattacatagaccccgggtgtacatatttatacccatgggttgatacaagtccttgtcggacaagaaagaaactttcctaaagataaaaggaaaacataaagtccttatcggacactaaacacaaaggaagctaacaaactattcctaattaatagataaactaccatgccgcatcctctttaaactcggtcacttagggataagcttcctttagtagattgatttccttaaccgaatatagcaggaatccgactattggcgacttgataactcccatcggctgattccgagatgctgcagccgataatgattctaagccgatgacgtctttgccgattaccaaatttcactgttaacactctcactcttctagtgggacccatatgcaagtgaccacgtcatcttcttttctctatgcccttttaactctctccctcctctcttctctcttccctacattagcgccgcagtagcaacaccgacctctagcaccgtcagcaactccatcctcaccactactgcataacaccttaaaggtgccagttgcaaaactggcatacatgtcggtttcacatccgacaccaatgacattagatcattggttaatgtcattggtgacggttatagaaccaacacctttgtgctctctccaaaaatttttttaaagaaagagaagccggctcgaagcattggctcattgagccggtgctttcgagcgtcctcctacaagcagcccctaatcccatacatcaatatcacatattaaccacaataatccctatcctcatccatcaaagaccacagatcaacaacagcaatcctcatccccaaccatcgcagatcacagattaacaacaataatcctcatccctatccatcacaggtcaacactagtaagatgaagaactacacaagatgaagaactacccaagcagtcgcggagccaaggcccggccagcacgggcaggtgcccgggctccgccgcatatgcatcaatgcattagaactaactatggtgcctagccattaacctagctgcgtacatgcaccattagattagcactaattatcatacttagtcattagctaataccccaattttacttctatccatgataaaatgctatatgtatttgtgtttacgtgttaatttgttttctatcgttaggtttgcctaggctaaaaaaaaatttctaaatctgacactgtacccaagcaatatgaacccactctctctggatcctataatagatgccgctattttaaagaactggcacctacaatatattataggtacgattttaatttataacaggcaccaatagtcgttcaaaggtgccgatttcatatttttctctctcatggaggtgggaaactgtcaataggtgcccgttttttaaaaactagaacctatgagcaggtacctatgagggttttttaagtagtgcaccactgttggcagtaacgaattaaaaagcagagctaggcggccgcaatgatgtacctggaccatgatgccaagtgtgcgtggccaacactggggaacatttgaccatatcaacgcctctcctctcccaagctcagtcagaaaaaagaacagatcgacgtcatcgttggagagaggttccaattctagctctatgacatccactacggcaggaagggagcaggagaggagggcagccacgaccgctcaggaagaggtggagtggagcttgataggggaagggggtgtggaagaaaacaccgagagggtggtgacctcgcaagatccactagtgcataaggcatcgtctactccgccccgtcgatcttcctcccatggtgagccggcatggagagttggaggtcgaggtttgtcaaggcgaggatgggtcctttcgacaacgacgcaaggagaaccaattggtgctaagctcgaccccaagcagccacagcgtggaagcaggacgcaactgtctagatggcaagtggaggcgagcctctatgccaggccttccacctcatcggcggacaatcattgattcctcccttggtcaacattgaagagatgaggacaaggaagctaaggtgttcatgacaagtcaacgaggttccctctaacttaagtcaaaaggacgtgtgttcgtgacgtgtggttccatgagggtgggtcccacttatcagggatccatgtccctcttatttaagttaacgtagttttaatttaaggtacctttgtctactactatcagtctagcaccttgacgttggtaaggtagaatgaaatttacagtaaaaaaagtaaattttgtaaagctacaaatattttaactacgtaaaataataagatttataaggtgttgaatcacaaaattacagatttgatactaaaattatcataaaactacaaatttaaaactaagtatcacataactacagatttagtaacaaaaatatcacaaaactataattttagtaacaaaattatcacaaactataagtttagcaccaaattaatcgtaaaactaaacatttatagctaacataatagtagtgctaggaatttaagctataaatagtagttttgtgataatttcaatattaaaactgtagtttttgtgatattcagctctaaattcatagttttgtaacaattttagtgtgaaatatgtagttttataacgattttttgtgcggaatatgtagttttgtaaagctataaaatagtagttttgtgataatttcaatgttaaaactgtagtttttgtgatactcagctttaaatccatagttttgtaacaattttagtgcggaatatgtagttttgtaatagttttataggttttgtaatagtttggttaaaatacctgtactttgtcaaaattactttaaaaatagatcatcaagcaagtgcttagtcatagtggaatgtgggaactaatctatactgcaatccttcagatccgctgtcgcgtgggacccacctgtcatccctaagaaagaaaccgcaccgcgtgcacccaaaaaaaaaaggaaatgctgcgaaaaacaaataacgcgcacgcccgccggacctaacccacgccgtgccggccgccagacgccactgctccgcccgcctgaattcaccgccgccgccctcccccacgccgccatctccacggccctcccacgccaccgaagccacgccgccgcgccgcccgcctcacctcaccgctgagccgcacttccccccgctgcctcctcaactcctcgccgccggccggtaccctactccgcttgcaaccgtcgccatcggagccgtggatccgtcgccgccctgaatttcacctgcatccgcccgcttgtgacgtgtttgattttttttttgtccccggtgattcgattcaaattcaatctgatcctttgttggttttgattttttttgtgttctatatgttgttccctgtggtcgtcctttcgccgtgttcggttgttgcaggagcggatttgattggaagttcccaagtcgaggtctcaaggaagaggtcagtttcccgtctacagtccggtcgtttgatttagtcacttgggtcggtgattgatttcagatttgagtggttgattacaaccttcaatcgatggatggatgatcatcggtttctatcagtccttacacgaggtgattcgataccctgggttgattgttatttgtaaccgctgatctggcttgtggtatgtgtttgtgctcctctagatgatgcaggaaggagagtgcctgttgagatgaaccgaattggtggaggtttgattattatggtccaggttcatggttgctttgattattagttagattcatgatgaataggggtggtggaggtttgcttgttatggttcatggttcttttgattagttcatgatggttttgaaattattctgacacgaaagtttgtggtgccgtgacaaccctcactggatttcctttggtcagatcctcaaaatgtgcagatttctaagtggtttcgagatagatgtacgagagattgtcagatggaatagcaatgctttgtttggattctgacccccccccccccgcgcgatttgatttatgcctgaaaagtctgatttgggccgttggttgttcttcagaattgttggagttgcatctcatggtgagtcctatttgctgcatgaattggaatcatacatacaggccgctggcagttctttttgtgtgatcaacaattccccttaatcaaattttccatgtttttcgtcagtaattcttagttcttgcagatagcacataacaaagatggaatttgcaacccaaacctgcctcggtctacgagctcaagacaggctttatccctatgcactcaatctttaattcatgttttctgtacttaggctactttcttccaaaataatattcttgctctctgtaggtctctgaataggagtaatttttttatggcccgtctcagtgaagcacaccaccattttctcttcaattcgtcattagaagttaaatacttacaaagttgaatttcttcccaaataaatgttctcttgcttattgcaggcctatctcataattttgcaagaccaaccttcaccgagtgaaatctttaaatcaccgccattctcttcaattcatcattagaagttaaatacctcacaaagatatatttaaatccaatctattactcactacaggtttctacataatttctatggccaatctgagtgaatcctttaaatcatctcccctttctcttcaatttatcatcagaagttaattgcttgcaaagttgaatttcttctcgaatatttgatgattctgaacaaaatctgctcgaaagttgccacaaatggtctgagagaatagtgaaataagaagaaagtaattggccgaaagaaagctctgcattcgatgtacacctcaaaataatttgagtttttgccgttccatatgaattcattgttagctgcaagtttctatactagatgaacaattcttacatgtgtgcggagtgcactaaatttcccctgaactcccctgattcacaagcatttttaatagataaataccagcacttttatgcatgtgctgcttccttcggtgttatgtatatattaaacttagaagaatttcttctacacaatacagttgaccttttattggttcatgtaaaatttaattgttctgtttgtttctttacagggaagctatgaaattatgagaagtagcatgcctaagttgactctcttctgcttgatatgatgtcctgaacatgcattgttcaggtgagcatagttatctatattgagatcccttccgcatcgtgatcgcgtccggcccacaccccggtcatggccattctgtcctctaaaccttccagataaacaatttaagtacgtctccactggtatattttggtattcatttttggatttttttttctcttgtcttttagaacttgccaattttgttgtttctcaggaaatagttaaatgagtattttggctttgctgtttatcactacctaggaagacatgtcatgatttcttttgcttatccaaagtgtcaaacattttattttattagatcctatgctaaactatgtaactgctgctgatatcattttgtaattaatactctgcattttgtctacatgattttgaatcgaggcagcaggagcaaaacagctttgttcgaaggactcaatgctaggaatagcatggggttaaggcattgaatattcctctcccatgctctggaccgtttttctgttggcggtctaagtcaggcattgctccagtattagcttttggatggctttaattttattttgtgaaatttgaatctgataaaagtacatgaataaaaacttatgttatttcttatttcatcattgtaaactatgagatcaatctagccccaggaggtgtttgacaatatttgaatgtttattgaatcaactacctcttggatatgggatcgtctgagaaaaatgtgtgttcaatgatctatatagattctctccacttctggggctacagtattgagcttgttatgaaaatcaaagcttgaatttccataaagaatcataaaaaaagccacttaaagcatgttgtataatatccaaggtactttagttattcactggaagggatcaaggtaatataaagccacggttttgtatactatacctggcacttctgatatagggaatagttttcacttttagggaactaccgataaatatgtttatttttccaaattatcacacctttttttcctggaccatttatctttcctatgctaatataattatttggaaagtctcgcaatcgtattatcttttctctgataatatttcttttatatatttcacaaggttgcatagctgaaaatttgcagcccaaacatttcttctttaaatggcatcccataattaaatgttaaactgtttcttgctaacttatgtatttttcgagcttgcatggtgaaccatcaattctgaattatttgtacttgtctgttttgtcaattgacattcaagcaaccaacaagcacctgaagctatcctgatatacaaaccctgtgtggtctatctataaatgccgatattctttttatttgtttgaatctttagatagataatacgcctaccacaacgttttcttgaatgtgtatacattgggaactagcatgtatacttaaaatcaacaacaagaatgtatgttaatccatacataaatatatctatctggattggatgtagccaatctgtacatgtactaaatttaaaatagcgacggataataatgattcttccataggagtgtccatgacattaaaaatgccattgaagaggcaaatgaacacacaaaatattaggcaaataaaaagggatttgcaacaccaattggcactcctaatgcttaacatgacttttgtgcacgatctacataacaaaaacttttatatatgtctatccgtgacgtgccttgcacgtgcacgctcactagtaataaaaatggaccagctgtggaggaaaactaaggtgaaattttttatctttttagatcaaagaacatggtatatgtggacaacataacactacctgatgtcaaagaaaaaacataaccctgtgtatgttaatctgtatagctgaggcatccaccagagcatgcatgtgcagtatattattggttgaatttggaaaactagaatacgcaccatataacatatatcggtcaacattatcataatccccaaataaaaaagataactttaacaacaaaaaagatgcatctggcatgcagctactaaatccaaatgaacaaaattcatatctcccaaacaattttggtcaaaatggattaaaaactcaagacgatgtcaagaaatgaaaaaaaaatcgacatgctgcatctgcctatttaaagctcaagaacattcagaagaatggcggcgaaaccaaacacaacaatcgcatgatcagctagagatcgaaacagagaaagaccgtgacccatggcgagcggcggcggcggcgtgaggctgaaggccgggacgcggccgccgtgggtggggctagcggcggcggtgtgggtgcagatggcggcggggaacgcgtacacgttcccgctctactcgccggcgatcaaggcggcgctggggtacacgcagcagcagctcgccgtgctgggcgtcgccaaggacgtcggcgagaacttcggcgtcgtcgccggcgtgctctgcaacagcttcccgccctgggtggtgctgctcgtcggcgcggccttctgcttcgtcggctacggcgcgctctggctcgccgtcagtggcgccgtcgtcgccatgccgtactgtttggtaagcactcatctgattccaaccagaattcaatctttggtattttcaaaacttgtattgggatgctgatatggcgatattttcaaaactttggtccaaaattttaaacaaaatttagtaacaaatattaccaaaattcatgaaaaattaaaaattttggccgaaataatatcatatcgaggatggtgatatgaccgaaatttcagaccctgattccaactccatcaggttaaactacatgaaatagtttctttaaatgatttttcgagaaatattaatcactcttattttctatagcaagtttataaaaataagactatataagtacaaacgaaactattttagcaaatctagccataccatttttaactattaaaaataattctccgttttatattataagatgttttatttttttaaaaaaaattatttgagtatgattaaatttataaagaaatgtaggaaacaaatatactatcaaactatagtcaatatattagatttaatgaaactaatttaatttaatgatataaagagtaaatcatcaatttttctatgatcaaatcttttaccttaacaaaatctcaattaagtgcaacaaaggttgtattaattccgatgctattgatgacatcacataacagctatggattgtgctagcaatggcaacaaacagcaacgcgtggttcctgacagccgtgctggtgaccaacatgcgcaacttcccgctccgccgcggcgtcgtcgccggcctcctcaagggctacatcggcgtcagcgccgccctcttcacccaggtcttctccggcgtgctccaccgctcgccgacgagcctcctcctcctcctcgccaccggcctccccaccatatgcctcgccaccatgtacttcgtcaggccctgcacgccggcgacgctcgacgccgccacaaccgacgccgacaccgaggaagacggccatttcgccttcacccaagccgtgagcgtcgtcctcgccgtctacctcgtgacaaccaccgtcctcggcaacgccatcaaactctccgatgcaaccagctacacgcttttcatcgtcaccgtgcttctgcttcttgcgccgctcgcgatcccggtgaagatgacattgttcaggagttcgccgcggcggcggagtacagaaacaacggaggagccattgctgatcccgccacatgtggtcgtcgacagcggcggcgatggcgacgaggaggaatctgacaaggtggatttgctgctagcggaagggaagggggcggtggtgaggaggacgaagaggcggcggccgaggagaggggaggacttcgagttcagtgaggcgcttgtcaaggctgatttctggctgctgttcgttggatacttcattggagttggaacgggtgtcaccgtgctgaacaatctggcacagattggtgttgctgctggtattggtgacactacggttttgttgtccctgtttgcgcttggtaacttctttggccgccttggtggaggtgcaatttcagagaaatttgtcaggtatgtgtgttatatggaaaaaaatagctaatttttagaaaattttgttgaaaagagaccgaaatttttatagagttattggcctgtgcattgtaacggtttttttattcggtttagtaaaaaggatttggacagagtgggttgattggtcttctatactatggttgggtttttaagaaatcggttttataagatggaagtatttttagaggatgaagtgcgggagaggaatggaaggtcttttttttttaagtagttgagaaaatcagaacagtccaaatatttattaccaattcttttttaaagaagtgttattctgttctgtggttaggtcgacattgttggttcctaggccaatatggatggcgttgacgcaaaccgtcctcgtcgtcgcttacctctgtttggcctatactctcggcccagccgtcgcctacgcttgcacggccaccgttggcctttgctacggcgtgcaattctcagtgatgattccaacgacctcagagctgttcgggctcaagaacttcggcctcttctacaacctcatgtccctggcgaacccgctcggcgcagcgctcttctccggtgagctcactggtcgactatacgacgaggaggccgcgaggcaacaacattctggtggtgtgtgccttggcccaggatgcttcagggccgcgttcgtggtgctcgccggtgcctgctcggtggggacggcggtgagcttggtattggcggcaaggatacagccggtttacatggctctctactctggcgggtcgttcaggttgcctaacgcgtcacagcaacattgagctttgcatttctttgaattgagttgttgttgcatgtcacgcgcgcgttacattaaattttggataattggattgctagcttggtttgtgaatattgatgacatgcatattattgaaaatggtttatgatatgtgaacaagggatttactagtttggtttttgggatcttttttttatgctggtgaagttttaagtttgtgagtattaccttatagataataagaagagtgttctatatgaaattacgaaattcgctagtatgtcacaaagtttagtggcgtactcacttttaccacaaagttgacgattattgcagattattcataaagttgagtgggaatgccatatcatcctttaagtactagaattactctcgtcttcttctccatcttctttctatctatcccctctcgttctcaactcttgcggcattgccaccaccactactcccatatcatcctcaactcctacggcattgccaccgccactgctctcatactgagcttttgatgcttgtcaacctgcctcaatgccattgtctaccctctccgagctctccgtagccgctactagagctcgcttgctctcgtgcttgcttgcctatcggtgaatctactgtgcgtgtatgctcggccgctggctttgccgtcagtcgttcgctgcgccgattgctcacgcgtgctcgccaatgttcagtccgttgccgctcgtccttgcggcaggcgcttgctagtgctctacgtcaacagcttgtcgatactcagccaccatctctcgccagtgctctactcacggatgcatgtcgtcgtttcgtcgagaatccaagaagagatgggaaatgaaagaagattagggtagaaaaagaaggtggggggcaaacgagggtattctgctgaactttgtagcaaatctgtaatgccacttaactttgtggtagatgttgagtatgctctccaactttgtggcgtatcagaatttttcatgaaatttgtttatttgtgttgttcttttcttatgaaaatgacatttattcagaaattcatgccaaataatttggatgatgcagaccgtatgttttataaaggagctacgaattgaaaaaaaaatacatctcatattcacatacccattgatcaatttaatttatgtgttgtttttgtcccatgttagacttcttcgtcttacattaggatatctcaatttctatctggagatggctaaatgatttctgacatcaaattaacaaaagatcgtagatgagatcgatctcttgtcaacatcggggctgttcaaattaatgcaattttcaaccatactattttttaagtaaagttgtcaaaaaaaaatatagtttgttaccaaatttaataaatacagaagaaatccttccaaaatttggtaaggtttatttttggttataatttaaacaggcccatcgacatggcaaatgttctctctctcttttagaaactatggcaagtgttctcgttggggaaaacgaaaactgaagtgaattttggcccagcccaaaccacaaacctaaatcgacaaaacaagtcttaatcaatcacaggccgatctgcgttaacagagaggaaacaaaatcatcccccaaccacaaaaccagatatccgatattcccttaactaatcaaaaccggccacaacaggtccttaggtggttttgactcc

SEQ ID NO: 58913 - DNA, 20703 bp, Oryza sativa
  unsure (1)..(20703): unsure at all n locations
ctcttttagaaactatggcaagtgttctcgtttgggaaaacgaaaactgaagtgaattttggcccagcccaaaccacaaacctaaatcgacaaaacaagtcttaatcaatcacaggccgatctgcgttaacagagaggaaacaaaatcatcccccaaccacaaaaccagatatccgatattccttaactaatcaaaaccggccacaacaggtccttaggtggttttgactccggttttggcctacgtagcggctgagtcagcatgggacccatgtggaccccgcatgtcatgatgccacgtcatctctctttcccctcttctctcccttcctcagatggggcccgcttgtcaagtgtctcttctacctccctccctgtgcgccaacacagagaggagaggaagagtagcgaaggacgacgtggctccagcggccggcggtagggaggtcatcggggcgaggagatccgacgaccggccggaccaggcctgcgcctcccgccgagcccgttcgggctgcccatcctgggccacctccacctgctcacgccgctgccgcaccaggcgctccaccgcctcgccgcgtgccacggcccgctcctttacctccgcctcggctccgtcccctgcgtcgccgcctgctcgccggttgtgatattctgtcatggtaattagcagtagatggacaggcatcagtgacactgccgagtatccataccggttgtgatatactccctccgtttcataacgtaagtcattctagcattttccacattcatattggtgttaatgaatctagacatatatatctatttagattcattaacattaatatgaatgtgagaaatgctataatgacttaaatcgtgaaacggaggaagtagaaatagaataggcggtgatactaatttcaggtaaaacgaaatgaaatcacagtacaattcgcatgacataataaatccattgttgttaattgacagcgctacgctacgcataccatttactctgagcaaatcatacaccaattgattctaacaagttactatactctactctgcaagcaactggttaggaaatgaaaaaaaaaaggaaaaagaaagcaaggatcgaatctaagcagctgattccaacgagcaacaaggaaaatgggggtagaagtagaagcggggcggtgagaccagaggatggaggcgcaaatcggtgagctcggaggcgacgccacccgccacctctacctcgatgcggccccgaatccacctgctccgggcgcgtgggtctcttggtggccgggaaggagaggcacgggatcgacgatctggtggcggtggcggcggtggcccgacgaggaggaagaggcgacacggggcggggagaggagcagcccgctgtgcctctgcggctccgcttgatctccggcgaagctcctctaccgccgccggcggctggtggagaaaggtggacctcctcgccccgacgacctcctccccattgccggccggccgctgctgccgagccgctggagcctcgccgtccttctgaggaagagacacctctcttctctgtgttggcgcagggaaggaggtagaagagacacctgacaagcgggtcccatctgaggaaggatgagaagaggggaaaaagagttgacgtggcatactgacacgtgggccccatgtgggttccacgctgactcaactgccacgtaggttaaaaccggagtcaaaaccattaaagaacctattgtgaccggttttgattagttaagggacgccgggtatctggttttgtagtttagggacgattttgtaactcgaggacaagttgagggaccttcgatgtactttttcctaacagagatgtgctttagcggctaagcctaagctaattacggcccacgaccacgagcccggctgaggcccagggcccagagcccagggcccatcctctgcgccgctgccacctcctcatttcacctcgcttatcgcctcccaaatccactcgtccgtctccctccacccatggcggccatggccaccccgcagcaatgctggctccccacccgcgcgcgcgctccccctcctcctcctccacgcgcaccctcctccgcgtcccccgtctccggagctcccgcctccctccgcttccgtgggcgccgcgccgcgtcggcgtcggcgtcggcggcgaggaggaggaggggagcctccctgccctgctcccccaggtagcataccagcatcacttctcgagagtaaaattgcgccgtacgcgcttcatcccgcattggcggaggagctccgcttcatttcgatcttttttttgcttatccgcttcgcaggtgcgcgttggagacggctggccctggctttgatcccctagggctgtacaacgatgggccttcgaggaatgacacgcagtccccgctgtcgaacttcttcggagtactgtcgccggtgttcgggagctcgagcggcggcaggaaggagaagtcctatggacgaggagcagcaggttgccaagttaaccccttcctattttttgtgcgtgtaactttgagaatttgttgttaaatgcttttggaatatctgtactaatttacctatgcagtaccattctacatcattgtaggagcgtgttattacttattaggataaatgcgtagtttgagctgaagacgatgttatgttagtaaattgttagtgaagaaattattgaaaattttccatctaagtaatatgatgaagttctgagagagctaccatgtaatttacgtagtacttagattttttttaacacagatgtaatctggtaatggtaaatcctagagacttcagtatgcgtgaaaggaaacctcttgattacacatggttttgacataatgttatcagcaggatcttgcttgttataaatatgtggaactactactctaacttttcatgttgtttgtaaaattaactcaagttatgttcatatttttctatcagtgcaaaaacttattttacccatgcatgcctcataggctgttactgttcaattacttacgagcattgacctatgttgttcatgtatctgcagcttgaatccactttaaggctcagttcgttccctccctttcccaacctcccttcctcgttttccgcgcgcacgcttttcaaactattaaacggtgtgttttttgcaaaaaaattctatacaaaagttgcttaaaaaaattatattaatccatttttgaaaatttttttagcaaatacttaattaatcatccgttaatcgctgctccgttttccgtgcgtgggagtgaggttcccaaccctcactcctgaacgcagcctaataagtttaaccaactagaattcctatttaaaatgtgtcttaacccaagtagttcccttttgagcagctgcaattgaagatagttccattgacattggtgacttcttcaagggtcctctacctgggaagttcttgaagctccttggttatttggccttgtctcgacttggtatttatatacctctgggtggagtgaaccgggatgctttcgctggtaatcttgaccagaacagtctactaggcactttggattctttttctggtggaggtattggccgacttggaatatgctcccttggcattgttccatttatcaatgcacagattgtgtttcagcttcttgcacaactttatcccaaattgcaagatcttcagaaaaaagaaggagaggcaggaagaaagaaggttcttcagtatacaagatacgcatctgttggttttgcaattgtccaggttagattcttggagcacttatcatatttatttgtcaacatgattgattgaaaattggaagacgtgggatgtcggtttccagggtgccaagggggtacagttagtctcgtctagatttcggagtacttgagcaaacatatctatatgaagctctagaatattatgtcgctagtcgttacattatataccaactgacctttacttgataatatacctttaacctttttgacttgtattgaacatgtcacaaaatatgactgtgaatcttccagattttaggaatgctgggtgctttgagaagttaaagttttttgagaaactatattttttatacagcaatgacctagctctggcgtagaggacaaatgcttaacatatcacaaatactctggaacttatttccacatgctaattggcaaagtaaatatgctgttgaagcacataaaataaaaatcaaccttttgttttacccaattaagtttgtgctgttaagttaactatggaaaaactctgttctgctttgcctggttgtactatactcctagtacttcatagtattttgtggttattagttacaaaatattccttaatttgattgaaaattcggaatgttctagtaccttcctggctggtttctttaatttgtttacttcttgctaggctattgggcaagttctttttcttcgtccttatgttaatgacttcagcacagaatgggtcctcacatctgtgacactactgacgcttggatcggtgtttacaactttcattggcgaaagaatatctgatttaaaactcggaaatggaacatctcttcttatatttacaagtataatatcgtatttacctgcatcgtttggaaggacagttgcacaggcatttcaagatgggaattatgttgggcttctgacaatcatatgtatcgttccttttcttagttcttgggattgtttatgtccaagtaagcaggttttaatttgtcaagatacatatggaattcctctcaaattgctcattgcttatttgagatcacttgggtggtttcaggaagccgagaggaaaattccgctaaattatgcttctcgatacagtagtcggagtggagggctccaacgatctgcatatctaccatttaaggtttgctgtgcttccatttaattctatttaatgtctatatttccatatattttgtgcaagggttgagtttgagcttcagcttttagttgatactctggatgcttctcatttgaatacttacaattcagaactttctccaaatttattgatagtattacatttgcattgtgacttaccacatgttggaagaatgacctatcttcatttgatagttgtggtttcgtgcaaaataagggataattctgaaagttggtatgcagactcctagttgttattcttgattatatgttgtctgtactcttctaaccgttcatttgaatgacactcaattcacctttttggttcactttctatttttctttgtttattactttaaaccgttccattggcacttttgggtgtctgacttaacaatctaagggcatgtttgggggagcttctagctgttgcagcttctcctagaatcagacgctcccccaaacagtccagcttttggtctagattctgagaagctgtagttgtagaatctagaaaatgaactagaagctagaagctgggaaactcagcttttccagattctcagaagctgcctaccagccagttgcttctcagaattttaagctctccaaacaggccctaaataactttgtagagggtgtatggacgaattaaagccagaggatatcacccatatgttctgacttaacaatctaaataactttgatctaacaagagttggagcctgtaggaccaagcacacaattattctgttattttttagcaaatgaaataagatcaagcttctaatattttttttcttaacctctctccatcattgggagtcataattgttctaatttccattttatttgattttttatgtcctaccttacaaattaccaaaggaaatattgcttatgacttactatgctaccattatgagcaggtcaatagttctggtgtcatgcctataatattttctacatcttctttggctttgcctggtactttggcacgatttactggcttagagtttcttaaaaaggctgccatatccctaaatccaggaggtaaacaaggagtttctataattcttttgaaatttgttgtctttatatgggagatggcaatgcaatagacattttgtttgcatgtaaatcactttctgttaacttcatgctgcaggtgctttgtatattccaactaatgtactgcttatagcctttttcaattactattacaccttccttcaattggatcctgatgatcttagtgagcaattgaagcggcaaggtgcttcaataccgcttgtacggccagggaaaagtacagctgccttcataaaaacagtgagttattgttcttccattagaataaatattgttctttcaccgcatccgaatttttagtttatgtgcataatgtatatgttcctgctcatcagctcattcttgtccatctgcttggttaattcggtgcaatggttgtctgttacagaaattggcaatggtccttatctttgtgtagttatcaatggaaactgttttcgtagtgacatgatgtattaaagaactccaaaactcaggttgcaatcctctaaagaagtcagtaaccactaaacagtctgttgtctcctctgcagtgttagattcatgtgaggcacacctgttcatgaagatattctgttttctttatcataggaaatttggagttgtagtaattgcacaacttatgccaaccagactggttaaactcattcatggctcatatcatcagaaaatatcctagatcctatttataagtatcttgtggtatggccaaatgctagtctttggtggtggtaaggtcatttgctacattcagttggttcagaaccacatacaagagaatttaggatgcaatttatagtcaagactttcatccttctggatttatataaatcatagatattcctatgttggttatgtgattcataaactgtatgatgtaaatatgccatcccttggactggacaacatttccctctgttagcgggcatccttactacttctatctttttgaagatcacagtcagtaacttttttgccagaactgattgctgcgcaagacagtgggacatacagttacatttgatatgttatgcatgtgaggggcaccttttactttcttgctgcgtatcattttggagaaattgaacataaaaatctcaaattcaataagaaatccaatcacaactaaagtatatcaagtactgcaaaccattagcttctatattgtgcactgaaattaaattatctcattgcaggttcttagtaatatatctgtcctaggatctgccttccttgctgttttagctgctggaccatctgtggttgaacaaatcactcacttaacggcatttcggggatttgctggtacatcagtgcttatccttgttggatgtgcaacagacacagctcggaaagttcaggcagaaataatttcacagaaatataagaacattgagttctatgatgtcaaccgttttgaccaatgattaatgacactgatcattcttttcaacttgtaccaaatgttctgttgtattataattgggtcatgtggtagcatttaagactgttcaattttatgcccgttttccttctatcgtgcatatcacttgtatgtttacttgaggagcagaaaccatacatccttatgtacataaatatattagaattatttacctcagaatatgaactttctaccatattgctcagacctcatcagctatagtagaattggctgagtacttaatacatgttgagacgatgagaagcagttatttttgttttacatatgaggctattgcaaactctaatatagctggcatatgcttacttgtggacgtgaccctccccacatttggtagccttttctgcgatacagtatttaataatttaagtgagcactaagataactaagtgaacagttattggcgaatgagagtaaacatccaggaactataattatcatacagaaacgatcaccacttgtataattagtacgttactatttgcatcatttgattatattgaatgcagtttgtgttactctggatgatgatcttcagagaaatcaggttcttcaggtcgctccttctgtgcttttttgaatattgatgctatttttgagacagtaactgtttctctgtgtgatacagtgctagaagaaccattaatgtcctcacatctcgtgtcattgaagtcattgaccaatgagaagaatgacttccacctgttgcttagacctacttctgccattttttgtcgattctggcgccttcgccatgctgattggataaagcgagcggcccatgttctccactggtatgagtgtaacctgaatgtgtgctgcaggtgcttggaatgcatcatcctgaatgtgctggctacgcacttaatgtcatcggcttggagggagaatgcttccaattcggcaattgttttaacagttcttgttgatgatggatagctgtctctagagctgggaagcaatgcccatgtaagcaactcctcaccacaaaaatcacctggttttaggatgatggagttgaagaagccagttctgccaccatctgttgtggagctctctagcttgccacgaataatgaagagcatcaccttgacagggtctccctcacgggttatgtaggtgccttcagtgcgaaggaagtaggtcatgcgttcacagatggcatcgagtagttgatggtccattgcagaaaaaaatggcacctgaaattaaaattgaagggagcatactttagctgatcattattttaggatatatgtttactgtctatcattagtttttgttcatttttgtccttaaacatgaagagtaaggatgagtaaaggtgatgcttgtgattgcagaagatatttgcaggaacaggactcacgtacacgttcgacaagatcaaggcacaggtaccgttttatatctcgatgaagatctgctggtagttgtctcaagattgaatcctcttcaactccctgcgtagcaaaccacttgtatttgaagaattgacnnnnnnnnnnnnnnnnnnnnnnnggtatttgatgatctatcatccaatcttccatttctgtttgccacattctccaatcttcagtatttttagaaagagatctcatgtgtatctgtgaagcatttctttttcttattttgtgtactacataagtatataaagtgttactgaaagtgttttacaagataaattacctgcatgttgcctattagttgtgcaaacaaaccaatgctgagaagggttaaccctattgcaaataggttttcaccaatgaaggaactagtcaccaaaggattgccatacgtgctgtcaccaaaaatatatacaaaataacatttcagtaatctcaaaccatgataagtctgctacaaatattgcaagcagcatgaaagaatttgtaagaacaggtcattatgaggttgatgctagataataattgctttctgggtgtaatgcctttttggagcttgaaaaattgaaaatgcattcagtaagtatcgaaatacgaacgtcaactgttgaagtccccaccacagggagtagaaatatttctcagagaatgaagctgtggtcactccattttgtattgcttgaatgaatatgccatagttgatactgacactattgctgttggcgttacaatgtgtgaacacatttgtgctatttgcccaactttgactgttacttgatgtggcatatttgcagtcaaggaagtgtaaatcacacagtcctttgtgtgccattctgtcctcaatagagcactgtgtttcccagcatgtcttttgtcgatccactgcagttagatagaatattgctccaaccacctggtggaaacatggcacaagtaatggtttaatgagataagttgcaactttttttctataggatgatttatgtttggcatattttccaatcgtttatttgatgaagtgtcttgacttaaaaatgcctagtgaaatattgacgacattaattctagccaggttgtatggggctaaaatttatgttttgaaatgggccatgatcctaaccaaattgtcattttatctgtttgcagcaatatctgctgcaaatatgctcaacgttatttatgtacttataaaatcattatatgacagttgtttttgtaatccaggcgaaataactaacacttacgtgacttgccaccaaataaagaactagactgtagatagctccttcccacccattttttgcgatgaaacccaccatctccatgatactaaggctgagaagaattacgatgtataatctgatggcagattggaccaatattataagaaagaaaggggcattgatatgcttgaagctgatagatggcatggctatccaaacaagaacctgcacatagaaagaaataatttaccagcacaaaaaatatcacacctttttctgattactgctgtactatttccaactttcaaatgaaagagacatacttgtggaactggcaatgcagctactaggtcaatgaagaagtttgttctgatgtatctatttgcaatctttttaggatctgtgacaagctcacccctgccaagcactttggagcttggatcaacatgtgcagtggagaaacttatagcaatatgagctatgaagaatatgtcaagaaaagaccgtagacaagtgagtataatggcgagatgatggtccattgtcatacacaactggcggtctctgcgctcaacaattggcaggaagaagaagagaggatcaatgaagtgagaagcaacgcatgagacgaggaagacacggttccacatcagcacaacattgcctccagggtctagcatactctcttcgcggcttatccagattctggtaaaatcctttaacttgagcactatcttgctgctcattgttttaactgaacctgtggccaagttattctgtctgtgtcttgcttcgttctcaataagattaagcctgcagagtaaaaaaaatcaatgaaaaattatacgacctaagtacaaagaactttacttttttgtttcctggagatgtttatagttacagcaatgttggtcaacatatgattctgcaatcattgtacttaaagactggaggtagttgccagtgacttgacaattggcagtaaattaataatagtcattgagtaactcatgtgttgctacatttgtaatgacctaattgtttataatcaatcttgtcagtactaaaaggtgagtatcaacattttctagtaatccctgattaatgcatttttttttataattaaacggtctcgtgaaatgcattcattccaaacttgtatcagtatattgtcggtctgtggggttactgttttattttccccgctgtgaaaccttaactgtgattataccgtactaatgtactagcccaatgttgtttctctataattcaatgcaaaaacgattcctcataggtcaatctgtctcttttaggctcttctttcttacgctatatccaactgagtcccctcttaactcttgacagtactttgcctaatcttacacttttacaaatgacaagctcatcctagtctctttgctcttggaaattctttaaatgattatacatgagaccttgtatgtatatgatctgttcgataataacacagagattcctatattccttagaagcaccacgaggtgctgaatacgttagtctgtgtagaaaatatacctatccaacgctaagaagtgtagtaccacctcaaacattttttaagctctagtacgatgcagcaaatgaaggtgaactgcgttaaatatatgagatccctatttacacctaactgaagtatcagacagtgataaaattaatgatttaaaaagacaacaaaacctcattaaaattaatgttcaaggtgaagaaaacagaattatcggtaggaaaataacaacttaattaatgcttgtaaataacgagcaagttctcattctagcaaaaatatcaatttgaaaataagtcgctaagcgagcagctggtgcatgatttgacacttcaaaaactttacactcatttgcgtcaaggctcaacttattcggtttatatagaacatacaccatccatcccatagaaaaccaacctctggttaggtttaaattccaaaagttgtttttttaggatggaggaagtaaaatacaagtaagacaaaaaaaaaaagagaagatgaaacaaactagtacttgaggaattcttttggaaataaaaattgcactctgttgttgaaagattcaagctcaagagcaaactgaatttatcccccaaaacgtctcatgaaactcctgattcaatactacatcaaatttcagcgaaataactcgagatcatttgacacatcatcaaacaatatgttgaactcacctcatgttcttgtcaatcgatccttttctcaagagctaagcctcctcatccacagccaccaatctcgtctctttgccttttatcttgcacataaaaccgaatttcctagagaacacactcaagaaaaattcaatatatataaccatagaatcccacacatcatcactcactctctagcacgaacacaaaagagacacgggatcgactgccattatctagaagcttctagaacctctcctcttgggaaaacaatggagacaagctacctaggatgagaaagtaaaccactcgttgtagctaggaacactggagagagagagagagagagagagagagagcgagcgagctaggacttcctcaggtgactgcttataaatattctgggagtatgggacaggtgcacactattcaccattgcataaaagaaatgtgaagtccatatttctaaaatttatattagtattattaatctaagatcagatcagaggaacgggatagtgatgacttgatagaagaaagacttggaagaaggtaagcatatacaagtattttttgtttttttgtttttagagcttaggaagtgggtgagtcagagtgtcttgataagatggcacctactgattttctttcttgaataatataatgtaaaatttttgtagggtagatctcaagagggactaaggtagggcgtttgcattgaagcaaagactcattttggactagttttctagtattgtttgaagagcttgagcttcatgttaattgttaaagccaccaagatgtttagctcacataagcaagtgtggctgacatacaatttacttgtcctacttgcgacgtactacctctatcctataatatacgtactaacctaataccggatgagatgtattctagcactatatttggattcatagtcctaaaatttatctcatccggtactaaattgctatattatagatagagagagtcgcctttaaaatttcagcgtactactatacacataagtgtttgagattgtctaattagaacggaatcagtatatttgtcaacaaaattgcttccatataattatatacttgtaatatatacttttaacaaagcagaataaaaaaaaatccttcccccgacaacacatcacaatgcactattgcaacttgccctaccttaaattatcctatagagataactaggcatgcttagctcactcgcttcagcagtttgtctagctaagcttctcagcattgtaacaattgttttcccaagagcaaagataagagttggttacagataaaaaggtgaactacaaaactactccaacatgagctaatatataacacagcttgaacatttttaattacatgaaacacatgtatatatatgcacacgcgcgtatcactactatgcgtgcacatatatgagtaagtaggcatagacctatatgcctacttaatgttagctttaagatttttaccaaagttgctacaaataaaataatggatgacgctcaaaaggtaattagtcctactcaaacagcgttcattcctgggagaaatattagggaaggggtggttattttacatgaattacatcgcaaagataaaagtggtgtaatttttaagattgattttgagaaatcttatgataaagttaaatggccttttgtacaacaaactttgagaatgaaaggcttttctcctagatggtgtgagtggatagcttcttttgttcaaggtggtcatgttggtataaaagttaacgatcaaattggtaatggttttcaaacttacaaaggtcttaggcaaggggatcctttatctcctattctttttaatatagtagctgacatgcttactctattgattaagagggctaaagaggcgggactcttgagtggggttattcatcatcttgttgatgatagtttgtctatcttgcaatacgcagatgatactatcatctttttggagcatgacttgcaacaagcaaagaatttgaaactgattttatcggtatttgaaaagttatctggcctaaaaataaattttcacaagagtgaattattttgctttagtcaggcaaaggaatgttatgaacaatattctgatatttttgttgtaagttaggtacctttccttttaaataccttggaattccgatgcattttaggaagctttctaataaatattggaaacttatagaagagagaattaagaaaaagcttagtagttggaaagccaagcatttatctgttggtggtaggctggtgttgattaattctgttctttcaagtttagccatgtttatgatatctttttttaggtgccgaaaggggttcttcgtaaaattgattattatagatcgcggttttttttggcaaggggatgaccataagaaaaaatacaggctcactaggtggaatgttgtttgtcaacctaaggaccaagggggtcttgggattcataatttggagatacaaaataaatgtcttttaagtaaatgattgtttaagttaattaatgaggaaggggtttggcatgatttattgaagagaaaatatctttataataaatctataacccaagttgacaagaaacaagatgattcccatttttggtctagtgttatgaatgtcaaaagtactttcttaaatatgggttcttggattgtcaacaatggggaacaaattagattttggaaagatagatggattggtaacttggcttttaaggataaatatccatctttgtacgcaattgttcggaggaagacatcttctattgccactgttatgggatctgttccgcttaatgtttcttttaggagagctttagttggtcagaatcttgtttgttggcatgagttttgtgcctctatagtacatattcagttgaatgattcgtctgatagttttagatggaattttcatcagaatggcttgttctcggtgaggtctatgtacctagctttaattaataatggctatatcgagagaaacaagtgtatttggaagcttaagttgccacttaagattaaaatttttatgtggtacctgcttaaaggggttgtgttaactaaggataatttggcaaggcgtaactggaatggcagcttgagttgttctttttgtttgaagaatgagtctattcaacatctctttaatggattgtcattttgcgaagtttctatggagagctgttcagttctcttttggttttaatcttccagttagcatatctcatatttttaataggtggcttttgggagttgataagaaaatgagtaaactgatacttattggagcttctgccatttgttgggcaatatggctgagtaggaacgatatggtttttgacaaatcaccatcatttttctatatgcaggtcattttcagggcaactcattggctccggttttgggcacaactacaaaggtgtgatgaatatgaagagtttctgaaagttgcatgccgaaagttggagaccacggttatacaactttttaccaattatggttggagatttacaaatagacttcaataattgtgatctccttacgttaggctggtttctttgtttttctcttcggtgtgttctattcatttagatttacactatgttcatgaaaactactatgtaataattggctgtagcttttttgagtaaaggccgggatattatattccattatctaaaaataaattaaactgatgctttccagcctggacaatttattgtgtgaatatatactgcattgcatctcatatttacttgttttgggggtgggtcttctaaaccaaatgactttggtgagataagtcttgaaagtgagtttatcttatactacaccgagagggagttgtccgtccgatactgcatcatatacacaccgagatatcctcgaaaaaccagaaaaaaaacctaagtaaaaaaaatgttcaaagggcgtgaaggtagtgggtgctgttatatgttggatagctatgccacaattttcatccgtgtcttttttatagtacttctatttacatatatgaggtgcaacatgttggctccggtgttgggcacattgcaaagatgtgacgaagatgaagaggtcctaaaagttgcatgccacaagtttgagtcgacggcttatgcagctttttgccaattatgggtgaagattcataaatagacttcaataatgtattctctttatcttttattggttcgtttttatctttccgtgatgtttgctgtcttagttggactacactcgatgtggagtgctagattataataatgggttgtagctctcttgagtaaaggtcgggatgtttattccattatctaaaaaaaacatacatgaggtatatatatggtgctgtagacaggaggctccttattggagtagttcagggtaatttgatttttttaacttattactatttcttttcgaccgaaagcggtccatcaggctaccagcttcaccagcaagtttttaaaaaatagcatggaaaattagagttaaataagaaaaaatattcagtagggaaaatcatactccatatcaagtatgtcctattagagcaaatagaatttaggtgctcagcgtgtggtcataatgtcatattgtaatttagttctctttgaaatattttcaaatttgattgatattcctcaaaattggacttctctgctgacttttagatgggctgaaatttggcagattgacgggctagaatcacgcgcgcttatggactgaatttgatgagacaaatgggctgaaattccctacaactacgcagatcaacgggccggaatcccacgcaactgtaggccatatttactacattctgggcctttggtaggctcagttccattgcttttagagaaaattcgattcatggcacacaaaaagaaaaaccggaacaaaataatagcacaaaaattttccccttttagctcaaagcacatgcctctgattttccttcgatttgtagcactcccgtcaccttcttctattccatctttccccttctctttgtcccgtcgatctcgccaccacgtcggtggccagccatggtgtggcacggctgagcgcctctgacggggatggcggctgcgcgtggcgagttcgtggggatggcggttcggtggtggaacgtgaacccaggggcgacggtggtggcaacgaaacgcgagatcgggggtgaccatggtggcgcctggacacgaacccaggggcgacgatggcggcagaggaacacgagcttgaagacgactgcggcaacaataggacacgagcttgggcatggctgtttagtggtggaatgcgatggcggcggcaataggacgcgagcatggagacggcgccgaacgagctcggggtggggatggcaacggcagagcttggggatggtagtgacgacggcgccggacaagcttagggattgggactgtggtggcgggatgcgagggccatcgctatcaaccaccccaccgccgccaccaaggcctgcgcctcctccggccacctcatccacccatactttggttagaaaaaagggtaaattcgtcttttcacgctcctaatcatcgctaaccaatggacttggacgataaatgtgacagaagtgctataaatcgaagaaaaaatagtggcgtgtgcttatggttgaaagaggaattttttttgctattttttggtaccagttttttcatgtgctatggatcgaattttctcttgctttttaggcctgcaattggagaggaagagggggactggggtgaaaatggtgagggagcttcctaaccgtttccggtatcttttttattatagtcactagggttaggagaggtgattgtggtctctcttgtggcctgatcttctggtgaggggataactctcattttgattggctgtgatgtttgcgacgtggctaccaactagaacaagttcagaacgctgtgcaatcgcaacaccacaaacgatattgtaccaaccgtgatgtgcggttgatgttccctgcaatgtaaacgagagaacacttcaagaacaagataagatgcaatccaaatatttcgaataggtaattaagtataaaagaatagttgtgattgaaatggtagatctaatcgacctagcaaatcaatgcataaactattgggtgactctgaatctctatctctagatgccgactaatcgagcaaggattaaatattaggtgaatggcacttggtaaaattcaacaaaacaaaacccaattgttttttagggtgtacgaagctttttatagaggaaaataaagctagagataggtgttggttcgtagaggtggagagaggcacttccgagatggccctagtctattacaaagcacaagggctaagttcggtttcagcaacaacattgttgtgttttgacgattcccaatttcctattgactcgagatgaattttgatattagactggatacgtttgaaaggtgatgagataagatctccaacaaatccaacatcatccaaattagagttggcatgaagacgctagatccatttgaaatcaatgctactgacttgaacttagtcattggaacttgtgaagttacatgcggattcgatgaaggatgtcgtcatcatctcaattattttttgcatttgaataattcatcaatggtatggattatatctttctccataaaaccacaccatgcactccaatcatttataccatttacataattgatcaatgtataatatatagaaagcccataaaacaaaatcaacccatattacaagatacagaaaagcacgtgaaaaaaaatcgtacattaagcaagaaaaatttatttcctctgttcactcactatgaccacacgtattttaaaattcaactgaccaataaatattttattataaattaaattttatttcatgtaaaataatattattggattatcatttaaatttatttttatattattgtaattctattgctacataatgtagtatactagaaaacatgcccgtgcattataaagggtgaaggctattttagttgggttattgttagatttttttctaaaaaatatatatgaattttattttgagatattatttatatccaattcggatccctagttgggatgatggccataacctatatattgttttcttatagcttggtagaaattttaaagcaattaggagtctgactctcatcctaggtgagtatgtgagttttttttaaaatatttttttatataacttcttatgtattttcaaaagcgaacgaatttagaatccgactcaaatacggacgacataccaaaatatcaacggaaacatcctcaatttttataatagtagaaaagagattatataagaaatttaaagttaagaattagttttaaaagactatgcccatgtgaacgcacctagagaaaatattattctatcgtacaattatctcgcagctaatacatgagtacttatctactctctccgtcctataaaaaaataacttcttaggatgaatctggccaagcatttatctagattcaagttattatttttctagacgtaggttatagattttttaatagcatgaaccacttaaccataaatccgaatcatcaagaacacattttgactacgaatgccacacctatctctaggggtgaaagtggttcggataatttccgtccgtccggaccatttttcggattcggatagtttcggtcggaactatccagaaattctcggattcggaaacgaattcggattttttttctcggaaacgaaaacgaatacagtaagggtactatccgtcggaatcggaaaacggtcggaaactatccggattttttttcggatatccgcaaacattgagcaaagtttagaaaaaatatgtatatatacgtaactttttcatacggaatcagatggcgacaaactttatatcaacattgtagagctcgatgagatctacaactttcttattgactattttattatttgaggtcatttaaggagtctaaatattcattataatataccatattaatttttacaaaatcttagatctacaattcaaacgacatctgatggagaatcaaagttgtagagctcaacgagatctaacactttgtagtttataacatttgtatttgaaagcatttaaagtataaaacaaacattacaagtttcgaagatgtgaagtaaaataaataacatctctaatttatacaatagtaagtaagttatacatctagtaaaaaggtcgtgagaatagaaaatggtaatcatatttgcatatggatctctaagaggaatagccataaaaattgattttcaca

SEQ ID NO: 58914 - DNA, 1256 bp, Oryza sativa
aagagaagctaaagctatagcggcacaagcaagtgaagatagtagaagggaaagcgaaaaaggatgtcaccaaatttcttgcaagatgagttattccccgaagttcaaattcttgaggggattctagtctccgttgaggagctcacaaagagcctggactttgattactctttcctcaagaggttgcacaaagcattcatcctttcactattggaatctcttccctttcggaggtgagacccaaccttcacaaacttcttccgaccaaccacacttatatcggtggctcaagacctagtagtctaggagtcctcaatctccaagagtaaaagattaagcaagaatgtcttagggatgaaacaagtgctcaacaaatcttcacaaagtcgaccacaagcactcacacgaactcaaatccacaactctctgacacacaaagtccgagctcggtggagaggagaaatgagggagcaaggctcaaagtggatcttaaatacaaagcaagctaagggcaaagtattcaatagcaccagcaaccttgccttgtggaatgaggagcgtatttatagcaacaccctcagaaatgccattggtgggtaaagataccctttttcggaaatttccaaaccaagttcagaaacttctgaaaatcaccactaccgaaatccaacgtgaaaagaacattctggatatttccgaagcaccttcggaaaaatccgaaatcactagtactgatatgtgcttcaactcatagcttcggaaatttccgaaaaacaccagtaccgaaatcaacaggttcaacacagttcgaaattttccgaaactctccgaaaaagaccagtatagatttttgcaagttcacagcacttcggaaatttccgaaacagctttcgaaaaaatccaaaaaacaacaataccatttttcaaaagcaaatacactttggaaaactccaaaaaacaccggtacacaaatctaaggaagaagccaacttcagcaaatattactttagcacttttctcattcctagatatcaatacaacatcccctttatagtacggctttcctattgaccgagtaaatgaagatttacaatttaccaatagtttcattattactttccatcaaaagtccatacaaaatgatgtcgcatcgaacatcatctcatgacggactaatgtccttcacacattctcaatagtaagcattagtccttgctaatcagatcgtcattaaccaccaaaacaattagggccta
